United States Patent 10,900,036 (RNA INTERACTOME OF POLYCOMB REPRESSIVE COMPLEX 1 (PRC1)) - sequence listing, part 9

SEQ ID NO: 17636 - DNA, 1221 bp, Mus musculus
aagaatgtaaagagaaatgctcaagggttgaaggataggaaaaaaaaatctcattatcatcaggtagattgaggaggagagtacgttgtctgatgaagtagttaattccaaaggcatcatatgaaattattataatgttatactcagatgagaatgttaatgaagaatgtttttataagagtgagtacagtataactatattgcattttatgggtacaaggtaaggatgggatgatattacaaacaaaaccaaaaaagagaaaacccttaattttatagaaaagtaaacaaacaaaagggcagatcattactcagagttcagtttctgcagacatactcaaagcagacataaattcatgagcatttcatgaacatactggggacatgcacaaatatactctgaaaaaacttgcgaattattgcaataaagtaatagttaactacttttttaatgtagttacattttagccattaaaatgtttaaatagtcataaacagactatttttaataaaaaaaaatcactattttttaattttgatcaattttagatttcctttcctggatgaaaatgttgtgtctttcctaaattctctgccagtttgggaaaaggtagacctcactctgccccgtggagttggtgagaagcttattttacgccttgcagctatggaacttggtctcccagcctctgcccttctgccaaaacgagccatacaatttggatctagaattgcaaaactggaaaaatctaatgagaaggcatctgataagtgtggaaggctccaaatcctaccttagaaaacctctctcaaaattacatcataataagattattctatcctgtactttgtgacagttacctcaaaataaacagctgctgccttactgtggggtgtagtagtttcacatttcattgtgttaatttttacctttctcatcaaagctccatttgaacagacaggggtttcatagatggtctcagcattgagatcatttgaagaaaggccagaatgtacagggttacatttggcctttttagaagcttcacctgagaagtggggtgaagagggctggagatgcagcattatccagctcttcgaagacttgatgagttccagtttgcaaatcaggaaagggcttttaggaccaaattgcacagagggcatgcaaggtcatttgcccaccctgtgcatttcttctatctggtggttcttgtgtta

SEQ ID NO: 17637 - DNA, 2634 bp, Mus musculus
tcatgtatattttaagagcttaacagaaatatgaaaaatcattatacagtgactttcagggataatactttgaacatctaaggcagcagttctcaatctgtgggtcagtaccctcttaggggtcacatatcagatatcctgcatgtcagatatttatattacaattcataacagtagtaaaattgcagttatgaagtagcaatgaaataattttttggttggggtcaccacaacaagaggaactgtattaaagggtcgtagcattaggaaggttgagaactactgctctaatgtcttgaagtatttaaaaattatatatctaaggtgtttagccaagtgattggacaaagtatgtattcagtggaaagaaaatattaccaaaatatcagcattgtttgtcactaaagcattgtgaattattgctggcatttgcacagtgaatctcatatggtttattcttgagaagtagcctgttttgtccatgaaatagtaggtaaatatttttgaactttcacttcaatattttttctcacttcctcctaacagatacattagacgaactaaaaaaagaataccaagcattagaaacctccgagacaaccaaagtcaagacacagtcaacctgacttcacataaccatgtgtggcatttgctgttctgtaagcttctctattgaacacttcagtaaagagttaaaagaggatttgctgcataatcttagacggcggggccccaacagcagcaggcagttgttaaaatctgctgttaactatcagtgtttattttctggtcatgttcttcatttaagaggtgttttgactatccaacctgtagaagatgaacatggcaatgtgttcttatggaatggagaagtttttaatggagtaaaggttgaagcagaagataatgacacccaggttatgttcaatagcctttctgcctgtaagaatgagtctgaaattttgctgctcttctctaaagtgcaaggtccatggtcgtttatctattatcaggcctctagccatcacttatggtttggtagggacttttttggtcggcgtagcttgctttggcagtttagtaatctgggcaagagtttctgcctttcgtcagttggtacccaggtatatggagttgcagaccagtggcaagaagttccagcatctggaattttccagattgatctcaattctgctgctgtttccagatctgtgatcttaaaattatatccttggagatacatttctaaggaggatattgccgaagaatgtggtaatgacctgactcagactccagcaggattgccagagtttgtatcagtggtaataaatgaagccaacctgtacctctcaaaacctgtcgttcccttaaataagaagctgcctgagagtccattggaaatccaatgtagaaacagttctagcacttcaggtacaagagagacacttgaggtatttcttacagatgaacacacaaaaaaaatagttcagcagttcattgccatcctcaatgtttcagtcaagagacgcatcttatgtttagctagggaagaaaacctggcatcaaaggaagttttaaaaacttgcagttcgaaagcaaacattgcgatcctgttttctggaggtgttgattctatggtgattgcagcccttgctgatcgtcatattcctttagatgagccaattgatcttctgaatgtggcttttgtgcctaaacaaaaaacagggctacctattcctaacatagaaagaaaacagcagaaccaccatgagatcccttctgaagagtcctctcagagtcctgctgcagatgaggggccaggtgaggctgaggtaccagaccgagtcacaggaaaagcaggactaaaggaactacagtctgtcaacccttctcgaacttggaattttgtggaaataaatgtttctcttgaagaactacaaaaactaagaagagctcgaatatgtcacttagttcagccattggacacagttctggatgatagcattggctgtgctgtgtggtttgcttctagaggaatcggttggttggtgacccaagatgctgtgagatcttacaagagcagtgcaaaggtatgatccaggactgttgctcagaattcatgagacctaattttgactgaagctttcatcatttaaggtttatgaatatacagtactatagttacactttctagtacagtgtatttgtttattttactgttttctaactcacagttttcctcctaaaatgttaggactacaactctttagcctgcatgagaaaaacacaacttgttttctttatcctcttgtcgtgtctctggctttctttactcttctgtaggtgattcttactgggattggtgcagatgagcagttggcaggttattcccgtcatcgtgcccgctttcagtctcttggcctagaaggactgaacgaggaaatagcaatggaattgggtcgcatttcttctagaaaccttggtcgtgatgacagagttattggtgatcatggaaaggaagcaaggtaactcattactgaatactttttaagaaaaatacaaaggaggttttacattccttttcccttggagattggtcccatgcaaagcaggagagcaagcacactgtctctt

SEQ ID NO: 17638 - DNA, 1416 bp, Mus musculus
gattcgatgactccttgcccagcccccatgaacttgttccagatttgttctgttagcatttttctctgtgactcatctggactgactcggaaatttgaaatctctggtgtgagattgtgtttgtagcttcatatattatgtttatattataaatgcacttctgcttagaagaacttaaggaacagtttaaatgctaggcttctgttggctagcatatcatttcttgtcctgaaattgttttgcagaggaaaatatttaagtatatgacaaaaaatgtaaattgtgtttaagagaacacatgcaactgaaagaactcaagttcagtcagacttataaaatgggttatattatggttagtaaaagttgaaaaaaaatgaaaacaggaatttagtaggttctaaggtaagccctataccataactctattacagagaatctgtttggggaaatgctgtcaagggtaaaccacaacatatactgctttataaatactccagagagagtttatagttgaaagtatttcccagttaccaataatagcttgaaactgtaagattttctttgtgtgccatgtgctcggtgagaggacacagtcaaccagagcagggttgatccaggctgtttctctgcaaaccgagtcaaaactcgacatcatttccagctcatgtattttgtacgtgcatcatatatcagatctaataagatctggaagatggatatgcaaataagaggcctttgtcttctagaatgattagagtagaggagaattggatagtacagaatatgctctagtttcagtcagacatattcataaagggaaatgttaagttctggcagctgacttagtgttggatgtctcctaagtctcaggatagaagcccatcattagagcataggcacttcaggaattcttgtgtgaaattctagtgagtgaggaggtgtgacatgcagctatctttgggctccttttgtgtgtgttctgctggacacaacacatgggagtgttcagtgttgtccgtggtcaatatctatgttcagtcctgatgggaggggcctagggactgctttggagatttcccactggtgtccattttaaggtctgtaataatgtcatgttaagataacagatctcataaatatgctactctatcagactccgttgccaaaacaaattaaaagcctgtgtattgaagtgggtgttagtctaacaacctgtaaattcttgaaattgttactaaaattccaaattctttagataactttaaactatttaaattgagcattgctgtctttgtttgattaaaggttgagttcctttatatctgttatttttaaaggaaaagttgtttgccttttgtatatgtgtgtgcatatgtgtatgtgtacaggtatatgtatatatgtattgatagataa

SEQ ID NO: 17639 - DNA, 1189 bp, Mus musculus
cacttgagtcttgcttgccagttttaaaggctttttgtcttttgagacagggtctcactttatagacttagctggctttgaactcaagagatctgcctggctctgccttccaagttctgaaattaaaggcccgcactatcagctcaattttgattatttgtctacttatatggcactgttggggactgaacctatgccttgtgcatgcaagttggtactctgccaaaagagctatatatgcaactacacatagtttatattatctataccagactattttgaaaaggatgtgtttttgaactgagttcaagacagagaaatattctttttaattatcttgtgcatgtaaatgaaccccttttttgaatttatatttatacatgatatattttgattgatcactttgctttttccaactagtgcaaaagaggatgtactttaagcattgagaaattttaattgtaaaatggtagttgtttttttaaccctttaagaattagattccagtttacattgtaacagttactgaacaaacattatttcagaggtgttattagtaaagggtacggtaatttattttacaacagaaatccaattttccatctgatgagtgatgagcccgccattatttccggttttcaacatcttctcaccctacttcacaattacaggatctatttctttttctgaaggtgggtggggatggcatcaggccttactgtcttggcccagtgtcaggctgaggttccttgcctgggacgtaaccccgctgtaatctatactctagtggttggactagagtcagttggcttcccattgtaattttcagggaattaaattactggattttgcttgctgttcagtgtttaaaaacaaacataacagtacagtgctgtgagtagagtacatagaacatagaaatcgtctgtcaacactaatgctgtcttccagtccctggccaactaaaacacatccttgaacgaacagaaagttcttatttcttctagatgctagataagtaaaccttcagtttatctgtttcctagacacagctcagtcttgttggtgcccatgtggtatagagaagttgcttggctgccatagtcattcacatttacttcatgaaggtctatggataggacaagtatgtggctttcaggatgttcttagctaacataagcatttacat

SEQ ID NO: 17640 - DNA, 1172 bp, Mus musculus
tttccattaaagtccaaattactcattttatagtataatcatattctttgcccaaagatgctcatttctgggaactcagtctgttgtttatttttacatgttacttttgggcataaactcaaatgtttatgcctcctagttcacctccattacaattacgattttatatttaaataagagtcttaaaaatatgtagaaatgacaatatgtcttttttttttaagcctggtcagattgacaaagaagttgtgcaagcagtgggtgtctagtgagatcagtttctacggttgagcgttgagagcacacactcctcatggctgctgagggagactgtgtacagagatcatttatttgtatgctaatggttatattcttatccataaaatgtagtgtagtaacaatgcgtcatgaagggagcctgtcctgacgtgagcagtgagaacggtctcggtgcagatctccctgtctcaacatgcatgcttgtcccagtgctgtgtgccatgtgcagtgcactaatacacctctgtgtacttttctgtgtatttttggtatggtataattaactggttatgttacatttaactggttgtgattcgggggggaaagtgctacttattctaatttgtagcgtgtcatgaatggttttacctgtgtttcagcattgtgatgtggttttattatgtgaatatttgccttcagtctccgctcaggtattaacgtgtagcgatttttggtgctttgtttttaatttgtcataactggtgttctgaatgttcaaaataaatttggtgaataagcacatttggtacaaagattgtttactggttttcatactctgcaatgctgtctcagaaaagaaagtgttacatgcgtcttctttacctggcccttcagtgaaagcagtgtgtgaacacagagcaccctaggcaccaggaaaagctgacattcacagcttgacatgttgtagtttccccatccatctctgtggacaccacatggttcatagtctgttttcaggactcttgcggagactgactttctcttttttcatgtgctaactggatatcatcctaggtgatcaggttctagcacagaaagaatgaaaagcaatttagggattgtatgcaaatgtataggttactttgcagttaatcagagtagtggcttttggg

SEQ ID NO: 17641 - DNA, 1099 bp, Mus musculus
aatctgaccgtggcttgttttgtggtgtaaaaaaaaaaaaaaaatcagttgttttgcacaatccatttttggtgtagatgtctggttactacagttgaaaccttccctgtggtgtttcttttgctttctttatgtctctgctcagtccccagtgttcatccactagaacctaatatagtataaggcaaaccagttagcatgcatatcttgtgccaaatactctgaaatacagttgttaatgaaaaaccctggcattggtacggtgttagataaacctagaactatagccacagagcagtcacgagaatgctagttcctcctcagaggagcggcatgggaattgcagtgttcctttagtttgcttagcatctactgcttctttgccctacagtactgtgatgttggtacatttttcataagttagcctcacaattaaagagacagcacagaaaaccagatattgaaatattcggtcttgatcgagtaatgattatctaagtaactgttggggactgtggataaattagcaggagggtagtttatgagagctggcttcaggacgctctgtcctctggaaggagtttgtcttctgtgtgcagtgatcttagcttaggcgggagatgcctgtcccttaacataagcaggctctgtgcttatgaaggcagaggtttgtgcagatctccgtcccctgctgtgtggttgggaaagaaatcttcatttttattgtgtataaattaggaagttgtgctgcatactttttttgaatatttttttgaaaataggcactgacgtgtatccttttcaagtgatgctgtggttttttaaacgtaggaggaactataaacgtagcaacatgcccaagataaaccaaaactgagtataccccatcactgtgaccttgaacttatttgggataaaacagactgtgccttaaaatgacaaagcaatgccctgcagtcttgtaactgtattttactgtgggtggtcttctagaggttgtctgaaacccctttctttcaagttgtcgagataaaagttttaagtaccaatggacccacatttactttagtatcccttagctgctgttcctgaggccgcc

SEQ ID NO: 17642 - DNA, 1219 bp, Mus musculus
tggtgaaagattttatgtcaaaaaaatgaggtggaaagtgattgaggaaaacacccagcattgacctctccctgcaccttcatatatacacatgggtgcacatacgtgaacatgtaaacacacacacacacacacaaatactcaagaggtggggatccacaaatatgaagtaaaccagagcagttgattccataactgtggaatgagtctggtgcctcctgtctccccttagacaggtctgaattaccttgcttgatttggtttgatgcaaacttttagaatgctgtatttaagcatataagaagtggttctaaaaaatcatttggaaaaaaatccaaaagtatgttgatgtgttggatagctaggtttttgttgattgtttttcatctgtgtggaagatttgtgagtttgtatatcataggaaacaagagactataaagtttatttagggtcacggtccatttggggagtgtgtcacttgccagaataaagggaaccatgggagtttctgggtttaagacattacttccttccgggaaatcttctttaccagataaagtaaatgtagaactcaccctacaaactgtaaggttgacagctagaattttactgcagactttttgaacaagaaacataattctgtgaatatctactctttcaccataaggcttgctgatatgtgaggaaacgagaaagctctgggctgttcacactcctaacttttcagagtgttatggaaaatgggagtcaggtcagcagtccgaatgtgtgctataaatgcttaaacttctgcaattgtaaaacataccacgaataaataaaaaacagaattttatatgttggtaacttggttttgagaacagagtaagatttggaaatgctgatgctaggcatgttgttactctgttaataccataaatgtagtagtgcagctaaggtgaccatgttcgaagttggcactatctaacctacagcttgattaacgtgtgcgaataataattttaaaatcgagaacagtttttattttcagtgcttgttatgtaatgctgccaaaaaacgtccttatactacgaagccagttaatttctgatgacttgatgtagagttggtatctcgagtcagactcaacctgtaagcattctgtcattgttgacttgaacatcagtgggaaatgctatctattggtgtttagttaccgtaaactctgcatatctgaatt

SEQ ID NO: 17643 - DNA, 1197 bp, Mus musculus
caatggcattttcatgaactttcaaatatgaatcttacagtgtatacttggtgaatattagaagcatggaagagatctatcaaaagatctattaagaaaagaatgttcttgcagattctgcattggcacagtcagcctccgcccctgacttaaatccttgccccagtggttgccagaagtgcctgtagcaatgataggttgttaaagggataactccagaggccagaacaactctgggtttgcatcatttgtttgtctactgaggaggaagggtctcagcataaatacaacattgtacttgatgtacaaagctatatactaatagagaaacaatggacagcctttactgaaaatgtgaacactgcctgaatagattgcacacctgtatcactcattaagagcaaaatcttggtttgtagaggtgtctcctaagactacaattttgccactggggggagcgggggtaacattttatttcatttccaattatagttcatccttagctatagaaaaataggaaggtcaggagcttgaagaatatagttgttctttgccttcagttagaataaattcaagctgagtcagacctgtgtcgtcaaacccttcacttagatgtgtgtcctataaatgcccataagcctttcccgtgaagtcctccagtgttacggaattcacagttgcacttgtgaacttatgtccttctcagtgcccaggaatggtactaagagaatcagctttgttttatcggctgttacacacggtgtcacagcctctcagctgctactgccaaccagagggttctgcccacgtcagccatgttagttcttccctggacctttgcttcttcagagctaatcaaagggtcaggttattaccacagaagttagttggtttgtatgattctgtcactgtctgactggcatcgtgcttgttaaatattcatattttcacttattaagacttttaaaggaaagccatcgtactagacatggcagaccctttagtcccttgtttcagaagagtgtcaaaaggaataaactgtaccatagtgtttgttgagtacccaagagtgagttcattggataattacaattttctcatggcacaacacttacatatctaagtaggaatgtatctgctctaactttgctggagatgtgtggcctctctacacatgctgtctttcattctgtcagt

SEQ ID NO: 17644 - DNA, 1196 bp, Mus musculus
ttgcacttgttgatgagcccatccctttgtggtcttgtaacatgacgttagagtgcctttttatatttgtatatcctggaagtgttctgtgaagcattttgtattttttcatttgagtgttattggagcaatatgatcctagtgagtttccctttctttgaatgtaccaagtgtctcctttcctagtcctctcctcctttgctttgaaatgaaaatgctcacgttttctagaggaactatgtttgactttgcagtactaaaatgctttcttcttacagaactgtaaaccataggtcagtattataggggaacagcgttttaagatagtgacaatctgagcgtgtttgtagaatgtcatcctgtgtgtttcctacatggtgatctgaagactcaatgcaagtatcctttgttcagtagctttgtctacagacgatgcttcagcatgtgcaatatatccttgcaaagcacggtgatacacatcttgtgccagtgttacattttgtaaaacatatgtgtaacagcataaactattatgtgatgatttcagtgggagttttgtctgtacttttaagatgtagacattggaattgaatgactttgataaatgttctgagtgtaaaaatgaggaaaaatggctttcggctcagtgaaggacttggggccggtgtgaatcttctcaagcacagtttaatactttcctaactactgaatgctctaataatgcaatgaagtacttacctgtaatatacagtggacatgcattcagatggttattttttacaaataaaaacggtacaaatattgttgcaatgtgtgttttctttcatttttcaaatgtatgctttttccaaattattttaatttaaacctttgccctacctcaacaccaaaccaaattaattctaaaaataatcaagaaagcaacctctagatttgttgattatactcaaattgtcacattggagtgggaaagattcatttactatgcctccaacgtttttcataaagaagttaagctgagttaaaatggaattcatgtgagaagccagaagccgaaagtccatgcaatcctaaggaccatcaagcttcacacagtagctgtgattgaacttgaagttgctctaaacttccttgtggtgagagggctgtgtaataagtcacatctatcaaacaggagggggtcacatagatcctca

SEQ ID NO: 17645 - DNA, 1212 bp, Mus musculus
gttaaaagcaaagaacttatagcaagcaaaggggaagaaatgattcatgctaccactttgactacagaaaataatgtaggtggtggaggaatgttaatctcaagatgcaaatgagagaaaaagaaactgatattttacaagaatgggctttttaaagaacaagacaaatgagagtagtgagcttgtaatttatctgggtatctgttagggcagattactagttctttagaaaatagaatgcatttttaattccactcatgagcagcctggagagatggctcagcagttgagagcactgactgttcttccagaggacccaggttctatttccagaatgcacatggcagctcacagctgtctgaactccactcccacaggcatctgatactctcttctgctttccgctggtaccaggggcatacatggtgcacagccacacatgcagacaaaatacttaaatacataaaatataaaataaaattaaatacactctatgtgggctaaatcatttagtctctacccaaggaattcagaatgatcactttgccacattcctacattcgttaacgttttctcggcctgattttcccgtgttgacttccccgaaaccttggaatatagattctatagcctctagcccggcttcccgtgcttctggatcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacattgtaccttcttctcctttacagatacat

SEQ ID NO: 17646 - DNA, 1210 bp, Mus musculus
gatttctcaaaatgctttatgagcagacatgaaggatatattttacttcttgtccaactttggcctgtgcttataaagtggagaagctgtctgtaacttagaatagtgtatttcctgttgggagtgaggctatctaagaaataattatatagtaggacagtctttgggcttttgtgtgatgcctctaatcagtttatttataagcagctattgaacacctgttgaatgctagccactgtctgttgaagaaggggcttcgaaggtgcacatgatccggcctttcatgtaacggaagggtgggcgcagatccttaggtaccagggtgctgtgcaatggaagatgcagagatgcctagatttgcttagcttgtatgtagcagtcagatactgtattggcttaagtgtgagcataagccaaaatgccgttcagtttatgaagaacaagcattaaggggctattttaatgttttgggtcaactaatgaatcagcttttttttgttgttgtttattgttttttaattttatgccccaaatttcttgtttttaaaacttttctagccatcactgttttgtctccctctgtacttgtgtggactctaaaaggaaataaattctgccatcagtgtgactggcatgtgactctaccaccctcagactgtcaggagtgctaggcagcttgtgcttctgactgttaacaaggaagactctggtggaagatcagattagattagagacagcttctgctctgctttctcagaatggatactgagcattaaccgtccccatgcaggacgcacggattcttgttctttgtatgtggtctgactatcattgtgtagtaaaccatttccctgttcttagaaaattcctagccatacctaagcacttttaaatgttttgtatagttgatttcaaataacccttggtaattacaatcttgaattgagtatatttctcaaagttaaaatttgactttaaaccacttgggaacattttattgtattattaattaaaatacttaagtttgtttaacttcttgctttttatttaaaaattaaattttgcagtagaactacagctcacaggagactgcttaccccttaagtgacattttcctgatggaggtaatctgagaatggataaggggaaaaaatgctgaaggctgcaatctcaagattaggaccaaaatagatactcaaagatgtttgga

SEQ ID NO: 17647 - DNA, 1857 bp, Mus musculus
taaaaatactgtgctttagagattgttttcaattctaaagaaatttttagaaagtgtgcaagttgaggtagtaacttgaaaattactaaaaagaatacttcttcagctgtgaaacattgaaactttatcattaaataagttagatagcaaattatagtgttcagatttttttcctaatgcctttgaggggttgttaatattttggcagaaagtatgaacactattttggttgcactcagtatatgaataatagattgatatgtcctggatacaaattcagatgctgctagagataaaaattcttatttgtgcaggtttaaaaacctagtagatttttctcttaaattgaatttttgaatgaaatcataccagtttgagaacaaatttcattttgacttgtgacttaactatcaaatatttaaggttacagaatttaaaatgagattgactcctgagagtaattagttccgcatgtacaagtgaatataaaaatgggactgatttaaagagacttttcccttccattattacagggaccttgttcacagacagacagcgagtgcagtggtgcagcacatgtcacttggtgtttacggatttggctgtgaggattctctgaatcacttactgaactatgtgtggcctaatgtgtttgagacatctccccatgtaatccaggcagttatgggagctctggagggcctgagggttgctattggaccatgcagaatgttgcagtattgcttacaggtaggttaaatgtgggtttttactttttttttattaaatgcggggattgctcaaaaaattacttaaatatgttgaagtcagtcattccctaattaccatgtggaagacagttctgtattgagatacagattagattaaattaggttagattttgtatttacccaccacaattttgttactcagtttccagactttttttccttccctcttcaaagtaagtacttttgttttattttattttttgagccttggctggcctggaacttactatgtagaccaggccagcattgaagtagatagatccacttgcttctgtttctaagtgctaggatttaaatgtgtgtgccaccatgcatcatatttatagctaatagtgtattaaagtttgtttatttatttattttccccttgaagatagaagtaactctaccttttatttattctagggtctgttccacccagctcggaaagtcagagacgtatattggaaaatttacaactccatctacattggctcccaggatgctctcatagcacattacccacgaatctacaatgacgataagaacacctatattcgttacgaacttgactatatcttgtaactttgtgtctaatacagctgtttcacaccttaaacctgcttcaatctgatgatataaacttgtaaaacattgccgatcagtgtagagctggtcatagtggagggatagaaatccagtagcatgatttttaaataacttttgtttttttgatgttaaacagtaaatggcagtagtgaccaaggacagtgcttatacacactatactggagggatatcattttttattcatctttatgaagatttagaattcattccttgtgtttaaagggaatgtttaattgagaaataaacattcgtgtacaaaatgctaatttgtgtgtgttttttgaatatgacttgtaaaatgcaaaactttggtaaagtactggtttgtgtagaataagtggattaatttcatcttttgtcacctagtttattatggaacacagcagcacgcaaactatatagtgatggcctgtttgtcaaaagcccattgttttgttggtaatgaagagtagcttgg

SEQ ID NO: 17648 - DNA, 1163 bp, Mus musculus
attccagtcattgtccccgtagttcctcatcccactcctctttccccttgcctctaagacggtgctctcctcctgccccctaaataggcatcccccttgcctggagcctcaagtctcttgaggattaggcccatcttctcaccgagggcagacctctgctatatacgtgccaagtggggcctccgaccagctagtgtatgctgtctggttggtggctcagtctcttgtagctcccagggattgagactgctggtcttcctatggggtcgccctcccctgaagcttttttttttttaaaccttttttcctctttagccttttttatttttggaagttgtaatgacatcctttagtgataagaaagtagtgtgttttatccattcgcttgcaggttttgtagtctctgagagcaaatttcctaagtatgataacatgctgatgtgtttcttctttctttttagccctcatgatgtattggctacacttttaaacaacctcaaagttcaggaaaggcagaacagggtttgtacgactgtagccatagccattgttgctgaaacatgctcccccttcacagtactgcctgccttaatgaatgaatacagagttcctgaacttaatgtgcaaaatggagtgttaaaatcactctccttcttgtttgagtatatcggcgaaatggggaaagactacatctatgctgtgacgcctttacttgaggatgcgttaatggacaggcaagtgactaaaggaaatgcagaaaaattatggacaattatgcgtcagtgtagagtttactaagattactttaaatgttgtattgttaaagaagaaatattactgtgattatttcacataagtataatttcttaccttatatttgttatagttaggtacccaggttttctctcccaggttccctattcttgttaatcttttcgtatgtgttaagctaagtagattttgaaatacaataatggatttactgttttttaaaacaattagggaaaaaaaggtgaacatgaattagtatggcagagaagccaatagttttgtttttgagacagggtctcaggtcacccagggtggctttgaacttactatgtagctgaacatgaccttagacttcatttctcatccctctacctccagagtttcaggactgt

SEQ ID NO: 17649 - DNA, 1194 bp, Mus musculus
tgaggattaatggtactaacttaagtggctgttgtcacttttctctttaggctgctggtctggctactatgatttctaccatgagacctgatatagataacatggatgaatatgtccgaaacacaacagctagagcttttgctgtcgtagcctctgccctgggcatcccttctttattgcctttcttaaaagctgtgtgcaaaagcaagaagtcttggcaagcgaggcacactggtattaagattgtacaacagatagccattctcatgggctgtgctatcttgccacatctcagaagtttggttgaaatcattgaacatggtaagtggtgtatcttttatagatcagctgtcctgatggggagaggtgtatgtgtaattaaatgaaagacttctcacgcaaattttgaaatggggtttgtaatattttctgttaacaaattaccattgcctaaattttatgtactataaaaaaattattgcagtttggatacatggttagatacattgctaaaatttggattgtattatgaaaattaggtgtgggtacctactcataaccatgtctgattgtataggtctcgtggatgagcagcagaaagttcggaccatcagtgctctggccattgctgctttggctgaggcagcaactccttatggtattgagtcttttgattctgtgctcaagcccctatggaagggtatccgccaacacagaggaaaggtgaatcgctcattagatcagtttttgttgctagtaagataaccgaaacttaatttactaacgtatatatttttaaatagggtctggctgctttcttgaaggctattgggtatcttattcctcttatggatgcagaatatgccaactactatactagagaagtgatgttaatcctcattcgagaatttcagtctcctgatgaagaaatgaagaaaattgttttgaaggtaagtaattagttgctcagtttgtgggtatgtgcatgttttaggaagttcagagagatctttataacattaaaaacaaatcaaacctatttttgtactgtaaaagttattacagcttggatacatggttagatacattgctaaaatttggattgcattacgaaaattaggtattggtacctactcataactgtgttggattgttttgtgttttgccagtgctgcatttgatatatatatttct

SEQ ID NO: 17650 - DNA, 1153 bp, Mus musculus
tatactccttttgaacttaatcgaattgcatgtaggggaagcagcattttaagagtgttaatagtgtggttttactgatcctttgtctttcaagatactcctgggcatggaagtggatgggctgagactcctcgaacagatcgaggtggagactctattggtgaaacaccaactcctggagcaagtaaaagaaagtctcgttgggatgaaacgccggcgagtcaaatgggtggaagcactcctgttctgactccaggaaaaacaccaattggcacaccagccatgaacatggctaccccgactccaggtacaaatttttttcatcattctttctcttacagctattttaattttttttgctgtttttttttttttttttctgggttccactaatgctagcttttctattaagaatgtaaatataaatatataactgccttgatttgcatttgcaatgtaaaaacaactctgatacggactgatgttaactattttgtatctgaagggcctaagtcttacactgttggtcattaacaattttgcttttttggtaggtcacataatgagcatgacacctgaacagcttcaggcgtggcggtgggagagagaaattgatgaacgaaaccgcccactttctgatgaagaattagatgctatgttcccagaaggatataaggtactagcagtgaatatatgatgactatgttgtattgaggatatgagttttaaatatttagttaaaaaagttgcctggtaaattagcattggcctttctgaaatttactaatttcatatttttaggtattagtaagtgcatttcagtttgaaaaagtaatagagatgaaataagtaacatggagcttttattactttggcaatcctaatgattggtgggagtcagaagtaggcggatctcttgagtttgaggtcagtttggtccagataacaagttttaggccatccagggctacaaaaagatactctgcctcaaacccctcccagcagaaacttttattttgggggctggagaaatggctcagtggttaagaacatgtattgcctttaaagagcagcaatgatctcttggaaacctgaggtcttgtgctggccttccaggctctgtcttcaagtgtacaaagttatattcaggcac

SEQ ID NO: 17651 - DNA, 1204 bp, Mus musculus
tgctagtgataaatacatatatttttaaaggagttatgtattttatgtgagtactgaagacacaccagaagagcgcatcagatcccattacagatggttgtgagctactatgtggttcctgggaattggactcaggacccttggaagagcagtcagtgagccatatcttcaagccactcacaaatacatattttaaagtagctttaattttcccgtgggggaagttttagaattttgagattatttttgatagcccacctaatggttagggaaagttgttgagatagtaaatcagctttgtgttcctttcacctgatgaggtcaggagatacatgtgtagatgtactttacagctagctcttttaacctcttactaaaattttctatgtttcaggatattttgaaaagatctagtaaggagataaattatactgagagctctttaaaacatgaaattttttttctttcttacagatatcgaagcacagattcgagaaattcaaggcaagaaggcagctcttgatgaagcccaaggagtgggccttgattccacaggttattatgaccaagaaatttatggtggaagtgatagcagatttgctggatatgtgacatcaattgctgcaactgaacttgaagatgtaagttacagattatctaggaggcaaggatttttgttttggttttttgagagaaaataaataggggaattttctgtttgagttgatggttaaatggagagaaacagttaataacacatagagggaaaacagactctctctctctctctctctctctctctctctgtgtgtgtgtgtgtgtgtgtgtgtaatcctagctagcctggaactggatatatagacccatctacacacatactcatacctgccactatgtgatcctttatgtagtagaccatgctggcctcaagactctacctgtctgtcttccaactgctgggactaaagaggcatgctacaataatcctccctggttagatagagtgtttcacagttagcttgtttttgcctgcttaatactagggtcctcactgggcccttagatacctcctaaagtgcccagttttgaatattttgtggaagacttatctgaatattgttagatgatatataaagcattttcacatcatttgtgatttaaattcttgttacctaatcctgtctgaagtaccctatggaagaca

SEQ ID NO: 17652 - DNA, 1206 bp, Mus musculus
ctgtttattttttgggtgtcttggaggcagtgttcctttggctaaattctattttgtgtaatttaatctctctctctctctactttttatttttgtttttttcgagacagggtttctctgtgtagccttggctgttctggaactcactctgtagaccaggctggcctcgaactcagaatctgcctgccgctgcctcccaagtgctgggattaaaggggtgcgccaccactgccaggctcctttggttttattaaagacaggctttgtctgtacagccctggcttcgggaactctctttgtagaccaggctggcctcgaactgcctcttctcttccgagtgcttgaattaacggcacgttacccaccactggccggacaggctacagccctcttgggaagtagccatcctcttccgcgtttagtcttccccgcggtttcgctggctttttaaggaagccgccgggagcccgccctggccccgcccactcccataatgcccctcgcagtctcatataggtggcagttgaagtacgtgctacagtgcggcgcgcgctcccgggtgcgcacgctcagagagcggcctctgtttctggcggcggcgagcggaagtccttgggagcgccagttccgtctgtgtgttcgagtggacaaaatggcgaagatcgccaagactcacgaaggtaagcggcctttcccttcccacgcgcgacctcggcagccagccagccgcggccctctctcctggctttctgcgtcttcgcgtggcatctctggtctcgaccgaggccgcgcggcgaggcctgctcggctcgtcggcgcaggccgctgcccgcgtaatggcgtcctctcgcactccgggaccggcgctttgttccgcgctggctgttggtgcttccgagttctcttgttctgaccggagagcctcgctcgagcggcttgccccgggggactcccggggagggagcggggaggcggacgtgggaggccgactttctcgccccccgggcgctatcgtcggcagttcgtacctggaaagccctgaatgacggcagccgctttcgggccgctcctaacggaggccgcttcagcgcaggcctgccaatcccagccttcgcgatacaggcatctccaaggcggctggatcgtgttgtggtgcttgcactaaatgattccggcagaaaatctggtagtttactcctttaatca

SEQ ID NO: 17653 - DNA, 1246 bp, Mus musculus
agagactgttttaacttcatgttgctatggccaaacgcctgacatgaaacagtttaagggagaaaggatttgttacggcttccagttcaagtgaaccctttcgtaagggtagagaaaacatggcagctggtgaagtcatagcaacagaattaggctcactggctggactgcctctacagtcaagaatcagggagcccccaaatggtgctggtgcagcgggagggcctggaggaccccggggcccaggattaggaggcttccgggcttccgcggagtattcagcagcggtcttaggggccgagggattggaggtaaagctgaagacaaggagtggatccctgtcaccaagctgagcttcctggttaaggacatgaagatcaagtccttggaggagatctacctgttctccatgcctattaaggagtctgagatcattgactttttcctgggtacgtccctataggatgaggttctgaaaatcatgccaatgtagaagcagactcgggctggccagcagaccaggttcaaggcattcgtcgctattggggactacaatggtcgcattggacttggtgttaagtgctccaaggaggttgccactgccatcttggccaagctttccatcgttcctgtgcggagaggctactgggggaacaagattggcaagccccacacttacatgaaaggtgacaggccgctgtggctctgtgctggtgcgtctcatccctgcccccagaggcactggcattgtctctgctcctatgcccaagaagctactgatgatggccggtatagatgactggtacacttcagccaccctgggcaactttgccaaggtcacctttgatgccaactccaagacctatagctgcctgacccctgacctctggaaagagcccgtcttcaccaagtctccttatcaggaattcactgatcatcttgtgaaaacccacaccagagtctctgggttcagaggacccaggttccagctgtggctaccacataagggtttttatacaagaaaaataaatgaattaagtctgctaaaaaaaaaaaaaaagaataagggagcaacaaatgtcggtactttagctcctcctctttattaagtccagggtcctggttctgggaatcatgctaccctgttaacctaatgtaaatactcttttatagataggccagagatttgtctccagtgtgcttctaatcatagagaccctctctcaaaaagatgcgtagcgattga

SEQ ID NO: 17654 - DNA, 1888 bp, Mus musculus
ttgaagtgaatgagaaaaaagacagagttactgatgctctcaatgctacaagagcagctgttgaagaaggcattgttctaggagggggctgcgctctgcttcggtgcatcccagccttggattcattaaagcctgctaatgaagaccagaaaataggtaaagatcatctttcaaatgagtttgtggcctcattcttattgaaaagtattgttgattagcaatgtaacacattttacagggggaattatttcacctatggtaggattggataagtcttctcatttactaaactcttgttttctttttaattattttgtgtgtgttggggggtgcattttgccttcatgtcttgtgtgctatgcatttacagtattctctgggccagaagggagcattaggtagcctggacctggagttacattggtgctaaggattaaactaagtcctctggctccccagaaagagaagacaaagcaaatttgtaaaaatgtgtttgttttataggtatagaaattattaaaagagcacttaaaattcctgcaatgacgattgctaagaatgcaggtgttgaaggatctttgatagttgagaaaattctgcagagttcctcagaagttggttatgacgccatgcttggagattttgtgaacatggtggaaaaagggatcattgatccaacaaaggtaagtgattcagcatttcatacacactggatgtcttgctctctgcatggtttttattcataaattattttactaaaattttttctaggttgtgagaactgccttactggatgctgctggggtggcctccttgctaactacagccgaagctgtagtgacagaaattcctaaagaagagaaggaccctggaatgggtgcaatgggtggcatgggagggggtatgggaggcggcatgttctaactcctagagtagtgctttgcccttatcaatgaactgtgacaggaagctcaaggcaggttcctcaccaataacttcagagaagtcacctggagaaaatgactgaagagaaggctggctgaccactgtaatcatcagttactggtttcctttgacgatatataatggtttactgctgtcattgtccatgcctacagataatttattttgtatttttgaataaagacatttgtacattcctgatgctgggtgcaagagccatataccagtgtcctgctttcaacttaaatcactgaggcatctctactgttctgtgagcatcaggactgtagcgctgtgtcaccacatgagagttcagaagcagcctttctgtggagggtgggaatgattgtgtacaaagtagagaagtatccaattatgtgacaacctttgtgtaataaaattttgtttaaagtttctggttgtgttaccctttccatggtcttgatgggagaaatgaaagccaatcagaggagcacagttgggtatatagaaacagtccacctatagtctgtagtctcttgcttttccttggagataggattattgcttcgtgaggttttacagaaggcacaacactggttagcttgactgatttggagagtatcataagtgatcataaaggagtttagtctttccttaccattttgaagtttatgccatagtaaaaagacttaatgagcaacttaacattttaaccagtcttcagtacttgaatttttaagtgagtctagaattaccagagatctagccaagcaaataagcactatgaggtttaatcccccaaccctcactttaccctcaaagagtgaagattattcatttcttggtgtaaaagaaacaagagggccagatagcaggatgcagagcaccagaaatagtctgaagtcagttggccattctgtgaaagcaaaagctggttgtaatt

SEQ ID NO: 17655 - DNA, 1097 bp, Mus musculus
tagagtacataaaatacataaaataagcatatcttaaagagaagaacagcaagtgttcttaacccctgagccatctttaggtttaactggcctctaattctttgactttgtaggatggaaaaaccctgaatgatgagctagaaattattgaaggcatgaagtttgatagaggatatatttccccgtattttattaacacatcaaaaggtaagagctggtccagagatgaaatctttacactatactttaagctataaacttactgtcagctgtaggcagtggatgtgggtggtacaataaaaattgtgatatttcaaaacattaatgattcagtaaatgaagaaaagatcatgagttactggtctcattgtggaagtaaattgttaattttctcagtactgttagaatttggttttactgctctctgtatttacaggtcaaaagtgtgaattccaagatgcctatgtcttgttgagtgaaaagaaaatttccagtgttcagtccattgtccctgctcttgaaattgctaatgctcatcggaagccattggtcataatcgccgaagacgttgacggagaagctctaagcacgctggttttgaacaggtaatagattgggttgttatgtttttaggtagaaggtgaatgctgttgctttttaaaattaattccctgttttgcttgtgtgtcttagaggtgtagtgtatgatatagtgctctatgcattatgagtccatcttaaagcggtctcaaatgtgcataatccctgagccgctgcttcccacagcctcccagagagaactatacgtgtcttttaacactggtatggttagtactgactcacaactgtgtctgcaatataagggcagcatttgtttaagaaggggatctgcttggaacaagatttgatgagtagaggtccccatcttgtcttttttcagaccaggagttgtgggaaaagagtaggattgggatagagttatatagtactaatagttgtatatagtactagaacttaccaggaactaaattagatgctttctcccaactcccccttcagtttacatcttacacagttaaatgttctttacaggctaa

SEQ ID NO: 17656 - DNA, 1308 bp, Mus musculus
gtcctttagtccccggtggccgcggcggtccggtgttcactttgaccttgctcggggctcctggtcgggaagacacgtggggccgcgaggctggactgacctactgtcttttcctccggccttgctagctgctgtgttaccgtagcttcgggtggatacctggcgacacactcagagggttttgcaccgtcatgagtacttctgtagttctctaggcaattgcatttagaacctgccttgcttgcaccaacttgatttttttcctttggacacttttcggagtggatctgctcccaaggccgctttggcagtgaaagattaacttgagagggcagagtgggtggccatggggatgtggttttctgtgctttgtgcttatgctgttggtcaggcttggggtcagcctccatgatcagttggctagcagattatgccctgaatctgcagcgcccaggcatggtggttagcagaggacagcccagctccaatctagcctcccatgttttgaagcaccgttggacaagtttgtagtgatttttcttttttccttccccagaaatgcttcgactacccacagtccttcgccagatgagaccagtgtcccgggcactggctcctcatctcactcgggcctatgccaaagatgtaaaatttggtgcggacgctcgagccttaatgcttcaaggtgtagaccttttagcagatgctgtagctgttacaatggggccaaaggtaccagtatacttaaatggtgttaaagaatatagtagctgcaagacagcaatttgttatcaagttttgtgaaaaatctaatttgcatgtggtacaacttagtggtctagaggtgttatttagtcaggaggtctattggtcattctaccaccatggtgtccttactactgctccaggcgatttgggggacttttgtacattgtgatgtaatagagtagtaatatctcaaggaggattttcaaactatagtcatgattttgtgcatgcttgcattaaattttggatctcgtcccagtagttagagggtatagaggggaaagtacaacttaagtctaataatacctcaaagtatatagctgtaatgtgagagttcactcattgtgctgaaatactccaacacataaggcaaaatgcactagcatagaatcattggtttctgtgttttttgttttgtttttttaagtaactaaacctttttttttcaagatttatttattatatgtaagtacactgtagctgttttcaggcacaccagaagagggtgtcagatctcattacgggtggttgtgagccacc

SEQ ID NO: 17657 - DNA, 1179 bp, Mus musculus
taatgtgactggttaatgcctataatacaaacctgaggcaggaggcccctggtgtgcatactgaaacaaaaagttcactgtgtgtctaatgaacaagacaagcagactcttggctaacaagtgactgttttcatcagagtggagagattgagcctgtcagtgtgaaagttggagataaagttcttctcccagaatatggaggcaccaaagtagttctagatgacaaggtaagtcaagctaagaatttttattttatctattttttttttaatttcgggggagggggtggttcaagactgggtttctctgtgtagccttggctgtcctggaactcactctgtaaaccaggctggccccgaactcagaaatccacctgcctctgcctcccaagtgctgggattaaggtgtgtgccaccactgcccggcaaagctaataatttaaaatgagttatatttgctatgactatcttaaccaatagtctctttattcacaggattatttcttatttagagatagtgacattcttggaaagtatgtcgactgaaatcactgttgaaatggtgtcacgtgaagctgccattccactgatgtctgaactatttcatcatgtaaataatttccatgcctcccttttataataaacagatgatgcctaaactgacagccattgtctctgacctttagtttcactgtactgttacaaacatttccaaataaaatgatgtaaatgagtggacagtctttggtaatttaaggtcgttttcttccaaggaagctgcgtagttaagagttctgagaaataaggattttctaggtaaatgaattttcgggatgaatttggcattattacatagatgaataatataagccacgggaacttgtacttagatactgtcttagtttacattctattcctgtaataaactgctgactaaatgctacttggagaagaaagtgcatctcagcttcaagtgtattacaggaaactgggcaagagctgaagcaaagacaatggaggaatgttacagcttcctccccttctcagcctgcttccttacacaacccactgccacctgccgagaggtggcatgacccagagatgcttcccacatccatcattaagattctgtgccatcaactttcctatgggccaattaatgaaggcattttctcagttg

SEQ ID NO: 17658 - DNA, 1159 bp, Mus musculus
gaagccaccccctggcgagaggaggtcttgaagtcctggaagccaatagactcccttcgggattccgatccctcagttactcacccgatagcccttgccccaaccttcactaagggatctacagagcagtgagcgagtttcctggagaggccagtgaggggacagtcactctcctggtcacaagagaaaggagatacctagtccccgttctaatcgtcaccgctcctccaggtctccgtaatctggattccactacacctcatactctggagacatgagtattcctcatttttcccagaagaatcatggaaggagtctttgtatgccttcccttgaatcttggcagcatcttgaggggagagcttcctcccccacccaccctttttttgttgttgttcctgtgaaatgttgatctctgtgagtttttcctggttcttgtgttttgggggttggagtgggagggagggagtttagggagggaggggcacagctcagggcatctaggcctcagattgtgatgatgcagggagttagctccctaaattcttgggtgactgatggtttgacttggtaagttgtgatctttcctgaaagaggaaggagctgaagttggttggccctgctgtaccccctgacaaggttgtgagaccctcttcccccccaactttgtttaaggcattttggttttttaaaatctgtacagtaaaagcaactttttctgtaaaataaaaatgagaaatgcaaaaaaaaaaaaaaatttctttccaggaaaaactgataatctttttttaagtaaactgattgttagacaatgtacacagataatataatgcattttaaatactctctcactatgtcaggtggtatcatataagggcttttgaatatatttcttaataattcatttttttgtattttatgctcttttactacgcttaattcccaaagaatattttgtatgttttgaaacaatttagtattcaacattagacataggatcctcagttatggatagtattaaatattcattaatatttttagggtatgaaaggatatgaatataaaagttgaacaattttgtgtattatttgattctcaaaatacttcatattcttaatatgtttgatgcataaaatgcatttaaataataaaaaaatta

SEQ ID NO: 17659 - DNA, 1675 bp, Mus musculus
agtttgacttttccttttagtaatattaatcttttcacctaaccctaggcagcattaaatagatatgaaaaaagatagtgtattaattttattttccctccttaaaagcttattatttgaattatatgcacatgtaagactatttacaataattcacaggttaagtggtgttgataagtggtcatactttgatttcttatttcatcgtcttaagaatttaagtgcagccgggcggtggtggcgcacgcctttaatcccagcacttgggaggcagaggcaggtggatttctgagttggaggccagcctggtctacaaagtgagttccaggacagccagggctacacagagaaaccctgtctcagaaaaccaaaaaaaaaaaaaaaaaaagaaaagaaaagaaaaaaaaaaaaaagaatttaagtgcagacttacataacatgacatgattagtggagtttctcattaaacgctgaggtctctatgccacactgtaacaaggcactaagacagaatagagacctgtgcagttgggacagctgaagccatctttaccaatttaacaaaagaaacttcatttttatttaagagctatttgcgaatgaaattgaaaaatgcattcatcttgtttgtttttctaattatttgaagaaatgatttgtattgtattataagacaagtatacacagacaaattgggaaatgacagcacactgagagtgtgtgtagagttgacgcctgtcagagcctgtgctgtgccagtggtcacggtcatcactgtacctgagcccacagttatcttctaagaagttatgtttgcagtgaatagaacattgactgaaattaggtgtttatattactgtcaccatgaatcattggggttagtaatttttaaataaacctggtaaatatccgagagactaacctatactaagttcataaattatacctagtgtagcaatgttgctgttctctagttggagtctcacggtgggtttctgtcatctgactgtttctcaggggacagttacggtagtgattgggttgtgggtgtgactgagtaattggaacactttgtgaatatatggcttagtgttaacaggaaaataaagtatggttttctttttatacttactccaccctccctgtagtatgtttgaaattgatcataaatctgcaaaagcatcagtttgtattcttgcttttgtattcatactgactcctcactaactcttgtacataagatctcagtgagacagtgtgtgttttaatactagttacatagttttgaaaatgcatatatacatgagtagtagtttaaaaagtggctggagccagagtggtggggcacactttgaatccagcagagagagggagagacaagtaggtctctgagcacaaggcctgtctgggctacatcaaaggatctcatggggccagcaggatagctcagcaggatagctcagcaggatagctcagcaggatagctcagcaggatagctcagcaggtagaagtgattgctaacaagcctggggacttcagtttcatccccaaagcctacatggagagagccttacatggagagagccttacatggagagagccttacatggagagagccttacatggacagatacaactcttgcgcgttgtcctttgactctgcataccatggct

SEQ ID NO: 17660 - DNA, 1202 bp, Mus musculus
acaacggagtcctaccaagatatgacacttctgaaccacagcaatggccagcatggcataatggcataataaactcaaaggtgtagtagtggcaggcataactttctaattggacataagatatactcaacaagagggaagtcatgcttttcctcctctccagctccaccactgtagccatcatgaatgacacagtaaccatccggaccaggaagttcatgaccgaccgtgtgcttcagaggaaacagatggtcattgatgtccttcatcctgggaaggcaacagtatcaaaagacagaaattcgggaaaagctggccaaaatgtacaaaaccacaccagatgtcatctttgtatttggattcagaacccacttcggtggtggcaagacaactggctttggcatgatctatgattctttagattatgcaaagaagaatgagcctaaacacagactcgcaagacatggccattatgagaagaaaaagacctccagaaaacagggaaaggaacgcaaaaacagaatgaagaaggtcaggggcacggcaaaggccaatgttggtgctggcaaaaagtgagtggagattggatacagccaaaggagtagatctgtggtgacttgatgttttgctgtgatgtgcagatttctgagaggacaaactaaaaagctcctaccaaaaaaaaaaaaaaaaaaaaaaaaaaaaaaaaaaaaagagggaagtcatgcctgatactggaaatttagtaactatttagggcctgtgaagtcatgaatcttggaagagaacattcaactaccattttactaaacagcacaattcatagctaaatactaaatatttctccgaatacccatagatctgtgtagttgtcaccccttatcaagaaaacatcttctttacagtggacagaaaccatcacagaaaaccataagcaatcaaagttcagttgtggagcccagcccccactcatatatctacaagacaactccttgacccaaggttcagggagcactgtagaaaatagagtggaaagattgtaagagccagaaaaatagcaagttttctgtgagacgttgtctcctaaaaatttcagaaacactgatgaagactcaccaacatggttgtttaaacaggatttgaacaaggataataccaaaagacatgttaacatgaatggagcaagcttgtaaagcctgaagttt

SEQ ID NO: 17661 - DNA, 1181 bp, Mus musculus
gaatacctgtcttagctgcatttctttctctcgccgcctagcccctcttctcttccaggtttccagaatgcctttccaggctagaacccaggctgtgatctgctggccagacacaacatttggggaaccaacacgggactgagaaacggcaaaggatttttggaagaggcactgctggtttggagctccatggaagaagaaaataattaaaggataaaggaaattcataccggagaaggttggtatgggctaaactgaaacagcgttaaacccgagcgctggttcacttaggttcagcagtgaagcttaacaggagtaaggtactgtaacaggaggtaggccgtggctctccggagctacatttttaggcatgagaaaagaaagggtttattaaaaggaaattaataatcaggcagattgcatcatgagggaggaaaatgtcccaaaaagcagagagaaatttcaggagtgccatgctttgttctctctgggccttataacagaagtagtactctgtccccttttgtgtcttgtctaatgtctggtgcaccaatctgttctcgtgttcaattcatgtatgttcgtgtccagcctgtatgaatgaatgttctatgttttatgttggataataaagatggtataaaaaactttatctgcaaagccgagagctgccacgtgcttcagccaggaatcagacacatggcaggagggcccctgctggaaaaactgttcattttaggaaaaaagggcgagtgcacagcctcttagtttccgggtaaaaatgattaatggttcatgactaatgtgtttgacaaatggtaaagtgccttttttctatgattgtagctacaaaaattaatattctctgattggtctaaatgtaactgcttcatttggttccttttttattgataatgtgctctgcatgttttcacattcagctcataagttgttggttaagattaataattgttacattgctacagatggttagtgttaaatttgataactcaagtttagactccttccgacacgtggcatgaggcaggccaagaggctgggtctctaaagatatttctagtttagataataattaatgtggttcctatcctaaatagtaaaatttaagataagatttaaagcaatgcctctttattaaagcattaaagcttgctttaata

SEQ ID NO: 17662 - DNA, 2904 bp, Mus musculus
tcggaggagatgtacaaggtggaggccgaggaagagaatgccgacaagagcaaggctgcaccggccgaaaccgaccagagataatgtgaactccgcaggcagagcaatagatgggtccaaggactttctgttttagtttctttcaagttcctctcggctttgttttattttgttttggttttgtctgttttatttttcttacccttaatggcattcctctgttgcacaggatagcctatagactgagtaagctcagagtttctgaatcagacgtcaccttggcaaagacactaagtgttaaacttttacaattgactcgaccatagtaattctagtcacgggcgaccctgccgtcattcctgccaacttatggaagcgataccaggcaaattccaggatgggaagacccacgagataaatgaaggaagctgcaagtgtgtatatgtatatgtacatatctctatatttacatatatatattaaaattgcatgggacagagaactttacaatccgaaggactagactgtgaaatgagttcttaaagaaaagacttgtttatgtataaaaactaataccacttcacagtgagtcactttgactttgagaaactgcagcctgctctcagggcgggataactatttttgaattcctatttattttgtgtgtttgtccctgatttttttttttttaattctatggcttcctatctggcagcttttaatgggtaatttctgaggtatgtatttaacaaaataacactgccaaaaagatgagagacaggaggaaagaagagagtaaagtgggagaaaatcagggcatgtcaaaaaaaccaacataagaccaattcctccagaggacataatgcacaccttaagacaaggactcagcgccgtgaccctccacactccattcccgagcatgccagcactgtatcgagcggatgccttctgtggaatcccgagcccagttcagtgcagaggaaacttgacctttagcgcagtctcaatgagtgacgttttgacgttggacctatggaatccatgctatgagccacattttgttgtgaagtttatttactcgcttgtggcttcaaatcttaaaattattaagcctgctcatttaatattgttagggtgttaccctttccttcctttcctttctttctttctttctttctttctttctttctttctttctttctttctttctttctttttttttttctggatttcttttgttcttgttcttgttttggttttggtttggtttgttttaaatagaacatagtttaatgtaatgttaggttagagaaagaagtttctgcccggttagaggggctcccgctcagataactccaccctgccctctccccgagtgttcctactctgcttccgtttagacttcctcttcttcacaaatccccttcactttagccagacctctgcagaccctgagctcacgcgtctccacccttcccctgccacgacagccctggcaggaacctggtttggaatcatgcacctccaggcaataaagtaagtgaagcgatttcagcagagtcacctactcatcggaaaaggaaataattgtcccagtgccccacatagcgcttaccttacgtaaagcagaactaatgccaacgggctgttttgtggaacaagcgttaaagctgcaatctaccacagtttgccaaatctcctccagtttcctattagaaacagtagcattaccttccagttccagtgacagcgattgcaagaggagacctcccttccttcgggaccggcctccggaacccactccaggcttgagatggccactcagcagtcccgcacggttggattttattttcttttgttttgtttttgagttgtatcctcatgcaaccttgtcaaagacctcatgcaatatcactttgaaatttattttctgtttactacacaaacattgtaatataactgttaatactatttatatatttgaaaggtataagaggtaggagtttaaaaaaaaaacctctatgtgtagatattaactcagagcttacactatacagggagaagacacgttgcaatacaagctaattctagctgcttagtaacctctggagttttcaaagggacatttttcctgtactttttcaaataatgatgtttaaaacagttacccttgacatgagcgtcatgcagctttgcaaaaggatggctgtttgcaactgaggcctgggcccgcccgtcccctttctgtagatgctgcagctttaatccgagagtccacagttgctgcttcctgatctccgagttactctttccaaattgtcttctgacgctgttgctgaagtcactctgtacacatcctagacaccgatttttttgccaagctcttacaggtggttcatcgatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttttgtgaaatgaagaaaaaaacaaattgtgttttattgcagtatcaataatgtgaataaggattaacatattgtaaatgttcctttttccatgtaaatcaactatctttgttatcactaagtgataatttttaacttatgtgcattgttaggctgttagaattttttggttgttaaataaaacgcattcaataaatctgactttgtttgtcaaatagt

SEQ ID NO: 17663 - DNA, 1162 bp, Mus musculus
aaaaaaaaaatgtataactatagcccagtggttctcaaccttcctaacgctgcgagccttttgatgccattcttcatgctgtgctaatccccaaccataaaactattctcattgttacctcataactccaattttgctatgttatgaatcataatataaacatttttggagatagaggcttgtcaaaggggctacgaccctcagattaagaatggctgtttaaatgtaaataaataaaatatccaaaaaaataaaaataaaaaaagaatgacagcttaaccctttaccataaggataactgactcacttttgttttggggtttttcagacttgtatgaaaaatatttgtatcatcagtgtaccaaaaatataaaaattaagtactctatgtagttgcaataaattataatcaagaaaatatatgattgtaatggtgaatttttttttcctttcaacagtggaaagagtggagcgagagaacctttcagactattgtgttctgggccagcggccaatgcatttaccaaatatgaaccagctggcatccctgggcaaaaccaacgaacagtctcctcatagccaaatccaccacagtactccaatccgaaaccaagtgcccgcactccagcccatcatgagccctggtcttctctcaccgcagctcagtcctcagcttgtcaggcagcaaatagccatggcccatctgataaaccaacagatagccgttagccgactcctggctcaccagcatcctcaagccatcaaccagcagttcttgaaccacccacccattcccagagcagttaagccagagccaacaaactcctctgtggaagtctctcctgatatctaccagcaagttagagatgagttgaagagggctagtgtgtctcaagctgtctttgcaagagtggcattcaaccgcacacaggtaggattcacaatattctctctggggagtaagagtcagagtagggaagaaacacgacctgtatttatttctctataatttcttcaaactgttttatgtgatgaggaaatgcctaggagacacttgctgtcaagcatgagagcctgagtccagatcccaggacccacgtcagaagctgggcactgggctcacagatttaagcctagtgagagaaaggtggcagggagagat

SEQ ID NO: 17664 - DNA, 1214 bp, Mus musculus
gggctctttgaagatgctgagattgaacctgaggcaggtgctaagcaccatccttctccctcttcttgtctgcatgctctcccaagtctcttcagagcaccacgctctctgagctcctcggctttctgactaacccttcttagcccttttgctagtaggccttctctgtccaccttccagcactggattctggttcacctctcagctcactcacccctacgggctttcccaaagtagccccaatcattaccagtgcttccattactgtttatgggctaacagttctctagtttatggtttgaggtgagaactttatatatatatatttcactacttagaggaattatataagaacttactgcattgttgattttgaatcctttccctaaaggttcaactttaatatatccactgaggcactttgctttttcaaatttgggctttgagctttttgtttgttgttttgagattgctcaatctcaactcatgctggccagactagaccctgcctccatctctcaatcaagatatcaaaaagtgactttctttgttcacccttggactcaaccctattttccccaaccctcctcagctactctacactttctccagattctggctgcctgtatctctctctgtgatggatagtttgaaattgatgacctgaagcatcctatggcctgtagcttgcctgtccttcagagtcatccttcccacccccgcgccagccgcacatccctctgatgtgttcagtgtatcccagctctcacggcgtcaggggtttgtctttctctgcctaattcactctttcttctgctctttctttggctagtccctcgcttcctttccggtgtcaggagcacctttttgaagaattactgcttggcttttctgcttaccaggtgaatggtatgcagcccgaggagagaacagagcattggcttttcttatgaagtcagattgcctttctccagttattcatagcttggttccttatggagcttaacataaatgcatgcattgatctagagctaaaacgagacaacatgtgctaatgaggaagcatgaacacgagcgcagggaactctggggaacaggtggacgggaaacagaacggctgtgaaggaagctgggtcagtgattgcgactgagagctgggcttggtaatgttaacagtttagaagtttgtagtgtttgcatggtctgcaagtaga

SEQ ID NO: 17665 - DNA, 1213 bp, Mus musculus
ctacagagtgagttccaggacagccagggttatacagagaaaccctgtctcgaaaaaccaaaaaaaaaaaaaaaaaaaaaaaaaaaaaaaaaaaagattgatttaatatatatgaactgagccagattccattatttttcactaaattgttaacagtgagatttgttaaaccgactttcttgtatgctggcttaaagtgctgtttgtgtttccagagtccagttatttctgctcatatttggcatgtgctttattaaatatttaataacaagatccagatttctttcaggggctattgggtgttgaatatagatcagaccattaaaagtgctggagtgtactttaatatttgtggtattgttcttattaaattaaaagagtaaacattttaattttgactaaccgttaatcattgaattagcttcttattgatactccttccctgttgttgttatccgagaatatttgagttgatggaagatctttatgtctttatgtttttcctagatttcagagggaattcacacaaggagtaaagcctgattggacgattgcgcggattgaacactccaagttactagaataatctttcttggaaaaaaaaatcagggcgtgaactcttaataattgctgtgaaaaactaaggaagacaagtttctggatgatttgattttaacttaattaagtctgtggattacttttgtattatttggaaatactcagtatattgacctaatacaataaaacattttccacagattgctagtgttctttaaaggaggtcaaagtaaaacacaaaactacagcaccacattggtgtcctgtttaatatcattctaaactacacatgtatatatgtaaaacacagaacgacagcaccacattggtgtcctgctgagtgtcattcaaatgttttatatgaacatgtgtcacagactagttttatacatgtgaattattgaaactactgtatatctctaatgatccaagtttctgcaagatttctacaagccactgagcctagtatgtttgattatctggatagtgatccagataaggactgggtagaaccatagcagcttgacctctgtaggacatccatgtttgtttactgttcacagtagtgatgaaatggagccagcctagatgtccatcagcaagcactagaatacatgaagaaaatgtggcacataaacacagtgggcatttattt

SEQ ID NO: 17666 - DNA, 1775 bp, Mus musculus
tgaggaagaagtgtgtgtcttcaactccagacattctgtatgtgacagatttagatcaccaaccaacttcaagtccaggatcaaattggaataatgagatacatggtcatactaatgaaaccagcaataacacgcaaagaaatgccgagtgttttcttgacttaccttctgagtcttccagtgagcctgacgcaaagcgcatggagctagtgcagaagaacaccgatagctttcacttccagaaaactgtatatgatgccgctgatatggagttaactgctactgacataggcaagattgtagcagtttcaaaaagcaagaaaaatcaaaataagaaaaaggcagactgtagaaaggagactttcagaaaagtgaaaggtgcaagctctgataaaaagagagaaagctcaaagagagaatgtaaagatggttcagaagtaggtgctgaggaagaggctgatgcagccagagcagaaagaggcgctggtgtcctggatggcagaggggattcagaagagccaaactgcatttccagtactgagcagccatctcaggtaaacacgcaaaagaaaagaaccctccagaacagctcagatcaggagaacattcaaaatacgaagaggaggcaaacatatacgacagatgagcaagaggaaacaaaccctttctccagacattcagtcaaatttcttcaagatggtaaatttgatctgtgtcagaaaaccctacatcataatttaagtaagccttctcgacagacatttgtgattcgtaagtcagaaaaagataacttatttccaaatcaagaagataaagacaccatttctgaaaacctagaagttacaaatgaatttcatatagatgatctttccatcgaagctaatgaaaatgtatgtgaccatgagactcagacaatgttggacttgaaaaagtctgtcagtgctcaacaaaatcaaacaaaaataaataagactaagcagaaaataaatcgaaggacaaaaataatttctgtcatgagccaagtatatgaggacaatgataaagatattcacgtcctagaaaaagacaactttccctttcatacccaagcaaataaagaaaccaccagtggaaacctagaaagttcaaaagaatttgaatcacctcttcttttcacaagagacaacggaagcttacgtgactgtaagacccagaatgttctggatctgcacaagcaaattcctgatctataccctgatcggaatgagtcccagattagcaaaatccctaggcaaaaagtaaatcgcaagacagaagtaatttctggagtgaaatgttttagtaatgaccaaggtgttcattgctcagaaaaggataagtctttgttactacaaaaggataaagacttcccaggaactttaaaagacttaagtgagtttgatacgcctgctttttgtaacaaagatagtgcaaagtcgtgtgattataagtctgaaatgctcttggggttgaaaaaacatgaccctaatatgcaacctgcttgtcaagatgattcaaaagcaggtaagaaacttagacaaaaggtaaatcgaaaaacagaaataatttctaaaatcacccaaatacatgaaaatgatagaggaagtacacatgactcattaaataagaagctctgtcagaaggttaatatatcaaaaatcatttctcaaatgaaccaaatatatgagactattaatgaagatggaaatggctttaaaagctctatcaaagattgcgaagatattaaaagttgtgac

SEQ ID NO: 17667 - DNA, 1378 bp, Mus musculus
atagctatatcttagataataaacttttttttaaaaacattggtcatcacataacttgttgatttaaatttctatcaaatttatataaccaagcaactattcttattaaccaaataaaatgtatcattgcattggttatcttgtatatcaggctatcttgtcttcctaacattgaggatgccatctttactgctaaaacacaggaacacaccaccctgcctgtgcagtggaggttggaggccttgttaacagaacatttactttgtggggagggttgcctttctgacatctgttcatgctccaggaatactgacctcctggaatccctctgacagtatagtttttgttccttttttttttttctaccttttatgagatttccctttatttctctctcccatgcaaattacttcatattttataccaagtatctttcttttactattggtagagtttgatcacacttaaaaaaaacgttttcaggttataaagtacccatggttttaatttaaaaaatgtttaggttgtgtgcgtgcacacattcatgctacagagcatgtggagagtcggctctgctttcctcatgaggacctgctagagggtggaactcaagtcacctgctttgctttttgcccactgagcggtttttgtgagccctacatttaaatttcagactaatacagagtttgttgtatgatgtgaagtatacctgtaatattttactatttctcaagtgatttattgacttaagagctcgtatctatctactgatttgaagtttttagcgttgtgttgtattcccatgtgtgtcaattgttgattttcctgactcctattcacttatgtatcattttatcattaattctctttatttattttttaaatacaaattaaaaaaagttttaaagatttatttatctatctatttatttatttatctattatatgtgtgtacactgtagctgtcttcagacactccagaagagggcatcagatttttgttaatagatggttgtgagccaccatgtggttgctgggatctgaactcgggacctttggaagagcagtccgtgctcttaactgctgagccatctcaccagcccaattaattctctttagaatgtcagtattttcctcataagttttgaaaatcttttaataaatttaccattaggcattttgttcttctgtggggttggcacaagcgaggctttctcttcagtttttctaatttactgtttgcaaatatgaagattactgaattttgtgttgattaataaaccctcttatgacataactattttctagacatacttcttgaagcaagctgtctgaccctatttttgtgattccatgacgaatacaaattccttgctca

SEQ ID NO: 17668 - DNA, 2943 bp, Mus musculus
ttgtctctttttaacaagaggggaagttagacattaatcattgtaacttagtgttgtgtgagtgccatgaaatatgtggagaacaactcaactctccttataacagtgatcaaactctggttaggtgatagcagaggttagcttactggtcttgctggctccatcatgggaaattgaaagtgttgtgatacatgcatatggacttgttctcagttgatgttagtcaaattctgaaatgattataaagttttaaataatggaaaatggcttcctgaaacaagatgtttgactatttttcaaattcttttctagaatctgagtctgaagctgaagaaggtgactgaattttgaaacaacatcctcagtaaagcaaacaggagttgtagataaaatgtcatgtctcatgtgtcctggttcttacatcttcctacctccctatatcaagcatgatataagggctttcatggcaatttttattttaactgtttttatggttactggaaatgttggctttggtttctgaaaccacgtgtgaggagcaagctgcaggagccgtagaattgaatctgatgttgcattggttttcagttaccttctacctcctgtattttctactgtaataatgtgatgtaaggccttccgcaatgagcagttcactttattccctgggttttctatataaacagttttcaagatatgatttggttaaaaataatttgttacaaaaagattctgtttgcaaattaaactgtaaaagtattcaaagtctcaaagggcaatgatttgtgtgataacttagtgtgtccagagccctgttcatcagtgaaaatcctgtagatgattgaatccataacatgaaccctgacgttggttatatgtgagcattttcttatattcttaaccccagatgtttgatttctgggtatcatccttagtaaagccatggagagcaaacttgagtttgagaactacatgtggcagaggtaggaagaaggaagctgagtctttttctggaaacttctaggttcatttgtatctttccaggtagaacaggttgataactcctcacacaaacgttctaccccaggatacagctagactgttataagagttcccacaaggactgaatcaaggaaatgtcttgtcactaaaccatacgattgttgagtgttttgggtgagcgtgttctaacaggatctctgtacgactccattttcctttgtgaaggtgaaggacagtcattcgcggtctgccattcagttgtctgggcctggcctcattctactatagtcaagcacctagtaactcaccctagttgccattttcttaaattgccatgagccaaatacttcaattgattaatccatttattttaacggctgccttcgttgcttttctttttgctatccatttatagttagtagtggaagatgtagccaccttttttgggaaaggctaaaagtgaacattttgaaagtttttttttttaattggtaaaaaaaaaatagtaagagaataatgccaccagagactttagtggacattgcccattttgaaggtgccattcttagaagccaagaatttggtatttaaagtttatcttgagagaataacctgtaatataatttgaaataaaggtatagtaaccttaagagcactgtagcaaaaacattggtgggtggggtgaatttgtaaaatgaatgactttgataaagttttatgcacaggcaaatgtattcattagattctgtgtagtgatctgctttccctttgtaatttgtagtcctaaaaagattttttttttttaaaataaagtccatccttgcatttaggttttatagatcagtctttttattcccacccctcccccagtcgcattgatccctaatggtgtgctgtatgtcctgctttcagatgtcaactgtgtataaacattagtaacaatttgtccatagaacttgcagactaaacacctcacagattccaatgtagctaaaactacattgccatttctacaaccagatccttgcatgttaaccgtcgttcaaaacgcaccgtttattatatactgtgtatagtgaaagagtgtgtagtcttccagaactacattatgatctttgatcattgatctttccccccccctttatacacagtagtgtttaattagtatagtagcacacgagtaaggcacctgtgagtacaatgtaaagaaagggatttatgaaattattctcattttaagtttaaatgccaacctatcgcctccaatatgtaattcttaatggagatgttaaaactgtactctgaatcatgattggataactgttgattgaattcctaacttggtgtcagtttctaaggcctttagtgtcttggatattctactgtgtgtttagaactgttaagtgtcaccttattctgggattattgtcctagaaatattctgttcttataaaattttcagataccaaaatgccacatactttactcagcataatgattgatggtgaggggaaatgcatgtgaccaagtaattaacttataacagtgttcaagctttttccattatccaaaccccccagaaaccttttcccctaatagcaccccaataaattttaatatagatatactacgtactgtgtctgtgctttatacatgaaacactttttttgtatcccgtagaagttttttggtttttcgagacagggtttctctgtatagccctggcctcactttgtagaccaggctggcctagaactcagaagtcctcctgcctctgcctgggattaaaggcgtgcgacaccatgcccggctccgtagaagttttaataggtcactttttcatagtgtaaaagtttgttatatttctcacctctgatgctggggcttgaacccagtcttgtaccacccagccattttgagaccatcttgttaagatgctct

SEQ ID NO: 17669 - DNA, 1195 bp, Mus musculus
tagtgatatttagttctgtaatgataggaaagattgtcttaatgctattccaagaaatactattttgataaattgtcagtttgttccaaggaattaggtatttttgtgttagggttagttatgacttattaacatgtgtaaatttttttcctcattaagttacagatttgaagttagtgttttcatgtattaatttggaaatctatcagataacattttaaatgttatagtgttatataccttttttttcccttcccaaattagggctatcattttatttactattttaatatatattttctttattagttaggccaaatcttaatttggccacagggtactaaagtaaatactacattctacagttttgtagtatgaatttaggacactatgtttgagtgaatgccacagataagttttgttttgttttttaagaagaaaagcaaatgtgtttatgttttgttgacttaccactttgagtatcttatctgaaaatctgttccttgccatgtttttctcctgttaacataaactatgtgccctgtgaatttctggggactgaatttgaaattgctcctgccaaccgtttgtggcctggcgtgtatctgaatatctccccgctgaatgaatttcgtattctgccctgaattcactcgggtgtattgattggctggatgatgttggtgctggtgccgcccacttgacgtgtccagaagagtcaccgaaggaaaagatcgaggagtgtagaggatgatgaggagggtcacctgatctgtcagagtggagacgtactaagtgcaagatgtatagaatatttttcaacacttatttacttttcagataacataatctatatgtatatatagattaaagtttcagggatttggaaatctttttctttcttttttttctttttttttttgctttcatttcttttggtgggaggggattgtctttgctttctttgaagttttaatattaaattccacagcagtaaatcaagttaatgaaattagtctgagaatgaaattagatctaagaatagttgtatgttttttggatggtgttggctgataagtaattaatgataaggaaatttgcagcatcacctagaataatctgcattgataatacttataagtacattgttctcatttcctgttatgaataataattattcctcttttttagatga

SEQ ID NO: 17670 - DNA, 1395 bp, Mus musculus
tccagtcatcacttggcagggattccatttttggtttcatctatacattagtcataaagtaaggatcgtatcatacaggattttaagtgtgccagcatttttactataacctattacatggtccatgtgtgaaattttcctcttatgcttgtattactcaaaacagttttgtaacattttagacataatattttctttgactgatgcaaaatgctgccaaggatggcagtatacctgtacttctagaatttgagacgctaaggcaagaggatcaagagcccagggccagcctctgctaaaataagggagtcagaggctatactgggttatagagaccctgtcacagataagcaagcaaacaaacaaatgccttgttaggaagttatagtggccaggctatggcacatgcctttaatcccagcactcataggcagcctgaggccagcctggtctacagagcgagttccaagacagccagggccacacagaccctatatttgaaaaaccaagagaaaagttaatgtgagaaaatatagggaaaactcaaatatgttttggatttttgtttttgtttttgtttttcgagacagggtttttctgtgtagccgtggctgtcctggaactcactttgtagaccaggctggcctctaactcagaaattcacctgcctctgcctcccaagtgctgggattaaagtcgtgcaccaccatcacccggcatgttttggatttttaaaagtaccacttatgaattcgataagtgaatttgagaacaaaaacatattgtgggggaggggaaatgaatataatcaaaacatgaaattcttgaagtgcctctgtgtgtgtcatatggaatttggtttgttcataaaaactttgaccagtgtttacagacataaagccattacaaataactttaaaaaaaatatttgttgttttgttttttcaaaacagggcttctctgttttgctctggctgtcctgagaaccactctatagacaaagctggcctcaaattcagagcttcacctgcctcccaagtcataggatttaagtcgtgcaccatcaggcctgcatacaatttttaaatgcataaataagagaaaaatgtgttcttgggaaagtgagctattttcagtgctgcacaattgtatcagttcatggttgggaacagtttgtatccgagcaccttttaaaatatcttggggctggtgagatggctctggttaagagggccaactactcttccaaaggtcctgagttcaaatcccagcaaccatgtggtggctcacaaccattcgttttgaaatctgatgccctcttctggagtgtatgaagacagctacagtatacttacatataataaatattaaaaaaatatatatcttaacattttg

SEQ ID NO: 17671 - DNA, 1127 bp, Mus musculus
ctttcttagcatgtgcatcccatcaccctcatttgttcttttttttccttaaaaaaaaaaacctcgtcctgtctcatccctttttggttctatcacctgtgtgcacctacgtacacacaccacacacacatacattctaggttcttcatagagaaatacagtgtgtcctttttttaaggtttatttaatgtatgtgaatacattgtaactgtctttacacacactagaagagggcattggatcccattacatgtggttgctgggaattgaactcaggacctatggaagagcagtcagtgcccttaactgctgagccatctctccagccaccccttccccccgggcaccccagtttctttctgggtctggcttgtacagtgactgcagaaaatgctgggtagtaatcagtcatattttgaacacttaacaccattaattaggaggagtttggagttcagtggtagaacacttgccttccattcatagagctagaacatagtccaagaatagtccagtcctgtgagggacttctgagtgtttgtgagaaaacagtttcttcaaaaacacaaaattgttcttgggatgtgcttctgtgcccttccccagtggagcaagcagataggagtgaggtgactttagatcattccttacagttggctggctattcttattgttcatacacctccatggaaaccatggttttgctacatgaggcttgtccttgtgattgtgcctttattcagttgactcttagccctcagagtgtaaattgtccgatggctctgaataaacttggctattgcgtgagacatcagctcacctcatttttaggccctactctcaagtccatgctgccaactagagtggtaaacagtgtccagtttgatccctgcaccaccaagaaacaaaacaaaaattagagaaggtttgcctttaatgtactctttacagacagttttaccgaatgagctatggcttttgttgagccagagtcgtgaactgaaatgagaagtccaatacagctctgcagagggtggaacaccaactcctgcacagccgtttcaatccaggtgatctgtggcttctgtcatcatggtgtccttgacgtccttgcatttaaaccacac

SEQ ID NO: 17672 - DNA, 1445 bp, Mus musculus
ctttaatctcagcacttcggagacagagtcaagtggatcattgaatttgaggccagcttggacaagagtttgttctaggacaggcagggccacacagaaaaaccctgtcttgagaaatactgtcttgaaaaacccaaaataaacaaataaatataaatttaaaattcagggtttttttgttttgtttaaccttcaacagaaaggtccagatagcttccttacaaggggttaacagatggaatgttcttttctcttgtagggaactgatggtgtagaatatttattaattcctgttgacagcggaatattggctgatttcttggagaaggaagaggaggaggcataggctgtctcttatccttgaactttctgtggaagcctcattgtggcccagctgctgctcctcagtaagaatgctggtttacatccaacattaggtcattctctccagcatacaagatgttctatggaagaggcatagcatcaatttgaactttgattagcctggctggtgtactgtctctaatactatgcagtggtcgttgagttggataaaagtgcctttaatttattacttctctggagacttcttgctggttgtacagtgtgctcagggattctttggaactggatggttttgggttattttatactgaatgctatccctaatttttgagggcaatttaacactccagagctgaattactacaagtgcacttgcttcagacggtcagaggacaagagttcagagtagcgttctcacgggactgatgaggaaggaggtgtcctgcttctcctgagatgatggtagaagatgtcagtggactgagatgacacagccttctccttgtggacttaggccacacatgctaaataaagacagccagcactgttcaaatgagatcacgggagaagtacaagggatgtgtgcatatgtggagcatgtgtccaatctagaaagcatatttaaaatcgttggtatcggtaccaggagaagccaggctaagaaataaagtcctgatttacattttattgttttcagtacagtagaaaataaaaacatttcatcattcttgtacattgacattttctattttcttaaatagctcacagggataggtagcgcacacctttaatcccagcactcaggagtcagaggcagacggattgcttctctcctttaagacacaagacctgagctcacatttgtaataccaacatcaagaaggcagaggcagaggaaaacatgagttcaagacctagactagttagtgagttctagaccagtctaagctgcggtgatgtcctgtttcaaaaacaaacattcagtaaataaatacacattggtaacatgaaacctgctggtctgcactttgcttgtgtggaatgtggtatgtgggtgtctgtgcagagactgagtaagatgtcttctaccaccttctgcc

SEQ ID NO: 17673 - DNA, 1220 bp, Mus musculus
gaaaaaatattaatttgccagttgtattatcctgtgtgacagagtaagttgcagttggtaaggtacttttgcacttctgtgatgcagatcctgaactctataactgaagatgtcctcagtcatgtgggtactttccaaagtgttctggatcagcgggactggataataaacagatttaaagaaggtaacacaaagtacttcatctgtagcatttagtgtgaagttatatactgcattgctatatttaattattttagacagaaaaaatgaagattattttaatattgatactctggtcagtgccaatttagatttctttaaaataatttgtcttccctattacacttatgtggtctatgaatttcctctagctgaaaggagttacacctaattgtcttaactctgtgtggcctttttacttctgaatagttttactttttgttttctcagtggtgtgaattgcctgtaacagatttgtatttttatgatgtttaatattgtgtgtatatgcttgtttataagtgtgtgggtgggggcagcagtgatcacacttgactgtacttgtgtatacagaggccagaggttgacatggagtgccttccttaatctatcttcctccccacctcccgggtttgtgtggtctctcactgtagcactgagctaagaatttagctggctgaccatcaagcaccaatgatcctccagtctcatccttggcttctcagtccccgggatgacaaatctaggctgctacacccaggcttttatgttttccttttgtcatttaatggtgctaagtgttgaactcaggtcttcatatttgaacagcaagcagtttatctcctgagccatctccccagctccagatattgttcagttatttttttaagagttttttatgtatgtgagtacactgtagctctcttcaggcacaccagatcagatcccattacagatggttgagagccaccgtgtggttgctgggaattgaactaaggacctctggaagtgcagtcaatgttctttttttttttttttttttttttttttttttttaagatttatttatttattatatgtaagtacactgtagctgtcttcagacactccagaagagggcatcagatcttgttacagatggctgtgggccaccatgtggttgctgggatttgaactctggaccttcggaagaacagtcgggtgctcttacccactgagcc

SEQ ID NO: 17674 - DNA, 1220 bp, Mus musculus
gtctatagagtgagttccaggactgccaaggctacacagtgagaccctgtctcaaaacaacaaacaaaaaatgtattgttcttgggaagagaagattggccttcaaataatgactgataatggtttgtattacttttaattttattatctgaatacagtgcaaagataatattccatttgatgttaaaaatattagtatgaggtttatcatgtttttttacactgaatctttttggttctaaaaactaggctggctaacattcagtttaaaactgattagatgaaactgttttagcagtgtacagattttactaccttggctttatgtactgtgatttctgtaacaggcaaacagaacatcccattttcattatttgtttctgtaaaaggacagatatatttgatcagcctattgttattgttaacctgtatcaatttatagcttggtataaacttcccaagtattgagaggattctgctggtgaacattatgggtaggcatataagaagtatgatctttattaagagatgtctttcaacttaggactagtgaaaaatctttttttgtttgtttcagagctgaagaaaaaaaaaaccaaaatgcacatttaagatcttatgtactggtgcatgtgagccattatcttgtcttattgaatggatcgatgctgttgattgttgaaatgtgaaatgtgtcactgttgaacttgtaaatatctgccagagatgaaaaatattttaatttattgtaaataaagatgtataaaatttagtatccgtctgcaatgcagaaataaaacatctcagatgttaaatattgtgtctcctgagggatgtgtcattccccccttgatgtatctagctacattaagaatgtaaaatttcttttgtacagtataaaaatacagctttatttggcttttaactggatttccctgagttgattgtatcttaccttagttttatactctaccatagtcctttcattgtattttcaaatgtgattttacttatgtgtctgtttttatttcattttgaagcagaatctcactgagtaaccctggctggcctagaacttgccatgtagacaaggctagcatataactcctagagatccagctgtgtctgcctcccaccatcacaccttcctaggtatatctggacgtttacattacattaaacttatatgacaccaggaaataacacaaagaccaaaaact

SEQ ID NO: 17675 - DNA, 1145 bp, Mus musculus
gttcacataatctatgaactatgaagataactggatcatatgttttctctctaaccaggagtgcctcagagattctgctatgactttgggcttctctgagcctgtgcaattttatattcttgggaagcatgggggaaagtggtagactactgcaatttttttattaaaatgaggctaactgccccccttactttatcccaaggacacaaatgtttaattattgaggcatttaaatcaatttgtgaccacctccattggagggtagggctctaagttgattgtgtgattgataatgcactttctcaatggctctctagtcattaacaacaggtcttccctcctcccacaaggacttaaggacatttctgcccttaaagtttgaactaacaaatcagagactcaaaggggcgtgttctatttcccaggaatgattgatattatggtgctggggctttgttgggggaagggtgttgtttgtttagtttgtgtgagattgtaaatgaggtgaagttataattgttttctttcttcctttcctttgtgagttggtgatgactgaagtagacactgtacgtcttcaggtaaagagagggatttctcagtccactctctgagatatcagactagagaaaccctttcagctgcttcctagatgtacctagattcagtcagatatgggatacagaaacctaaagtcctgagatcatatactccaaggaaacacatcagggacaggtgattggttgaaaacactgatgcttctatgtgacacatttgtatagaacatttctaccagagggtactgacttgattgctctacaaggaccacactgcctttgtgtttattgcagtttgtgtatcttctgattatctgcaaagtttctcgtttttataaaacgttgaaatcatgccagtaaactagatgttgaatgtaaatgagtagcatttggtaactgctaagaggctacaaaaatgcattattagtttaaaggatttttgttgtgatttggttggataagactttcttataatctcttctgggtctcaggctttgtttgaaaaagaagggaatatattaggattttaaaaatcagtattgtgtgacttcaattgctatgaattacccatctcaagaacatcagtta

SEQ ID NO: 17676 - DNA, 1202 bp, Mus musculus
gaggcagaggcaggctctctgtgagttcgaggccagcctggtctagagagtgagttccagaacagccaaggctacacagagaaacctgtcttgaaaactgaaaataaaattttaaaaaaagttacgcagactcttctgtattgttctgctttataatagcacaagagatatgaagtcatggttcaaaatggaaatggtagcttgagaaatccaagctcaagactagcattcatcatagttatgaagttgctttttactgtcaaatcagaagcttggatcatgcattcagtctttgagaaatctaagataataaattctgaagaacccagaactctcctgcactcatagacagatgcatgttaaggcctgaatttgttatattctgaagcatcatcaggtgtgctaccaagatattatttcagaaaatggccatacactttatttaatatgaattgagctttggatagtcttaaaatcaatgttgctttaaagacataaaagtcctagatatacattctagaggtttaattttacatgtcatggctacctttattgcaatttgacttttaaactctacaccaatgatactgcttttttttctttttttaatcttaacagatcttaatcactctaatgcttcttccattttgagccctccactctgtgagtcccctttgtccattttatattttctttgatttcatctctagccttccacttttctgagacaggtgtgcaagtgtctgagtgttgtactgtctcccttcccgtctgcctgcgagtgtgcaggggttaagatgcacaagtcctgagatctaagtcaggtccgggactgcagtgccaagcactttacccactgacccatgcctgctcacttcatttctttaaaacaaaacatgaactttttccagtctaccttctattatctagctcatttttctgtcatcattcgcaaatggacttataaataattttattgcttattgtctgtcttattgtgtccatttcttgatctaactttatttcttctaatcaagttagaattaggattctgtttcccccaaaatgctttctgatgttttcatcagacagtatgtctcagtaattatggtcagccctgtatgcttagtttaggaaagctgtcagttatttcataactttttaagccaaagatgatgatttttatcacttttgatgtaaat

SEQ ID NO: 17677 - DNA, 1392 bp, Mus musculus
tttaacctagtgagaggagccttttatgcccttaacagaactgatccaagcgctactgaggactgctggctatgcctgtcctcgggtccgccttattatgaaggaatcgacttcaatggagatttcaacagaaccagcagccatacttcctgctcttggggtacaggacaaaaactgaccctgactgaagtatccgcgaggaatccaggtctctgtataggtaccccaccttccactcacaaacacctatgcggacaaattcagtctgtgtccagaacggaagctaattactatcttgtaccttccccagttggatggtgggcttgcaatacaggacttactccctgtgtatcaactaaggtttttaattcatctcatgatttttgtgtcatgatccagctgttaccccgcatatattatcaccctgcatccagtttagaagaaagctatgctgggcggcggtcaaaaagagaaccaattactttaaccctggctgcattcatggaaataggtatggcagtaggagtggggacgggagtgtcagctttgatagaaggaagacagggaattcagtctttgagagatgctgtcaatgaagacctagcgacaatagagaagtccattgacgctttaaaaaaatctttgacctccctgtctgaggtagttttacagaacaggagaggtcttgatttgttgttcctaaaggaaagaggactgtgtgctgcccttaaagaagagtgctgcttctatgcagatcatacagaaatagttagagactctatgcagaaactgagagaaagattagagcgaaggaaacaggaacgggatgctcaacgggggtggtttgagtcgtggtttgaatcgcgaccatcttggataacttctttaatttccgctgtagccggaccaatccttatgatatgcttagctttagttttcggcccttgtataataaatagaggaatggctttcatccagagtaaaattgatacagtaaaactcatggttcttcaaaggcaatatcaacttatagttcaggtagatgaagagttaggggacaccaatctctaaaattctatgattagaattagtctaaacagaagaagaggggaatgaaaggaaataaaactgtaattcatgtaatgtatgttaaatagcccaaagagttgtttgtgagctttgaaacctggggctgagaacatagcagaacagaccaggacatgcccgggcaggcccatcgcctccctagctcccacccctttgacctaagttaaatgttacaggctgctgatgtttaaatgggccaatcatgtgaaaccgcgccaattcctcccccagccccactccttttctataaaaacccctagcttccaagcctcgtggtcgaatcca

SEQ ID NO: 17678 - DNA, 1665 bp, Mus musculus
agagccaagacttcttttcctctgatttctttaacaagctgaaaagcaagtgaggcctgaggctggggtttaggccttcagcctgtggtgcaggcctcacgctgttggggggggaggggggcagatctgtgctctgaggtggcaggccatggtctgcctctgcagctgacatggctttgtctccgtggggttgttcaagcacctggggaggagataaggggcaactgttggttttgtttgtcaaggcagaaggtcctttacttggtcctttggtgcttaacttgcaaatattttgcttcagagaaattcttttctgccagggagttttgcctttctctcttgagcctcctccccaagaagagatgctctcagagggttagaaaagccagcctccacacagtggtaagagcatatgagttttctatatttctagaatctttaatacaacttttctaaatttttcagaagcaaagggtggagagagatgtccctcccttcgccaccttcagccccttcgtccagactagctgctgtcaacagttcatcgcacacatgcacacatttatgaacgactctgggttagtgagtgaccctgcctgaagcaggcaagcgggcattagcaagaattctactggttaaatttcctaaatattccaattcctgttttaaaaacagcatttgcgtttctagtctataaataactgagtaccacctccctcagcaggaccttaaagctttgccttggttcctgaaaaaaggactcttcctgctacttggacagttacagcttctaaggaaggaacagcacagagtagggaagcctggggctaaggggccagtaaaatgttaaataaccaggtttacacaaaggacagaaaccacactactgagttagagattgtggagttctgtggtgacaataattctgtccttctgtcagtgcctaagtggccactggaagcagagttttgccttggaagccagatgaatatggccaattaaagaaagccaaacttacgtttttgaaaattaaattgatcctgatgttctgtcagaacaaattgtacctgtgcatgtttgtcgctgaaatgaatcctgtctaaagctgggccttgctgactttcagtttccacctaagatgatttgggtacagcctgagaatctgttccatgggactatctgcaaaatataacaagaactggaactttccagtaagttcttcctccacaggactcttaactgttctcgttttgtttttgttatcattcagagtcagctggtatgtactttcatgcttgcctgggaaaactcaactgttttttccttcaagattttctgtgatgatttctcaggtactttcaagtagcctgttacctattcagagagtctccttgagctcagaattaaaattgccctgaatttttgaagatccaaaatcttatgtaaatagccattggtagttaagtgggttttattttttagtcttgtgcttgcccttggtctgacataagtgatcagactgccaggagaagatgttagagaagctcactagagcctaccatctgttgaaggcacattttacacagtattccaagcccctagtgcataattagtagtgggtggttctcacatcagcttgacatctggagttagggttgtccgtct

SEQ ID NO: 17679 - DNA, 1126 bp, Mus musculus
gtttttttggtgaatggctgccacaagacctttctcttctcacacgtgtgttaggaattttaaattgtgaaagcatttatcaggtggatcttgattttgtgctttgggggctctttttcattgctcaccatcctttatcaagaggacacctggatacctctctgctgttcgtactaaggctctctattgtgcttacaggatttacatggatataatgtgaagtcagatatttacagtgttgggatcacagcctgtgaattggccagcgggcaggtacctttccaggacatgcataggactcaggtaatgctccagaacttaactgtgacagctttcttaggtccagataacttctattgaccatgtttattgtagactctagagctttattagcacttttgtgtacatgttttacctatagatgttttcctttctcctagatgctattacagaaactgaaaggtcctccgtatagcccactggatgtcagtatttttcctcagtcagactctagaatgagaaattcccagtcaggagtagactctgggattggagagagtgtgcttgtctccactggaactcacacagtcaatagtgaccggctccatacgccatccacaaagacgttctctcctgccttttttagcttggtgcagctgtgtttgcagcaagatcctgagaaaaggtaatactagtcacctctaagtagcataaaacatacgtgctttacatcttatagtagttttacgatattactcttcccataaaattaacgtatcttgatcaagaaacttaatctgaagagtgtcagtgctaagaacaagtccaagtaatgagcaggtatggagagcagttgggctccttccgtggccatgccacgcccagctgagctgcctatgccacgcccagctgagctgcctatgccacgcccagctgagctgccataaacaaatcagttcttagtgtgtctgttaaggcacctttggaaactcctaagaagttaaaacagttttgtgtgtgtacatacacacacacacaaacacaataatgtacacatacacacattttctgatgttagattttctaataacttttccaaaaatttcaggccatcagcaagcagttt

SEQ ID NO: 17680 - DNA, 2385 bp, Mus musculus
aaacaaaagtgtctccctgaggaaaggcctaactgtgaagccagcagcttttacaggcaaagccacagaaatccgaggttttcctttggttgttaatttggttgagataaacattcctttttaaggaagagtgaagagcagctttcatacccattcaggcacacgttctgacttggataaaggaaatgctaggagttttgttatttgttttaaacagatttaattcagaacacatgatctaatagactcgtttgcttaatgaaatctcctcccattctacgcccccataacccaaattttgatttttctgcccccttccttccgtccaatttgggatttttgctgtttttgttttgttgtgttttgtttttcctccagacagggtatctctgtgtagccctgactatccaggaactggctctgtagagcaggctggctttgaactcacagacatccacctgcctctgcctctcaattgctgggattaaaggcatggtccaccaggcctggctccccttcctaatttgtatctttcaagacataacgctcacattagtaaagataaaagacaaaaattttaacttaaaggtttaaaagcattttgccctcattttcttgttctagagatgtaaacatctatctatcagacacatgagctgaccctttctctctctggttgcatgaggcgagggcaagaggaatgatagcgaaggaagaggagagtttgagtcaggtttcaagaaagtcattaagggaaggtgaacttcaaagtgattctggagttctttgaaatgtgctagaagacttacatttattaatcttaaatcgtgtacttctctttttttccctgcaatagaagtctggttctttggcataatgtaaagctgagcagagcatcatgggagttgacctttaccctacctttgacactgactgtcctccaattttgcaatgttcttcagtttctcagagcagtttttaatgccagccagggggggattgtcgggaggacagattacttcatatgtgtcctgttcagttgaatggagctgcttttacaattaaagtgatcttgtattttttaaactttcaaagtgatctcacctgtcagaatttttttaagctgccactacacaggtttggcatcttttgtgttttatctctttaagtgcatgtgaaatttgtaaaatagagacagtgcagtatgtatattttgtaaatctcccatttttgtaagaaaatatatattgtatttatacatttttactttggatttttgttttgtttacctttaaagatctacaatgaagccccactttatcacatgtacagatcacgaataaattttttaaaaaatacaaagtgaatgtttatttactcttcctgagatagtaaccaaagaataaaacttttacgtgggaaggaggtggagcgagtgtgtggggtgtgtcctgtcacatagtaccttagcgagggtcacaaaagcttttgggtttgctttgttctcattcttgtttcctgtttccaccaccacctccttatttacctctaagccagccgttctcaacctgtggattggacccctttggggggtcacatatcagatatccttcatatcagatattcacattatgcctcatgacagtaacaaaattacagttatgaggtagcaaggaaaattgtatggttggggtcaacacagcatgaggaactgcactaaagggttgcagccttaggaaggctgagaaccactgctctaacagccttttcagggaagcttttgaggaccgactagaagtttagaatccaagtctgatctgtagtttactaaccttaggaatctaagctcgggtttgaaaggactagaagatatttttgctatttctacttttcccattgattgtcttgggaaatgtgtgtgttgtaatgcaccttatctaaattattgatatttaaatgctttgaattcaggtgatagggaaaagtttccatgcttccagatgagcgcaggggtcacctttgtgcagaacactcagctggaggcttccctgaatcttctaggtaaattgaaacaggctcagcggctctccccaggggcagtgactcagcagctcagcaggactagtctccacgcctgaccccgagctggcctcggaagacactgctctcctttgctgcactcagagaggctaactttggaatcagacgcgcctgggtagcccctcagggaaatggtgaaggcgtctcagactcccagttctaagcctgagagtctttccatttgcttcttgtttagttcaggtgctgatgatactgtatgctctccccagagcaggcgctgcactgctgtctctcccattccgccacaggctggaagtttctgta

SEQ ID NO: 17681 - DNA, 1388 bp, Mus musculus
gcactgggattaagccacacaccaccagtctttctccagttttttgagacaatctcatttagccaaggctggtttggaactaactgaagatggccttgaattccttattctcttacttaactgcctaggtgttagcattacagagcaacacttttcaactttagaggcttattaattatagatgacatgtttcttcttgtaccttaaaatagtggccactaattgcagccaatataaaaataatgcatttttcttttcttccagctgggaatggaggaagaagatgtgattgaagtttatcaggaacaaacggggggtcactcgacggtttagataattctttttattttttatttttcctttccctcaatccttttttatttttaaaaatagttcttttgtaatgtggtgttcaaaatgaaaattgaatactggcactccatctcttagaacatatgaattctagtgttcaatattcattattggttgtttttgttgtgctgatttttggtgatcagacctcagctcccttaatactgccctttttcctttaagagatttcatgtgtgcacagagaggccacccttttcaggactgtgcattttcaggtttgtgatgataaaaagatcgaccaatgggagctttcctatgacctttcaattggctctgaagttccagcatgtggttgcttcactcctggactgtgattttcagtgggagatggaaatttttcagagaactgaactgtggaaaatgacctttcctcagcttgaagctacttttaaaatctgcgggtctggaccaaaagaagaacatcatgtttgtagtcaagatgacagatacagtgagagcaacagctaactccaaaggtggcttcactggagagaaagaaagtgtcttgagcaagacagtattgtcagaagatcccaggaaagttctaatgttcatcagcagttattaataaagttactcatacagaagtgtacgcaacagacactgcttttgattctgtttgtactttttggcctgggacatgggttttcaagggacatcgtctgtaccagcttcattaaaataaacaatatttgtaaaaacattactgaagctccttttattttagccatgtagggagaaaagtggaaatgccccagataggattttcttgcatgagtatttctttagtactatacagtaatgactttaatggctttgaagcattaaagtttctagaatgttttctgaatcaagaatttagttatagtcacaatgcctttttaaaaactcactgttggggttggtgagatggctcagcgggtaaagagcactgaccgctcttccaaaggtcctgagttcaaatctcagcaaccacatggtggctcacaaccacc

SEQ ID NO: 17682 - DNA, 1179 bp, Mus musculus
gacctagtggaatctagtgttagtctagtatagagattttacacttagaaaaagtatgtttggggctggagagatggctcaacggttaagagcactgactcctcttccaaaggtcccgagtttaaatcccagcaatcacatggtggctcacaaccatctgcaatgagatctgatgccttcttctggtgtgtctgaagacagctacagtgtacttatgtataataataaataaatctttttaaaaaaaaagaaaaagtatgtttaagggaaggactattgtgtatgctggattaaaactaaaattgggtaatacagaagattacaaactagaaatgagctggagagactggctgctctttcagaggacccagattcaattcccagtactcacatggcagctcacaggaattcataatcctaattcaattggaagggatctgatgctcttgtggcccttataggcattaggcctgcacatggtgcatagacatacatctagacaaaacacccatatacataaaacaaaaatttaaacttaagctaggaacatgaaatgcaattttaattttaaagagctttgtgtgtgtgtgtgtgtagtactaaggattaggcccaaggtctttcacatgctaaacagacactttatccccagcccaaagaaaagaataaagaaagtctctttacaaaaaggtagatattaggaatcagtgtatacagtattagaaggcagaagaaaatagccagggttctataaaaccctttcataaatgccaggaatgatgatgcacatgtttatcccagcacttggaaagctaaaggcaggctcacaaatttgatgccagctgaggctatagactgccctataaaaagaagctgaatctttttatttatttatttatttatttatttatttattctatgtaagtacactgtagctgtcttcagacactccagaagagggcgtcaggtcttgttagagatggttgtgagccaccatgtggttgctgggatttgaactccggacctttggaagagcagtcgggtgctcttacccactgagccatctcaccagcccaagaagctgaatcttaacaaacttatttatttcagagtaggatctcactttgtatacccagctggctttaactcaggttgccctgctttttcatgcctcccaag

SEQ ID NO: 17683 - DNA, 1209 bp, Mus musculus
agagtttagagattcttgggagttgtaggagatcagtcaatagttgtaggagtattattacatgttatgtggccttatatacaccacagcattcattgtgtcagaggcaacttatgtaaatctcattccttgtttcatcttgtgggtcttggtgattagactcaagttatcaagataggcagcaagtggctttactccctgggccattgtttgtctttagtttgtttgcttggttggaaatggattcttactatgtagtctagctggcctatgaagatcatactagccttgaactgcagcatccacctctagattgctggtattaaacctttagtacctggctccatgggtaaagggtataagatactcaatttggaggatattttaaaaagagatgggtataatggttatatggcataaatgtactttatacaactaaatttttacttaactgctttaaggcaatctgttgtgtatattaactactattatcagtctcattagttctgtttttatttccttttacagccttattagatgacttggataaagaactaaacaactacattatgcggtgtagggaatggtatggctggcatttccctgagttagggaaaattatttcagataatctgacatactgcaagtgtttacagaaagttggtgagttgattgttatagataaaaattaatttgataaagctcagtaggtattgtattaaatacttaagattattgaagttttttaaaaattacaaatggaactaacatctattatcttaaaataatttgaacatttactttgtggtttggtttgattctgcgttttgaaacagtgtttctttgtgtagctttggctgtactagaactcactctatagaccaagctggcctcgaatgcaaatttgccaatctctgcctccagaatactggtattaaaggtgtgtaccaccgctgccctgatcagttttcttttttttctttttttaaataatcatggcttcttttgaatatctaactttgcaaataacgggtaaagtcaatatcctaatgaatccaactgaaccagatagccaagattattgtttattacctaatacataaaaatgttgcttttagctttatggtagatttttaaagttacagttatttggccatatactgggaatactgagtatggacctggccagatttaataaagcttgcttca

SEQ ID NO: 17684 - DNA, 1159 bp, Mus musculus
tatataatagtaaattgtatgcatatacaatgtactgaagattttctaaaaaccagatttggaggtctaattttgcatatttctgtgtgtttctttagatacttaagtaggatttaactagaatacttaagtataactagatacttaactagtatatacttaagtataactagaatacttaagaataactagatacttaagtaattaagtaggattaaactagaatttcatgaaatccacagttactaacacaaaatagtaaatggacaccataaatgttaaaggagcagcttctgagtcaaaggtaggaagggatagagagaaagactgaattcgactttttattaataggcatagaataaatgttaatgtgatttcctataatattctcctgagtaaacaattgaggattttacgttttctgaaaagaatcaatgctgcctctcattttatgcttttgttgatgatagatttctcgaatgctggcagccaaaactgttctggctatcagatacgacgcttttggtgaagattccagttctgcaatgggaattgagaacagagccaaattagaggccaggttgaggattttggaggacagaggggtaagaaccacattcttcctgtggccaatgcttgctgactgtcttcatgagctataagcatttcgtgttaacaacagcatttcttatttcttagataagagctgatgtgctaatagtattagtcattgacacatgtttattcaaattagcaaaaccattatcacatactatggcatgctatatgcagtagaagatgtgttaccggttttgatgttattttcatttttctttttagataagaaaaataagtggaacaggaaaggcattagcaaaagcagaaaagtatgaacacaaaaggtaaagtcatttaagaataaagaattggttttgttaatttaaatgttttgacaggtgttttttgttttggggggcattattattattgtaaacttgagacacagcagtatggactaattcttatgaaatttggcaaggggctagagcgatggatcagcatttaaaagcatttgttcaggtcatcttttagaggacctaagtttttgttcccagtacccatatggttgctcacaaccagacacacttgtacatatatg

SEQ ID NO: 17685 - DNA, 1623 bp, Mus musculus
ttttaattcatttatttatgtattattttaaacgtaggagtgttctgtctgcatgtacacctacatgctgggagagggcctcaggtccttgtgagccacattgtggttgctgggaattgaactcaggacctctagaagagcagctcttaactgctgagctatctcacaagccctcaaatttagtttcttaccctgaaacagtttactgtgctaagaattgaacctaactaaaagctttatgtatgcaaggtaagtactgtcaccatgcccccaactcatgatttactgaagcttgctttgttgacattacagttttagattttttagtacaaaatttatgttctaaatatatagcgaaaagttcattttaaaatggccactatttcaaaaagatttcttcttgattattttcagagtccagagaaaaagaagaaaaagaaaaagaagaaagatgctgaagactaatgtaaaggaaccatagccctgtccccgaacacatcatgcttacgattcagttgggagcagagcacatcagatgctctcaaataatcaagggaggttgaatatctagcttttcaagcctttttgtgtcttgacatcaactgttgaccttagtctttgatacacaaataaaatattttctttgtattataaggcagttttgtgatctctttatattttaggcagagaatctttagccctttctatgttgaacttaacatcagactaggtattgttattgttgaaaagtgagttgccgggaattggaaattccaaagttttaaatagctttttggaaggtggtgattagacagaccaatttaagatcttatgtttcccttgccttctcgagttttaaaactgagaacattctgctatctgcttcagaaggacgaaggtggttgtgatttttatcattcactactcttgatgtgtggtttttgagacaaggtcttattgcgtagactcactgtgtagccaagagtgacattgaacttcctccacagagacaggattagacttgtgtcacttggtgtttgtgctggggatggagctcacagcctcacttctgaactatagctttagttccctgcctgggccatgtgtgtctatgtgtctcttgtttttcttgcatgtgtatatgtgtactgcttatacaccttagtctgtggagttcaaaagaatccattgtttaacctggatggttgtgagtcagtatgtcacccaaggtccactggaagaaaatcagctcctgtattttttacaccaaaaagattttctctgaaagtaatacaaggtgattcataacttaaataaaatacctaattgaaacgttaggttttcttagctactttggctcgtgttttaaggggatttggtcagaattgttggtcattgttttgggttactttgttttcctctcacaggatctcatgtggctctggttatcctggaactcctgcctccaagtactggtcttaaaggcatgtgcacccacgaccccgcctatttgcaacttgtttaaggcttgtaatcctaactgcctagcacactaaacgaaagacatggtatgctgtctttgtgattaattttgtgtctaactttaagtactatatttggact

SEQ ID NO: 17686 - DNA, 1185 bp, Mus musculus
gagggagaggcagtcacatctgagtttgaggccatcctgctctacacaacaagttcaggacagtcagggctttaaagaaaaacttttatctccagaaaataaataaatgaaactacatttttctttttctatctggagagatggttccacagttaagaatgcctttggctcctccagaggaagagtttggtctggcagcctagaattatagctctgagagatttgacttttttggcttccacaggtacccacccagcatgtaagcatgcatatgcatatatacatacctataaacttgtttatttttcaagacagggtttctctgtgtagccttggctgtcctggaactcttctgtaggccaggctggccttgaactcagaaatctacctgcctctgcaactctttaattgttgtgttttgaggctgagtctcactgtgtatctctcactggactagaactcagagttttacctgccattctgcaccacatgcatgcctggtgcctttagaagtcagaagagggcattggtttctctggaactggagtcagatggttgtgaactgcaatgtggatgctgagaattgaggctggatcctctgcaagagcaacaagtgctcttcattgctgagccatctctccagcctgctaaatgctgggactttaaggatgtgtgctacaactaacattattcttaatgaaaagttgtgagttgatggtttctacatcatagactggcaatggtcctgtgaatggtaagccagtgccccaccccaccctgtaatgcatctccgaccctttctaatttttatacaatacttagaattatacacctgttatcaccagtctgagtttataactgtgttttctaagcaacagatgcacactgtgctcattgaggttttattgttgactaaactgtagctatgtatgtctccaaaagaactgagtatttgcaaacagcccacgaaccttaagattaccttgatattacctgtcagccctttggaaagactttctgacttcaggctttgattaaaagggatttgaaagagtcaaatacagtgtataagccttgatttatcttagttccatgagaaaagaggtcagatattgaatacaggataatagtaaatggtttggaagaattgtgtcactttttagatgtaataatggcactatagtt

SEQ ID NO: 17687 - DNA, 1192 bp, Mus musculus
actactcttccaaaggtcctgagttcaaatcccagcaaccacatggtggctcacaactatccataatgagatctgacgccttcttctggtgtgtttgaagacagctacagtgaacttacatataataataaatctttgggccggagcgagcagaggtcctgagttcaattcccagcaaccacatgatggctcacaactatctgtacagctataatgtactcatatacataaaataaataaataaatctttaaaaatatttttacatcacaaaaagtcttcgacccattattaatagtttattcattctttaactcctgataatcactaaccagttttatctctgtgaatttctcattctggacatttcatagaagtttaatcaagtaatatttgtcctttcgtgtgtggtttatttcactgaacatactttcaagatttttccattttgtagcattaatcatatgtgtgtgtgtgtgtagtatgaacgtatggaggtcaggttgacagtgtttttctctcattctctaccttatttttgagacagcatctctcattgaacctggagctcactaactgactagactggctggccagaaaatctgtaaggctttctcgtctccatctcttaccagtgaagtgcaggtgcatgttagcatgcccaccttttcatgtgggtgctagagatctgagccaagtccctatgcttccgcagcaagcacttcacttgttgagccatatccttgatcctcgttttatttttaagttcattttaaatatcattacttgatagatacttgattgtttccacttttcagtattatgaataatattgttattaatgactatgtgcaagtttttattgggtatattcctaggagtaaaattgctggtctgtatattttaagtgttagttctttttatatgatggacaccccaataggaccctctgcattctgtcagccacctttatttatactttgaagcatgggaattacagattttgataaagcaatttttttttttttttgtattttcaaaactctgtgtagcctggctgtcctggaacttgctctgaagaccagactcgcctcaaactcaaagagatcctcctgcctctgcctcccaagtgcagggattaaaggcatgcaccattactgcccagcaaagcacagattttccattctaccttct

SEQ ID NO: 17688 - DNA, 1237 bp, Mus musculus
gcaggttttcactgaaatgcattatctggcaatgaaaaattccaaacataaaaaagttgtgtctgattgctttttatttttatttattctttttttaaaagtagattctttaaagtagaatcaatagatcataaaaatgtatggttatgctctagattaaaattgctaagtttttccaaaattaccatcatacacacattgattacagaactgtatgcaagtgaatgtcactcagtctttgttatgattgtattattattttaaagttaaggacaatgtaaatctaaaatagttggactttgctgtttcttcagtaattcttatattatggtgcagttaagcataattgttttgttgtttgcttttccctgtgaaatgtctgtggtaccgtttttatttaggtttctttatgactacattagttttataagactgcaggtatttcataattagttgttatatttaccatattgcttcctaactaactttaatatcgatctgtaggatgttggtctcacatcggtgatccccaagagtgccactatgaagagtgtgtagtaactaccaccccaccctcaattcagaatggaacgtaccgcttttgctgctgtagtacagatttatgtaatgtcaactttactgagaactttccaccccctgacacaacaccactcagtaagtatttacagtaatttctttataattccttgttctagaagttttgaaaatataaatagataaacattcaaggttagtaaaattttctctaaaatcttcaaagtaagataccaccaccagcaaagcattggtatatttattatcaacgaaatctgaatcaagatacagttttccctttgtctggcatgatggtgtgcggttgtaatctcagaactccagaggctgaggcagaaggattgtaaactcaagacagcctgagctacctggtgagttcttaccagtctggactacataaaacaccatacctcagcaaacaaacagaaaaatctaaaacccacttaaggaagggaatttggtgatatcagatgtacatgatggcacatgcctttaatcctgacacttgggaggtagatggatctctgtgagtttgaggccagtctggtttgcatagcaagttctaggccaaccagggctacacagtgagaccctgtctgaaaaacaaaataaaacaataataacaaaaggagagaggagagagatgggggttagggggtggggg

SEQ ID NO: 17689 - DNA, 1102 bp, Mus musculus
atattgaagactctatccatcatactgacagcattgtgaagaatatttcctctgagcattcgatgtccagcacaccattgacaataggagaaaagaatcgaaattcaattaattatgaacgacagcaagcacaagctcgaatccctagcccagaaacaagcgtcacaagcctgtccacaaacacaaccaccacaaacaccaccggcctcactccaagtactggcatgaccactatatctgagatgccatacccagatgagacacatttgcacgccacaaatgttgcacagtcaatcgggccaacccctgtctgcttacagctgacagaagaagacttggagactaataagctagatccaaaagaagttgataagaacctcaaggaaagctctgatgagaatctcatggagcattctctgaagcagttcagtgggccagacccattgagcagtaccagttctagcttgctttatccactcataaagctcgcagtggaagtgactggacaacaggacttcacacaggctgcaaatgggcaagcatgtttaattcctgatgttccacctgctcagatctatcctctccctaagcaacagaaccttcctaagagacctactagtttgcctttgaacaccaaaaattcaacaaaagaaccccggctaaaatttggcaacaagcacaaatcaaacttgaaacaagtagaaactggagttgccaagatgaatacaatcaatgcagcagagcctcatgtggtgacagtaactatgaatggtgtggcaggtagaagccacaatgttaattcccatgctgccacaacccagtatgccaatggcgcagtgccagctggccaggcagccaacatagtggcacataggtcccaagaaatgctgcagaatcaatttattggtgaggataccaggctgaatatcaattccagtcctgatgagcatgaacctttactgagacgagagcaacaggctggccatgatgaaggggttctggatcgtttggtagataggagggaacggccattagaaggtggccgaacaaattccaataacaacaacagcaatccatgttcagaacaagatatccttacaca

SEQ ID NO: 17690 - DNA, 1515 bp, Mus musculus
aaatattagccttttccattttatttttctatgtatatgtcacgtctgtattcattatttaagaaatattttttattagaaaatgtatagagctgaacctacatggaatttttaagtaagtagctgggcaaggtgactagtatagtaactttcattctctgaccatcacaaattaaattacattttctatttataataacttcagaagtaagtgatagttgatttgaatctttaatacgtatggttcgttatttcccagcacagcctgacagttctgtgtgaaaagaacgatccctccccccgtgacctaaaatactatggaaagctcatcctcccagcatgccgattcctgtggaataaaggcttgctgcaaacttgccaccagtgcgcagaccaggattgaccctctgtctttcctaagtttatttcttcactaatcctggctttgtagtgtccccttctgccagtttcatgtgttctttgactgcgagcagcattcactgtgtgtgttgtagtagagcatacttctggtgatgatgcaccgtgacgttgctgtcacgtagcttctggtgctgctgtaccttgatgttgctgtcatgcggcttttgcttcttttgaaactaatgatctctgaaacaacagtctctgtgtcttttaataaagactttctatcaaaaattgaggagttttccctcaacattgcttcttatcagtttgcagacaaattgttaccatgtgttttcagattctcagaatccttaatatccgttatctgattacgttttcaaatttagcaggaagataaaaagttaagtgcaaatctccaaattcctgattttggttcttctgtcttgaacaccgtttccttgtctataatcctctctccttctgtttaactcatacacgagcttccttcacttaccgtctgctgtgctctgacgtcacagcatttaccgtttggtcagctgggatgctgactggagctcagttcttaggattaagtttatctcacttgtgcccaggatccctttctcacctttgggtttcattggccctcttatggttcagagtcttaatatatatttttgtcttctaacattcagttttttttctttctaattagttactgtcctttgtatatttaacaaataatttgtatctttcacttatttcttttgtccaaatggctttcaaatgcattttagaattttaattttcagttgtaggacaactttaaaataagttatattcctcccatctcccaatttgaaatattaagagtaaatgaatctttgaggtccaaaagatcttttcctgtcagaaaaattgtcctacattctgatacagtttgtattaggaccagtcaattgtgaattttccaagtcttttaatgtttattaacagaatgctttaaaaatgaatatgccagataaaagaaatctgtagtttcccatctcattaaaatatatataaaacaaataattcctcgaactgcttgaagagtaggaaaggtag

SEQ ID NO: 17691 - DNA, 1244 bp, Mus musculus
catatacatctgcctgcctgaagaaggcatcatatccccctatagatggttgtgagccaccatgtggttgatgggaagagcagcctgtgttcttaatctctgagccatctcaccagcccggaattacaaattttatttaaaatatttccaagtttggtttctgaatctcagaggaacacctgttatggtatcacactgcacttttactctgttagtcatttaaaataggaaaaagaaaataaacatcagcttcctcttaatcataatcatgttcatggacataaatatttcattgcaagtcactcacttctagaatttgatgttacgtcatatcacattttataaacctatgttaagcttatgtatatgttattacatgactatccagatttttgaaaatatataattacattatttccttaactccttaaaatattctgcacacattctaattctactgttctagatcagtcagtcattctaggaagtgtgtaacacccctcataggccctagtagtctctcttagtctataatgttaatagtcacacccttacctagcagtgggttgtgtgcattgtgggttttttttttttttcagattatgagctatgcaaacttcatccaaaaactaccttacatgatcccttcctaactgtgctcattgattatatcagtctagccggttactttctgagctactgaacaaaggctattatcaaaaaaggcttttctgtaagtgtccacattaacccagaggaaatctccaagtgcccaaagaggtggtaacacctacctgttcctctctttaagtttctcatggtttatagagcctgtccctttactatctggcctgcagtcatatgccaggaaagttttctccatgcctattctgtctctcttgtttgatctaaggtctgtttctcatacctagtagggagaagagatggtcatcctatctagcactcttcagtcagcttcaggcttctcaacaccagatcaccagatcaaagtgttccacttccttcaggtttttttcttcctaaatctattttaattactttatttatatttaaagcactaaaattctatgttatattcaaattaattactccagttaatttatagcatagtagtttgatagaattgagaataaagatgttaccattgaatttaatcaccagaccacctgaaaatcagcacctaatttttgtattatctaacattcttctattaaagtatgttt

SEQ ID NO: 17692 - DNA, 1174 bp, Mus musculus
tggtctgctgtatatttaaatcttagcagtgagttttttgtaaccagtctcttgtctcaggctctctgccttgttatcagtcttaagcatataaaagaaacatttgtaaagatgtataagagtaagaaaactaatgactaaaaaatgcaattcaaagcaattaagtttcaatttaatattgagttgcttcacttctgtggcttttttttccctggtaacatatatttatttaagcaatgttgtatgccttgtcttcatttctatagagattgtattgtatgtgtttgtgtaagctggaatcatccttaattttctgttgctaatttttcaaatgaatttacatgaataactgtaaaatacactaactcttagggtgttatagctgaaacacggagatgtgtagctgccatgctttttctgaatggacaggagaaacataagctaccaagtattcatttctgagggtgctttgtagggaaagaaaggctggcacttcctcagaaccctctgtcttgttaacgggtatcttttgttggtgtgttttgctcttacattacagatagaatatcgtgtgtgagctgatgaataattactttcagttattttgcttttgtataagccatctgagaccttgctatgctgtataagttgtgtgacggagcagtgtgagtatgaaataaagcagatcactttccttttgtattatctatggatgccactatgaacgctgacattaagccactcaagagttttctatgaataagtgtaagtaaatgctttgatatatataaacctaaataaaagattgtattgagacagagacattggcaaaggaagttttaaggcagttctttaggtgtaaaaggcttgctgtaaaatggtgcgttattccacttattaaagatcatattaatgacaacagtaagtgtatttttgatttcatgaaatcttcagaaattgttactgctaatatgatattgtacagactttgcaatagagtcagcacacactatctctaacatgactcttataacagtgtgatactaaaaaaaaggtcaactgagattagaataatagctgctgcttcctagctactacaatacaccaaacaccatgttactcattttatactcagttgacagtttttaccactgccttagaaacgtgttctctg

SEQ ID NO: 17693 - DNA, 1144 bp, Mus musculus
aatgttataatttcattcttccttatagctggatgaaattccactttgcatatatactacatctttatctattcatctggtgatgataatttcttagatatcttgaatattgtagcaaaaaacaaggatgtgcatatatctctgtggtagctggtttaccaccctttggctagcagttttggagtttcaaggcttatattaaaggcttattggttgttgttgttttgtctttcttcatttgtattacgtatgtatacgtatgtgtgtacatctagtggcaatgggcaaattacaccttgttggacgtggtgtgcttctatccatgtcctttcacctaatgggtcctagaatcaaactcaggttctcatgcaaatatgacccactgtgagctatctcactaaagtcttctctctctcttaaaatatatattcatttaatatataagtacactgttgttgtcttcagatacaccagaagagagctctgatcccgttaaagatgattgtgagccaccgtgtggttgctaggaatggaactcaggacctgtgggagcgcagttagtgctctttacagctgagctgtctctccagccctgaagtcttttcttaattgtaaaagatgctttgccaaatgtgagtagtatgtagtaagtgttagcttacacttaccatcacagcccctcatggaaggaagtcacagcaggcacctggaggcaggaactgaagcagaagccgtggaagggagggttgttactgcttttttcattatggcttgctcagtctgctttgttaaacatcccaggaccacctgcccaggatggccatactcacattgggctgaatttcagcatcactaatttagaaaatgggatacaagcctgcctacaggcagattttatggaggcattttctcaactgaggttccttttcccaaatgattctagcttgtgtcaagttgacctaaatctagtcagtgcattcactatctacatcattcacagaggtaaactacatgtaaacttcatctaggataaaaacatgtaagaaatgtcattttaaaagacgttttgttgtcctttaatccagcactcagggggcaggaggatctctgaatttgaggccagcctacagaatgagttctagga

SEQ ID NO: 17694 - DNA, 3830 bp, Mus musculus
tccctgcaaacatgatttctgaagggagatgtgatcgatgctgcaagaaaatcatcttttatatgaaaacgactattttataataccaatgtcacattttctgaaagtaacaaacaagatgttccaatgatcctttggtggcctctgtttcttgtttcctttttctagatattgcttttctcggctgttttcagctttgggaccaaagggattgttgacatttccccagcaatgtcaatctcatgactgttcttctcccaagtaagaattgataggtaatgcattgaaccaagtatatataaaaagataaaaagcaatatttgtacattatgtgatttatgtttttttgatgtcaacagtttgtgatttgagtgaagtatttgtaaactgctgttttctgcactattcctgttcacacttcatcgtgtggtcagtcagtgtgaagacaggttgctttaacagtcagtgagccaaaagaaactctcaagtgtggattgttagctaggagtatggagctctctggtcttctgtgagctgtgtgtcccgtgattgcccttcctcgccgctgtcagtctgactttgatcatcactgtatcatatagccccaagagaccctgaaaaggctgtgcatggatcccccctctgcttccgtggtggtgttgtcttgtggatttggtcagggttagtagtttgccaggagtgtgatcctttgagtagcaatcgggagctgcagaatcttgagaactgactttttcttcatgtgttggcgctgtgatttgctacttacagattttgctagtttcttctccaacattccacacactgggggaaagagaagaggattagagcttagaaaacaggtacctttggaacgtctatacagttttggattcgagctcatctgataaccattgccagtatcacatgacagtatttaatttctaggtgtgtgataataaaattaaggagctgctctttagaaatgaattccatcagtgttggtaaacattgttttaatatattctaacttatgctgctgtgtacaacaggtagatggcaaaccctgcatgagagggccacaattttgaaggcgaattccatccactggtccagtcattccatcatgagaaaccaagaggtagcagtacatcttggcaagctgtttgtcaccttagaatgcctagacagtttaaaatgggctctgcttaattttaaggaaggatatttaggttaattggataaattcagacatctaagtaaaatccatcagtttttggttggaaaaactgatacattttggtacttttttttacccaaatcttaacttcctgggaactagtaaagcatagctccttagtcagtaaaagcctcgggttttggagtgtaggctttttggttggtggttgggttttgtttctcagtttagggtttttttgtaccttgatttttcgccttgtcaggccttttgactttaccattttaccaatatcagaagtacagaagaaaggcagctggcagtctgttgagttgatctgaagggagaaggagacatttaaaagcaagggttcttgttttgtttgtttttgagatggcttttattatgtagaccaggctggcctggcactcagatgcccctcccaagtgctgggattaagggcatgtgccaccacaccatgcttgtcttctttttaattctgtgggttttccccacttgaatgctgttaattgatgttctttttcctttatcttataccatctcatctctcgatttacaaatagagtttactctgtaatagatttttcccttttctgttatacttgtttggcagattgacacctctgcctttacatctatccttgaagtaacagagagggacaggtttcaggtcagcatctgctcctagaagtagaactttagtttgaggtttggttggaagaagattgtgaatttgcaaataaatgaattataaggtgaccaaacattcctgagatctaaagaaaaacaaaaaaggtctatgtccaaaaagaaaactgcctgggccaaagggctaatttttaagcatatgagctttattgcagtcttaacatatattaaccgtagatccacctagctgttttatttaactcttaattcccaggggcttggttttaaaagtgggtctactcttagtagagtgggcatgattacattgacaagccacactccataattaggttattctgtagaaactgtacagcggtagagtagtttcaatgcaaatacagtttttttccagtgctggggatcaaacccagggcctcatgcatgctgagcaagtgctgtgtcgctggcttatttccccagctcctaatttaaaactttaattaaaaaaattttgttccattgcagtaaaagtgggtggcatgtattttttggctaagggtgctgttccctggttcctggcccatcttagttatacttgaccctcaagcagtttcctccctgcagtgattattgcttctgacacggtaagtctgttacttatcactggtttatgggcagttgtgtttaaaaaactagtagttttgctttctttggttaaatatggtatgaatgtcaattttttttcctataccagatccttcattttgtttacagtgtttcttacttagacctaggaccataaccaaatctgcctctctatagatactgttgctaattggagtgtatctggcaacagagaaaggctgctttttatttttattttttaatgttttgattaaagaaacagttagcttttcctaggagaaggtctaaacacagtggccccatggagagctttctctgtctgggattgaactgagatcctgaggttttcttttaggaaactaaagtaaacttgccattactaaatttgtaaagttgagattcactccttaatgctggtgtggggggtgtcaaactggaccaatggaaatgctggatttgctaaataaagccaagatgcatagccctgcactttaaggtttctggttgctctgccttcattagtgaccctgcagagtggctctgaacagtactttgtttatacagtcctgttggagatatataatttatgttttttaaacagtgcatctttgtctctgttgatgtaaattttttaatgcaattttttaaagttacaacaaaattctcccccaaaaacagcatttccagtgatgataagtattgttgtggactgtgtccctgaacctgagcacttactgctttgtcacagggaatagaacttcctatgttcaaataaagtctgttgttcttgagtctttctttctctgtgtgtttttatgaatgtcactgcaaactcacagttcacttatttttaggcatttctagccctgtgtagcttatgtatagtttattctcttacaaggctgttcttggccacccctgactgccttagaactgagtgtagcctatccttataagtacacagcagacatggacacacaaacgcacactgacagggattcactcataagtaatccatgaatcccttgtttgttagagattattaagctggggaaatgagtgttctgtattacatggagaaggttttttttgtttttaaaattattgcaagattgtttggtctcgggtgttgagtctatatgaactagagctggccagatcagccctgtgaagatcatgtaaccacctaggaagaggagccctgcttaataagtgagaggagcttgatcctctcatttgttaacattattaaagtctatttttgagccgggcatggtggcataccacattcccagcacgtgaaagaataagaggattacaa

SEQ ID NO: 17695 - DNA, 1178 bp, Mus musculus
caggggagcccggcccacacagtgagatcaggacagccagagctacatagtgaggcccaggaagaaagaaaagagataacatatttctgtcacttcattctgtttgaatgggtcttatgttaatattttttattatgagaacagaaagttacatacattcttcccacaaacaaaaagaaaacagaaaactgaatacttatatctctaattgtatatttttgctttcttaggtagaaactggaactattaatatttttgagtatttaaataagtagtttttaaaaaatggtatctaaatgagtttaaaaatgtatttgtcttctaaactcatgtatagtcacaacatgtcagtgttggctaaaggtgcttagtaccagtttttgaaaactatgtttacatatttaaatatttaattctttacaaatgtacaagatcttaaacaaaagtgtataaaaatttcagtatctgtatttggcgttctcttaacaactccacagcaaaatttggcaatactcttttgttcatgtattacaagatgtagtatctgtagtggaaagctggacatttaaaataagcagttagaaaatcataatcatagcctggcttgtttctctgcagttttcatggtctaggcctccaggtaaacttagtatatacccaggaaattacagataaacaaccacaggagacttgaccctcggtagtaattttctgtgtaagcagccaatgtacttagagagctttaacatcttatgcagagtgaatgtttcctaactgataggaaacataagcttggagatccggtcctgcattgaagtttttaattttaagccccagcttgtgctttatcttgcttatatcctgtcaagctatatacttaatcatgtgggtttgagatagtgtttgctttatactagatttgtaaaaagattttaaaatatgtatgtatatattgtaacttgatgtacagtgttcttattataatgtaatttttattaaaaaattctgtttttttcttatgtgttagtttttgaaaatttgcttttcttgaagataatgaaaattctttttttttttttttttttttttttttttttttttttggtttttcgagaacaggtttctctgtataaccctggctgtcctggaactcactttgtagaccaggctggcctcaa

SEQ ID NO: 17696 - DNA, 1196 bp, Mus musculus
tgtctatgctgcagtgagaaaggaaatttgaggacaagttggggaattgccgggtatacctgcaaccccaacattttagaagctacataaggtagctgagggtctctgaccattaccctagctccaggttccatgagagaccctgcttcaagggaatgagttggagagtgataaaacaaaacacctcaatacccttctctggcctccgtgtctatgtgtattcatctgcacacacacactcacatacaccatgcacacggaacagaatcctaaaggataccttcttattgtttctcgttaaattgctttgttattaaagtaattgaagagaccttttcattaaaaacttgtatacttttaatgaattttatattttttgttgtacttttttgttttgtgttctctttgcagatattacagattttgcagtcccagccagatgcagcataccagatatcacaacaagtgggttggcaagacacctttgttagacttttcttaaaagcaaattttgaaaatgtaaattcccttaacaaacacgggaagacagtttcaatgaaagaaaataaaaatatgtcaactgaagatgttaagaggaactttgaaaaactggatgatgaaaaaatgatgttagctgacgtatcttcagaccattggagtttagaagatagtcagtccctgaactcaaacacaccattatttcaagaagatagctctgaaggagaattatctttcaagtcagagaatcaagaagaattttggcatagtaatacttcccatctgagcttagatctcagtggaattgatgcatgtgaactgagcgacagtggaagtcaagtgccagacagttcacctagcactccatctccagtagagtctactaagtcattttctttgcagtctgacaaagaaagaagcatcacgaatgaaatgggcttcagtgatgacttctcttttcttgaaagccaagaggtaaatttgcttatctttccaaataagattaaaaaaaaaaagatttatttattattataaataagtacactgtagctgtttcagacacaacagaagaaggcatcagatctcattatggattgttgtgagccaccatgtgggtgctgggaattgaactcaggacctctggaagagcagtcagtgctcttaattgctgagccatttctccagccctccaaataaga

SEQ ID NO: 17697 - DNA, 1172 bp, Mus musculus
tacttctttaactgtaacaattagtgtcagaccagctgttaagaatctgagaggatttactgacattattgaggaaggctttcgacctaaggttgttgggatctgtatttgaaatcataaagtattcttgaatgaaaatattgaatgatgtatgactttaagcagtgtttttgtggaaatgtgcaccagagtctgagagtataacttagcagtagagggctcatccagtttgcataccacaaggccctaggtttcatccgggatgattgtccataaaagaaagttatttgtatgaaatataaaaccaaaagaaaagataaagctataaaaagaaatccattcaggagacattaaaaaagtggaataattatagatacagaaattagtaaaaaataaacgtactgcaaaactatcaacttttagctagactgattaggagtttcaaaagacagcaacacaaacacccagcatcagcagtgaagaagaccctgttcgcctcagaagtgagctaaattcattattgcttcttttaaactttgttcagtgatgaaaaggaagaacagaatcaaaaggaaaaattggtattgactgaagactgtgaactcattactgtaattgacataattcccggcagattagaagtcactactcaacacatttacttccatgataacagtgttgaaaaagaagatggtgagtagttctgggaaaataattacctttcattattaagaatccaggtccatgagtcatgaattagaggaagaaacaaacaaggtgggactgtgaaattatagtttatcttgtaaaatgaaaaatggagagtcaggaattaggttcattcattttcttacctcagccttgtgagtagctaggactgtaggcatgcacaccctctccagttgctttcattatcctcattaatgtattaatgtatctttcaagatttggcttgagggtttcagagtaaacttagttacaaagtgcagtcttaattttatcctactttgtatatacacactgtcctgtaagctcatttttatgactaaatctgaagatccacatcctagaaagagctctaggcatacattttagaattactatctggcctcgtagaaaggtagtagaatagcttcggggttctagaataatttaaaagaaacaatttataa

SEQ ID NO: 17698 - DNA, 1175 bp, Mus musculus
tcgcttctcaatcaacatgataaaagtatttaatgaaagagcttacattctcagtattgtgatgtttgagtatagtaactgaccttgaagagtttaagacgttttacaagttgcctgtcaaggtggtacattaaggtccatacttaggaggctgattgtgagttcaacgtcagcctagcctgcatagcaagaccctatttcaaacaacaaaaagaaaagtagtgtgtgcaggaagagcttaaagattgctaggatctgaataatcaaaggagtcttgttgaagaattagtaaaatttgaaatggagatcaacttaaggaaattatgagagaatgagttggagataatggtcgtaaatctgacatgtaaagttggaatgcagaactagatgatcaagtcaccttccatgtgtcaacttgtgtggatccatcctgtatgcatggataaaaactgtgaatggtttttatctcttctagcttgaagctcagcgtcactccattagccatgcgattacctatccactgtgtttctataaccaaagaatacagccacattcttgttggcttagaagatggcaagttgattgtagtgggtgttggcaagccagctgaggtaagacttagcagcgtgtgttccttcttattgttgtgtgctcctttggtccttcattctagctaattcagaagtctccactatggataaactgaaacataagtttgacttttcagaaaaagccaaagtaaaaagttgttagtagtatttctactatgatataattgaaagcatgcttgtgtatcagtcttcgtattaatgtgtgaataagaataataagcaaattttttacttcaagtcaagactccagaggaattttttgcggcataagaacccttgtaaaaaataaaatattagtttcattagtaagactaatttgatttaacagataccaagcaggactataaaaagtcattttttggaactacaaatatttcatatgcacatgcttattcttagtgagtttactataatgataaatttacttgttcaatagtcttttatagataaaacatttgttcctcagaaaacataacggctgtaacccagtaacctagtcattcaatgtttttgatacattcttggcttcttcagagaatcataatatggtatctgcaggttttt

SEQ ID NO: 17699 - DNA, 5686 bp, Mus musculus
catttagataaagtaatattgtgaaaaatcctttttcttgatatatatatatatatatatacacatatatataaacatatatatgtgtgtatatatacatacacacacacatacacaattgttaggatggtagctaatttttattatagttaagtattatatttaaaaatttaaaatagctaattaatttggaatttaaagtgatttttatttgtttgtttttgtaaaattgactttgagttaggtcagagtagttctataactagtagtattgttaattagattccatggactttggaaaaagatctgtaaatctttgaagttatatagaaatttatatgttgagtttaatttcagggaagaactattgcgtggctttcttaaaatgatctatgatctttatttaaaagatctatgatctttactatgggagcctttaaaagttataccttttttttattctaataaccatatatttccttatatctacttgtcttttcagttgagtcttaaagaacttttgatttttcattttctctctccttttgaccatagtatccagtggccttttcttcataactcaaaaaaatgtgtttttagaaatttagatttagaaataaaagattgtgtttagggaaattttccaatattttgttatgttaggagtcaggattagtaaaacactgcaaaatcactgtcttcttagttaaaattatctgataaataacactaaaccagctggtacaaaggaacttgtgtaagtgtagagacaagacttcctttttggaaatgtgttggaagtctcccaagtcagtagatggttgtgctgtatgaaacatagcttctgctccgttcccctcccccctccaggtgctacaaccacaatgccatcagggctttgttcaccctaaaatccttaggagagttcaaagtcaaccaacatgagtgggttttcttaatttgaaaaatagtgatttgggagtagggatatcacccgacagttgaatgcttgccttcattgttcaagactctgggtttgctccctcgcatgggtgcgagatgagtaaagggaagagagactgaaaaacacagagacagacactgatggccttaaatcaagactcgaatgcctcgttggtccttgatttgaaatcacttaatattggatttatgattttttttacttaagaattataaaatctttgataatctaaggaaaaaatcctaagtgtatggtgtttgactcctgccttttaatgggaagtagtatttcttttataacatgaatacaaagctttgctcagtttcatagccatctgacccaaattactgctagatgtaatcattcctgataattggagggttttttccctaaaaactataaaccataaatgtggtatgaaaatactaacaatattcttgaaggatgaacgtctatatttattaaaacaagcaaatacagttgaactattatctgatatactcatatatgaacggtaggttatgacattaaaaaaatcactaaataatattactgggaagatatgctttgacacattggaacgtagatgttatccatagaaatttttgtaaggtatagtgaaaacattattagaatgaattgataactgggtgttttggttaatgagtataaatccccagcttgcttgctttgagtgtcaggtcatcttttcaggactttccatcagcttttgtttcttgatagaagaatcatgattataaaactctcagcttctgggtaatgagcgctttattctcaggtgtcactcttacttttggaaaggaggatcagtagaagttggtggcggttgtgtgtagacgtgtgtgtctctgtgtgtgtgtttgtatgtacacatttatgtaattgctatatatgcttaaagagtaaaaccatgagtattctgttactacataggtaaaattgaagaagaaaagaaggaacaatcagaacatgaaggtcagggaactgtaaatacagactggcagttaagttttggtagccagagttgcctgtgagggagtttgtattcccttcctttaagtcgcaatgtatttctttgtaggagaaaatgtctgcagagttgtaagcctgtttttttctttttccttgtagatttatgagactatttttcaaagaaccgatacagaaatgttgcatgctggtagaggaataagtatgcccacagaattagaatttagacttgaggatggtctcctaatcttagcctctttatatttcttttgacataggctaagaaaattaagtcgagtcccagtttttgtttggtgatggtagagccaaggtatttgcctataacttttttattaaagatatctctaaggaaagattttagttgaattttgagaggttagtttctttaaaataattatatttttaaaataaatagcatcatctttgcctccctttcagtagaaacatatgagtacttggactgtattgaatataagcaaggtattaactgcatagtatctgggggtgtgaaggtgttagtcttctcttctcacttcctacattgctattcctgtccctttttttttttctattcctgtcttaaccatatcttctaggtacgaaatgaaatgtattgtttgtacctgcaaagtctgttgtttttatttctcatccagacccatgctaatgttagtgttctgtctccagtcgaaagtcttctgcatcctcttaagcatccttacatgggcagcaaatgttcattttcagtcatttttcctaatctatgtgtgtgtgtgctttgcatttgattggtttcagatgcccatatataagcattattttgtagaattttttcatagtctttttcctgatggcattaggcaacaatacaatattatcagtctttaatattgtgtacagtgtgggccatagccatacttacttgatttaaatgtagtagtttctgtgccagtgattttccccaacctgtcgctgcctatattaactatgtttcacatggacagaaccactgcatttccttttcattatccttttcattgttgaaaagttcacttgtcttatgaattctccttagaccttttgcatttgaaaatcatagttaattaacatttaccttcaacaaaattgtttctttgctaggttcaatacatatacttcccaattcctactagtcaatattttccacacttgaaaaagtgcaaattttttgctgtattggggattgaattcagggcctcatgcatccatgttagtcaagaagaaaagcattagcaagcagtgttaaaagaataaccgaactgagtatcttgtagtattgaacgtacagtgaagagagttcttccactagaaaagcactggtaagctctcctaagtccttctgatgatgtctgcaggtatgacagaatagtgaatgcaatgttatttgatttttcataggttttagagcttagagctcatagagcattaacatttgagagctctaagcttgtgctagcgatgtgtctcagtgacggtacccttgcacatggaggaagccctaagtttgggatttggggtagcattttccccacaaccttggaaacagagtataggcctcatacacagtaggaggggttctaccactgagccttacatcctcagttcatagagttgttcttcatttgagatccagtttatgtgtaagttaataaatgactatgcctaggtactacttgggatttcagtgatttaattaatcctaactctcaaaaattataaatacattatgtacttataatgtgtataaacaaacatgtgctgaaattgccgatggttatattcttatttgttgtaaatcatgtggccatcctaatacaggatttatatctcttctctgacttttagctaccataaagtttagagtataaaaattatgtatctttattataaaacccttatataaaacagctatattatcaatgtcagctttttggcagtcatagttatttatcagccatattttctttgaccactatctttactgatattcaccacacagaagtggttgctgaacacattgcaagatttggacatataaaagttattcttttcatgccaaataaaaaaccacaaattcagtggtatatgtcttcccctaaagcagaaagcaaagtgaatgtcactgattcagcatccttttttctttgatagttttcatgctccttgaaaatgctcatcatttgaaaattactcaatcagacaaagtggtacatgcatagggttccaataacttgggagactgagatggaaggatcacttggacccgaaagttcaggaccatctgacagtgtagtaagatctccatttcaaaaataagtaaatgaacaatgtttcaaagttgacaaagatgtgctgctgctctgtgtgtgtgtgtttgctttataatggctttctagtaatttaccggcattcttaactatttttgagtgcttacaaaatttcagtgcttttatagtgctactgtaaactaaatgtagcaatcaaggtaaggtgagtttcattgagagtaagagcagttagatttagatgaaatttaaaagttttactgattaaaatgcaaactatttttaaaacaagtcttattccagttaagattttatttgagtaatatatttctatttaccttatattaaaattacatactctctgtgataccatagtaaaattgagaattaggctttaatgttgtttagtttagtttagttttgtttgagacagagtctcactaagtagccttagctggcctgtaactacctatgtagactagactaccttgaactcagagatcatctgcctctgtctcccaagtgctaagatttttcaagaatatacataatcatcttgcttttcataagtaattctggtagggagatatcagtagttaaaatttaattgaagacagtttaaattcttatcatatcaggtcttaaacattttttggaagtctgaatgttttgttagctaatccctagtgacttacttggtttccgtcgtccttccaaaatgatgtgttaacgtggctcttactgctgaaagccttttgtattttagatgattcttttttctattctgccttttactttcaaagactgtgcctcagagacatcaccacaaatgttcaccacaaatgtatctgctgctacttacagtccatttcacagaagaaaacttgtgaggaagccatgtggctttctgctaaattcttttataggctaattattctctttcccatcggtttgcttttgtatagttggaaggggggaaaagcaaaaaaaaaaaaatcagatttctggatagccattttctatcaaatgtattgctaaattaagtcaaaattaacaaacatatttgattaatttgacagtttttctgagactcaattagaagcatttcagttttaatagggtaacagtctcttgaatccatgaatatatgcattggttcagaagagttagctgaaaattcaaaatgacttgtttaataacaaaaggtacttagctgagtatgataggagacctgtaatctcaacacccacaggctgtggcaggaggattgcctcgcctgtaggctaccctgggctactgaattaagtgtgtttatatctatctgcctacctgcctgtctctcttgtct

SEQ ID NO: 17700 - DNA, 1150 bp, Mus musculus
ctatcacttcagagaaaattgagcagctcaggtaagacgacaatgaaaggaaaatctcattaaaaggcaaacatcaggtaatttatttataacataaagcttatgctaatatgtaggaaagatatatggatcttaaaatatttctatagatttgcaatagaatataatagaaaaatatatacatagatctacatatattttcatttgtttctgttttttttttttttttttttaattatttaaccaggcatagtggtacatgtctttaattccagcacttgagaagcagggagggataggtggatctctgtgagtttgagaccagcctggtctacaaagtgaattctaggacagccagagctacatagtgagaccctatcttgtaaaacaacaacaacaaaaatagctaaaaatttatatgcatctgtgtctatatgagtgtttgtacatgtgtgtgtgtacatgtatgtgtctgtatgagtacgtgtgtgtgtgtgtgtgtgtgtgtgtgtgtacatgtatgagtgtttgtacagatgtgtgtgtccctgtggagaccagaagaggaagttggctcccttggaactggagttgctggtagttgtgagctgcccagcatgactaagcagcaagtactcttaactgttctggacagttgctgctttttgaggcaaagtcctcctgaatgctgtgatcacaattacatacaccacacctatttaattacagattttaatggataatttaatctcatgtgtaaaaaatcataaaagtagttctgggagctggagagatgggtcagcagttaagagcatcgactgttcctccagaggacccaggtttggtttccagcacccacatgtggttcataatgatctgtaattccagttttcagagctccagtgccctcttctgtcctccatggacagtatacactaatatggtacacagatacacatgcaaccaaaatacctacacaaaataatacatttaaaaacaagactatgcaactcttgtttcacattaaaaaataaataaataaaataaagtagttctagataacctgttagttagcctatatgtagtagcaatgatatccagcatgtgtacattcatgctttgttcataggactacatgtcagaagccatc

SEQ ID NO: 17701 - DNA, 1190 bp, Mus musculus
cgctgtggacagacaagtttttgaaatgaagtatgaactggtcacatcagcaagggaagaagcttggatcactgtctccaaaagacactaaacgtttatgcacttaaagtctgttaggtaaatgaagggaaatgcccagttagagtatgtgctgagaccttttataaacccagtatcattttgtaatgtaaaacctgctagtgcttcatgatgtaaatttgttttttggtttttttgttttgttttgttttgttttttgtttttcgagacagggtttctctgtgtagccctggctgtcctggaactcactttgtagaccaggctggcctcgaactcagaaatccgcctgcctctgcctcccgagtgctgggattaaaggcgtgcgccaccacgcctggctaaatttgggtttttatatgtcaaaatttcttactgtatgacatatgtttatacttataatgacaactttaacaggaaagtttaattttcttttaatttgcatcattctctaaaaccattatttttaaatttttattatcatttgtggggcagtgggttttgagacagggttttttctgtgtagccctgactgctctgtaactcactctgtagaccagactggcctcaaactcatagagatccacctgcctctgcctccagagagctaggatcaaaggcctgcatcactactacctggctaagctgttattttcaatcttgatgttcataatttgacctctcaaatgagtaatcttagagagttcttttgtgcaagttggagaatcatgttttctaaatattcataaaagagaaacataatgttgcttctttttgcatttctaataaatcacctatcactctatttggaggattgttttgttttctgagtattagtgtgtctccatcattttcattaggctttagtgagtccctgggcattctgtctaccatctgttatgttctcgtgcacctaagcattcatctaaaggcttgctcgtggcacagcagttcaaatcatctgggaataacacagttgcttccgaatctgtttcaaagccagtgcctctcccgtgtgacaaaccgaggcgggaacttgtcctgattttctggaaatctcacagcattatgttaaattctgttgctcatgcagagaaacagaattcccaagttgggaattaactataatatca

SEQ ID NO: 17702 - DNA, 1115 bp, Mus musculus
caaaacataaaaatgcaaccaggaatagaatggttttaattaatgaatttgttgtatttgtttttaggccaggttgtcactacataatgcaatcccacccttcctaaagttttggaatgctgggattccaagtttgtgcctgtaattcagtttaggcagtttaggtaattcagtttatctgaaatgatctttttgccctcaaagaggaaagaatctagcaggtcaagtaagtttagacttgagagggtatgaaatggctgtggagtgtggcaatagcagaggggccttggctttgtttccctcgggtggaccacctagtggaattggttagggtttaagttaaggctgttatccagtgtctggtaaaattaaagtttctgttggaatgtatgtattcatgtgccagtaatgcatttttttgggtattagcagaagtgctaaactccattgcccatttgatggtcctgggctgttttagtctttctctagttactatattctcttcctcctgtgttgttgttgttgttgttattgttttctcccttaaccctgttcgtatcattattattttattttttgtatagttctcatgtagtgaagttagaatggaatatttttgtgtgcagaaaacatagtcaaaaagtagagtttagaaatttatttcctgatatagatatcatataccaacatattatatgtattatatgtcatatatagaaattataacttacttaaatgaaattatttgtagtttgtttatatatgtgcattctaatttcagagatggttgtttttggttttttaagacaggatttctctgtgtaacagtcctggctgtcctggagctctctttgtagaccagtctggcctcaaactcagagagagctgtctgcctctgcctcctgagtgctgggattcaaggctatgccaccaccacacagctgttgcttgaatacttaaaaaactattttaagttcaaagtcctggtctttccctttccttttgacacaatagtatttattttgaattgttattttgtttattgaacagtgcttgagagaagtaggatgaacagtgcctttgaaaaaaacgatcttatgtgctgggtggtggta

SEQ ID NO: 17703 - DNA, 1162 bp, Mus musculus
cctcactctgctctcccaaacctcatctgattcttcctctctctcctcatgttctgatgcaactttgaacagccaggaaggtgaaaaaagacatcccagagataaacttaagttaatataaaaaccattactaaccaggaatagaaattgcaagttattttttgctggaaatttacagatgaaaaactattcataataaaatattagtatattaccatgccattacaaactgaaataaaataatttagtaaaatttactaaaagcttctttagatgggtatcaggccaggatataaaaggtagtattattttgatgtgtaagcaccaacagtttgctcttacatttatagggaatttacttaaattttttttataaggtagactttataaataggtatcaaaacaagtttactgaactcaagagtttctccttatttattaaggaattcctatttgaaatggaagcctttttgaattatgtttcttgtagctatgtccgtttcagaaatacacgggaatcctggtattgtgctctgcatactcattcttcggtggctcttcctccttcagcagcagtgggagcagtggaggaagtcacccaagtagtcggagcagcagtcgggagaacagcggaagtggtagtgtgggggtacccattgctgtgcctactccgtctcctccaagcgtctttccaggtagagcattagtggttatttgtttggttttattttgtgaatttgaattcaatttgttactgaacttagtgagtgtgtatgtgtgtgtgtgtgtgtctgtctgttttgctggctgttaaacccagattcttcttaatgaaatatttaaagaattcttccctagcactctgcaaggttttgggaagtctgcacatatccagctgatcttaatggctttgctattttttctactttgttattttgttttatgtctttggtgagtacttcagttggtactttgaggttcatgtttgtattataactgcattttcttggaaatggggaagacatggtttgagaatcattttgataacaaaggactggaaatgtaaatttaggagcgttagaatccagcagtttctaaaaaactatttcttcaatctctttcctttctcgctctttcgctctcgctttctttcttaagattt

SEQ ID NO: 17704 - DNA, 4709 bp, Mus musculus
cattattcggagtagagcccggcacagctgtgcttctctcaggaggtcaggtcttcccagattagcttgaggccctgggaatttcctcccagtgaaatgaatgaagcatacaaatgatgaagttactccttttattactgttttggtttatccccttgtatcaaaaactgaaagccaagtctgaacaagtggatcttcttgctgtcatttgcattatgctgtctagattgaaaatgtgaccatttctcaatcatgaaaggcataccaacatgaacatgtagctaaaacatgtaagaccaagactgacttgaggaaaaatatctgggatctttctcaggaatactgtacacccttggatttctcttcctgcagaatctgtgacattggatgctcattgcctctgctttggggctaacctcatggcctggtggacacccttgccctttactttcagtatatggagaggaaaggaaccagtgtttaaatactttatttaactgctttttgattgcttaaggctgttttccttctttaacactgtaaaccctgtgttctcttagcactggagtgcgctaggtgagttaaccttgaactcccttgcaccctgtcctgtttgtagattataaggatgacaaaatgtgaaagtctccaaatattcccagggttgttaacagtttgattttaatgcactgttgcatgagactgcattgctgatagcagccagtgaaagcaatgtgaaatgtggtgtaggtacttcatgtactgaggtgagcttgttggatacgaaggttcctaaggatctccagccttaggctgtttcagagcaggaagtcagaccagctattactgttcttttgatattcaacccccccaccccacctttaattttttagcagagactagtgttgtcaagtctcttgacagtcactggactgggaatgaaaggctgctaccatgctcttggaccattatcaatggcagtgttagctgatgccaagtcattttcaatctctcagctatagaaaaataagtctcctcctgatctgaagtgattagactctaaagtggcactcctagtaatattctgaattttgtgattcagagtgaagagtgtgctggagaagactaatagaataaaatacttgcccagtcacactgaggaaaatcagtagtatgtatttgaaactattggcatctccctcatctaccgaagaggaagtaaagctgttgtaatccagatgcaggccttgtacatgctgtctggtgatgctagaagaacaagcgttgtagatgtgaagaaaagcagactataaggcactgacactccactggtagatccgctatctgcacctgaggcttcactgtgcaactcggacccagacagtgttcttctcaagacctcttttgctttaaggttgtaggttttgtttgtttcagacatggtgtcttcctgctctagcctctcaaatactaggattgtaaggaggagccactgtaccaggagcagcaggctgttttggttttaattttattttaaaaccacattgcacatcagctatcacgcttttagatggtttgttttttttgttttttgtttttttttgtttttttttggattttttgagataggctttctctgtatagcccaggctgtcctggaactcactttgtagaccaggctggcctcaaactcagaaatccacctgcctctgcctgccgagtgctgggactaaaggcgtgcgccaccaccgcccggctcacacttttagagtttttttagatgctttggattctttaacttgcttctagcacacgttccacttcatggatttgttaggtcatcttgactgtcttcagaatatatccctgaagtcctctgaacctttagttccattatggacccaagcaagactgtatatgaacgtttaactctgattgtattggtacatggaaacttttgaaaaatagttgcactaattatttatttaagtagccttttgttgaacaagcttagttgactaataagacgtttggaaacccagcaaacaactagcttttgtagtcatagaaacaactggtggtaggcaccaggaatacagtttatcttctggactcctgctgagttggggtttgcagaaaacacttgtgaaatcctttgtgctgaagacttgcactgggggtaatccatgggacagatgactccctcccccttgtattattgagtactaatagggtttaaaaacgaaacacaaaatactctatgttggccttttcccccaatcttaaattttttcaattttggattctatgaattgttttggaaggatactctgtaacaatgagccaggcctacagtaatcggagacttttaatgtatgtaatattttatagattgcatgctgttaatactgtgaggttatttcctgttttattgtaaattttcccatttatttgcccataaactaaaatatggttgatattaggaattttaaacaaatgttgaaactttgctgaccagaatgcaaccactttaccaagacacaggtactgagggctctggtctatcctgaaatgtctgattctgtgcacagttcctttacccttaaaaaaaaaaaaaagaaaagactggacatgtctctttttttgctgttaatatttgaaggtccaaggatctgagtgaaaatacattcttgtgtttgatcttatagccaaggcaaattagaaacaaaaatagtgccaatattttgaaatctagacccaagatttcagcctgctgtgtttggaataaatatgaatttttaaagatgtctcctacagtattttccttttggctacttctgtcttcctgagaggtacttgtcctcatctagggattagcacaggactgctgagtttgctattcttaagtcactgggtgacaatttttaccccctcctttccttaccagtactactgctgtttatattgcctggctagagactggtttatgcatctttacaaatgatgtctaccatgtagttgcctcgttaacagttttatgttgattaaagatgattcttacgtgtgggacatcaaaatgatagcttgcttttatctttcagttctcattttcttttaaggtcacctttctgcagtacagcttgctttactcttttctcctcatggagaacatggtgtctcccgaaggccgcctttacgcctgcaaagggctttggtggaagaaatggttggtagacttccaaatctttgaaatgaatgggagctgtttacttatgaatagctttggccagaaactcctcccgaaggtgacttgatgtttccctaacaccatttacttggaatcagaatttttgaactaataagctttaacaatgtttgtcccggtctcacctgagtgatgctgtgttttagataagcagctagttagttcttgactcagtgctcggttctctctccaccggaccaactgttgtaactaagcgtgctgtacttttctttagaaatagagttctatctgtattcaggattatacttgaaaaaatatgccatgttctgattaataaccatcaaagtattcagattgcttaaaggaattcaagtgcaacctgcattcaccccttctaaaacttaattcataaatacctttctataaagctgtgtgtagcaagaatgcattgtatttagttctatgctggcaggaacagaatggagcacaacaaagtacacagccttacttacgagagccttacaaagttactaaatgaagacattgagctggctatctaaatttactttatgctctttgttttattgagaatctctatttaaaaaaaatcaacaaatgacagggcctagctgtgtaaatgaccttgcaaaatatgttaatttttttgtaaaaaaaggattattttcacattaaagtgaagcctctttcgcaagttcagaaatctatgggaaagcagtttttaatcatattttatgtcctatacctttttttcttaataaaatggtttacaaaaagaatgtaaacaatttatgatctggcagttacactaagggttcccagagagttggtggtactgagtaaaaaaccattcaggcaacttgagcagacaactgttgtcagtaacattccttgtgtgcgccattaagcacctccagatgaatgagggacagtcacttaatttttaaattgtattcggaataattactgctgtgtactaagaacttgacccaaataaaaatcacacgaagtatattgcagtgtcttgtagaatcatttatatatttactacttctttctaaggtggttctaagcattgatgtactgttcagttacgtaacatttaaaaaattcaaatactgttggacttcttgcaagtttggtctctgaaatattttgttttaaagacagcttctcattttagttatgaacacggctttttccagatataactaaattttgttaagtgtaaaattttccatcattggaatggggttttaaaacaaagtgtgggttaagattccagaaaaaatgactatagaagttctctagtgatttgagtgatgtgcagtttatctccagagtgaggatactacagttcttgctgccttacaagcccattgttcttcagtgcctttgtcacttccatgacacataatgtggaaactggaaaactcaactaaaacacattttaaagaaatgtttt

SEQ ID NO: 17705 - DNA, 1710 bp, Mus musculus
gatgtaatcccagactttactgcaatttactaattaaaacaatggtcctgtgtgggtaggtgacaatttttgataaaacaggtattactatttttgttatacatgaaaatggctttctttttttaaaaaatccctttcaaattaaaaataccttttggagtattagttactttacattatctgtaatatgtaacctctctccaagtttacccaaagggaatgcaaaatctgaatatcccaccatcttttaagatggtcctttagtccaatgaaaacatgctacatctttaaaactccagccataaaaattacaagtgctcagtgcccttaggaggtctgtatgtaaaagaaacccaaaatctaggtgaatttaatgaaataacatacttcatacatatacaatgtagggaggtgggcaggggctctattggattttctctgaagtaaaccattttagagagctatctgctgttatccccagtgccttgaactctttagaggaatagcatttaaaaacaacaaaaaaccacaagtaaacttttgaggtgctaatgaaagagaaggaaggtaagtacttttgaagtttgggcagaaatgggaagggggtgactcttaaaagagtttttcatccatctacatggaatctggctgtttcctctcaaagatgtttagaaaagtggttcaagtcaatactgagccatacttaagatctggccaaactgggagcatgttgttcatgagctgtgaatttcaagaatcagcttagaaagacatggttgcagcagtaggggagacatttttttttaaactatccattaaatttgttacaacttaataccaaaacctgacgttttttcataattccacctcctagttcttcctgtatttgtaaatagtccctcctagaaaataagcatcaactggaatgtgtcaaatgactttgcttagttttactatcagccactagtgaactcttcttcctgagatgcataaggtaaaataggattagcttgtgctaagtgttgtaaaaatactgtttactgttttcaaagagaattgcacagtatctttaactggggttgtcctcttctgtttctttttaaaaaaaaaatggagtcaaggctcactctgacttctagctgtgggaattctgtcatagatataatgtagaaatatacttttttaaagcatgaagaaaacaaaaatgtacctgaaagaggacattattcagaggattatgcacagctcgataaggatgaagttgtggttttctttcagccttgttgctattattttcttctgcataaatgtacactcatttcattatgtgccttgctccctgattgtgcaaagctatatatatacacacaaatatatatatatatatgagagagagatatattcattcagtactactgatgtttttgttctactgctggattaagttattgtctgagttacacttgccacttgtcataaactattgtaatggcttaggacagtggtcatatagccagagtaaatttgtttttccagtttcattattttgtcatctatcccaattcttaataaaaaaaaaaaaagtacatagattccatttaaacaaaggatttcaagtgttttggatgagcactattaagagcctggctttgtagggtgggagagatgactcagctgttaagaatgctttctgctcttccagaggaccag

SEQ ID NO: 17706 - DNA, 1148 bp, Mus musculus
ttcatgtttttttttcattgtggatttcatgggaatccttaaggcatcctgagccatgacttacttctgttttattgtcttgggagagcagatacctttgaaaactagtaatgccaaaaaaatgagagagcagtaactatccttttctaactccagtcatgtgaccgcatgcaatttctttatatttctcaaagataacacctgttaatttaaaaaaaaaaaaagtgatacatccctatctttttcttttaagtaacattccgatttttgtttttaactgcctagtgtgtttgaaggttttgttgaggtgtagttttgtttcttctcttgtctcggatgtgttcacagacaagacccacagccctctgcttggcagctccagcttacatggctttcaggcctgtgaaaggcacgtgcagctttctcagatgctgactagtgaatagggtgaggatgttctgaccctgagggcaggacactggtgcttttcagaattggtgactcactttctgacaaccttcatttttactgtataagcaatttcaagagtctctagtgcttaaggtttggcaccaactctgaagggcagcagaacaaccaaactccagctcacaggtagtacaaacactactctatgttaacctcaccatcttggcttttactcccaagagatttaaatactttgcctttttagtcactataattctcatttgaaggggagaaaattcgtttttttagatgcccacttacagataactagatttttttcaatatctaaactttttaacatgagaaagatggctgtatcttagagattaccaaaaagacttgttttcatcaggtaattaaaagtaatagagatgacaatgtggttttttttaagtcctccaaaactaaggtgctcctacccacagatggcatatcttgcaaagggctaagaactgttttgggttccttctctctgtgttactttgatgttataaatagtgctgaatttgtctaaacagaattgagaggtcatagaaatccttaacagggtaacaattccaaggtttccgaacctgggtgttagtgtggactcgttcatcagactttgaacagaacattttgccacctttgctactcaaaaccaattttatgttgccaac

SEQ ID NO: 17707 - DNA, 1131 bp, Mus musculus
ttatagaagaaatagatgggcagtttctcagctagagagtaccatcagaatgtttggtgtatctggtagggctttttttaatttctcccagtttttcccagttggctgaattgagaactgcttgactgacataagtactacatgtaaagggacactgtacatcaggaaaaccttcactatacggaacgggtaaacagtgcaggaaagggaaatccagaagacactgtggctatacataggaaactaactcatggctgctctagttgcactagtcctgccatgaccccagccacatttgagatgtcttcacaggtaagcttcttgtctacaacacaaggaatatttaatgctatgaacctggctactttcagtactgtcttgcgaagcttcatcaacttggcctcatgattctcgctttattgtgaatgtccagtacacattgtaatgtactgtccagttatgtctttaagtgacagttaccttcatatatagtgtgtgcatttgtagacatttgaatccatgaatagtctgaatatgaaatatataccctgtgcccaatttggttcatcattataaagacagtcacctgctgcaatgccttctttaaaaattgtttggtaggatagaaaagaactgaactggccctgtacaggtatcactcactcatgaagttacaatgcaaagaatctatttgggaatgggattatcatgaacaaagtgagttttcataatttcatcgatagctagtggagctgctaagatctttgctatttacagcacaagtgtagagattttgtaggtaaccaggtgtctgatggagtagtgtcacagtccagtgacagtgacactggctatgcataggcagctgggcaaaccttggaagcattgctccgatgacgctactagacttcacattcttctgtgtgcttttggtacttttatcaacttacaatgacaggttgaagggaataaaatacaaccttagagctattttttaagagaataaaaactgtccatcccatcaattacaaatgaacatatcttgtaaaggaggtctgtgcctgttgaaaagataaccagtgccaaacacaaaactccttagttcctgtccctcaaggagatagaaactgc

SEQ ID NO: 17708 - DNA, 1174 bp, Mus musculus
aaactagaggattcttaacagactcgttttctttagctgatcttttgccctataatgaccattcccagattcaggacatacaaataggtgatttacttacttgtttgaaatttcagatttaacaagaatttgttttaaaatgttaggagacctggaaattgagagagacacgtaagttttaaaaaatgaagtctttaaatagaaaggagatgattagcatatattatttgaatactcagcaaattttaaaacttatttttagggttaggtatcactgtgtaatactggctggactggaattcactgtatggagcaggctggcctaaactccagtgctcttatgctaccacacccaggttccatgtagttcaggcttgtctcaaacttgctatgtaaatgaggatgaccctgaacactgccaggtagaagcagaactttaaagaaacttgttagaacagagatagccgttagaaggagagctacatcatgacaaatgtaatttttttcactttagggaaaaaaacacattttaatgagtatgcatgttcatgtgcacaccctcacttacacagtgtgccgtggcacatttggaggtcagagaacaacttgtgggagctgtttttctctttccaccattgactcctgaacatcaagctaagtgctttgaggcgagcactttttttttaatctaccatgtaaggtttcttaatacttataatttgaatggattattttaaaaaaaactaatttgagttcagactttgtccttataatatgcatttattattgttagcataactaaatcatgtcttaaaatatccttaggaaacattccactgaaattgtgtggagtcagattttcctggtttttcttaattctgctgttggtagagaaattttaaaatgtggtcgttcctttatttatttacttttaaccagatgagttgattttttttttttaaagaagtgtttctttagctttgagtcatcttaaattaacatcatcttaatatttaaagatcctaaattgggaatatttggggaaaaaaaaagttttaaaatttagatcaataaatatcagctgggaaattccagagaatggccctgacctaggtccatctcttagttagtatttaatatttaataaagcttgctttaaatttggccccccaaa

SEQ ID NO: 17709 - DNA, 1530 bp, Mus musculus
cagcgagctattcttccttgtatcaagggttatgatgtgattgctcaagcccagtctgggactgggaaaacagctacatttgccatatcaattctgcagcagattgaattagatctaaaggccactcaggctttggttctggcacccacacgtgaattggctcagcagatacaaaaggtggttatggcattaggagactacatgggtgcctcttgtcatgcctgcattgggggcaccaatgtgcgtgctgaggtgcagaagctgcagatggaagctccccatatcatcgtgggtacccctggccgggtgtttgacatgcttaaccggagatacctgtcccccaaatacatcaagatattcgtactggatgaagcagatgaaatgttaagccgagggttcaaggatcagatctatgacatattccagaagctcaacagcaacacacaggtagttttgttgtctgctacaatgccttctgatgtccttgaggtgaccaagaaatttatgagagaccctattcggattcttgtcaagaaggaagaattgaccctggagggtatccgccaattctacatcaatgtggaacgagaggagtggaagcttgacacattgtgtgacttgtatgagacgctgaccatcacccaggcagtcatctttatcaacaccagaaggaaggtggactggctcaccgagaagatgcatgcccgagatttcactgtttctgccatgcacggagatatggaccaaaaggaacgagatgtgatcatgagggagttccggtctggctctagcagagtattaattaccactgacctgttggccagaggcattgatgtgcagcaggtctccttagtcatcaactatgaccttcccaccaacagggaaaactacatccacagaatcggtcgaggtggtcggtttggtcgtaagggtgtggctattaacatggtgaccgaagaagacaagaggactcttcgagacattgagactttctacaacacctccattgaagagatgcccctcaacgttgctgacctcatttgaggggctgtcctgcgacctggccctagcccagggttcagtcctggggtggggctaaggaagagctggaggggggaggggagggagccaagggatggacatcttgtttttgttttggtttttttttttttttttttttgtttcagtttttttttctctatgaataaatgtcactttttgaggcaaaaagaaggaaccgtgaacattttagacacccttttctttggggtaggctctgccccaggcgccgtctccttctcccccaaacactaatgcatttccctaacctagtcacctcattcctaaaggctttcctaccccagccaaatctccaaaagtgagtcaaggggctaaaaaacaaggctggcctcatttgctggaccaaatctacagggagaacccctgagtgaggttgtccagggaattgtcccccggtgaggggagcaggggagagaaaatggtagccatttttacattgttttgtatagt

SEQ ID NO: 17710 - DNA, 1348 bp, Mus musculus
ccaaatattaaactatttactaagtctttctgcccctttctcctagataatcaagttatatgatctaatgggtagtcctgaacaagtcaacgactgtttcggtaaaataacatgggttcctattttgaaaatatctactgtttctgtgatggttattgtcaatcagacaggatctagaatcacctaggagaagggcttcaagcacaaccgtgagtgtcttagttagggttttactgctgtgaacagacaccatgaccaaggcaactcttataaaggaaaacatttaattagggctggcttataggttcagaggtttagtctattattatcaaggcaggagcccttttgtgactggcggtgaacgagcgtgcagtgccatgaaggcctcgggcacgcttcgggagtacaaggtggtggggcgctgcttgccaaccccaaaatgccacacaccaccactgtaccgtatgcgaatctttgcacccaaccatgtggtggccaagtcccgcttctggtactttgtgtcgcagctgaagaagatgaagaagtcacctggggagattgtgtactgcggacaggtgtttgagaaatcacccctgcgtgtgaagaactttggcatctggctgcgctatgactcccgcagtggcacacacaacatgtaccgggagtacagggacctgaccactgctggtgcagtcacacagtgctaactagacatgggtgcccgacaccgtgcccgtgcccactccatccagatcatgaaggtggaagagattgcagctggcaagtgccgccggacagctgtcaagcagttccacgactccaagatcaaattcccactgccccaccgtgtgttgcggcgccagcacaagccacgcttcaccaccaagaggcccaacaccttctgctagacacaaagacccactgaataaaaacttgagactgtcaaaaaaaaaaaaaaaaaaaaaaaaaaaaaagcaggagcatggcagcatccaggcagacatggtgctagagaaggagctaagagttatacatcttgttctgaaagcgaacaggaaaagactggctcccatgtggttaggaggagggtctcattgtccacccccacagtgacacacttcctccaacaaggccacacctactccaacaaggccataggttctaatagtgccactccctgggccaagcatattcaaaccaccacagtgagtgatcatttagattatatcaaacaatgaccatgcctttaaggaattatcttgtttagatgaattgaggtaggaagacttgaagacacacactaaagtaaggaagcactattccctgggcatgtgttctggacttcaag

SEQ ID NO: 17711 - DNA, 1163 bp, Mus musculus
acatatattatctggtcaattttccagatacagttcaattgctcagtggttcatctgtcttttctgggctagagttgaacaaaggtgaccctcagagctccttacaaggtcttgttatttcagaaacattttatttgtgtgtgtgtgtgtgtgtgtgtgtgtgtgtgtattttcttgagacagtctcaaagattaatgtctaaaataaactcagctgttgaaaaattgttaagataccatcagaaaagtaattcaacatgtcctcgatgcttttaactcatgtgttgaaattctaatcggcaacacacttgagagagaacaacaatgcctaggtttccagatgatgtgttgtagcgaacaattttgaattcattttcgtcttaggaaattaaattagtctttacaagaactcagcaagcatcttccttctcctctaattatcccaaggaatatacttgaaacaaaaattttaattatcacaggtctcttagaacaatagagtattagcaaagcaaaaaaaaaggtgtgtgtatgtgtgtgtgtgtgtgtgtgtgtgagagagagagagagagagagagagagagagagagagagagagagagagggggtgtgtgtgtgtgtgtgtatgtgcacatacatgttcacgtgcatgtaaacttttgactaccctgggggctctaagaggctctgtttgggtacagtacccttcatttatttatctcatctgtcttatcaccaaaatcctttgttcttatattgaaaacaattcctagcacatggtagggactcaataaaatctgttgactgaatgaataatcacatattaataaacataaatctttctctttactcttgtgtatattcgtctaggatttatttgctggctgagggcaataatctgtctaactgatggcttaactgtggatatgcaaaactgcttcccaccccaggaaacagtatgcaaacaagaagtgaaggtatgcctgggtgtccgggtactggaactttcctttgtacacacagtacatttcagggacaggtggtaaaggaacaaaggaatgatgtgtttccatagttctgagatttgaatacttactaccgagtgtaaatgtataacccttcaaaattcgtagaactaattcagtccactgaattcatcaaat

SEQ ID NO: 17712 - DNA, 1226 bp, Mus musculus
ggttgtggccgaggctgtggccgtggtcgaggccgcggggctcgtggaggtaaagctgaagacaaggagtggatccccatcaccaagctgggccgcctgattaaggacatgaagatcaagtccttggaggagatctacctgttctccctgcccattaaagagtctgagatcattgacttcttcctaggtgcgtccctaaaggatgaggttctgaaaatcatgtcagtgcagaagcagactcggctggccagcggaccaggttcaaggcttttgtcgctattggggactacaatggtcacgttggtcttggtgttaagtgctccaaggaggttgccactgccatctgaggggccatcatcttggccaagctttccatcgtccctgtgcggagaggctactgggggaacaagattggcaagccccacactgttccatgcaaggtgacaggccgctgtggctctgtgctggtgcgtctcatccctgcccccagaggcactggcattgtctctgctcctttgcccaagaagctcctgatgatagctggtatagatgactgctacacttcagccagaggctgcactgccaccctgggcaactttgctaaggccaccttcaatggcatctccaagacttacagctacctgacccccgacctctggaaagagactgtcttcaccaagtctccttatcaggagttcacggatcatcttatgaaaacccacaccagagtctctgttcagaggacccaggctccagctgtggctaccacataaggattttgtacaagaaaaataaaagaattaagtctgctaaaaaaaagaaaagaaaagaagaagaagaagaagaagaagaagaagaagaagaagaagaagaagaagaagaagaagaagaagaagaagaagaagaagaagaagaagaagaaactctgcagaatcaaggtactgaaggttataaccactttggttcaggccttcaggcctgcctcctctgcttcctagtctatagccacaaagtaaacaataatttaccacacactcaggttatcatgaaacttcctccaccgtgatagactgtggccgccgaaagcatgggctaaaatcaacctttcctctctgaagttgctccggtcaggtatgtgtcacggtgatgattgtaactaatacaacaatttaaataaacaaataatggaagtaaaccaagaaaaatcttgggataatcataggcca

SEQ ID NO: 17713 - DNA, 1181 bp, Mus musculus
gtgtgttgttgtatgcatatgtgtttgtgtgtggtgtacggtctgtgtgtgtgtgcggtatgtgtatggtgtatgcctgtgtgtgcctctggtatgtgtggtgtgtgtatgtgtgtgtggtatgtatatgagtgtatgatatgtgttggtttgtgtatgtgtgtgtggtatgtgtggtgtactgtttgtatctgtatgtggtgcgcatgtatatatggtgtatacctgtgtgtacgtgtggtatgtgtatgtgtgtgtggtatggtatgtgtagtgtggtgtgtgtgtgtttatatgtagtatgtggtatatgtagtgtttgtgtgtagtatgtggtgtgtgtggtttggtgggtgtgtgtgtttgtgtgtgtgtgtgtgtgtgtgtgtgtgtgtgtgtgtgtgtgtgtgtgtaggagtccaggggactcaggggcaggggcagactaagactatttacagaatcaggcctctagcttgtcctttaagacatagaaaggcttctctttccttgactgccttgctggcatccacaagtgacctcgtggaaggaagaggtgaagcaaggctataaacggagcaaaggaatggctcgtgggattctaaagaaacctgtgctggacagcaggtgactgctctcaacgcattgaagcaggcatggagaggcagctgagggccatctggcttccaatccaggcctcctgaagtccaggtgtgctctctcaaagcctcagtatttccttctggtcagtgggaatactggtgctgagcccacagcttgctatgggcgatggctgtagataatgtctgccgcctttgagaacacatgggtgtttgctattgtctaactgatgatcttcccccacaaacacacagctctgtgtgtttgtggcctctgatatgcagagctggaaacttcctacaacagtccacgatgcttgcctacacagccacgagaaaggccttacaaaactgtgtgctttttcttttaccatgtggtcctcttgaacccaagccaaacctgggtctatttctttcttcttttccttagtttcttgaaatttaattttgacccagctaactttttttttttagggattttccttctaggaagaaaaatttttttgattatgtaaattgaatacaggcatctattctgcaatcaactgggatgggttgtga

SEQ ID NO: 17714 - DNA, 1198 bp, Mus musculus
ttgaggacattagactctgaaaggcaataacttacccctaatcatcatccatccagaaggtgatagaaccaagacttgtacccaggctaccacaagctcatcttgtaggcaaaatgatcttccactgtgcccgctgtccttgagagggtcagtgaggatctggtgttgtggataaattgtgccaacaacacacattctcagaagccctggtcagagccatacattcagatagctaacagccactgtgtacttaggtgtaccagcctctattctaaggccagcacaacaggtaggccccactcagagcactcctttagagtcggggggttcgatgtatggaataattaaatcacttgaccaaaactgtacaactaagtaagctgcagagtgaacataaaaccaggcattctgagtccaagttcaggctccgaaccacagttcaaactgcctcaaaatgcaagataaaatgaataagcatgtgacctgacggcctgacagttgcttagtgggtggactccaattagtaggtctcagccacgacttctagtatcctccttgtctctcctagatgcaccctgctccaacatgctggggatgctctcgggcctcattgctgatacccagatctctgcctcctccacccgagagtacctctggagccccagtgctgcccgcctggttagtagccgctctggctggtttcctcggaaccctcaagcccagccaggtgaagaatggcttcaggtagacctggggacacccaagacagtgaaaggggtcatcatccagggagcccgaggaggagacagcatcactgccgtggaagccagggcgtttgtacgcaagttcaaagtctcctacagcctaaatggcaaggactgggaatatatccaggaccccaggactcagcagacaaaggtaggtcatttcccagaggggttaaatggggtacagagagttggggtgctgatttctcatctagtaggtatctatcaaaccccatcagcacaacaaatcaggtatcatccaagaggcaatgttgcgcagggcctggttgcttaagttagatttgttcttaattcccataatctttctacaaaggtatttttggtcactcacgtttcagagatggcagaactaaggcgtatgtcatatccagggtcacactgtatgtcggtgtttgagccatgattcagaa

SEQ ID NO: 17715 - DNA, 1952 bp, Mus musculus
aatagagaccattgggaatgcaatgtggcttcacccatccttatccccatcccaagccacccaagactatggttcctccagtgcactcagacatgaccccttttgttatgtttcctggtgtctttgaagtcacaagataacagccattgggtgcatggagtcatttctacttccagccctgaagcaaatgtgtctcatgttgccttataaaaagaaaaaagaaaagaaaaaaaaaagaagaagaggaataaaaagttcataatgaatgtttagctctgacggtccagttgtggaatgtcataaagaataacacacctgggatgatgtaaactcagtagtctgttttaattgtgagcaggaggggaccgatagaagggaggagatggaaagacccaaatgttgtctttgcagagtctcctcacccccgggcatcattatgttgagcctaacgtgggatggggttgaggaagaaggtattctttggtattattttggtcattgtcatagagtttgtaaaatacaagggaggggtttatttgctctcctttcatggtgttaacgtgtgcctgaatccatagctgctgaagtatgtggctgtccttctgacttagttaaatagtataagaaagtaaaaaggaatcgtttgctaaaatgaacccaagtgctgccaccagttaaagcactcatggcatctggctaatacacccccaatgtctggtctgaatacacccccaagggctggtctgacatcagcagataaactagcatgggcagagagaagacgccgtggtaaagttatacctgttgcccctacttttcctcccccaaactctctaccgagagagatgttagagatgtgcaaaagctgcattaaacggcagaatcaatttggttgcaatgaagtgtctatttgaagattccaagtatactagggctcagtcttgaagccatttgctttctactttccagctaaaaggcttcttagaaagtgaacaattctctcaagatggttgcctggtcacatgactctccagacaccttctaagaaagaacaaaatactaatgatttttttttttattattgcttgggagagagccattcagcattctctcagagtagccacataggtccctccagcacactctcagcttttgcatctggtgcctttcatccccctgaaaggacactgctctcctgctcttactctgtttcaaagagctattctgtctcaactgtagcaactctgccaagaaaagaaagatgaaaggctagtgtgtggctaccttgaggtgtcctacctcagtggaagatagagaaggaagtgtgaactcaggtgggcaagcagccctgagtgctgagagaaccatggcgtcacggagcactttttgttgttgtttttaaacagagttgtttattcaccactagctgaacatttagggccagtcattccttgcaaatgattgacattcctacaggtgccctgtgcaggcatttatagaaaaccacagctggagagtagctgatgagagtttcttcctctttaaaagaaaatggtggccatgttgtgaacttgctctatgctcacctgatgccccatgcagcatcatattcatgtacatgtcacaaatgagaagatggtgaatcccatgataccttcaaccaggactcagcttaagctctctctctctctctctctctctcctctcctctcctctcctctcctctcctctcctctcctctcctctcctctcctctcctctcctctctcctctctcctctctcctctctcttctctcttctctctttctcctgcttccagcatctctcatagcattatctaaaagggcagctcatgtgtaaaaaggccatgccttgatgctttagaaagcaaaattctgtatcctgttagagaggaaagaatcaatctcttctaagcaaactcgaccggaca

SEQ ID NO: 17716 - DNA, 2484 bp, Mus musculus
gaaagaataacaaaggaagagagagaaacgcagcctgtattgggaagaatgaccagtgtggacagagacattttgttgaatgagtctccttgataggttaagaacattgatttcttgtgggaggctacatccttatagggatataagtgcaaagacatgcacttctacctacaagtcagcaagttctatggatggagaagcttacacacagcttcaacctcaggagacctgagttcttattcatacacatatgtgccatgtacgtacacacacacacacacacacacacacacacacacacacacacacagcagttcatgtgttttttattaagtgccttgaaaaacaatgaagaaaaatgtcctttcctctaggtagaaatcaccactgtctcacaagttaaggctcctcctgcttctcctgccccagtgactccattcccagcccccctacccacggctgagccacagtggactgagtctggctacccggggaaaaaaatcagagccctagatgactccagaaagggaggcatcaggaagataatgaaattgtgtgaaggataagattgtcctcatcaagatccaaatcttgactttctgttaatgcctaaagattgtctgtgccctagaaatacagtctaagccccaccagtatgtccagactgttgcatatcagtggtaaactgtctgaccgttttttttgctgctgtgatcacccacaatttcatttgtcttgcacccaggcaaaagggggagggtggacgggactggctgtggtccctttaaatgttaacttatgaaaaccctagttcagatggtaatgtcgcagtgttttgtatgaagagggggaacagtcatgccgacatctatttattcccgcgtgtgtgtgtgtgtgtgtgtgtgtgtgtgtgtgtgtgtgtgtgtgtgtgtgtgtttgtgtgtgtgtgtgtgtgtgtgtgtgtgtgtgtgtgtgtcgcacccttgagttctctgtatctactgtgtatgtgagtggtaacgtgggactcagtgctggtgttgtgatttttgacctagagcctgggtgttactgctgatcttggcactcgttggcacagtggtagaggtgaaaagttcatttgtctagcccaggggggcatagcgttaggagccctctgagctgggcgtgcagtagaagaaagttggtatttagctcaccctcttcttcaccctcccatgcagctaggattcagaaagctgggggtttctaaggaggagagaagtgcccactccgggggtcctgccctcacatgcccagtggaccatttaccataatccacccccccccaagaccagccctgtctaaagttatgtgcaactcaacctgcattcctctacaagtcctgcatccacttcactttggctgatttgaggctctgggtgagtcctgagggccgaaaagaagcagggtccccggggctacatgtagatacctcaccaaggctggaggctggtctgttgtaagatgtaaagaaagacagctgagtctgattctaacttagccagaggacaccttgacgaatctgttatctctatctgcaggtaagctagccagcctgtctccttgaattgttccctttgggaaatctaattcacagtattgatctccttttttgccttgtactgaatgacacattacctccacgctctcccggactaactggtccacagggccacagggttgcttgctctctcttgcaggaatggggagtcgacagggatgagggtccaaggaatgagcatgaatgacaagaaaacaaggggaacattaagcttttccagggtgtgcggttaaaggtatttgaccattcactggctgagccagatcacgggaactcgagagcttttactgtgattcttcaatgtaaaaaataaaacaatgtcagactgtgtttatatgatttgtataaagcctttttaagattactatttaaataaacattataccagaactatttttcctacattgtctttcttgagaacaaagagagccgggacctgagtgaccagattgccccatgtgctggagacttttctgggttttaccactcagagttttgtgtcctggaaaatgctccaagttagtcatcttggacagctataacagataccgtatgtcaggtgacttagactcaaccatttgatgcttagtgctggagactgagatcaagttcaagcaactactagcacatttagagtctttctaatttgtagacatctaccttcccttcatgaaccatatggcttttccttcctgagtttctttgtctgtttcttcttccaagagtattaacctcatccttgcaacctagtctaagcctaactactatctatgaccccacaacctcctaataccatctcagaggaagttagattctcaatatgtgaatttggagagcataccaacacccgtaattgtgaatgaactcacatggttggtcat

SEQ ID NO: 17717 - DNA, 1077 bp, Mus musculus
ggagtggacatagaaatattcaaaggcaatgaaatgttgctctctagatatatgtatataaatagtgttgatataactgtacatacacgtgtatatgtatgagttctatggcaatcttttacatttagcaaaatgctgccctactggaatatcgccactgcagtggcacttgtatgtaatgatttaaaagacattatcaagaattatttaaagaacattaaaggtctcatctaaagacagccacacactatttatttagcttcctagtcctttgattgttgtgtctgtataactgtaagggagactgtcattttaagtcaccacccgtgtaggagagctgagattcactcgggtgctttgtatccctcccctctctgaaacagtgatgtaccacaacccagcttgtttatctcagttttaaagcagtcctagtattgccattggtgtgtgtcatccaccatgtccttgatcaacttaattcaccaatttgcctcttcctttcattaataaataatgatcgttttgatcattttgcctgggggaagctaactcctctcttgctgcagggaaatagatcatctagctgttgttctgccttgttccaagttcaccatggaaagaagatggttctcataacgctgtcttaagcatagtttattttgcatttatttaaacatcttacttttttttttttttgaaagaactcttgagttgcacatacttggcacagatttctttcccactgcccttccccacaagatatcttttcattggtccatcagttttccataccaaacgcaagaacatcaagacgaaactgttaactcctgttactgtctgtgaggagctggcggcaggttctacctggagaatttagagggagagaaaggtagccggataatcctgaaccctcctgaggaaacagttcacagagtagctccctggaaactgatgtcaggatcagcctttaacagcaagcctcttggcagagggcactaactaacctgctgccccagtgtaaactgaaaccaagttccagtgggaaatcaagggtgggaggtagccattggaaaccag

SEQ ID NO: 17718 - DNA, 1849 bp, Mus musculus
ttctattttataaacatgccatattctttgctatattatgttcaaaggctagctctgatatcacgtgcatttcctattaacttttggattaacttatgatgtttttaaagtgacataagaaaaaagcagattctaagaccagcctcgtagtcataagcataaaagtgtgtgtgtgtgtgtgtgagagagagagagagagagagagagagagagagaaacagacctagatagataacagctcatttatcttttgaagtgatgggaccagagatttgttgaaacattatgtctagtaaattttcttcatattccaagtaataaagtaatatgttttcttggtcaagttcagaaaacataggccttggtgaggaagctttgcaggggctgcttttaaggagttggtgggctccatgtatatttcaaagctggtatgatttcagttgtttgcaaaatatgttttcaaactgaattgtgccattggtagtggagtggagcagcccagctccgccctctggctgtgggaaaatcccgctaccttcagtgcttacctgagtcatgtggaaaagaaagacacattcctgtcctgggagctttgtcagtcgctgtgcactctttcctggagcacctggtgatcggagacaggcaacgagagccaagtgctccgtcacacttactctactatgagagctctatacttagatacgccagaacaactcccaggaacacacttgaattggcagtcgtctctggggcctcagttacttcatcttaggttcagacaaaacccaggaaagctctccatgttgttttttacacttgtgtttttgtagcatctccctgtttcatttactcttgctttcagattttaacaaatctacatatttcttgtacatatgcatgcaaacgaaagaagggagtttgtactgatgccatttctcccttcagttgctggttaatggaatttgctagactcaattcccccttattgaagggtgagaacagacccttgtttatatctgtacagagatgtgtatatgggatgtggtggcactttgctgaatgtgaacttgccttgtcaatggaaagattgaaaaagtattatgtttatttatacatttgtataaatctatatatacacgtatgtatatgtgtgtgtatagataaagctatatacatatattccctaaaaaatgtgtgtgtataatagattaacagcctttgctaagcaagattatgcatctgtgggaaattctgggttattcggcaagccagtggaaacgacgacagtgtagagaacattaagcacgctgaaatgggactcctttggattacagtcacaatgacagattacattggtcacaaatgaatctttgtctggactcttctttctcagatttttgctagctattctctcattacttaacaatcacacatctttgccaagttgtctgttgtccaagtgctgggcatgtgcagagccacccccctgagggcggccttctgggcatgtgtggagccacgccctggccgatgttccccttttcctatttagttctctcactagacaccttggcatgaatatctcagctgtcactcacaggccttatcaatgacatttccccacagtatacagctttcagtaatattttctcttaagaattgggtagtcatcaaaaataaaaagccaacattcaaacagttaattttcaattttttaacttaggtaactttggagtattttacttacattgaaaaaacataattaatgactttatgattgatattagtattaggtgtattttcacacttattatcatttaaagagtttgatttgctttgtgttttaaat

SEQ ID NO: 17719 - DNA, 2049 bp, Mus musculus
tggcctgccactgtgctctggcatcctgggtggcgtgggtgggtgggtggttgtgggtgggcttcctctgcagtgactgtctaaaaccactgccttcttctagcgcagttctcagcatggctctgcattgttttgacattgcagagtgggagtgaggatattaacactaaactgtttaataaataggtttggagttcattacaattttaaagtatttactttttagtctcctttttagacttaaaaaaattaaactctattctttatctgacatgtgtaggataatctagcacagtggtttgttgaatggtcaacacaattctgcagtgtaatgaggaaacttagaaacatctttggaagagaatttagtcggagtgaatgaatgttctcttgtatttttttttctctattgctacccacattggtctatggattcttcatgtcaaaattatctcatgggagacagtcactcatgaaaagacatactgttttccccctttcaacaaataaaaaaataactgactcttccctgaaattcattaaaaaagaaaaataatgacttaaaattttggcttctttaagctttcttattatattcttgtggaaaccaaaatcacactttaactaaagttgtattttaaatgcaatctttcaaaatttttataatacggtgtctgtgaaaagcagaggcagatgtttgctggccagtgagtggaaggacatttctgggtcttagttctgcctcttgtagtccagtgtcatagatgctgcagctgtgggtaaatgtaggagcctgtgggctttcactccagtctttattcttggctagcttcccctctgcactgtggaaaggagcaagtaaaattgagatgtggcatttcagagatttgtcgtgactttatttaccctgtgttcctgagtatcaggaatgttttgagtggtttgaagagcagatccgatataatctctggctgacctaagttagtctgagaagcagtcttctaagataaacaaacgctgcttgactcttggtggccagcagcacagcatgtttccttttctccctcccctctgccttttgcacgctcatccccagtgttgcagtgtgctcgtgcacaaacatgaccacactcatcttggcccaggagtggtaggatcttcttttgttggttttcattgttcttcttatgtgtttgtttgtttgtttgtttgtttgtttgtttgtttgctttttaagctggggaccactgacctaactctatatgcaccccaagttccccatggaaaacgtttcaacatgcaggacggaaggcaccagtacagctcaaggccacaccgtcactttccttggggacttaggctgatttgccccaaattgactccagcctgtatcatttagtacaggcggctcccgcgggtcaatgctgacacagtggagagcttgacacctgctgacagtgtgtgcctctgttccaaagggttgaatcagttcttctcaacggtgatagctcttctcactgtctagtgttgagtatgtctcagggattccttgtggaaattagggcagtttttaaaataaaaaactagttttaaaagaaactaaaggtgactcctcattgatgagagctccagagagagaagcgtttgctctcacagccccgtggtgttgcgtcgaggacttctttctacgtcagctctcatctcagcttcagcatacagaatcctttcccatcatgcacagctttaaaacttttatttaaaaacttccttccccaatgagctttcagaatacttattgtagattttaagagaaaaggtatattaatttatgctattaacatcacctcataaattataagttttatactaaagctgtattgagtgtaatgaattatgttgcctatgtgttttaatagcttaaaattatatatgagcttctttttatttttatttttatttttattttttgacaaaacaaactagtgacgcacctttttacactggatctctgccgtgtcaaggtgtatagctgtcctttgctaccttgca

SEQ ID NO: 17720 - DNA, 2558 bp, Mus musculus
gatagatttgaaagctgacgctaggcctgtttggtccatcattggctcctagtttttacatgtttacagttgtgattctttggtgagatttgtgaactgtggaggacacgtgtagaatccatgtaccagttgtgaagtgatgtgtaatatcggaaggacacacattttaacagttctttcaaagcagaatttggaaattagacataatttgacttaccttaggtacttttaaaataatttaagtacttaggataaagtaaaattggaattttttttttttttaagtgtaccaaggtttggggtaaaactctttttgggtagtgcagtaagttggtggctgtggactggtgtgaggggtttcctcttgcctgcccacctgccttcccctcccagagcagggtgcagcttcgtgctctgcctggctttgctgatgggtccctgtcctttcatgtaccattaggtgttcatacctgagctcaacctaatttacatatgtatatttttaaaagtaaggcaacatatctccaaatgatgtggtacagtaattcttttgtcagggactgtctgatcctaactccttcctgctaggtaaaggttgggatgtattttccaacttctgctgtgtgtgttcttcatgccatgctacgtctaaccaggcccttctgttgaaggcttttcgttctctgccttgtgaaggaatgatggtgatcagcaggcattctgtagatactacgtgcctgagcttttggaggggaagtgccacatgaaatcatgatatgccctattttgtatttactgaggttggggaggcaaaatatgtttgtatttacttttttccttaaaaatcatgttaattaattgcaacatttatttttaatagctttgcctcttttgcatattgagaaatttttaaattataaattatgtcacaaagcaaaattatgtttggtgtcaccatgcacttcttttctggactgtgagaacagccttttgactgctggacctgtgagcccacgtcagtaggtttcttactttagtacgctgtgatggggtgagagtgagtggttgcctcacctcaaaagtgtcattttctctgctaggctgttctcaccacccactagagtcatcattagataactgtattcccagaaaatgcattttgtctccagtgtgcatcaactgaagactgtagcagagccgcactcggacttctccttatcagctcttctttgccagggagaggagagtcaggagtagtcaatttggactgttattggctatgtgtccctatattagctgctgaaaattgtttagttgtcaaaactgagtttgcagtaggttgcaccttttattgtttgcaattttctgttttatgtgcatttaaaagcccttctttgctttcgagtgaggaggcatgaactgatcaggaatgttgccagctacagcttcacgccaaaaatattgagtaagctcccttttgtttagatgcccatgatggcttctgaaggaatactgatagcagagcgaatgagtagcaaaagcacactcccttctgttttagagcagacagccaagcctatcatttgctttttttctagctttttttgtgagccccctgttgggagattatctgtctctaagcccagaggtgtttgtccactttgttacaactctagttgctgaaacaattctagtctctcaatagtaggtgggtattaatatgcaaagaaaaattcagcatcttttataatgcttatatgagatcatagcacttatggtaaggcaatactggaatcaaaaacaaaccctacacagatcctgatggggtagaagctagttttagtgtagtgctcagtgcgcgagagacagtaacaaagaaggctccctctgtctctgcaggtttctgggaccatttataaaggccagttcgttgtgttactgtgatttaccttggaagttgctgcagttagtgactgcatatgtgctctgaggatatgaatgtcagcaactgtaatctctggtgcctgaagggaagatgggctcctttaattgttgatgttattttagtaataatactcaagacactttttttttttcttctgtaaaaatggcttagcaattttcacacctgggtaggttacacagctagggaacaattcaggacaataagtggcagttacaagtagcccagcaagtgatagactatgcaatggacaaatcttctagttaccatcacattgctgaaaagcaaaggtgatttttctctagtgagcctactgtacgaggtattcctgcttagaaatgacagcagttccctgttggcaggtaatgtggtctgatgcccctctatgaaaagagtatggtttgatgagaagcagatagtcattagagatggagttgagaagtgatcattttatgttgtcaaataactatttataagtttaatctcttaaagtaaaccagactctcgactaaaggtcagaaaatcattccctctgtgagtcacactaaaactcctccgaagctcactgtccacacagcaaagttagtcctctgtg

SEQ ID NO: 17721 - DNA, 1340 bp, Mus musculus
ctgttacttttgtttgtttgttagcatgtttgtttgtctctgtttgttttcaaaatagggtttctctgaatagtcttggctatcctgaacttgatctgcagaccaagactcgctctgctagctgtgaactcagagattcacctgcctttgtctcctgagtgctgagattaaaatcatgtgtcaccattgcctagctggctatatttttttccaatgtggttttgaaagatagagtctacaagctagctttgaacgtctgatcgtcctgcttccacatctcaagtgcttagattacaggcctgcaccaccacacctggccttggccatttgatttttagtatatttggagtcacattttgtaatatgtattttatgctctgccttctgtatatgtgaggaacatcttcacgtgtctgtgcatttttgcaggtactgcaacagccacttgcaggtactcggctttatcccgaaaaaagagaggaagaaaaagactgacccggtagatgaggtgaaggccaggcaccagatggatgccatggcgtttagcctgacggtgcctaccctggccttgaagatgcccaatggactggatagcatgtccctctctccacctggggcaagggttcctctccactacctggacactgagttggaagacccctttgctttcaacgaggaagacgatgacctaaagaaaggggtgactgtgagaaaaaagttgcagagcaagttggctcagaaccggcaacgccagagagagacagagattttaaaagttcggcaagagcactttagcacccctcccacacctccacagcagcacacccacctgtcacctctgtctacttctttaaaacctccagcaccaccacagggttcagtctgcaagtcacctcaacctcagaacaccagcctaccaatgcagggagtggcccccaccacacactctatagcacaaataaggcaggcctctcacaagaggcctctgcccctccttccctccagtcgagctcccatctcagatgcccccaggactgaccgaatcctcatgaaagccgccgccttctctccacacttgtcttgtataagccgcctgcagagactggtgaaactgtgcacccaaaagcgtcagctggacgcggacctgtttcctcatttaggtgagttggcctcctttcctggaactgattgctgccatgaagtgtgcctgtcacagctattgtatatttcagcagaccactcacagtagaaatgttttgggatagttggttgagtagatacagttctgaattgaccatttgaacttttgttatagcttttgaaaattaaattcttgaaat

SEQ ID NO: 17722 - DNA, 1135 bp, Mus musculus
ctttttccttttcttcctttatttttattgcatttatttctttattttttttgtgtgcttgtgcacacatacataccatgggcgcctttacttgaaacttatgtttctttgtgaatatgctcttcctgtgtacccctggatggcacagccagagctctatatagaacaggctggccctgagttagaagtaatcctcctgcttcatcttcccaaatgctgggattataggtatatgatactgtaaccaactctgttttatatttcatataaacattttttaacaagttgctaaatattttgtcaatataacaaaaaatgtagtgctttgtaaaaagctatttttgaaaatgtatatttgttttatgtgtatgggtattttgaccccctgggtgcctgaacaccacatgggtgcctagtgcccacagaggcccagggactgcagttacagatcattgtgagttctgggcactgaacccaggttctgtagaaagacggtcagtgctcctaactgccgagccacccatcgagctcccactctttctcccctcacttagcccaggatagctgaggatgacctggtccttctcctagcacctcccatgtgctgagattataggtatagaccctcatggaattaacttgatagaagaggctctagctttgatccactttgagctagtcacagagtgaatctgatttggtccagttttggagagtgacataacacattgtataaaccccttttcctcttggatcttacccttggaatattagattccagacagcctctcatgttgggaagggcgacatggaatactttatgttctggctgagctggttttgtttatgtctgtgttaatgaggcctttgatattttgtagacaatctgcttcttcttggttgagcagcagtccaaactgtggtagcctgggctctcttcccgttgctgtgctgcagaagatttaaaatcaggtatggctgagaggccgcaagccccacagtgaaattctccacttgagtatgccatacactctctgatttgtttatcatctgggtttcttttttgtggtggccttttagctgatgttcacaaggaatagagtcacgtgatgtatgaagggaaacatatacactt

SEQ ID NO: 17723 - DNA, 1164 bp, Mus musculus
gtaatctccccaccatgactggaggtaaggggctgtgcctatcaatctccactgtaccccacccagcctagacagctgacctcaaaagcccggaagatggcaggtaggtgtgtgcctaaattctacattaacatgaccatagacactttcagtctaaaccttactgttttagaaatggccatttatagtgtttcaaagatttgggttttattgtggttactgggtcttgaaagaaactgttcctgaggtaagcaccgaatgaagcaggcatgtgatcgctttagattatttcagtgtgaaatttctgtaaaaaaaatacacaagtttaaggtaggcatggtggcacacatctttaatcccaacaactgagtagatggagggagacggatctcttcaagttcaaggctagcctggtttatattcaggagtgctcactctagataggtaggtaggaggtagggaagtaggtaggtaggtaggtatctctgattcaaatgtagtcaaatataggcaatctgaattctaacttatccacgactactcagacctgagaactgttacctgatcttatgctaaataagaagggagtctgtctgagagttgctgagagggctgctggtttgtctgtcttaagtctcctcaaagcccagcaggagcccttccagaactagatggtcagtggctgtgctggaggaggcccctttcaggctacaggcagagaatgacaatgtcacacatatcagggaacattattcctcctgatgttaagaaaataactctccaacagaagtcacatcttaagtgataattgggtgggttgttttgttttgtttaattaaagcttcaaagtaagattaaagattgaatttaggtagaattagcattaatagtcaatcttttctgtaatttataacaagaaaaaaaaagtgtccccaaagttatggttagattagttaaatattgtagtaaggagagaaatccatggagacctcaggataataagcaggggttagcagaaaggtgacactgttcatttctgtgacatttctggctaaacaagcttttgtagacccactgggaatgtaaccactatttccatgggaaaataaattccaggttccagacaagtaatttagagatgttgtggaacacagccactaataa

SEQ ID NO: 17724 - DNA, 1185 bp, Mus musculus
tatgatttcaaggctgactgactgctctgtactggacaacctatatgggggttcattcctgagagaagctaattctttttctcccagcagtcagttgcttgcagttctttgtctagaggtgagacctgtggaattttctcccttccatgttaaaattcctgttggtattggtattcggatcttgtttatgcagcctttctaggagacactgctttacagcagacttctggtacgctggctcttagactctttattttctggttccttgagcaatagctgcaagagccatggtgtagatgtgtctgttgtggctggggtccccacaatttgttgatttctgcattgtttccagtgtggttttcctctgcatttgctgtaaaaagcttctttaatgtgcagtggtagctacactaattcaggagagacggctgtgcctcctgctactctggatgcttgaaaatgacttggtttatttcctgaacagtcatggtctttgctgactgtaggtttcttagagatgcccttttctgtttccagttacagaattttgaaggcaatgctgtggcagcgattgcaggaggcttggtggatgctgaagccttagtagctctgaaagacttgcttaataaagttgactctgacaacttatgcactgaagagatcttccccactgaaggagctgggtgagaagcagtaagctgtgctccaggctgctgtttgggatttcattttgatttttgagtttcttgtagcccaggctggccttgaactctgtgtagcagaagaactttctgtctttacctcctaagtacttggattgaagatgagtgttacaactgttctcagctatcgttttccttttttaaaaaaaaaaaagcagccacatctgtaatgtcactgttcaatctttgacacactgggttctctaacataccagtacactttcacatctaagtcaaaccagacagcatgaacgtagaaagatcctgtctgagcaaaggtagcttagaggggtgggaaggaagctccgagggcaatgagaggtgaacgtgatcagattacacatgtatgaaagtggaattctcacccatcatgtgtagttaacacaggctaataaacgaaatcaacagctaaatcttacagaagaatgtagtccttaatacatgttgtaagtttagtttcatt

SEQ ID NO: 17725 - DNA, 1218 bp, Mus musculus
catttgtaactactcaagttgattttcttctcattctctttataaaaactcaaatttttcaaaaatgtatatcattttgcaacataaaaatgcccattaaaggggctggagaaatggctcagcgattaagagcactgactgctcctccgaaggttgtgagttcagatcccagcaaccatatggtggctcacaaccacccataatgagatctgacgccctcttctggagtgtttgaggacagctacagtgtacttacatataataaataaataaatctttaaaaaaatgtccattaaaaatgaccatgagggctggagagatggctcagtagttaagagcacttgttcttgcagaggacacaagtgcaattcctagcacctacatgtcgactcacaaaccatccataacaccatgggacacacagattatccataaaagcaaaacattcatatacataaaataaatctcaaaaaagatcatagatttttaaatcaatcgcaaaaaattaaagacaacacctggttttatcagagatccattcttcattaatatcttcatgcattcttggcaaaatcctcattacctctccagttcttgtgctaaccacaatgttacttcccactgcatccattacatcaatggactctgtctttctgagaaaataaacacaatttagtatgctgattctgagagtaagaagagtttctgttagctagttacttccatatcaggtttccttttttggtattttgaggcaagtctcataaggccatgttggcctcaaaccctctagataacaagtgaccttgaacatgtcctccagcacctgcatccctcgtgttgggattactaccagatccaccttgccttctacatttctaaaactagcggaactcagaacagcaatagaaataagcacctccatattttaatcacattatttgataggccaattagaagggcatacaattaattagtccttggctgctggcagtcagataccaatgaatcaaccattccagaaagcagaaacaaaacccgacaaaaatcaacaaaaatcaaaatcctcccaaataacattttatcacttatacatcaaaacataagaagctttaatgtggggttggggatttagctcagtggtagaatgcttgcctagcaagcgaaaggccctgggttcagtccttagctctgaaaaaaaaaaaaaaaaaaaaaaag

SEQ ID NO: 17726 - DNA, 2278 bp, Mus musculus
ttcacatgcaaagtagggaccgggttaaagttggctttagcattgctgacctagtgtgagctgaatttctttgtgaccttacaaggccaagagactgaagtcctccattttctcacagaacaggtagaacatggacaaccgcagttcacctttcccacacctctctgatcatgtgctttggacctgggggggccaccgctggggtgtgagggtagctcgctcattcggtccctggccattcttctgaaactaccagcaagggtggaagtttggggaagtggattccagttcactaagaatggaagtgagcatacttaatgaaatctcaaacagatgttcattctgaaagagtaagccgtagtgagtactgaatacaatgtctcccatgggtgaagagtaaagttatttgcctgggattgtgctaaaggttaaataaccagaagagagtgggagttcctgggaaaggaagattgtgtgttttgcctagaaagggctttgacactgacctaatgtggcagaatgtttgttttcaagcctgccgggagtgaagaaatctttgggcaagtatggccctagcagtgtagaagacaccacaggaagtggagctgcagatgctaaggatgatgacgacattgatctctttggatctgatgatgaggaggtatgacttcatctttatccaagcatattgagaagcctgaggacagatgccatagccactccctggatggatcctggcgtggctttattgtctgccttttaaaatttatcactgggtacatgatgaataaaatcaaatcaccttctttcggctgagctcctgatggatttgctttttctgataaatctggtgggttttgtgatgaccttgtcactacatttaagcagaagataaccaactttgtgaaacatcttttctctgtacaggaaagtgaggaagcaaagaagctacgagaagaacgccttgcacagtatgagtccaagaaagctaaaagtgggtaatcttcattgttagtagtgttgatttcaggagcttgtccagtgcttgccctaaagtggattttccccagttaaattgaatgggtcaatattttaaaacttccacagctactggtctacagctgtctttatggtagcagttgtagcattcctctgtgggaaagaaactgttacacaatttaatgcctctttcttagccacacaggaggaggattatgtgtgacagacacaaggcaaattgtgtgtgtgtttgacaaaaagatggtctgttttaaaacaaatttgagatttgacttaatggtgaaagtgttgagtgtttaggtgcacttcttaatcttccttagagcctgcagttgttgcgaagtcttccatcctactagacgtgaagccttgggatgatgagacggacatgacaaaactagaggagtgtgtccgaagcattcaagcagatggcctggtgtggggctcctgtaagtgtgatgcttgtgttttagggatttgtgcgttttcccgtaaggatttcctaacatttaccccttgatgttcttttttagctaaattggttccagtgggatatggaattaaaaagcttcaaatacagtgtgtagttgaagatgataaggttggaacggatatgctggaagagcaaattactgcttttgaggactacgtacagtccatggatgtggctgcttttaacaagatttaaatcattcttaagtcagtgcacttaaataaaagcttgaaagataacccttggctcttcattttgctgtgaaatggtatgtcttcattttgaaggaaaggattcagtgtaactcattagtggcgaaaacttgaactggaaagagaaatagctcagcatttttaaaccactcagcttgatgaccagaccaacctgaagttgtcttttagccaacactgtgtgtaccatagatataattaaaaggaagataaagaactgatgtgttattaaagatttagcaattagagtatacttttgtgattagtgaaataattcttttgctgttagcagtacatgatactattgataaactgtcactagatgccttcgatgtctttctgaaaaactgaatcttgggctgctgagatgactctatgatagccactgaggttgcttactgtttggttcactccatagagtaagagcgaaactctagaaggtgctctgatggccacgagcacaacacctgtacataagagtttttggaagtgtcctgaaaggaacattgtaggctcataaggtggtcaagtgtgg

SEQ ID NO: 17727 - DNA, 2278 bp, Mus musculus; identical to SEQ ID NO: 17726

SEQ ID NO: 17728 - DNA, 1190 bp, Mus musculus
ataacttccaactccagactgaaatggaagggcttttccagtcacttaagctgcgcaccctttctagcctcaaacagcttttctttgacttttgaaatgacactgtgttaaaaaaaaaaaaaagggaaaaaaatggactttgagtgtagtttttttcttttctttttaagaattactactttttatttgatgtgtatggccatttgtctgcatgcctatctctgcagagcatgcacgcagtgccaaggaggctagaagaaggggttggatctcccagaaccatgtcacagatggtcgtgagccctcacgtggatgctgggcatcaaactctggtcctctgaaagaacatccagtactcttaactgccagccgtcattccagccccaagtgtggtttttttttttttttttttttttttggttttgttttctttcttttttcttttctacaagacagatccttgtgtatcccagaaagggagtgagcagtgagtggagggtgtggcttggttacttcccagagcgatctgtagcattgcctgctgtgttgctgttgtttagttgggaatcactgtggcttgctgccctattgctggcaggaaacacagtgcctggaagctacctctcttttgtctggagaggtttttgcttatgaaaagtcagattatagtggcagcaatggaatagaagccagaagatgtcaaaggggagttgttgaacgcaccagaaactatagggttgattaggagagatttttcaaagtgatattttacctggggtatatatagaggtcaggggacacgttgcaggaggctgttctcttcttccaccttgtggactccaggattgaactcaggttattaagcttggtggtaagtgcccttaccctccaaactatctcaccagactgagttttttttttttttgtttgtttgtttttttttttttttagctcttatcacccactgtctgtggccctggtcatatgtacttttgctagaggcaggcctcagtacagaaggttaagaataagtagtatggagacttgacaataagcaagcttggacgctgttggcctcctgctgaagacagaccttgagtttcatatgctccacgaacctgaccacatgatatttgaaactgggcatcattgggcctttaaaaggtcagcttttgctggccagtggtagg

SEQ ID NO: 17729 - DNA, 1121 bp, Mus musculus
atatagaacaggctgggaatccaactttcttggtagatgctttcctagtgtgccagaagccctgcatctgattcctagcactggaaaaacaaaacaaaacaaaacaaaacaaaacaaaacaaaacaaaacaaaacacaaaccatcaaggctttcaccaatttgagggagtgtggatactttaaaacaaaacaaaataccccaagtatagtggcttacacataatgccagtatttggaaggttaaggcaggaggattcccttgagtttaaatcagactgggttatagagtgagaccttgtctcaaaagcaaaacaaaacaaacaaaatcaccaccatcaacaacaaaacaacacaataacacaaagccagttgtggtggtatacctgtataattccagagttctggagacagaaacaggcaggtctccataaattcaagggcactatcagctaccaagtgagttccagacctgcaaagattcaaagtgagatcctgtttcaaaacaaagaggactgtgtgtgctgtgtgtgtgtgtgtgtgtgtgtacgtgtgtgtgtacataaaaatgaattgaggaagggcttaattggtaaagtgcttgcttgagtttaatccccagaatccagtatttgaaaaataacaaaacaaaaccaaaactgggaggaaggtagaggcggcatctgtggagctcattggctgccagtcgagcctaattggtgaactccaggtcaagggagagaccctgtgtcaaaggatgtggttaatatttctgaggttgacacccaaggttgtcctttgacctctcctgcacacacatgcgtgtgcaggcaatatacacatatgtaagcaatgaattagagcagctgggggtaggtggattttaagaccatcctcagctatatagagagttcaaggatatcctgggatacaggagtctctctctctctctctctctctctctcaacctctctctctctctctcagaaaaagtgtctaagaaaagaaaaagagaaatacactttctaaatgtcccttaatatgtaatttttgattttgtaccatagttgttttgtattactaaaaaaaccaattgaatcaaatgaaaagaataacctttagaa

SEQ ID NO: 17730 - DNA, 1109 bp, Mus musculus
ttcatacctattgtcccacggtgatgccattcattgctggctgtgagcttattccccacagagaatataggctagggatggtcctgcagtaactcctcactcaatgggttcagggacttgctccctgttccctcgctatgggaattaatttcctgtatacctcagcccttgacccgacaattagatcccacctggtcagctctctgttgggaagggggagggggagcccttgccatcagtccttcctctctatggtcggtctgtccgttcctgtcagaacagagatgtcattttcctcccaatgggaagattcatgatgacactggcaacagaatacttgagggtggacagagatgtggctgggacactatgctatgcagcatgaaagagctacagcccctcagtgacagagccctgagtgtcccagtgcagtttctgggctttccttcgtttatgtgagtgtagaagagctaacatccagggcaagtgcagaccgccacaatgctttgactctcctgtttgcaactctctttttacactgttatcctgtcttcctctaatttccttgtggcaggaagcaggactcagctttgggctgacaagatttggagctagtcgtggagcaaatctatgagcctttctctagacacctctatggcctggcttcataatggttaagtgtcagaccagtgaccaggcgttctacacagggggaacttacttttgcagatgagcctttatttataatgaggtgacaccttgataaacacattgtaagatgaacacatcttaaattgaaaacagattgaatacgcctaagctactgcacattgttgcttagcaacactgcgcagcagagtaccatttttttttctcctggtgattacgtggctggctgagagctgtggcttgctgctctgcctggtatctgaagtgtttgttatattgctaatccaggaaaagatgaaaatttaaagtatgaagcccagtctctgctgaatgaacattgctctctcttccaacctaaaaccccattccaaggcttatcatcacctctgtgggtgtcttactaggacacacccgtggttactgtctggtttttatccagt

SEQ ID NO: 17731 - DNA, 1166 bp, Mus musculus
cagataggactagcttcttacatgtgcttgtacaaatagaattaactgtatacagttaatttttgacatagctcttaaaatttgaggttgtagggatcagacctagggccttgcacacacttggcaagtgctttagcaactgagtgacatcttgagcctctgggtcaaactttgtagtgtttactgtgataactgaaaaatggatatccgagacttatttgcagttttgtatgtccaggagccatttgtttatgaaagagcagtttgtggatttattatatcttctatactaactaacttcctaaggtccatggagtgtacaatctggtattccttttcctctaagaatggtccataatagaaagaaaacaataccatggattgtaagcaagaactaggatatcttaatgttttctccccttcttctttagatctgcaccaaatgagccagaggcggcggcagcagcggcagcagcagcagatcctggatcacctgaagtggtggtggttttggatgattctgatgagaaggaggatgatactgcagatagcggtgcagagaggaactccgaggattcaggatctgttgaagagatagattatagacctggtacttctcaggaacacgcagaagttgcagttcgaccatcagttattcaaaaactggaacggggacagcagcagtccttggaattggctcataaagttgagagtggtgtgaaaaaagttaattcagtcggtgttgttcaggctacaactagtggaaaaaagttagtgcgtccccctgtgatttgtaatgctcctgccagctctttgcctagcggctctttcgagagaccagttgcggctaacagtgttcctcggttagtactggcagttgcttcagattcttttccagcttgtgacacagagaaccttgaaacatactttgactccccagatcagggccctagcaacccatcatctcaacccaaaactaaagacccaaaaaagaaactaagtataaatttagacaaattgcttgcacagagaaatcttagggctaagggtgcgtctttttcccctgtcgtacgagtccgtgagctaacaggttctgagctttgttctgtaagagctgagtcttctgagttagaggcaggtacagcaggaaacccgagggagactga

SEQ ID NO: 17732 - DNA, 1276 bp, Mus musculus
tgagtctcatggtcctgaagtgggttttcatgctgatgctcaattagaggctgatcaatctccagtaaaccctgaggaagtagatcttgacctagaaaatcagagtgttcactctggcatttctaacctaagttttgattccaatgcttcttatcagtcagctaatgatcaacctcaaggggcttggggtgaagtaaatctcgatgagttaaatgtcgacatggaagttaagagcaatggctgctccagttctgagttgacatttgattccgattcccctcttctgtcagttactgagcggtctctgctggattttgaaggattaaacgaagatgactttaacctggaagatgaaaactgtgtgtcaagtagttctgacataacttttgattctgatattcccgatgactcagtagctgaccaacctcaagtagctgtttatgaggaggaacctgttggtctggaaaataagagtaatgaatcttgtgtttctggaataacatttgattctgatattcctcttcattcaggaaatgatcaccctgaagtagctgttaaagaagtaatcattaaggaagacgaaaacgttcacttagaagggaagaatgacaatcccagtggttctgaaatatgtttggattctaatgtccctcttcattcagtgactaattctgatgtagctgttaaaaagataaatccccccaaagaagatcaggtacaaatagaacaaattgaacaaaaggaaaatgaacctactgattctgaattaaatttggattgtaactctgttaattcaaagcccggatgttctgaagatcccattatattacgtgtttctgaaacaagattggattctcatgtcccctttcagtcagttattcgcaaatgtgaagtagttgtcaaaaatgtctgtcttcaaaaagaaaagcatgctgagttaacaagtaaaagcacggaatctcattctgaagtaagttcagcttctactgcttctcacccagtgacagaaccttatgtaggtaaaaaggcaaagagaaagacaaagcatcttgaggaagtcaacagtgatgatgaatatggtggctctcaaccaactttcaagtttgatgtttttcctcggacaatgactgaaaaacctcaaccagctgctttgaaagagggccatgctgacccaaaagataaaattactgagcttagagggatggccgtaaatgtgaatactgctgattgtcttgattcagtccttagccagcctcagttagcctcaaacgaaaac

SEQ ID NO: 17733 - DNA, 1315 bp, Mus musculus
aatgaacatagcaagcttattaatttcatcttttaaacaattgggaccgatatctatttacttagttaccacacttccaagttgaatagccagtaggtattctaactggataaataaaaagagcgacattgtgctatctcggttttcaagtatctcagttttgtgatcaaacgatcacaaaaatatataacttctttttcttttaaagtcattccataaaatatttaatccagtttttttaagcacctggtgaaagacaaattctttttcatttaaattggatctgcagttctgtagcttttctcatttgcacacatacccacagatctttttgttaacattattaagtcttacgtggaaaagattttgcaaatgtgaataagctttgaaggtaccttttctccctttattagtaatctaaaatgaaaatccaggtaattttatcatcttatttactaatattttggataacatttttaaaatgatgagcttaagctgttggtttgataatggcatgtggactggccattaattgtcattagtgaaaaacttgacatttcagaaaaattaagttaaactagtaacctaactagagacctacttttcaagtgaaaaacagtttatacatcagtttatcttaaactatctaattatattaaactagctagatagttaaaggttaagccaatttgacattttgtcttaaactacctaattgagtttaacagttgagataaagagcttggatacacagtgtgaacctctgtggtacttgagtctattcctttgagggtcattgactgagctggtgcagatgcatccccttttcttgttcagtcaagacctggatctttttctgtcattgatgttatgaggaaacacgaagtttccctttactgtgtaactactatattttattgaaactagagtcagtgttaagatgtgtcttgatttcagagataaaactgtgttaccttagaattaatgaaatatcaacgtggttttgttccaggggccattatttaacctgtgagtcgttaatggtgatactatagtcatctctttacttctaaatataagtggtaattatattgcagagtggacaaatgtgcttttttagtcggcaagtaacgtgtttaattttttcaaccttgcctctttatcttacaaacattttaatttctttaaaacattcttaatgggctgctagtttttttttaaatcctcaaaatttaattaaggaagaaaactctttcactgattatgaagtaaacatgaaaaagtattctttgtaggtattaatgtcttttgcagc

SEQ ID NO: 17734 - DNA, 1465 bp, Mus musculus
aataacctaccatgtaattatgccagattatatctattgtgattatgtcccgcaatgaatattcaaataatcaaaatttaaagttaaaaaattcataatttggaaacttgtctaaggaccttttaaagggaaagcaaggaaaaaattaaaatgtaaaattaacatcaccaaaaatataaaaatgtctggtacagaaattatggctttgtttagcattttgcaaatatttactaacttcttgtaaggattattattttagacaagattggaaacttacttaaaatggtaaaacttaagttaaaagtgaattattttagaatttgataggatataagatgtgcccctttgtctacataaatgttgatttaattttcaggctaggttgaaacaattggttattttgtgtagtcaagagtgcattatattctttcaatagtaatacatcaaattacaaccatatcatttcattaatcttgtcccttttagtatcttgaatagatttttattgtgattgtcctggtgaaacagtgtgtggacaatattgtgtaaagagtggtttttttgcatttgtgcattttaaattatttatgtaactagggctctgagtaacacgttttgttttgttttgttttgttttgcttaaagaaaagctatatttaaatattcaaataattatatatttccatgtaaaactaatgtgaagaccgatgtattttttataatgcaatttaaagtgtaaacttgttttgatgttatcaagataaatttattaaatattgaaatttgtgtgtactctctcctaatgttagaacctttttctggaaatacttaaaaagaatcagagagtaattaaggctgaagtaattctgtaaaaggcctgagagatgataaataagagaatgcaaatgttgatgctggcgagaaaattgtttaaccaaagatacataggttgtactcacataagtaattatttcaaaagattaaacaaccactaatttgcctggaggagtgatggggcagctgtttgactagcacgcctgcactgaaaggattgagttcaggaggcaggatccataccaccatctgacgccctctgggaaatgaccaaccccaaagccttccatctctctccgtgtcttctggtgccatagcatctgacagtgatgacaggatggcatggacaggtgcctgagagaatagtgacataagtgcttctgaccctagaattactgacttggaacatttgttggtcagggattttcgagtgagaattatcttcctatttacaatgagaagttactactttttagtaaaggacttttatgtttagaaacatggaattatagaattatacaccaaaatgccaactcaagtaaattcaaagtgaggagacatagctttttttcatctcttactcagatgaactcaaatattgagggaaaaattagttaaaacatttcccttt

SEQ ID NO: 17735 - DNA, 1611 bp, Mus musculus
agccttgttggatactataacgatcactgtgaagtgagaacattgaggcatagagtagttaacccccttcctacccgtagcaatgggccatcttctagtctctatccccttagagtcatcttctctgtttacttcatataagcagtacctttatgtttctctctctctctctctcctttgtttcatttatcatgattaggtgttttgttgttggttagttggttttgagagtctcctagttatagcatgctgagcattttgggttttaaaattactttttagcagttagttttaaatctacttaattttttttatatatttatgcctctgagagttgaatccagggccttgtgcatgtgaatcaagtgctctgctgcaatgtacctccagctctcagtcttgaatgacaccactaccagaacctttctctcctgccaacagacgggaaagccagcaggtgcgaggctagctttgttccctgcatggttcttattatctgattcctcctcagatccaagactggacagcagagttgccttttagagtgttcctgtggttcacttgagtgttgtatgctctcgtggcctttgactcctctttacctacccatcatgccactcttccctgtgctcagttctcattttcaccatcaacacatcacctcatgctctcaatcctttcacggtggagtgcttgcaggtaactgagaacaagaaccaacaaattgctgggttttaatccagttgtgccacagagccaggaagtgtgttggcagcctcttggttaagttgctctcctgcatatttagatacttactgtcaaaatcaggaagtcagcattgatctcacctatctactctgcagaccgtagtcaaattttgaaaattatgtcaaaatgccccttgtaggtcctggatttgatccacagttatggacttcatagatactttgttgtttcctcagtgtggagcagtttctcgcctgtctgtacttggtagcatggcattttgaaggtactggtttatttgtggaatatccttgagtttgagcttgtctgatgtttctttgtaatctatgcatttttggaatttgaaatttgtgttctcagtgtgtattaacagaagccatgtgatgtcagtttgaataaatgtggtgatagaatatattatgtgtttgtttttattttatataaaaaaaagccatttgaagaaccacagaatgggggggaggggtgtgcctcagaggctttaagaaattaatttatacttaaagttttcttggacctgtttattgtatgtgtgtttgtccacatgtggaggtcaggggggcagtttcttctaccacatagtttccaggatcaagctcatggcgttagacttggaggaaggtgtttgcacttgcacacccatctcacagatacttttgacagctaactttttggggtagttgtgactgaaaatttggtgtcacacactagcaattctggccattttgggggaagctgaggcagaagggttccaagttcaaggacaagtgtcactatattgtaccacatcctgcaaactggggcttagtgtggtatggtgacattcaggagactgaagccaggatt

SEQ ID NO: 17736 - DNA, 1153 bp, Mus musculus
cagtgccttttccaagaagaaaagaaaatttcagagagaatttttctaatacatgagaagtccacacttcaagcatgtgagtccctatttataggccttccctgctgtgttcagtactgttgaacagcagggcatttttgtagtatacaaaaggccattttaaagtctttaagaactttctgcaaggtgaaagccatctcaagtctgatgctgccagtgttgctgtctcagtgtttcccagacgagataaacttaatgcactgccttgtgagaggaccattcagagataagcactgacagacggctaaatacactgactggcactagcgtgagtgaggctatatcaacactctgttcaggattatgccatggtgactgacatacttggtttcttcctcacacgcacacgcacacatactaaataggtgactgtttattgaatctttactatattagtggtagaatcagtggttttgggtttgtctgtttttaattgactttgaagaacaagagaatctaatacttatatgaagcatcttttgcagatgtaacgtattgccctctggctttcaaacaaaccttggtttggaaggctgtattcactgtccccattcacagcatgcaaaatgactgctttgtgtaaggccccagtatatttttttaagtgtctttcttatctatttccttcttccttcctctttatcctaacttatttctgaatgtgttttgcataatcttttctttgtgtatgttcttctaaaacatatgttataatttcataggcctttcccataagtgatgttatctgtagatttctactcaacctggtatttaaagatctgtaactgtgtttatccttccatgatctctaagcatggccgtggatctttggagtgcatccagtacccattcattctccgagggagagaaatctccattccctttggctctgtgcagccataaaccataatctaatgcgtttgcatgagtcagtgtaaatatagcccataggcctgcgtgagaacctctccagtgggtactcagacttgctgtagcatggaaggcttatcctccagacagcctacactcgtctccccttgagcagagcacagagctccacagtgcattcagatccctactcatccatgccagg

SEQ ID NO: 17737 - DNA, 1161 bp, Mus musculus
tgaactgtggccacactctagcctgccatctttgccttacttcacacaaagcctctatccaacctgtaattctttttacctacctcatgtatctgctccagtcttcaatcccagcctcaccacaccgctatctttttacccagtgacaacccttattttattgtttatactcaaaggattatactttgccctacacacttgagaaaaatagcaattgataaaccatttcacttctaagtctaaaaaaaggaacaagccaaaagcaatagaagggcacaagcataattgtaggtaacaagctataattgtatgaatgtcttgacctaagtgtctgtgattgtcttcatttctacttaagaaagtaatcatttgataaattaaaaatatcacaagttggggtgggagatatcttgacaggtacagttcttgacatataagcataaggacctgacttcaatccctagaacctgtgtaaaaaactgtccaaatggtggcacatgctgcaggaagtggggaccagaggattagccagcctagcttcagttagtgaaccccagagcccaataaaataaggtggagggctcttgaggaaagaatgagattgacctctggactccctctctgtctctttttcatacacacacatacatgcacatcatatatacatatatgtatgtatatgtatacatatctacatgtacgtatacatgtatgtaatgagactaaagagaagcttctgtaaacagagggatcaggcatagtgtctgtaaaattcaggatccgcctggtgaccagcagtagctgtcatgaactaattcgttaaatgaactaaaagctccaaggactggtgggaatcgggggaaagagagttcttagaggattctgtcagaggtcatttgggtgagcatgaatacatgtttaagtatagacactgtcttaattgcctttctgtccttgtgacaaaccaccatgaccaaggcagcttagaaaaaaagtttttaactgggattaccgtgtcagaaggtaagggttcatgatgggggtggagtagttacagcaatagctcagagtttacatcttggtctgcaagtcggagtgcagggaaggagacgaagctcatatgtacatgtatctcctgaaacctccaagcccacccccagt

SEQ ID NO: 17738 - DNA, 1184 bp, Mus musculus
ctccaagctaagaagaacaacagcggagaacagacatgttatccttcattgtggggtcactgccttctttttttttcctgattgctatgatcaatgctttgtcccagctcagacacataagaatttgtcatgttgttgttgcagccgtgtctgaaaagcttaatggattgttctaatcaaattcctgacctttaaaaagttaattcagagctcatatccatctcaggcaccttgtacagaatcatgagcatttcccatgccgcatttattttttttcctttatgagataaaacctgggtattaagaacatggtatagttacagaggcttgtgtgggggtgcctgttaatgaataatcatactcttgggagatcactctgctgagaaacatggcaggagtctgtcatcatttgaagtgattggtttctctaaaatgttagtgtactgattatagaactcttgtcatctgatgcataaactgcacatggagggaatactgatgggcagtggtatgttcctggtttactcaatggagtgttttctctaggaatgctatggagtttgctgtaagaagtgttcgctctccaatggggcccactgcagtgacggcccctgctgtaacaacacctcatgtcttgtgagtcccctggaagtttcatgtttcttttcattccttgacaagttagccagccgtgtcaggatgtctgttgagcttttgagtgtcttgatacacatttatgcatgttagctcagtgatactggtaattttattgaacttttgtggaccacagcatgtgtctattcactgtctactttctcatcctcccaggcctcctcaagagggtgtacccacacctacagcctccaaactagacaagttaccctgttaacacagacaaacagattaaatcataggacaaaagaggaaaaattctgttggtctttaaattgaacaacctatttccaacattcattttttaaaacttaccctaatttgttttagacacgtagtataaaaactagaacttatatctcccacttggctttttgaatctcataatgtcaagaaagcgaggtgaggcagtacttacattgtcacatgtgtgcatgtgtgtatgtgtgtgcttgcatgtggggtgtgtgtgtgtctgtgtgtgtgtgtgtgtgtgtgtgtatgtgtgtgtg

SEQ ID NO: 17739 - DNA, 1130 bp, Mus musculus
acctcacctgtctttaatagccttactgaattataaggctatattacaaactaccatattggtaaaacattcagcaagactccttgttaataataattatatccagtttctaattattatccaaattctaattacccctaacgttgaaacataaaaggtaagcactagtaaagtcctggctttctcctttcagttgtgatagcccaatcctttgaggtaatagtaatggttttcaaatcaaatacagccttgctctgctgtgtttgctcagcattatttccctcccatactatcttttccccaccaggccttggagaatcaatcacacactttcttctctgtctacacaaacacctttcacttatccttaatattgagaacacccaaagagttagaatatttcctgctgataattgttgttcctgatgctgtgtgctgtaaatgataacaaacagcagtttctttcttggacttttattaaagataggtgggagggaagaaaagtctcgaataaaccctggctcactgtaacagtatctctgtttcacgaatggcaagccttgtgcgggctggctctgtgttgttggatagtgtggtgcttatgtttatgtgggtcactgttgaggtgtggtcttttgctatgtattgtaatgctgcatactggctctggttgtccttaccttgccccgcaagttagccctgattgataaataaagatgctcacagcctatactgaggcagaagagactaggtggagtttcagttcctgggcttgggatccgaggcaggagaccacgggagataaggaagaaggtggagagaggagaagatggcattgggtaggtaagtcatggaaaaaaatggccatgaaggttggccagctggagataagagcagcccagatagataacagaaaattataactcagggttattgatagggaagtaaacattaatagcttagagggtggatatgtgcccaagtctgatggtgtgaaggcttctcgtaaacataaaggcttgtgacttttatctgggcactgaatgatcgaaggtggggtagaactgagccccaccccattgagatgaattatttaatacaacagatcactgtctgctttcagtggtgct

SEQ ID NO: 17740 - DNA, 1187 bp, Mus musculus
tatcgtcttttttttaagacagaattttgctatgtagttctagctggcctcaaacccacaattctcctgcctcagcctcccagctgctgatattacaagtgtatgccatcatattcagctgaaaacaacataggtgtattagttaaactgctctggctctcagtgggttgctcttctagcgaccagcccaagagctctctggattttcaaatgaaagacacatttgccagtttacttttgatatgccttgactagttcagtggatgggcacttctaaacctccctgcagccagcacacactcccctccagtatttctggtttaacacctcctaaatccatatctcatctttgctttcctggctccttggcgcgggtgtgcgggtgtggggaggggggtggggtgtgtgtgtgtgcggggtatctttgctgcccaagaggcttctgagcagcccttccaggggccactttcttccttgtgcctgcattcctccctcctgttccttccctatagggtctgtcctaccccttctcctgttctcctggtggtcctttctgcccccctcccccaggaacttagaagttctgcctctgtcatcttgcccagccattggccactggctctttattggtcaatcaaaaatcagttagggacatggaccttcagtgtttggacatgtagattcccaattttgggacccaaaataagacaaagcattagaaccaacccccaacaaaataatatttgtcatgaaataatttattgcatatccttccagacatatctcccagtatactaaaattgaactatttttattacatggaaagggagaaggagatatgaatttatgtctagcacactgaaattttgaacaagataaggtatttttataatatcagtattatgctgtcaaataaaggggtttatttagtgtttatttctaaccttcagtttagtaaagcaaacccctgcaggaagaactaactgtggcctagaagccaccagtgctggctttgctgcctattgcctttgaagtgccaagggatttagagttggcccacccgtttcacataggtgaaacactgcctcctcctgttttggaaactaagaaaggaaccacccactttcaaaaagagcaaaacagagactttttttttttatgccataaaggagaacatttatagtttg

SEQ ID NO: 17741 - DNA, 2208 bp, Mus musculus
tataatttatcagatctacctcatgtgagagttaaagggaaggtaggattgactggtgagttttgactctaagggtcggtacttaaaaattaagcccctcccccccaaaagttatgaactaacatatttgttaatttaacattctgaagacagcgattttattttaagaaaacaagtcaagttttatgttgggaatgcctttcctttctagtctttgtctctagagtttggaaatctgagatgtaatttgagtcatgtgggcttcatgccatggccatctcctgtcttcctcctcccgtacttcactagacttctctgtgtaatgttgtgtctccatctcttcagttttaaaggtctttctctggttgtgtctagttactagcctccagactcttgtttacattgtttaccttgtgataaagcgaagtaactgcaaagttgtgaagcaggcttagagatccaagatgctccacaagtgcaataggaagccttaaccaactgtggccatgagtctcaggtctcagtcctgtcccctgtgttcacagagtacagtcctgttgaagtgaagctgttctcgtccggaaggtcgattccattccataccttccgtttttctagaaacaagagacaagtgtctgagccggttcccttttaccctttcagacatcactgaccctaaataatattccctcctatgttaatatctgacttcacgtagcccatgtggagaacacagtgggcatctctacctgttccaggtctttttcccaaccttggaaagctttacacagaagtgatggcgtacggctgcagagcatttctgctctgtactaataagtgcttggtggtctgcggcagcctctgcagtcttcagaggccctctctttctctcagcacacacagttatacactggaatctacagtccaagaactaaatgtccatttcctatgacagaagtgcaaaccttgagttatttagaatatgctttccaatcaccttccaggtaaattacacaggattttaaagctagtctattgggtgtttatgaattttcacaaaattgaatggtatattctccatttaaatgatgttaagcacattttgcagtttgaaaaacttataaggcatgcatcaatggttagtttataattacaatataaatttgctgtagttcagttaaagatttacccttatactgctaggcactataactcagaatggattagttatgagcctaaaagtatttataaggcattatattttaaagtagcacatgtagagtttgaagataaaaattattttcatgtattctctgatgtatgcccatctctgtttcaagtttctgagtgaagctatccatacttagccaactttcacagcatttcctggagaggtcgtttttgtgtgatagtgaaaccagtgtatgatttttctctgttttaaaaacaaatctccgtttccctccacacagtgaacatggccacgagcaggctcataggggccgtggctggcaccgttctggccctgggggtgatttttggaggcacagggtggggcatagagtaagcataccgagtgtctgcgtgtctctctgtggtgtgtgaggcgactctggcctggacctgacccttccatgcttgtcctgtcgatggttgcccgtgctggtgtaatctgtgttgtgatttttggatgtattgtgtcttgtgacttgtgatgtttcttgtgcaccatagaaccttctcctgtctggaacaatgtggggcatagaacagtgtagggtgcttattcacagttaaggcaagagcccaagactccctttgctctcctgctggcaaggctttcaaagtacagaccttattattattattatactattaattggcaaaatgcttttatgtgagtgtttcatagaagcattttaacgattttactccactattcaaataaatccatatatacaattaggaataccagcaactctcacactttttaaaggtagtgagaacgggagccagttaatgctttcctatggatttagactgacatggcaggcttcagctccatctgtctgagaataacatcaaggaagtcaatttctttcctttttttgttataagattggttcagggttcagctttgaagtgttcgtacacatcggagcaaggaacattataaatgaaaatatattaagttcaaacctgcacaac

SEQ ID NO: 17742 - DNA, 1141 bp, Mus musculus
atagccgaagccatgacatttggtcaaccatctagtcttagagatgaataggaatcaaaaaaaaaaaaaaatctttattgtaagcagtcctgttgcctttgttcccatccatcctatccagtgtggctggtgtgttgctatttatgcttgtgacaggtaagtgtctacgtgtatgctttaaaacaaaaacaaaaaactaaaggaagacttgatgttcttgttttgtaaacatttcctctatagtttattaactttaccccctttaagtttcacttatttgtaattgatatgtaatgagtttttagagaatagaatcatctagtacaacatagttttaatgcttcctcatttaattgacagtgtaaccaatgttcatgtaaccaataacatggacagattgaatttttgaattctaatatatagaatttaaatatataccccagggattactttccatggattctgtattgaatctgatcctaacctatcctgaaccaacaaagtaaatctgcttaagtgtgggtgcatacaaggtactatgaacatatttttgaatgccttctccaaatttcactgtggagagatggagacaaaaatatgtggaatagaatggagtttcatcaaggcagttattcacaaacttcctataaagggcgaggtataaatagctttgtcttccaatttctcaacagtgctatcagtatatctgcaaaaagttatcgctgtgctatagtaaaatgtctttacccagatagatagtgaggccagatgtggcctgtgggctccagtgctctgacccttgacttataacacaagtcttgaagtcaggcaagtccatgtttggatcttgtttccattatctattggctttataattgtctgggccttcatctcttgagcaggatggtccacattccaccttgcatgttcctgtgtgaggaggattcaatgcgatgatgtgtcaaatgttcagaagtgagtggagtcggggctcactctgcagtctctatcattatcattctcactgctgttatttattgtccttgatgtatctccaaaagccactgaaattcatgctctaaagctcctctatgatttaagagcatctcaaaacccaggaaccagataagaccccatcctg

SEQ ID NO: 17743 - DNA, 1165 bp, Mus musculus
aacctaactgagtttaagattagtgggaaagaaaggacagacttaaagacaaatcatccaaccagagatggacgtgtctgacctgggataaagctaggacaaaaaaagcatcagggaccttgcacaacagggttttgcctcctgaagctgcttacctgcctttcctttgtggtaatgaaagtagttggctcacatgactttcttcccatgatcctctgtcacaggtcctagcgccaccaatctcataataggctccatcgctggtgccatcctggtagcagctattgtccttgggggcacaggctggggatttaagtaagcaacgccgcatgtcttcttctctgtggctcgggcacctctcttttctgcttacataacctggttttgagttcctgctacgagactttggtgttgataatgcaactacaaccaccaccaccacaacaacaaaaagacgcgcttttactcagaagtgggttagaaacgtagaacatggagcttcaaatgtcatcttcaggcaagcagggaagtacaagctacgaaaggaattccctttcaattgagcccaagctgttctagaaagtaaagacactctgccctgtgggagcagcctcctgcagtgctctcctttgcacttagatgaccaagcaaacatgttggaaataaatacacttgaattcatagttgtttctgctaaacactggcttatagtccattggggttttctgtaccctcagtcagcacacaaccattgtttcttacgtgtaaccttgtgatttgaaaaaccttcattttttcacttaaatatattttaattgaaagcaatggctttgtggcatttactgtaaccttggtataactgactggcctgccgtgctttcataatgacttttattttggattgcatattgatactcaagattgctagagcagaccatactggatagttgcagataaaccctactatgttgtaagttttaaaaccccatttatctagtttggatattttgtacctctgattcattagagaatcactttcaagcattttgagccctggttatttgatttttaatatttgtagataagccttcctctgcatgtagtctctttcatagattaagtaagtttcatccagattaatggggatgaatttaagtgggaaatg

SEQ ID NO: 17744 - DNA, 1273 bp, Mus musculus
caaactaccagagttactgtttttaccggacatcggaacattgttttaatagtgtcttcctgaaaggttaaggaaacggggatgagcattttgcatatgcattaaaaacagggtcgctattactactttcatgaaaactgtttaggcaacacacctgtctttggtagttactgttgctgtgataaaacaccatgaccaaagcacaacttagggaagaaagggttcatttggcttacaattctatattatggtttgtcattgaaggaagctaggataggaactcaagcagggaaggaacctggaggcaggagctgatgcagagaccatggaggggtgctgcttactggcttgctcctcgtggcttgctcagcttgctttcttatagaacccaggaccaccagcccaggtggtcccacaatggactgggccttcctctatcaagccttagttaagatttctctataggcttgcctacaacttcatcatagggaggcattttctcaatcaaggctccctcctttctgatgttaagttgacagaaacactagccagtacaacctcctaaatatgaatacaagaatttagatgtgagctagatgagtgcacacagtatttattgctaacaagtgatagcaatgatggtggcaagaagatgaaataaaggtgccaatcaggtagttttctgacagcccttaccacaacattgatgccgggctgagtgtggagtgttccaccatattacaatgtgttaatcattggaatcccccaatattccatctggtctccacgagttcccatggcaaagtgagtttctacccctgccagcagagaccatagtaacctctcatggcagttcttgatagaatgttctctaatagcctgcagttctcacaggtggctgtcctactgagaagtcattggcatgagcaccctcccttagctctgagccattggcggttaacctgggttccattctgttccatttcttctctaaagaaaagactgttacagttggtactcctctaaaatgacagccaaaggactctggccagaaaaataactgaatcttggtggggagggaaagtatttttgattttctcaaagttaggatgccgtgaaatcaattttaacccgtttctgtccgagaatggtaaccaagtggttgctttcctttctaatttctgtgtcatattccagtgcagattaaggagccacattaccttactgtccaagactcttgggctagacactttcttctccatacatcatcatg

SEQ ID NO: 17745 - DNA, 1421 bp, Mus musculus
atgcagactaatgcatgagccccttgcttgatgccccacatgaagccagaccatgggaggttacaaccaactcacattgttgctgtgttgtgtcttgctattctttttttctttctcttcaagcccaggaatcactttttaggagactggacactgagtgaggcacttgaacctgcttctctccacagagctaaactgctgcatttgcttggctaacctggccctgtgtccattctcctgagtgtaccacctccctgtgcactctgtctgccaactttccaccatgagaagtgcctgttccttagtggagtaagacctcacacacccaaggcagaaatagccaggcagagcaaggatttggtgagctctgttgctacagagctctgggggtttggagggaacagctacaagaccttccaagttcttcctagttctcataggtgaaaactactatgctgtagtacttttcatctggtgaattagcaatggtttttgcttctgaaattagaccaatttgtggttgaaaatgaacaatctgaagtttcccctagtgttccccaaagtgtgtagtctcaatggggaaatgcaaacatgttccaaaacattagcttttctttgtttctgattacttggagactgcctctgtgtgagtggattactctgctctgggacacgcaccattgttgttgtcatcatttgtctctcactgtcatctgattaatattgtggcttctcttttcctctttctgcatcttctttgacgtactctggaagaaacgtcaagaagaggagattcgatcccactcagcaaggccccatctgaatcgtctgcactggaggaatgccaccttgcactgttgggttctgggaatgacatgttttcagccatgctgccggaactcttaagtctgtaaagaagacccttgggtggtaatgactacagagcctcagatctgagaattgggatggggtacaagacaaaggtcccttttggaaataacttcaagtaaccccccccccatcacctgtcaataacggggaggggttaaagaccatgtcattaaaaaaaacaacaacaacttcagaatccttttttttctttttaactaaaggagaagggagtagcaacaagtgcaataaaagaacaaatagcaaatgaccctgccccccagcctgctggcacttaatattttctaaatgatttggcatgattttttttccttttactatcaaggacaaactccagtggcatgaagatccaattttggaaagggtaaaaactgcatggcatatataacaacaagctagcaagccaaccttcagcaaatcctacagtggaaatcccgaggggaagatgacagatgaccacacaaacgctacctgggtctggattaatgcctttccatcctccaccacccccc

SEQ ID NO: 17746 - DNA, 1591 bp, Mus musculus
aggagagcttccaatgcaatcctaagggaacaggctactgaggaaattctctcaggtttgtttcggacatgcaggtgtacagtgaacacccatcaagaactcagacccgccagagagcccctacttctccactggcccatttttaccaagaagacatccagataaactatgcatttcttcccggcactgagttactttttacatttagctctaaggccctctccagcaagactcatgtcttaagttttacaacatattccttgactagaagggaggaggatttcctaaaaatagactgcatgaaactggactttccctcctcccccaaagatatctttaagtgttggcttttcaccctcacagagcagaaaccttgattgctatatactaccccaaaccataacaacatcttaaccttcggatggctttctgagaaacaggtgctatgcaggtatgcagtctttcgcttgaatttgctgtttgtttatatagtaataacagcgctatctataaggcttactggccttattcctggttccataagacacaggctgtacccctttactgaatggcatgggctcagcttggaggaaggtcagaggaaattcagataacttggtatctcttcctgtcgttgcaatgtttcggggtccacttcactatgagataccaagcagctgccaacctcaccatactcatttcgttacaatttctgaggcaccgtggtgacttgatccgacatacgaccacgtcagttacaaaccagatctttatggttaacttttgaacatttcacaaacaacattgtaaatgtgcgatgttatgttttaaatcagaccacagtggtccccaaatattatgtacatatgacaaatgtcagtgtaactttttgttacactgacagtttcataggtaaacaaacctacgctccaatgttaaattatgcttgtgtatgtaaaatacacaagcattgggctatgtgtgtacggacatgagggtagtgcaatcgtactgtacgaaatgggtcagaatcattttcagtggtgttaggttatgtagtttcagactccatgctgcattttctcttgcacatgccatccatttgcttattttggagtgtgagtattccttcttattaatttgaattcaaagcacaagcctcccattgttcaacattacccaacaagagtgtccagtgatgaccgagttatctcacctgctatacttttactgcaataattaatgacacctggatgaggaggcgtgcgctgacttcattgttcacccgggatagtgcatgagcccactgaattagagctgcttctaccagcaaagtgagcagtacacataggtgcatgtttgaaacatgaatcacatagagctatggagttttgccaagtgatgtgttttctttttcttttttctttttttttctttttcttcttttttttccttttcttcttcttcttctttttttttttttttttttactatgcaaagatgggaaatgcacaaacttccaagacatgtctgaagaactttacaatacttgaattttttctttaatcatcccatcacatttatggtcatt

SEQ ID NO: 17747 - DNA, 1188 bp, Mus musculus
atccttatggaccaaggggtggacttcaatgcccattctatgtgagaccctcctgaaagctgtaagtaagcgctcagcttccaggtggcccaaaagctgggtaaccaaagctcctcttgttgtgaggagttcaataagattgtggtatacttgtggctcattttgtgtctgcatgtgtaccctctatcaccagtgggcctggaaaaatgagtcccagtctatattttgcagactctcctccagtttcaaaagttaagttgggagttggagaggagaaatggcttggcagctaagagtgcagactgcttttgcaggtccccagcacccatatcaggtgctcacaactgccaccagcttcagctccgagggaatctaaggttctcttctcacctctgagttctgcacttgcatgtactttcatacacaataataaaagtaaaatcttctttttaaagaaagacatcaattgagtcaaacgagatcatgctttttgcagtagctaagagcatctgctttatccacagtaggcagagttcccatggtgcagcacggcaggatggaacatccctttgctggctaatgcagtaaggctctggataggtcatcatggtgatttcccaggttctgtgctctcagcaggagatgcagctctttctgactgcaggttctgtgacagtgccgagtcattctgaccaaaggcttcttgaggctgctttgacatgtgatcttactctctgcacatttctccaggaggcaaggaaggagagaaaccatcccacctccttttgttttcctcctgttcttttcacacttgggttttctattcttttcccatagttcactgcaagtcttccactgacctctcaggcactgttcccatcctgggatcatgttatcctgaagagagaagagaatgtatcatcaaactttaacccagatggctttagaaaagccatcccttgtccatgttaaatgcagaatggagatgtggaattaattacaggcaaaactttcatcttttcataactaagttgaaagaaaatagtgccaatatattgggaacctttatagtattggttgttgcttaaactcatcagaaaatattataattttttttatcattccccaaagttttttaattaggtattttcttcatttacatttcaaatgctatcccaaaagtccccc

SEQ ID NO: 17748 - DNA, 1227 bp, Mus musculus
ggattgaaatggggccatgagcagtctatttgcatcttgcttccatggaatcctaggaatgcttgcagtgtctcttacctgctggactgataagagtggaaagagatcaggatttagatgttggggttctatggattttgcaaagtgtaaggtagttctgggaccctgggtctctctctgcaacagtggttaaagtcattccatgtggccttgctgaactcttcagaaatactcaaagagtaaataccaaagcatcaggttcatagacaagaagatcatttcagacactaggcatgaacatcttctctgtcttcctggtttgcctgtcaatacatgcatggtgtcctggtgtcctttacctcagatggttacttctctccttccttcctccacagacatgccttgagttggaacgctacctccagacagaaccccggcggatctcggagacctttggtgaggacttggactgcttcctccacgcttctcctcccccatgcattgaggagagcttccggcgcctagaccccttgctgctcccagtggaagccaccatctgcgagaagagctccgcagtggacattttgctctctcgggacaagttgctatctgagacctgcctcagcctccagccaaccagctcttctctagacagctacacagccgtcaaccaggcccagctcaacgcagtgacctcattaacgccgccctcatcccctgagctcagccgccatctggtcaaaacctcacagactctctcagccgtggatggcacagtgacgttgaaactggtggccaagaaggcttccctcagctcggtgaaggtgggaggggtggcggcggcggcagccgtgacaccagctggagcagttaagagtggacagagcgacagtgagcaaggagggggaggggctgacacatgccctgaaaacaagaagagggtccatcgctgtcagtttaacgggtgccggaaagtttatacaaaaagctcccacttaaaggcccaccagaggactcacacaggtagtggtacaagttggccgcaggtcgtttcttcctcttttgggtgttccctttgtggcgggatgggcttctcttataagaagttatcttcatgctcactcgagggtacagagaggcaggagggaagtggagtgactcacttccgaccctaagttccagcacaggacatggatttgtcattgcctggctgaggagagagctagt

SEQ ID NO: 17749 - DNA, 4953 bp, Mus musculus
gaatacattaacagaagtaaccaactgaatggaaagcatggttttgaattttgagttaagttaaaatcatactataaagcttattctggtgagtactaagtcttaatgagtaggtgctggccaggaagctaactccttgagttatacaataaggtgtttaataaataaagacttttgtccttgctttccgaatcctcatactgtcactcatttacctagtccactgctgcatttacactgtgcagccaacaggagcgttttcaagatgtccagccaaagtgatggaaagtactaaatagacaaccttttctatagtcatatttttatcagagaatctcttgggatttttttttttaaatcaaagaagttacaaggatgtgattctaaaacattgtgttaaatgcacacaagaaaagtaatttccttcagacattggagtgtgtgctatggtacaatatttggcaaacacttttttttttctcctaaaaaaggtggtactgctttaactatccaaaagctgttctgtttctgaagatgtttctacttacatccttacctatagtctacatttatgtgtaacattgtttctgataagacttagtaataactcattttttttttattaaacctaataaaatctaagagttacctctttaaaagacaaatatgaggacagtggaggctggcatgttaggttacttcacgtttgaggaagaactcagactcagaagagtgtcttatatttgctttgggatattaagaaagttaatattaatatcagtatacgtatgagcgggaactgtttggcccatttctaagctaagactaggttgctatctgtaaatgttctacgttgtttataacaaaccattgtcttttttcaaggatgaacagtttgtgaaggacatgattctaggagttgagtgatgtaataatccttctgtctggacagttcaccagattctccagaaggctttcaaacggctaaagtttgatctttgtcctgctgagcttgctgggaaggagatagcataaaagctgtctgtgctagcaagtagatgtatcatttgctaaacgtggtgaaacaaaaaggaagcagaatcacaaatctgtcaacaaactggaattacttcacattaagtcagaatgtcagattgaacattttaaatgtcacaagtggaaaatttgcctagcgtgcagaagttgtaatctctaagtgtctatcttcaaaagtcgaggttttctacataatgaggaaacaggtggtctccttaaccctttagagaccaaggcagtctcagccatacttcctagttggatggatattaatttacagaggcctgggtctttatgcttggagcatgactgtactagtttgacaccagttacttgataatgtgagaaatatatggtgttgtgaaacctgactttgaaatttcagttcatacagaaagaaatcaaagcctctttaatgcaagctggattttttttttaacatgagaatgagaaaaacaaaaacaaaaacttgtttttgagctatgtggagaatctttattaagaaaatgacataattttttaaaaactcttatatccaaaattgtatgtggccacattatcggtaatgttttctcttcatgttggccaaaagggaatggaactgtcataggaatctgtacatatgctactgatttgcctagagaatagaagtttggtactgctcactttgcatatatatagtggcacttttatctatagggcagattaactctaataaaaatgaaatggggataggtttatttttgatatattactcttctgagttttcaagctttgatagtgtttaactgaaaaatggtttagaaagggctagatccaatatgttcatatttaaaaaattgatatgagatacaatttaagttctttatcaaaagcaagtaccatattagcaaccatcatattgtcctaggtgctgtgcttgtttagatggtatagtgtgggtggggacgtggcattttgtaatatatgtgtacatatatacatacatacagtatatcatctaaatgctctgagagctggtatgtcaggaatgctgagtattatagcgtattgaggtccggtgagattccactttgctgtgctttctcctgcatctcttctggtgtttcagtgactgttttactccagcactcacaactgggttttctcttttcttccagttttttattaggtttttgttttgtttggcttgatgcttttgagtatgttaccagtcacttaaaaactcctaaaccccaagctcttttccccctgctttgtttctggcagctataaaattggtaagaacattttgaaaaaaggttttaagagaattgtttcaagaatcattttgggcaaagacttttcatgtttcatttgaacagggatttttgtcaagatgtgttttgatggtaggccagcaagcagtgctactgtctaaagcacaaaccagtcaggcaggctgtccagccagaagccctcttggctgaagccggtctctgcctctcaggactcctccctactattttcgaccatttagggtgacatggaatcatacaaatattggggcttagaaacaaacatttatataacccggaatgcttttacgtacttgaagtgacttcagtcaaaatgttgcctttcctgtttaggaagctttggttctctgttgactcgtcagctagtaacacaaatcggtttctctaccaatagctgcttcattttcagttccttccagaggcttttgttctgcctttgtaacactgaaactctggattggcacagcatcccggggcccagtacacaggctgtatgttgacttgaggttgtatttacagtagttctttgtaaaggtttgctgtaacttgcacttttttttaaggacccagtttgggtatcagcaacttgggaaattccttatcaatgagttctcagctgacccttttgtcttcctccttcaaatcatgactccttaatggaagcgtttcattgatcacagtatcatagctagccttaagcatgttataaaagctaaatatctgggaattaggtttgactaatagtgaaggaaaaataagtacttataattttaaatttcatcctccaactttagttctatgtagagcatgccaaaagttttttttcagaagattacaaaccttgttaaagcaattaatttgttgtcatcatgggaaaccatgtaatcgatgttactaaatcattttaatttggctttgttaacttccgagaaatgctgcctaaacgtaactggtttctgactgcgggggagtacagtatgctttgttaggcctgtaggtgactcattctagaataaacgtgttcactgagatgtacaaagcacaactagagttttgggtggcttgtgtgtgtcttgattactttcaatgttaatgttgactttttaagttaacagtcactgttatgtactaggaactggtttccttgactttctagaatcaatggccaagagaggcatataatccttgaggggttgaaggtatcatgaagttgagtcagtatggaagaatttcaaacaaatcaaacagggtgctgaagttccggctgactcatctgctcatggtatgcttactgattagtgaatgtagttttaagcctttgtgtgtgtcctcaggggcagacagactttaacaaggaccagataacatttgaatggaggaattatatttcaggtgttttagcttgaaatttattttttaaaaaaaagaaaaattaaaaaaaaaataagagagcaaagtttgggaagcgagttgacagtatgaaagcagcagagctgaggatgagctggcctgtcccactgctgcagtggggtgggtcccagctggggaaatgttacattgttaccagcaagaaaaaggaagaagggtcaaaaagtaggaaactcctacttttgcaggcatgatttactacttgtccatagtagtatagcatttctaagcttctaagggcatctcaaaagataagagtaagtccgagatgttgaaaaaatcagtagggaagaaagatcactgcagatcataatctatgttggccacatgaaatgatttattatatttgggaagttttattttcttatgttttttaaaattgaattggtaagtgctttatagacgtatttttacccaggtgccacttcaatgtgtatgtaataaaattatttatattaaaagtgggaaattttgtgaacatttttctgtgtgtgtagatttattaggatggtgaagaagtgtgctagttagcagttttctgtgtaaagctgtcttgagctgatctgtacacatcggttataatgccccagtggaacctagacatgtcacttgagacttttgaaaaacaaaataaccagggaagtcctagaatggtatttggctgtttggtttttccttgagtactggagtagagaatacctccccagaactgtcagcacaaaacagggtatcagctttaactctgatgttcctattggagtagagtactaataactatgagaaggggaatacatttctaataaccttccctacaatctagaaacgtccctgtttaaattttttacctaaatctttttgtgctttatgtgtaaagaataaaagtaccaagacaccatgcattttattaacactatgtacatactggctgctttgtgttcagaatggtagcagttactttgtatattaaagtgatccttgtgaatttgtgaaatattgtcttaaagtgcttttcttactgtaatctttgtggtatcaactgtcataatgccctttttacacagacatttatgtgcagtcacataaacatgcttttaaaaactctgtaaagtctcttttttgggcctgggacacccctccccaagctagtatttgtttaccctcattttcttgg

SEQ ID NO: 17750 - DNA, 1219 bp, Mus musculus
atcaaacccttccgaccacccgagggcaagcacaattttcctgagcaaatctcaaacggatggtaaggctatttccccacccacccacctcggagaagactgactaactactgctgatactcagtgtgttacagtatcagaagcactccatagggcctgtgcactgacttttgatgtgggatgatgtgctttgctttgtttactagcagtcttgtaggggagcatgtcgcttttataaacacactcccaccttgttgccgatacagatgcatgatttagaagtggtgtgggcttacggctgtctgtctctttccttttcttccttaatccaacagtgtgtttcaaagattaatgataaataagattttgggttctgttatatttttatgtgaaacatccaaacaagtgtttcatatatgtcatttgaccttattttacatagtaccccctccatgtaagcctgtgtcacacccagatatgtgtaactcaaaactttcaggctatgtaaaacttcatcctattgcaacagacctcagatcagacatgtcctaataattcctaaaaggtttggtagtgtgtagatttctgcttgtttatgttgagggtctgaactatggagtttgtttgtttgtttgtttgtactattttctgtgattttggttggccctctcctccgtttttaaaaggtaactaactttttctgttggttttgactgtgactgtaatggagaattctccagcaatactggaatggtgcagtaatgcagcccaacactaaggggacatggtgcttttagcatgtatttttgtacttgcgtgtattttgtgagccttgagctatacccattctggttactactgctgtatcttcatgcacaaagggcgagaaagcagtaaaagaaaagctatctgttccctctcatcagtggggaggaatgtgttgagtatgcagcctagtgttgacagaggtggcagtgtggggaactggtgtggccaagtctcttctggactctgtgtgctgtggatgtcatgctcggttaggttagcacactcccttcaagggcttattaaggtaggctcagtgtttaggtgtattgcacaatatttttattagctgaatttctcacctgccctagagtatttccacattatcttttgtatatggaaattcacatttgtgcctattagctgttagctttatagagttgattttgacaaa

SEQ ID NO: 17751 - DNA, 2057 bp, Mus musculus
ctaagtatacgattgaggctgtccttgaactcctatcttcctgcctctacctcccaaatgctgggattaccatgcctggctcagatttttagactttaaagacactaaccatataactttggtttttcttgcccctgccccacccaactgctgcatatgcttttagaattgatgcatttcagtattaccattaaaacatgagaatccttctccatttttgtggtgctgggaatcaaattgaagacctagcaagtgcttggtaagcatttgaccactgagcaacactcctcagccccaaacaggattcttaacactcatgaaaccacctaggagcagattgtagcctcattaggtattaaaggttctctcactgtatcatcagagctgctagtcattactggcaatcagtttaaattaccagaaagctgctggaaacactcgccattcacgttgttcgtaagcgctgcttgctggcattttggtgtgtttggagccatagagagagagtgtcctgtgctgaccacttctgttgcgtccacgctgcgttcatttcctgttcactactaatggtgcttctcatcctctgatctcttctctctcgtgtgttaaacaagtgtattaaagatgcttcataatgccaacaacatagcaggtcagtgaacatgatcccatagtaaaatacaaggggtccccaaaattagtgattgcttcacacttactgccctgtgggctctctggggacactgcaacagaagccacaaacttgcacaaaacatcatttgaaagttttaattttaccaatttgaagctaatttaattttattgtttctcagttataaccgtaaaccaaaaatattccaaatgtgggaaattaagttgaagggaaaggtgacttaaaactttcaaataatgtttcattagttttgtagcgtttgtgattgtaaggcatcagagctgacaactacgtggagctgtgggagctgccgtgcctttccatggaagcactctgttctcaagtgttctttgccaggctgggctctagccgctttgatcacctaagtgtctttacgctcagtcaagggaggctattaaagtggtggtaactcacatggaacaaatcaaaagaaatcagatcctcaaacagcaggtgaaatgagcaattaaaaccctgcgcgctctcctgggtgcaggtctctctcaagccgcatccttgcaggcctatgcaccggctttcaacggcagggagcgaagactgggaaagggatggcagtagcagctaaagctgaaataataaaagatttgcatcctacaactatgtgcattctatttcttctcacatctaaccttgggagtcttacctaaaaagccttttgtgggccacgaatacttcctcttgaggctgcaatgcttcccatgctcgtcagtgctgccaggctcatcactttcaagggacagacataagtgttacggaaggatgtatgaaatattacaatctaccacctcaaaaaacattgtttatggagttcagagcttagagattcaagtattgattgcagttttattttgaaaagaatgctacaacttaacgtggtttttctttctcatgtttatattaaaagctaataaattctattttaattaaaatatggcgagtgtgtttgtactacttgtctgtccacagggcattatctctagaacttgtgtttaccttggtcgtgaaagctttcacatactcaccaatctgttctgattcctgtcatctgattcctgtcactagttcaggagtaattgtgctcctcggccttcctaatgctgagacccttaatacagttccttgtgttgtgccgatccctgaacactaggttatttgtgttgctacttcatgactaaatttgcaaacgtatgaattgtaatgaaaatatctgagaacccctgtgaaaggttgttccaccccaacccctaccccaaaagggatcacaacccacaggctgggaaccactggcttaggaatgtgttctgcctgaagatagtgtattatactaggagtctgtctagcc

SEQ ID NO: 17752 - DNA, 4914 bp, Mus musculus
gcatcgtggtggcctgctacctgtatgagcagcactaccgggagagctgggaggcagccctcacctgcgcgtgtccgggaccggacgctggccagccacgcgccaaacccgagtactgggtgctcatgctcaagtacttcatgtgcctggtggtgggcatcacgtcgggagtctggatctggtccggcaagactctggagtcttggcggcggttcaccagccgctgctgctgcagctctcggcggggccacaagagcggtggcgctatggccgcaggagactatgcggaggccagcgccgcgctcaccggcaggaccgggccgcctggccccaccgccgcataccacaagcaagtgtccctgtcgcacgtataggaaggcctggaggccgaggcccagggacagtgctggaagttgaagggggcagttgtttcgcttggtagctttgtgaaggtcacttccgtttaccttcttggtgctgatgccccctcccagagtggcttggagaggaaaagggggcggtttcaagagattacctgtccccagtcttctacagggggctcggctcgcagggcagtgggttaagtgtattctagtttgcatttcttactgctttctttagaagtaccttgtttttaatttatatgtattttaagttttaactttgttgcattttggcaacaaaatttacctttgctttgggggctacataatcctcaaattggcattgtaatgaggttactgttggttcaggtttttttggactgtgtggtctaaattaggaaaatatatttcctatacgtgtcttttttttttttttttataaatgtgaacagtgaaaggctgctgtgagtgggaaggtgtggagtgtgtgtgtgtgtgtgtgtgtgtgtgtgtgttttaaggtagtttcttcttacagtgcttaaaatgtccaggacacttagaggccagaggccatctgctctttctgtgtctagccccctcaagtcctctgtgaaagtagaccatgatgtggttaggaccatccctcacatgataaggttagagttttgtgagcctccttaaccttgctcagcaagcgttgggctcttggcagccgagctgccatctttctcatccccgatagagccagccgcccttgtcgtgtcttgaataagttagaggaggcattatagagcggacctaaacatttgccttggagcctgagggatggggattggctgaatgtgaattctgaactagtgaggtggtgagccttctgctggagagggtggctcttaagatgctccagagagccccacccccaccccccacccccgagcttttgagaataaaaaattaggctacaaatttcagtaaaaataaattcactccctttttctggaagtagttaggactctttgctaaagggggctctcttttagattaaaggacaaaaaacggatatgcttccagtaattaaagtaaattcccattgcttcgaatctgcggctccggcccacctcctttatcatgttaaacagtcctccttgcttttcttattcctcctggtggagagtggtgattagaaaccacacccacccaccaatgaagtgctcagactgggggagggaggttagttacctgggaacaaaccttggctcagggggaaaacaaatggccctgaactcaaggtttaaagccagatagatatattccccaaagcagctacaccatgccctagtagcctgaaaaccaacaagactcctaacttaagctttgtaatatgggggctactgtaagtgtaaagccactgctggagagaccaggtttctttccccccccttttgagagagcctgtatagtgatggacacccccttacccagtttccctgctattagaagagtctgtttgctttcctaatctatttaactattcattcactaagagtgtggggccattactgggaaggaaatggcagggcgtaccagtgaccaaggcagagcggggactgaatttagggatctaaaatggccaagccactgaaatgtcaccaagctttcctagagaaacagctggagtctaggcatcccgattttcttttgcagcagctggggggtgggttgggggtagggagagttaagcctgagccagctttatgccccagggactgagtggaaaaaagcgtagttcccactgggaatgtaagcagtcagagggtgttcacatttgtaaaatactctgccctcgctcactggagtcagaattagaatttcagtggcttccacaagaccttgtacacctagatgcaggactctgtgaaggtcttattccgatgcccttttccttccgggaacctcaacacactcactggctatgcaccacttctgtttttcaaatgaggttcttttcttatcaccttgccctcttgccttgtttagcatggtcttcccagaatctgctgctccctccccacccaccccccctcagtctgctgtgcatagttagggttgttcctctctcacaaagaaaatcgagaattggacatacagtgtatctaaaagttgtggggtggagcggatgaaagtgatttaattcatcttttttagaatgattatttttttccatctaagcaacatgccaaagctgtaaaaaaaaagaatgattaataataccctttgaacaatacagcagttgaagtgggcgcaatgctagagctggaggccgggaatgcctttggatggagcttcagaggcctggagttttctgtcctctgctcccctctcccttacccttagagagacaaagcgcacctgcttccctgaagccaacaggagtttctagccagccctaggggagggaagagggaagctgccttcggatgactaccccctcttcccaccctcttcccaccgcacgttttcctccactttgcatatctgtactgataacaagaagcgaaatgaaaagccttgggggagttcagcaacttgtgcaccgccagccttgtgtagctgagaggactagggttggtctcagatccagggcgcgtgcctttggccacctcactcacctctcaacccctgggatgcttcacagattagagagtgaggatttaggtagtttaaagaaagaagcaggacctcaatgactccgatggccagatattaggaaggctttttgttttttaaatttatataatttccctcctcacattttgaagttgtctgagttggaagaaaatcctttttcttggtgccttattggtttcttcttgcaatcctttttgtcacagtttcctgtgatcattaccagtggccagggccagtgtgtgtgcgcgcgcgcgcacgcttgccttgtgtgcacttgtgcgcatgtacaagcttaaataatgtgcggatggcactggttctaagttggtattcattaggctgttccctcctgggccagggcagcactaatcttgacaccggctgccaggagaaaacatcatggatcatacactgaaccttaataacagcatcagtgacctgcaccggcgagtgtggctgggaaccccagagctaggaagcacggttgtatattttaatgaactgctgcccctgctaaggaagctgctttcacttttgtgctctatctacagaaagacccaggggggtaggagggacaaagctttgaataagtgcgttctaacactggcaaacaggactgagcacatcacaaatccaggcaggtgtgaggtacagcggctaagaattgtctgctgcctctctctgccctttcttgtcgccaaagtccaatcaagtgatcctgggaaagaaacagcctggcttggggagtgcgctcagaagggaaacctaacaagacagtaaagaagggtagggaagatgtagctaacctgcttcagactctcagagccttctggtagtgtggtgacaatcgcaggattgatttcatccaggatagtgtctgtctgtggtacataattttaaaagaatattaattcatgttgttacaaactatgtatagtatgtatgttttgtgggtgtgtatatacgtaatatatattatatatatatatatatgagagagagagatttagtgacttttgatacgggttggtgcaggtgaatttattactgagccaaatgaggcacataccgagtcagcagttggagtccagggcattcagtgctgtgcatggttggcatacatgtacagtgcctatcccgtgcagtaagaatcaccaccggcatgccacatccagtactcagaactcagagccagcaatattttatttgtagacaatcagcttgaatctatagattttatgactggcaaatgattataatcctgaacccataacgctcgcaaaaggagacccagagcgtcttggagagacgtttggtttggttttgtgcctgggagtcagtcagtacaacagcaactgtatgtgcttatgttagtctcaagatccttaacttgttgaccttattattttggaaatttttttgtattatatttgtgggaaggtaaaataatgattttaagatttttatcaaatatggagattagttatttatgaaaaacaaagaaatgtctatttttgtttctttgttcccaattaatgtagataactttttaaaatgcattaaagcaatggtgaagaaaatgtaatggaggcgttgagtctttcttgttacggagaaatgcattggtttccaagagtaactgcgatgcagactccagcatggtcaccacaggtctcagatgtcctgaaagtataagcaactgaattttcatcagtaaaattgaccaaactctaattgcaaaaacaactgcatatgaccattcccccctctgtgcttcctgggtttctcctgtctgtgtggggcttgctttgttcacttgaagtggagggagctccattga

SEQ ID NO: 17753 - DNA, 1225 bp, Mus musculus
acggcctgcccctgccttgctctgcccgaatcatgcagggggccccgaaggaagagaaggcgagtgaccggcccgcgccgcccatggtcgaggggcgccctgctctctgaaacgccctccacctgctgccatgtgtcgccgccacaggtacctagcttgtcgttaaactttcccagctctggcccgattcggagtcgcgcgactgaggagcccggctggtcgcagacatctgccgcccagcaggatcctccgaggtgagagcccgcgtcttcccagttcacccggttcctctgcccccatctcggggactgagctctctggccccaggcacagcctgcagggccgggccagaaaagagaggcgggcgcgggcagtggggtggagggggtgggggcgtctgaagtttggttctaggaggaggggaggaaaggagttaatcttgagattggagctggtttgcggagaccaagtggttggcgctcctctaagaggagtggttgcgatttttcttttcccctaccttctcttttaagagttctgtccttggagtcggagccctaatcatccctccagccctatctggtgtggaactgagtgctgccggcggaggcagcgccttccagaaacagtttatctttggacggatttctttaagagaaaaagaaaccaacaggttgccagcccgggcgtcacactcaagactccggagagggaagccccggccgcagattcgtcggccaacgcagaccctctcaggcagcgggaggcaaagggaagaaggagacgatggctcgacccgacccgtctgcgcctccctctcttctgctgctgttgctggcgcagctggtgggccgggcagcggccgcctccaaggccccggtgtgccaggaaatcacggtgcccatgtgccgaggcatcggctacaacctgacgcacatgcccaaccagttcaaccatgacacgcaggacgaagcaggcctggaggtgcaccaattctggccgcttgtggagatccactgctcaccggacctgcgcttcttcctgtgctctatgtacacgcccatctgtttgcctgactaccacaagccgctaccaccgtgccgttccgtgtgcgagcgcgccaaggccggctgctcgccgctcatgcgccagtacggcttcgcctggcccgagcgcatgagctgcgaccgcctccctgtgctgggcggcgacgccgaggttctgt

SEQ ID NO: 17754 - DNA, 1155 bp, Mus musculus
tgtttgcttgctttcattaaccaaactcaggggaatgtcatgtcaccacagtcaatggggaaagaaagaaaactagctatgcagaagtgaatgacaaagtctgtgaacttagtctttactaggttcagaagtgacatcaacaggaggatttttttcctttattgtataaagattctctttacttgccacctgtgttccacgtagaaggtgggaagcctcggggatgtgtgtggatgacagtgtccctattttcgccggggcagtccaccaagccaccggatcaggccctcattgcagtgagctctgcctctggttacctgtccggctcttactgtaaacagtccttacctgtctccaaggaatgataaagggaggaggacgccaagactgcaggtgaagagcaagagtgtgtgacgtggatggtcctgtatagctcgttctcgggctcctagctcagatccgagtcattccccttccttctgctcatgcggtacagaagcaatcaggatgtgcctttgagctgttccttctctctgttagttattcgcaatagctaatgtgctagtttacgtggtccctgttgtctggatctgattgccttttttggttaatttatccatatttttgtttacattatttttaaagctagtaactgtaatagtataaaattgaagttgtgctgttgacaggacatctctctctctcttttttttttacatttatctgtcacaataatttaagtgcacctgttcctaatgtataaagttctctccctctcaataaatgacaatggaagtactttctctcatatcagctttatttaagaaaaaaatcttcaggaaatggggaagtgagcccttggcaaaatcaagatttgaggtctattgagagtgggctatttacttttgtagaagaagggggattaagacctttttgtttgatgtgtgtgagaggtttgctgtgtgtttgtatactacactcatgcttgttgcccaaggagttcaacagagggcattggattcccctagaactggttttatagatggttgtgagccaccatacgggttctgagatctaaacccaggtcctctggaagagctgcaagcatccttagctgctgagccatctctccagccctgctgtgctttaaatatc

SEQ ID NO: 17755 - DNA, 2679 bp, Mus musculus
gtagtgtactcccactgtgatccccttccttgtaagagcctgcatagttgtcactgtgaccaagatggctgctaggaaggcactgagaccctggcggccagcattccttcttccttaactctttccaaggcaggagaatggactcaccaggaagtacttgtttgtgtctttcacctggagctggtgttgcccactgccgcccatgcttctgtcctttgggattttcactgctgttcagatcaggggaaacactggctcacagagaacgcaggggttcaactccaagttgctcccacaggcaccagctctcgatgcttcagtctagtgggagacattcagctgacttgtgcagttagaggcaagcatttcacctcttggcccacaccatttcctttggccccagaccatgcagttgaacgccacacgtgtgttcatttcctagctacccggaagctatagccaaggcatgaaacttggtaaaaggccagggccctatttaccagacacctcacggtgccttttataaactcttgggaaggcaggttgacctcactggaatgagtggtagggaatgttgcgcataaaggacaaaggtgggaagtctcaaacacttggcaaaacagacaaacagatttgagtctctctcttcctcctcttgttcatgaaatacagtatttatattttccagcctcagagaacagaacatgatctttcactggagaattctagacctgcttattatgaaacagatgtgctcccgtggcacagtgccttctccctccacccccagtccctgtcaccgtagcttactcttgacctttgctgaaactaatgtatctgtgattctgactgtcagagacgccattcccagcacactgagcacagagacttgaagaacagagcccccgaccccaggttggccccatgtcctgccccaactcacaggtgcccaagattagacctaataaaagccgagggtgaaatctggatccctgtttagcacacctgagttgtctgtccccactgccccttagagggccttgctgtgtgtgagcggaccttggacactcctaagacctttccctggacattgcttcgtgtttattttttaaagggaaagataagcatgctgtcactcatgatctggaattggagccatgtcctgctacttctgttttcactatggtccatgcccgctcaggactcacaacagcgttctctgccaccaccaccggaatctgataggacaccgtggagccagatcaggagttggatctgccatgaaaattcaaaattgctattttcagcccagaatgtctcagagtgcatgaaggcccttactgttttcaggtctaacaaatgacttggtgcagtgttaggtagttgttccactgcttagaaaccatcgaaacaaaagcaagcctgtgcatttccacctccttttttttcatctcagtaaataccatacacgtaaagcataatggaaaacggtccattaatctcctggagctgcttgcaaagcccagggaacggcttttcactaaacagccattccctggtgtagcacaagaattccctcctgctagtgccagaaactcatgtgtgacaccatccagcccgggggaagtgttggcacccaaccccaccgttaagaaaccagttcctaaaatagacctgcatttgcaccgcagtaggaaggctgcagggtgctccaaaggcagtcagctctgatgggagaggagttctttccagggctgcctgttcccaaagttggacacagccttatatgaaaaccatgcaaactctgtcttccccctgacttcatgtgctgaataacagccatcttttgggagtttttacatttgatgagctgaaaggttaactgcttcttgattcttctataataggcctctaccaaaaaaaaaaaaaggagtgtgtgattacagtgcctcgggattcgaaggttccaatacagtctgaaatagccccgtgctgtgattcccctcagctgccccaaaacaaaggtgtctgtgtcactctgtcactgtggctgagttgcagcacaccctcggtgaggtctggcctgtctctgcttgtcatgtgtgcacactgcacatgagcactgacagattgctttctgcaactcctccaggaagcttggcttgcagccctgcaagttcattctccatccgtggcccagagatctccagacacaaactacctatgatagcaggagcacagtgatacaggaccacagtaatgccacacaccctgagcaccaagagcaaagcccgctgccagcaaggaagtagagaaaagttctgctgctagttcaggggagctctgccctctcaccctgcagatcagctctgggtcttctcccaagctttgctgaaatagtcagattagaaattaggctttgacccttagttggaatactgcctgttcccaacacagactattttattttgtttgatttggtttttcttatggtaaatagggaagtgtgcaatattgttttgggagttttctacatgacttttcatcttctgaaataatgtggagatgtcaggaatttgagacaaaggggaaagaagctagccctttcttccttggccacttctccctggagcctctggcccttgtcatccattccttggtactgactcagtagtggtg

SEQ ID NO: 17756 - DNA, 1180 bp, Mus musculus
aattacaagtgctgacagttgcttaccagaaagcaaatcacctttacatgcatggaaaggtagcagttgttcagcacattatgtgactgtcagttggcagcatttcctggagcatattaatattaagacagagccaaggatcattctgacctaatggcagggccaagggagtggctactagggcaggcaaaggttctccagctcctaggagatctagggcacaccagctcaactcactcatttcttaaaacttgattccaaatgaatttctgttcatccaaaaggatcttagaaaatgatactcaggctgaggtggtggcacatgtctttcttcccagcaatcgggagcagaggcatgtggatctctgcattcaagtccacttttgtctacagagcaaattccaggacagctagggttacatagtgagaccctggctcaaagaaaaaaaaaaagatattatttagtcttttaaaagactttttaaaaaaatttctgtatacctgtgtatatctctgtgtatatatgtatgtgttgatacccacagaagccagaaaagaatgtcagatcccctgaggctgtagtcacaggcagttggttgtgagccatccaacatcagtgctgggaaccaaactcaggtcctctgcataagcagccagagttcttagccactgagcatccttcctgcccctgctagtgaagttctttgtgggacacttggtcttgtttggggtgctttttgctgtttgtttcttttctttttttccattttatctcatttgttatatatatatatatatatatatatatatatatatatataattattattattatttacttatttattaggtattttcttcatttacatttccaatgctatcccaaaagtcccccataccctccccccctccactctcctaccctcccactcccacttcttggccctggcgttcccctgtactggggcatataaagtttgcaagtccaatgggcctctctttccaatgatgccgactaggccatcttctgatacatatgcagctagagtcaagagctccagggtactagttagttcatagtgttgttccacctatagggctgcagaccccgagctcccatatattggggagaggctttctgttaggaggtgcgaatacacggtgttacacactcaaaagg

SEQ ID NO: 17757 - DNA, 1177 bp, Mus musculus
catgtgcatgcgcgcgcgcgcgcgcgcgcacacacacacacacacacacacacactttaagaaatgatgcacttccatagccctgaaggaaatgtaaacttagatgggagctttccactttgagaagatggtgatcctgaacatgctgattgtgtgtaagtagtagacttttaataagtgcataagagcctcacatctgatagtcacactcccatagtgtatgttgagggacttagtggttttgtcaggctgtggttccctcctcacacttccctggccactctgtccatcagatgagcttccacttataattccagacctagatcagtgtggattgcttccccaggcctgcctggctccttgccccttccccaggaaagctgattcccctcaccgagcttcctgtgagccctctgtgagagcaggctgcatgtggttttgttttgagtcgttatctttcctactaaatagccacatgagggtagggcttgtgttctcctccttggtaagctgttgctgtggggcggaaagcatcgtggctttgcagttttcttctcaatgaacaaatgtttatgttagtgcgggatcccagccttgcttctggagacagttattggggacttgtggagaggcttactttccatcagcggaggctgagccagctctctatgacactggcagattccatctgagactcagcaaacaggcctggagagttcagtcacacacacacacacacacacacacacacacacacacacacacacacacacatacatatatccgtgtttacatatttatacagtttttaaagactatgagggttttcgtttggttggttttggttttggttttttgtgagttgcttgtttgtttgtgtctttttggcatattgcttgaaataattacagagctgtagcaagttgaagagacagggaacatttgagtatctttcaccaagtttccttcttggtcacatccaccttagtccatcacagtaggatatataacagtaagcatgtcagaagcatgatatataacagtaagcatgtcagaagcatgacatatctgtgaggtctgtgccatcgcaggtaaaggcttatttaatcactaacatgaactgtggagttgatgaattccttccacatttgccagttgagcttctagaggtaagaag

SEQ ID NO: 17758 - DNA, 1657 bp, Mus musculus
gggtgatgaattcagctaaaacccaggggggaaatataattctttctacaagcaatgaagtttaacaattttcatggaggctactagtttggaattccagaagtagcaacaggtagttgtggaaacagcagtgtttggaaacccttgggctgttcccagcggtgtaccccatcccggaacaccccatctcagtgcactccaccccagtgcctcccactcagtgcaccccgtctcggtgcaccccatcccggagcaccccgcccccttactgtggcaaaagcactcaaagacttgaagcatcaaaaacaagcaagagaggaagcaaatgctatgcagacttcaaccctgagagagaagaaagccatgagctcagctggggagacctagcagacaccatccagtgtggtctgtagtatgttttctggcaatttgtataagaaaaatggtagaaatgattaaattttctccaacaagaaatcaccttttgctttttccggtttccgcggcagccgcagccatgagcagcaaagtctcacgcgacaccctgtacgaggcggtgcgggaagtcctgcacgggaaccagcgcaagcgccgcaagtttctggagacggtggagctgcagatcagcctgaagaactacgaccctcagaaggacaaacgtttctcgggcaccgtcaggctcaagtccaccccacgccccaagttctcggtgtgcgttctgggggaccagcagcactgtgatgaagccaaggccgtggatatcccccacatggacatcgaggcgctcaagaagcttaacaaaaacaagaagttggtcaagaagctggctaagaagtacgatgcctttttggcctctgagtctctgattaagcagatcccacgtatcctgggcccaggcctaaacaaggctggcaagttcccctccctgctgacacacaatgaaaacatggtggccaaagtggatgaggtgaaatcgacaatcaagttccagatgaagaaggtgctgtgtttggccgtcgctgttggccacgtgaagatgaccgatgatgagctagtctacaacattcatctggctgtcaatttcttggtgtccttgcttaagaaaaactggcaaaacgtgcgggctctgtacatcaagagcaccatgggcaagccccagcgtctgtattaggatgctccaataaacctcactgctgccactcaaaaaaaaaaaaaaaaaaaaaaaaaaaaaaaaaaaaaaaaaaaagaaatcaccttttacaataaaaatgagaagaaaaagaagccactagtcattttcaactgcaaaacacttaagagctgtacacagtgatgaatgaaaaggacccacagtagtataattgttttataaacactgaaactataatacaagtggagaaaggaatatgaaattaggaaagacactagagggcttaaaccagatttgatcagcacttgaagtgtaagtactcaggtgtaaacgctgtaaccataagaagaattttgttttgagaagtatgtgtttataaaggggggcaaggggctaaaaacaaaagtcagagaagaggaagtacccaccatccaagaaggatagatcagtgtgacgggcgatggtacctcactctaggattcctaacgacccagagggcatcagcaa

SEQ ID NO: 17759 - DNA, 1636 bp, Mus musculus
ggtagttcagagccgtacagcagggtctcctgtgaatgtgtgcacatgagaccccactgcaggctaccctgagcacaggcagcaccaggaacctcagtcatggcccacagatttgtagctttttaacattaatgagttctcttctagaagtgtgagtagcattactgtgatttgtttttaattacctcctgccttgtcagagaaaaaactaaatttctttcttttttctcccaccagtgtacaacgttctgactacttgaatacatttgagtttatggacaaacttggagaaaacttgaaggccaaattagctcaggccaaactttaaggtcaaacctgggcttagaatgagtctttgcggtaactaggtccacaggtttacgtattttttttttttttttagtaacactcaagattaaaaacaaaaatcattttgtaatttgtttagaagacaaagttgaacttttatatatgtttacagtcttttttctttttcatacagttattgccaccttaatgaatgtggtggggaaatttttttaattgtattttattgtgtagtagcagtgtaggaattatgttagtacctgttcacaattaactgtcatgttttctcatgctctaatgtaaatgaccaaaatcagaagtgctccaagggtgaacaatagctacagtatggttccccataaggggaaaagagaaactcacttcccctgttgtccatgagtgtgaacactggggcctttgtacgcaaatgttgtactgtgtgtgggagagctatacagtaagctcacataagactggaacagataggatgtgtgtagctaaaatgcatggcagacgtgtttataaagagcatgtatgtgtccaatatactagttatattttaagaccactggagaattccaagtctagaataaatgcagactggaggattctgctctttgatttctcttctcctgtgacccagcctaagtattatcctaccccaagcagtacatttcacccatgggcaataatgggagctgtaccgtttggatttctgctgacctgctgcatttcttttatataaatgtgacttttttttcccagaagttgatattaaacactattccagtctagtccttctaaactgttaattttaattaaaatgaagtactaatgactcttctttgaagtgtttattatgtgtttttatttaaaaagtgtttttcatttcttttcctattactgtaataagatacctagatagaagcattttaaaggagaaagggttagttttggcaacagttcaaggtacactcccagtgtagctgggaggtcagggtagcaggagcttgaagcagctggtcctgaagtagagaacaaggaatgcatgctagtgctcagcctagaaaccaagatggcgcttcccctagcccttaacagaaatcagagaatccctagtgtatatacttagaggccatatcccaggtgattctgggctctgtcaagttgaaaagtaacacagacacagacactagattatatcctagccatgggaatttgatttgaaaatattttttctcttaagaagtctactgtgagacagctgtggtgcgtatctgtgatctcagcacttgggaggcagaggcag

SEQ ID NO: 17760 - DNA, 1147 bp, Mus musculus
gcacttgtcacaggcgttgccaaagccctttgctcagattgcatagacatgtcctgccagctgactggctttcttttcctcagatacatatgtaaaatgaggctgagtagtttatgttatataaagtcagtttctgctctaactttataaagctattattattttaacaaaaaaccttggacacctataagtaatgggaaattttttgtctgctcatatttacgtcttacctgtagattttaaattaactttaattgtaaagagaataagaatggtaatatttgaaatgagctcagccacatacatggttttaagtgttgaggctctttccatttagacagtagtaatttttaagcctcaatttttgaatatttggacataggtctccttattcttttgtgttttgataagaattgtcacgcaggggggctgtttggttatttgcctgttcttgagatggtttctaaggaatctctttccctccctgccctttctttccagactcatgaaatggccacagatgacaagagttccccgacactggactctgctaatgatttgcctcgctctcctgccagtccttctcacctcactcactttaaacccttgactcctgaccaggatgagccccccttcaagtcagcatatagttcttttgtaaacctttttcgttttaacaaaggtaagattacatcttaataaacctcataaaatgcagtttgaattctctgcattccctttagtgtcttgctgtgtggttgtgagaatgtgaaatattaataaggtggtgacttcaatctcaggtcaccaagtctttctgtctaagaaggaaaagatagcatttcattgtaatccgattaattatttgtgtaaattgaatttaaagtggttagggaggtcctttttaatgagaaaacatttgttctacatattttctatcaatgtgctttgacttaagcttacagaatgaaacttgttttgagggaggcattggtaataagattttaaagcaataatattaagcagcagtatatggtttgtatgtttagaaacttacaagctgacagcaagcatgttgggacttatactcattggattgagttgtaaatgacatgaaatgaacagataatttaaaggatgagttctt

SEQ ID NO: 17761 - DNA, 1185 bp, Mus musculus
tgttgttgttgttgtttttgtttttttacccaaatcacttacatcttgtatatgtgaaatggaaatgaattttacaaatcacctacccaactaaatttgcagttttattgacatttagtacacttaaaattatttttttgatatttaatatcctagagatgaaactacacttttttgtttgtttgttttttgagagagggtttttctgtgtagccctagttgccctggagtagaccaggctggccttgaactcacagagatccgcctgcttctgtttcctgagttttgggtttaagggtgtgctacaccactgcccagagaaactgcactttttgcctcaaataaagtaagggtgaaaatgaactgcatataatcttattgttgatgggaaaatattgcttttaaatgttaaagcacttattatagccccaaatgaccccaatattttaattttctttatagcttgattcatccggattcctcaaatagtgctctttcaacaagactcgtatctgttcaagaggatgctgggaagtctcctgctcgaaacaggtaaactgccaataaagaaactactctgtctgattttttatttatgtccattgtaatgagaacaaacaagcaacatggtgagactgtttcaaagttctgttaggttatgctttctttttttggtagttctttcagtgtttagctccttcagatattttctgatgatgtcaggtactggaacctatcttctgtctagtagtttagtatgatggtctgaaggatgtaagaaaatgagccatggaggcattcctgtgagagtgtgcaccaggaaaacaccaggaaaacagaacagcggagtcttaagagggagcacagctggccaggaatggaagaggtcctatgtgctgcagcagtgtcttgcaagaatgaatgcttcagatgctttaatctggtctaagatgaggagccattggaattaaacaattttttttaaatttctttgtaaaacttaacttatattttacctatttattttgacacatcttaatgtacaattaaaaaagaaaaatccttcaattgattgatttcagccccgagtttgattattttctcccatctgcttatcttgtgtttatgtttgcttctttttgttctagagctttcagatttgctttttaaaaagttgctagtttg

SEQ ID NO: 17762 - DNA, 3333 bp, Mus musculus
cacacttgatagcttctagattctgtagttcatttctgagtttagatgtcccatccctcaagagaactcatcttcagaagcattctgcctgcttcagagtgcttggggcagtgtatgtttggtgaagtcagttgcccaactgaattaaaacagctttattcctccctttgtctttcactgtcttaggtaaaatgccaactgtggtctctccagagttgtataggactagattttgtgaagcaatggacaagtatttcttgatggtgccagaccactggacagggttggatctgaattgctgaaatcacacagatgatttgaaaaagactgtgaatgaaagtggatctgaagaagaaacccaaactctatgatgttttgtttctttgtcatatataccactgaacacaaagacctttcagttctgtgactgtctatagattggctttagactgtccatgactgcagggtaaaaaagccccatggatttgcttttgatatttgctattatctgcctgtaaatgggaaattgtaaaagttaaatacaatgttttttttcaaagggctgtgattagagatgactatatagatggagtaagatattgagttgtcatacttactaactcaattgcttgaagaggaaagcgctgtctgatagacactgtcttgtagactgacaggtagactgtctagtagactgtgactgtctagtagactatgactgtcgggcatcacatttgttacttttttccatgagaaggcacttgcagaccttcttggtttggtatacgtttcctgtgtagtgactttatgtttgttcttataatatctaaaacatttaggaaaaatctgatttattccattaatggccagttaaacagattggtgcttgctttattaggaatttgacttaaattaggaatcctgccataatctatattctccaactgttttgatgctttcacattctaccttctatgcaggtgacaagagcctttattccttagcttgagagcctttcttagaacattttaaggagcttgtttaaaacatttgagtaatgtgccaaacagcacttaatctgcatatgtgttcatagtctagatttacctctcattttgggcaagcaaaataagcaggaaatgaaactgtagtcactgaagccctgagtgaagaattaataatgaaagctttttttttaacggcaaagagaaactaattgagaatcaaaaatgtggggttttgttgtttgtttttgtttttcttatatatgtatttgtaaagtatcttttaacactactagcagttaggtgggatttgtaaaatttaaaagttttcagtatggatactctcattttaagtttccatcacactgaccagtgcttctgagaaatgctgagaggtaaagttactcctactgaaggagtagtttactagttagcagtatcatctaaaacatgaccagaaatcctgaactgtgagcagatgctttcaccccataatatgcgagtgtttctcttgccttttctgtaacaaggatatttggaaatttataaagttgtaagatttccattttattcagactttatctaatagcatgttaatattcacaaagggctggatggacgatgctacagagggcagtctgcacccgagtcagcacagtgtggcaggtttgctgtagacagtgaagcagtagctggctattggttacttgttgagtgtgtggctaaacaaggcttatgtatgcttgatgttaggccttggcctcttcagtgccttggaaagatggaccgaacactgaagagtccagctgtgatgttaaagatcagtaaaggaatgtatagatttgaagattgtgtggaacacactttctgtgcttcctgggacaaaggcttttgtgtctggtttgaaatgccagctgatttgtctttgttcattttttctaatcttgattgattaggctataggaccctctcacttcctgtaggactagagagataccttgcctagctggggttgtgttgtttctgtttttctctttggtttcagtccagtgcatatttgagctgagctccaggggggtaactcctgacagtaacatggcgtgtccatcttctcttgtccctgattgaaaagcaactttgctttttaaagtattgtttaaagtaagcaaatattgaggtattttggtgactttctgaagcaagagtttgtactttgaaagcttgatttgtttttttgctttttttttttttgttttgttttgtttttttaaattaatgtctggctggtgttaatgaaggggaaacacataattgaactgttttgcgtggtacaaatgtgtgactcctggctgcttgtgtttagcaactgctgtgtatatgtgtgtatatatagtgttctcagtgctttgaattgaatggctgttgtcctccttgactccctttcatggcctagagaatattaatgctgaaaagctgtgaatacgaaagaaatctcatgctcaaaatatgaattccaaagtagctgatagtaacatgagaaaattatgcctacgtgttgctgtgtataaaaatcttgttcacaaatatgaaactttttgatgacgtaaaattttgtttaaagactagaatttgaatttttcatgtctgcctgagaaaagaaagctggaataagctggagagcccttttgtagtctattgagtgcttatagattctcaagatttcctagggaaggacagagcaggggttttctagctttgacctctatgtatgtatggggtcactcttgagcattggcttgaggtgactgtgtggtggatggcttcttggcacgttagccatggcactgggcttctgtagaagtgccaaggaggtgatctgcctgtggcaagtcatctaagtttcaagtgtgaaaactattgtgagcctgggaccgagtcttcctaggacacccagtttctaaagtgacttacgcagtattcaaaccttctgtgcaatgcctttttttggttgtttttgtaacgggtgcagtgtattataggaaaaaaaaggaaactacaatcacaagcagttttgtttaatgctgctttgtcagttttgtaaaagaaaatgtacataatgtctttcaacaggttttagactagaggaaataacattgtaaatcacagtagcctaatttaatagtaaaagtacttaatgtattataatgtgtatatttctctaactttgtttccagctgttttatatgattgacatgttatttaaagataactaccatagcttcttagagacttgtactgtaaataaagaggaccttcaataaactggaat

SEQ ID NO: 17763 - DNA, 1175 bp, Mus musculus
ttcaccatctgacaaaagtctcttatgccttttaaccagcagactaagatacatcagagcttttagaagatatgcactgttactaaaataatgggccctttggattcaccttggccatcaagaactaggcaactttgtccaagatcacaagtctatacaaccttttctccacctttctttctctctctctctctctctctctctctctctcctcccttccttccttccttccttccttccttccttccttcctttctttctttctttctttctttctttctttctttctttctttctttctaacttcttcacctcccccccacccgaaaaattctttaacctagaaattttaacaaaaatcttcccttttcatttgtagaaagaagggctgaatattactcttatcctattttattcttactctgttcctatgtggtggtctcaccttcacaaaggaggtttgccccagctacaccaaaccccacaatcctagcacaacccaaatatctgttgtttcaacattccaaaccctggctgtcttaactaatttcgagccgaacctgatctagcgacattctcccagtacaaatatctgctagacttctgtcttaggttttattgctgtgaagaggcactatcaccatggcaactcttttaaaggaaaaaaagtaatttggattggcttgcagtgtgtttaggcctttctttttgatttgtgctggtttcttctctccagacttctagctcaagtcttttcttcatagtaagcaacccagctatgtgaagagctttgtgtggtattttaaatagaggacacaaagggatcaagcacacaccagaaagtcatgaaattaccttaaactgcaaatccgtgaagcaaccatagatgaaagccttgtctgactcaaagcagagctgcataagttctgttctcacaaacccctcagagatctccacacagggaaacaactggctgattaacacttagattctaaagggtttgaaaatgagccagatcagaactgtccctacttgccctctaaggccttagctggtatggaaaacctgcaagctcttcaaggagccactccttgaaggctgctcccactcattctttccctggtagtgagctgctgctatcttatgccaatttgcagacccaagagcgctcaaac

SEQ ID NO: 17764 - DNA, 1191 bp, Mus musculus
tttttgtttttttttaatcttagccattctgacagatttaaggtgaaatttcaaagtagttttgatttgcatttttcctggtggctaaggatgttgaacactctttaaatgtttctcagtcatttggatttcttcttctgcgaattgtatctttagacatatatctgatttttaaatttggttatttgatttctacttcctggagtagttcatatactttggatattaggcttgtattggttgtggagttggtaaaaatcctttctcattttgtaggttgctgctttgtctgaatgatggtgcataagattttgcaatttcacggggccctacttattaattgttgatcttggtgcttgtgctaagtgatctgttcagaaagcctttttctgcttttgctgcccgacactgccgaggtcacacgcatgtctcccgcagccgacatagcattagctaagttgcctcctacctgctggccgcccgcggggcaactcctctcctagcgccaaagacatcaagaaaatactagacagtgtgggcatctaggtggacaatgaccggctcaacatgatcatcagtgagctgaatggaaagtacgttgaggatgtcatcgctcagggtgttggcaagctggccagtgtgtctgctggtggggctgtggctgtttctgctgcccctggctctgcagctcctgctgctgcagaggagaagaaagatgagaagaaggaggagtctgaggagtaggatgacgacatgggatttggcttgtttgataaaattcctgctccctgcaaatgaagcctttttatgtagaaagaaagagagagagggagagagagagagagagagagagagagagagagagagagagagagagagagagagagagagagagagagaggaagaaaggaagaaaggaagaaaggaaggaagaaaggaaggaagaaagaaagaaagaaaggaaaaaagaaagaaggaaagtctttttctgtgacaactagttcaaaggtatccccgttttctctttaatcaggttcagtgtatctggttttatgttgacatctttgattcatttgcaactgttgtgggcaataagtactcatctattcacattcttctacatgcagacacctactctgaccagcaccatttgttgaagatgctgtctccccccccccccccccccagtca

SEQ ID NO: 17765 - DNA, 1148 bp, Mus musculus
ccacgaccctttgcccctgtcttcttccaatcagatgacaaagtgtctctgcaggaccccagtgctctagctacttccaaagagagttctaaagatgaggagccactgaaagataaagcagacaaagtggcagatgtttccatctcagaagttaccactttactgggaaatgttcatagtccagttgtggaaggctatgttggggagaacatttcaggagaagtaaaggttaccacagatcaagagaaaaaggagacttctgcacccagtgtacaggaacctacactcactgaaactgaaccacagacaaagcttgatgagaaatcaactgtttctatcgaagaagctgtggcaaaaaaagaggaatcctttaaactaagagatgataaaacaggtgtaattcagacttccaccgagcagtctttctccaaggaagaccagaaaggccaagaacacacgattgatgagttaaaacaagactccttccctataagtctggaacaagcagttacagatgcagccatgacctccaagaccttgggaaaagttacatctgagccagaggcagtaagtgaaaggagagaaatccagggactttttgaagagaaaacagctgacaaaaataagcttgaaggcgctggatctgcgacaatagccgaggttgagatgccgttttatgaagataaatcagggatgtctaagtactttgaaacatctgcattgaaagaagacatgacgagaagcactgagttgggcagtgattactatgagctgagtgactccagaggaagtgcccaggaatctcttgatactatatctcctaagaaccaacatgatgaaaaggaacttcaggcaaaagcatcccagcctagtcctccagcacaggaagcagggtacagcactcttgctcagagttatacacccgatcatccatccgagttacctgaagaaccaagttctcctcaagagagaatgttcactattgaccccaaagtttatggagagaaaagggaccttcatagtaagaataaggacgatctgacacttagtcgaagcttagggcttggtggaaggtctgcaatagaacaaagaagcatgtctatcaacttgcctatgtcttgccttgattccattgcccttgggtttaa

SEQ ID NO: 17766 - DNA, 1338 bp, Mus musculus
ctctttcttctatttcctttttccatttgctaaagttgaaagtaggaaaaaataattttgaatagcttttcttgttctccaaacagtatctgttcattaaattctgtgatagaatatatttggcttccttcccccaaagacctcttgatcaaagatgaaaaatacaacatataaagaagctatatatgtaatacttttgagacacagatatctaaatccatctctccaggattcttcatgaacatggaacatggtattacttattcatgagtaaatgctatttttttcttgctttatatacaatctagacatcacaactcaattactatcatttacaaatcatacttaatgaataagtaatagtcgatggcccaaaataaggcagagcattatcaaaccgagtggactttttttcttaatatttaatttgttcttttgcttgctcgggattggtgggtggaatatgcagagataaatgtgaaaaagctgtctgggtgttttatgtctctgaaataaaccaagccctgtatacaaaggagaaggtgaacatgaacaggataggaagatgtaggagtgtctaagacagaaggcaagaggatgcaaaagtggagagaaacaggtggcagtttagtgacccattgagtattatgaccaatgtgacagtcacatagaaagcttagcatcaaacagagacagtcttattggctagtaggcacacacacactacagtcgtctttgtaaattggttattttttatataactttaaaactactgaatagtggttttcactctggacaacccattccttaccttctcttgaaatgcacagaaaatggaagaaggaatgactgtgtgtggagaagtacagtcttttcttacatgttttgatagacaaggatcaaagttgtctaggaaaaaaaggtaccagatgatccatgtggttttaaactatgcagaaaataatttcaacccagtttattataaaaattaagcctaagtaaacattttctttgtgttaaaattcagtttcttatgatgcgtgttcaaaaaaattatgtaaaccccaatgttaatagatctagcactaaaataatcattttttctaatgtcaaaacaattataatggatataagtccttgttctatgtgaaatgtgtttctctataaagttatcacaagaaggaatttttataggagacagacagagaaatgcacaggctaaaatcatttccttatgggaatgtgggatggagctcaccttacctactctcttaagataatgactcaaattaagctttttggacaccacttttgtggggatacacatacgctgatcta

SEQ ID NO: 17767 - DNA, 2007 bp, Mus musculus
tgcacatgatggtgtctaggccagaacagtgggtaaaaccaatggctgtggcaggtgccaatcaatatacctttcatcttgaggcaactgagaacccaggggctttgattaaagacatccgggagaatgggatgaaggtaagttgataataggagtcttattttatactagtgcctgtcagagctggtaagatgggtgggagaaaatgattgatagggaaaggtctggacatgggcagttggattttaaagaaataaagatagaaaatataaagctgggcggctagggaggacctggaaggagttgagggcatgatcaaatatattgtaagaagaataactgtttaataagaacaaaaaataaggtagcaaaaataaatctaagttaaacagaaacaaaacaaaaaacctgttatactctggatgattttcatattgttttgtaagatgagtttttttgtttttgtttttgttttaactaggccactataatacaataggaaaataatgtgatttagcatttgtttgttacaggttggccttgccatcaaaccaggaactacagttgaatatttggccccatgggctaatcaaatagatatggccttggtaatgaccgtagaacctgggtttggagggcagaaattcatggaagacatgatgcccaaggtaaaagcaagactctgttctggggtgaggtttttgttatagttgtctattcagtagacataactgcaatatatgtcattgagacatgtcctattttgttatagttgtctgttcagtagacatactgcatatatgtcattgagacatttcctattttgttatagttgtctgttcagtagacatactgcatatatgtcattgagacatttcctattttgttatagttgtctattcagtagacatactgcatatatgtcattgagacatttcctattttgttatagttgtctattcagtagacatactgcatatatgtcattgagacatgtcctattttgttatagttgtctgttcagtagacatactgcatatatgtcattgagacatgtcctatttatttgggaagtgaagggacagagatgccttcagatactataatacagcatgataagttttaaacttatttttgtgacctttggtcacttgaaagttttcattgcagtcttcgtaaagctgtcacaaattgaatgtcatttgctgaactgcttttacaagcataatatgcttagtctattgaagtgacccccagtaatgtcttgtgcagtgtgggtggcttagccggttcatggctagtgttagctgcggtgttctgtgtgcttgcttccccctgcatgtccactgtagaagtcactgtttgttcgtgtcgtctaggttcactggttgaggacccagtttccaactttggatatagaggtcgatggcggagtaggtcctgacactgttcagaagtgtgcggaggtgagacgactcctcaactggggccgggacagtttccatagctgatacctgcaggacactctcagcaccaaaggattgctcaaatagatttttttccttgagaaagtattttttgttcaaatgtaggattagaaagtaaaggacaagtgagtcactaactagcataaattgtcaaatagtgaaccctggtctccagaaggaataagttgttaaatagtgaaccctggtctcccgaaggaataagttgcccttagcaaaacctccaagttcttttaaaagataacttctcaactggagaaaagtagatacatttaactggcctaataatgctgtctttagaatttaaaatttattagctacctgcttgtgttttataagaagtgacgagatgtagttctgatgaaaatcaaggccgagctcccatttaccaagcttagtctgttttgcctagggagctaccctagcctggatctgctgctgggtgtcattagatggcagcccttcctgagaacaagtcaaatggttcgtttttattcctatt

SEQ ID NO: 17768 - DNA, 1455 bp, Mus musculus
tatagagatgtcatttagaaatttagcgtgatgaaaatattcatgtttatactgggagaatgatttttgtaaagagtgaaaatatgatttcttaagattacagacagaaatgtgtcttaatggctaaagaggaaaattagatactatgaaaaacatttttctgtatttttacaaagaatgttctgttgattccctggtttattcctaaagcaaatgacatccacattttctctagttcatgtcatttgtgatttgcttatatgcctgagaatatgaatggaatgagactaaaattagaagctttggtggggtggcatgtcatggtctggcattggaattatttttactttttaatcttacacttggtttattaaaaactataaaaaacaatgtatgaagcctagggtttctgaaatgcaagcacagacttatcaaggtatttactttgtcacagcagactactctgtcattccttcctgcccctgggtctcactcaaccacccttctgaggggaatgaaatagccagaggcagaaaggaaccatacagtttctcttggaagtgccactgggttggacaccaatagaacagagtaccctattctagctctttaactttaataaaatcacccaactgttttcactataaacgcttatgtatatcgaatgaaaccataactattgtgcatttgagaattaaaagcataacatgattttggaaggcttatagttgtactcctagactgtagaagatgctcaacacaaaatggcaagcatcatgtctgttttatgagttattaagcacttttctataatcatattaactgctaaattgtcctataattgttagaacaggaatttttttccctattttaagactaaaaaccgtaaagctctccagtagcctggcacatagaaagggtccagtcagaagcagttttctggtgtgtactactgctctgactacaaacagagcccctgaagtggattagaaaaaaaagtttttacttttcttattttcagtgtaactgaatcctctggcagaatcagagtaagttaagaatattctggaagtatagattttgactccaagaatggatagatggatatatatatatataatttctaagaaggaagaagtaggctaagatgatacagtacagacttaatccataaataagtagtaataaaataagaacactgacaaataggcatggaatagagagcttgcttgggctttttcctgccctgtaagataaaagtttattaatacttgtttttattttagcttacgaaaggtttgtgcatttaatcaaatcacacaatacaaggcatatagaaataactttaattaaaaaaaaactatgtagaaggttataatatcagtcatgacaaagatttgaaattatttgttgggacaacttgtatttttctggcttttgttatctttttcttta

SEQ ID NO: 17769 - DNA, 1111 bp, Mus musculus
aactctgctgattcattggcttaagatgtcttcccttctctaatcttccttggtttctttcatcagtttttttcacttttctattatagatcgccatcatttttatagttcgaattgtttcttattgtatttgaagctaatgtgaaaggtttatttccttgatttccttttcagcataattataactgtatattaaaaagtagactatattttatatgttgatttttatatcccactatgtgttgggaatgtttagccaatctaaaagtcttatggaggagtcttttaagtataatatccaaacacttgcacatacggttaattgaatatttcttttatgttgtatgcatatcattttctcatgctttactcttacgatctagataagaattcccatgatgtattatataagaatggggacagtgaatacctttgtcttgcttttgattttagggaaaatgcttttacttttcccctttttgtatacttttggctgtacatttgttaggctgtgtgtgtgtatgtgtatgtgtgtgtatgtgtgtgtgtatgtgtagtataccacacacaagttggtttcatttcagagatttaggaatgatttaacataagaaattaataactataacacatacatatgtaaagagacataaagcacatgattgtctcactgttccaatggataaggggtccttgaccaagttcaacattttttaaataaaatccctgcagttgggaatagaaagaacataatcatagatagatagatagatagatagatagatagatagatagatagatagatagatagatagataacataatcatagatagatagattaaatagatagattagatagatgatagatagatagatagatagatagatagatagatagatagatagatagatagatagatagagaacataatcatagatagatagattaaatagatagatagattagatagatagatagatagatagatagatagatagatagatagatagatagatagatagagaacataatcatagatagatagattaaatagatagatagattagatagatagatagatagatagatagatagatagatagatagat

SEQ ID NO: 17770 - DNA, 1242 bp, Mus musculus
gcatgttatcccatctcctggggagagaggcaggaggatcacaagttcaaggccaacctaggcaacttagtgagacccgttttcaaggtaaagagcaggagagatctggcacgtagctgagtggtagaacactcctagcatggagaagagccctgggccctgccccaacacagatacacacagtgcacacagtgcacacacgagctcagtgcaggtggacacattacatgtgatggctgttgctgggtactgccttccagctcttctgttgagcattctgcctccacagagagtagtagttctgggactgggttctctcaagtggtgagcaaaggggaccaaaaaatgtagcccgtgcttctggaagaaaaactgcaagagttatagactagatttttgggcctaaatgtcatttttttaaattcctagtttctgtctgaactagaaatcccacttcatgagccacacaggccctatctagcagcaacaggatcaaaacttaaatggttgggatgcacattctgatctgaaagtttactcacaaataacagttccttggcttgtgttagatttcagaaatgtttgttttaaaagttgtctgtcctttagtactcagatgagatctagaagtagattgtctgtgtgaatttgctgagacagggtcccacctgacctttggctgaccttgagacgtttggctcagctttgccttgcttttcgctgactgtgcctgagtgagtgccacatgtcatcaccttctgtcaattgacttgaacattgatctcgtcactaactagtacaaactctaactctgcttacaaagagtgtggaaagggagctgctctgaccagtagcttctaagaaaacacggctcttggctggaatgggatgtgactgccttcatgcgtgtaacaaatggcggtttgcatatcccaagagcaagtgtccttcacattccgagaccacctcggagtcaggtttgtttgtacacgaagactcccccgtgtttcgacctctgaacaaacgcctattgactctttagctcctcccttctttcctcgatatcaaaggcctaaccagactctaacctacgtggtaacattttccagctttaaaacaacagggtctaagaatatttaatgtgctatttgtggctcttttggtcattcagtttttattggagatcaaatccccatggagtgtatcctggttgctatgaggagtaatctcctgttattttct

SEQ ID NO: 17771 - DNA, 3171 bp, Mus musculus
ctgcttttaagatatttttgttgttgttcttttttaagggtgggggctataactcaagtcttagggtcttcatcacctatgtgggaggcacaggttccacactaggaacttattttacatgtggcctgtgtttttttttttttttttttttttgattgatcatgtctttcagctttctcaacatctgtcgaagattaataagtgagatagcatcaaactacttgttaaatccacgtggtgtattattaatttagcatcctttagtaaacagaatatcatcatatgatttattctgccctttttataatgataatagagcatttatgtaaatgtgccagtgtaggcaaaaagctctatctggagttatccttttcttatgttgtattttagtttcttgtgttttcttggctttccattgtgttttttttttttatttatttaaaaataatcttgtgtatgcattaggaaatcatgattcgaagcactgaatgttagtggtaaaatcagcggtatgctctcactgtgtacatttgctgtctgcctactgtgcgctgtgcacaccttttttctgtaacttattttagcgtcactgcttagaatgtcttgccagtttagaacactgacaaatgttaactcattagattataagcaatctggttttggtaaatctttctggaaattactaaaataagtccttgaaggttttaatcccttctctcattccctttctccctccttccctccctccctccctccctccctccctccctccctcccttccttccttccttccttttcctctctcctttcctcccttttatttgtgctactgggtatggaagtcaggatcatgtgcatgctaggcaattacctactacataactatatccaactttgagacaatcttgctaagttagccaagctagccctgatctcacccagctttaattttttatacagcctctagattggtgggtaggcaaaagttggagattgcttgatttactacatttttaccatatccgacacaaaccctgtagcaggaaatcaggcagtgggagtgagaagagcttcttcttgttacagaagcagccccagcaggggtgtggggggcactcctgagcctgcgcacactgcagcttactctgcctgttctgtaggtcctcattgtgagtggacagggtctatacttgtaaatggtcttaaagaagaggattcttccatgcatcatcccagaaggtaaagagttggcagcattatggtttgcagaaggaagtcctaagacaaccatcagctctgtttttaggagaagagggcagcttgacaagccctgggtggagttgccccagctcagaacaccaggaagctgggatgccagtcatttcaagatccacttactaggaaagtttgagattctgttgatcatttgaaagtgcaccttgcataaatccttctttgacatactattttttcatgccaataggcatgttgacgtgaacacaatgtttccccatgctggcttcccaggatcaatagttaggacagtctaataaggttttgtctgtgtttgacacacagttccttctgcatctaggggtgggtagaagggtgccatgtggattaagccatttaggcctggggttggggtgtagggatagttttccctttacttcacacacacatgttgagctccttcctgttgcgtgtggcgtctcacccctgcccagggtcacagcctcgttgctgtgaagcctttgaggttcctgttcctatttttttttttatttttaatttattacgtattttcctcaattacatttccaatgctatcccaaaagtctcccataccctccccccccccccacttccctccccacccattcccatttttttggccctggcgttcccctgtactggggcatataaagtttacgttttaatctcttgcctcacctcctctcggtttcccttctttcctactagtattatttttgaatgctctgaatgctggtttttaaaaaaaattgtctgaaacagaaatgtattttcagaataattcacaaaagcgcaggtctcacactgaaacttcaactccttcttcccctttctcctcctcctcttctctgaatgccagggagaatgcagttgaaggagatgcgcagtcacaatgaccaactctaaagacaaaagccctcagcattacgtatccggttatgtgaacagcttgactgagtagggttaagatgttgcagatgtcctgcttctttaaggtggcttttcagggctgctcagggaggtaaggatggagtgcaagtgggagacatctttggcccactccctgagcttaaggctaaagtcacacagttgtgcatccattttagggacagctcatcagtgtcctcatagtggcagtgctgccaggctgtttgcctttgttttcttcagctgctcgctgtctcacgcactacccttcagctccattactgctttcttcccacactgctgcttgctgccgagacttggcatcaagggcttccaagtgctctgtttgctcttctctccatttagggatactccagtctctgatcgcagtagacctgcttctgagatagccgaataactgtttgttggcccattactttcctggtagtattcgccattttccttccatcagcagcatcagcagttggtttatgttagcttttaacacttgaggctgtactttcttttatagaaatgtgtgtaatttttattttttcctaatggatttaaacttataaatcattaaaactatttgtgcttgtatgtgtatcttctgtaaaaatgacttatttcgatattgaagaatgagactcaacctgacctgtgaagaagtcttccagctgtggtttttgtgtggctccgcaaagctacattcatccataaatgtaagcattgttgatatctaagcttaggcctccacactgccctgaggaccttataggggccaggtccatccactttgggcatggtgccacaaaaaggctgtcccagcctaagcaccgggtacatttcacacatccacaaagaagaaaagctaagaggaccttgtttctaaccttagttcatactttgtgagacacgttgggggtgggggtgggggtgcatttacctgctggctacagtaatgtg

SEQ ID NO: 17772 - DNA, 1193 bp, Mus musculus
aggtgctctaccctcaacaggaactgtaaggttaagccttatatacattttaggatagagcactgtcagaagaacagattttctgagtttgttaataataaattatagtacagtatgataccatgaatcatttgaaagtagctgaaaattttgtgtgtgaatactgttttatggtttgtttttctttttttttttaactttctttctttttcaaatgattgatttattttatgtatatgagtacactgttgctgtcttcagacccaccagaagagggcatcagatctcattacagatggttgtgagccaccatggggttgctgggaattgaactcaggacctctggaaaagcagtcagtgctcttaaccactgagccatctctccaggccttatgatgtgttttatgatcttatttttcatgttgatggccaggttaaaaagtactgaatagaagaaacattatactgaatataaaagttatctttgaagtgtcagttaattaaatagaattaacggattatcaaaagtagattattttctttctgttttccttattgctttgtttgtatcttagtaactcatgtcattgttcctgatgaggaagcgcagagtactctgaagtgtatgcttgggattctcagtggatgctggatcctgaagtttgattgtaagtactggatctgggaggattactagaccagttagtatagtcctgtccttggagttagtcaccgttttgaaagattcatgtatcattggtgcctttcagatttcttttttttttaaagatttatttattttatatatatgagtacactgttgctgtcttcagacacactagaagagggcatcagatcctattacagatggttgtgagccaccacgtggttgctggaaattgaactcaggacctctggaagagcagataggttctcttatccactgagccatctctccagccctcagatttttttttaataaatgtgcataaatatgctttgattttaaagtagctttattcaataatatcaagcatattaataaagaataaatgttgtttgatgttaactttgaagtctaaatagtccatattaatgctaaatggttcttttgacaaaatatactcatgttttaaatgcattgctcggtgcatctgtgaagtgaaattaatttattgttttccatttaagat

SEQ ID NO: 17773 - DNA, 1397 bp, Mus musculus
tgcttgtagccggccttatttgtttactgtcttcagtgcactcacccatgtcactaggaagaagtggagtctttacagtatagtccaagtgctgttattgttaggcagggtcatgtgttacattcctgcaaggttgaaaactacttacttattttccacttcctcttccttacttagggtgctttttacctggtggctgtgtttgtaagatgggaggtgaaagaagagacaaagcaaacaatcctaggcatttaggaattggtggtcgagcagtagaggaataaaacgtaacagtccttagagaacagaaagtcgaattcattggtaggtcaaggtggagaaattaatccttatagcatgtttcttttccttttttctatcagattcaaaagacaacacatctagggcaagtttatttggtgatgcagaaaggaagaagaattcaataaaaatgtggtttagtcctcgaagtaagaaggttagatatgttgtgactaaagtgtcagtacaaacacagcctcaaaaggcaaaggacgacaaagcccaggaagcctcaatgtatgaatttgtttccgcaactccccctgtagctgttcctaagagtgctaaaacagcttctagaacatctgcaaaaaagcatccaaagaaatctgtagctaagatcaacagggaggagaatttaaggccagaaacaaaggatagtagatttgattccaaagaggagctgaaggaagagaaggttgtctcctgtagccaaataccagttatggagagaccacgggtaaatggtgaaatagacttattagcaagtggttctgttgtagaacctgaatgttctggaagcttgactgaagtctctttaccattggctgagcatatagtgtctccagacactgtgagcaagaatgaagagactccggagaagaaggtctgtgtaaaagatcttcgttcaggagggagtaatggaaatcgtaaaggctgccacaggcctaccacttctacttctgacagttgtgggagcaacattccgagcaccagcagaggcatcggtgagccagcattgcttgcagaaaacgtagtgttggttgactgctcttcactgccttcaggccagctacaggttgatgtcacactcaggagaaagagtaacgcatcagatgacccccttagcctttcaccgggcacacccccacctctgctgaacaattcaactcacagacaaatgatgtcaagcccctccacagtgaagctgtcttctggtatgccagccaggaaaagaaatcacagaggagagaccttacttcatattgcttctattaaggtaggctgcctactcagaaccaaatcttagaaagagaccagattttttggctcttactgtaacaaatacttgagat

SEQ ID NO: 17774 - DNA, 1231 bp, Mus musculus
aggccgatttctgagtttggagccagcctggtctacagagtgagttccaggacagccagggctacacagagaaaccctgtcttgaaaaaccaaaagaaaaaagaaaatattttataaactacctttgtgtacaaggggaattccgatgagctattttctccttgtttttttttaaggtaaaaattaaggtagtagtgctattcacagttactttatttgaaagaatgttcttcaactgataggaaaatgccaaagaaaaataacatattttgtccttcaaaggtggcgtgacattactgagagctgcagccaaaaaccacgctcgagtgacagtcgtctgtgaaccagaggactatgcgggggtagctgcagagatgcacggctctgatagtaaggacacctccctagagaccaggcgccacttggccttgaaggtgggtacacttctgtcacactgtaaagcagtgtccatgtagtctaagtgtgtcagtctaagcaccactcagttctgctaaatatgtctgtcagcttcccacactctgccttctgtcctttcattgaacacagagaaatcaaatattagaaaaagtgttaattgggatgtgttggggggtggcggctgaggctgtacctaaaggcgttcttgggagacattcctggtatctcacaaaatgcaactttttgtaggcattcactcataccgctcaatacgatgaagcaatttcagattacttcaggaaacagtacagtaagggaatttctcagatgcccttgcggtatgggatgaacccccatcagactcctgcccagttgtatacgctgaagcccaaacttcccatcacaggtaaagtatgagaagtacctgttgtgtagacacctggctttctctgttgtatctgaagttgctctcattcagaatgtaagagtaaattacttaggaggccttagaaccacccagaatggaggtgcatggaaagtgtcagagtggtacagcagcttcactgtctggcaaacgccaggccctgggtggcaggcaaagcccgagttagagatgacaaatcttaaggctgctttggaagacttcagggtgcagctgctgaggtttccagaggaggagcagaacgagcctgtggtgcgtctataataatataacgggaagcagtgaagaaagcagccgaggaagctgttgtgtgtttcagtgggttgagagccaccctctgtttgacagatg

SEQ ID NO: 17775 - DNA, 1336 bp, Mus musculus
gaacttggagagactcgcctgcctcctgactgctgggattaaatggaagcaccaccgtggccagcctgcagcttctaaaggatgaaaacacactgtttctgtccttcctcctgtccatggcacctgagcttgttccacagctgatagggttggtcggcttgttgttttaagttgaggtttatgatttatgacatccggtcactgtcattttcataactatttaagctattcacatggacacagctgatacccggtcttgtcattgttgctgagtcttacagttgtatttctactctgcagggatgggggtgaggtaggaggaggaatttgaagatgacccaagtgttctgatccttttgaagtgtttgtagatatctgttacatcttgattagtttttctttcgggagaggagggtatcggagaatggttcttgaggaactcattatgtagccctggctattctagaactcgatctgtagaccagactggccttgaactcctagagatccacctgcttctgccttcccattgctgggactaaaggtgcacaccacctccagcctttgattacttttgtgacttttgcctaaaatcacattgaagttgtatagcttataggtgtccctttttaagggacatacatatatgtagcctttcttaacctgcgtgttaatgtgtacgtgtgttttcgtgtgtagttctcaatggagccccaggattcataaacttgtgtgacgctttgaacgcctggcagctggtgacagagctgagaggagcagtagacatcccagcggctgcttctttcaagcacgtcagcccggcaggtgaggaatgccttccagagggctctagaatgctccacgagtaaggagctctgaggccagttatacagccctaggcatcctaggccacttggcaagtccagtgatagtgtcagtgtagtcatggcaacctcggtaacataatccatatacacataattatgtgacagtgtcaggagacagagcagttgcaccattggctcttgtggtgtctttctgaaagtttaggaatggaagtgaagtgacataatctcataaaaccagagaactgctgctccgttttggaattgtgccttagtaagcgtgcagagattgttcatgtagcattctgctcctgttgctattgactgagccattcttttgtgtatactctcaagtccttaagtccacacacaattccatgatccataatgtcacaagggctgcctgcagtctcacacaccattgttaatatttattgggcgctaaagtgcagtgagtgagtagaagtgaatggcgtgtgatgccaagccga

SEQ ID NO: 17776 - DNA, 1677 bp, Mus musculus
gcatcggaaagctatgtcggtttgatataagtgagctattttccttccctgtgtgatgtaggcaaaatccaaattctcttgctttgtctggatatttcatcgttagcttatgcttttttaaagatttatttttatatatttttatattttatatacatgcatgtacttatgtatgtattatgtgtaccttcctggtgctcatggaggccagaagagggcgtcagagaccctagactggagttacagatggttgtgagtgctatgttatatgggtgctgagaaccaatcttgaattctttgggaaagcagccagtgctctaaaccattgagtcctctctcccaccgctgcattctagaggggaattttgggtttttctaggtatgcatactataatgccttgaaagtcaccattggttttgggggttttctccgcagagtggtgtggcctacattgtcgctccatctggatctactgctgacaaggttgtgattgaggcgtgcgacgagctggggattgtcttggctcatacggatctccggctcttccaccactgaccttagctgacattgtttcctggtcgtagataatcatgtgtggggtcttggaagtacctctagaagagtcatttgtatcttaatatctgggtgtgtggtttagtaggtgggtcttacttatctgaaaggtagagctttctagcctaagacaccttatgtgaggcttgtttctgcaaaacctgaaagcatctctccctcctggagccagctttcaggaaaagtccctgtgagacacctaagtgcaggtaaccaggagaagccacgctgccttatgatgacatgccacccccaccccaccccaccaccaccaccctgcccagcgctctccccagggctcctttcttcctgcctctcggaagcttaactgtttgcttcccattatcccctgggaactgggtccttaactagatctaaatgctgggactgctctttctttctccagaattgcttaaaacctctgttggctacttagtattcctgtttggtataaacttataaatggactggcgttctgcatagagcttttcacccaaagtgagcagatattaacttgtgggggtcagggggaagtgggggtgggggtggagtgcctccctgtaccaggcaggacataactggatctatgtccctgtggttatagtcctcactgttcacccagaggatccctgtggtcacttagccttaggttagttttgccttctttccaatcctctaaataaattttaaaactttttgggtttgtggttacttttgttttgttttgttttgttttgttttgttttgttttgttttgtttgacataaggtttctctgtagctcctgctgtcctggaacttgtaactgaggctgatctggaactcacagagttccacctgtcccctcggcctcatagtgctggaggtaaaggttagcacaccacacccagcacagaacattttataataaacagtcatcttttgagttgtttctgtgctggctgatctttcaactcttggagtggcccgctgaaacaaagtggacttacataatcagtaaactgtgtggcttcacagggcagagatccctcagccttggtttcttggattgcttgctgctatagcaacattccctgcctctttgag

SEQ ID NO: 17777 - DNA, 2412 bp, Mus musculus
ctaaggctatatagtataggttagggaggttttagaagggactggaaagagaatgtggccaggtacccagttctacctgggacccacggcgtcctttctggttccttccaagtcattcctctccttcaccagaaagtgatggcatttgtccccacactctcaagtcactgtgactgatttcgcagccctaggggtctgtgagaaatcttccacctagagcagaaagcctaccaaggaggaaggtaggaccaaagatgagaagagcaaaagaagtgaggaggatatttcagcggaaaggaaagcatatgtagacagatgaataagccaagatctattgtaagagttacgactgtacacaggcatcattgcagtctcctgattaactgcttgtactgctgatgggcaagagctgaaactcagtcatgataccctcaggttatcctaaaccccatttaacttcgtgtctttcctctcagggctggcgctgtgacaactgccgtagacctggggctgctgaacccagtcccgatggcaccaccggccacacctacaaccagtatacacagagatacaatcagagaacaaacactgtaagtgtacacatatccccacccacccccaccaccgtgactctccctgcatgcagccaggggcaggtggatagatgcttttcttgaatgaaccaaatgagttttatttggagataagtcttttgctcatgagtccagtcctcaggacccatccatgtaaaagagctaggcgctacagcaagtgcttataatctcctcactgaggaggtagaaatagggtgtgggtggtgtccctggggctgtctggccagccactgtagccttgttaatgaacttcaggctcatgaacaaagcagacagcatttgcttgattaaagttaactcttggctccttatacacacaaagtcatgaattaattataactcgttataatttactaaatccctaagcattgtctattgctcagtacattgctagtcttttgaaactatttatccttcctataaaacacctgtgacacaaatctccactcaaccctccccgaaacacacacacttttggttttccgagtatttgctactaatgtttgtcttctattttgacagaacgtaaattgccccattgagtgcttcatgccgctagatgtgcaagctgacagagacgattctcgagagtaatctttccagccccaccctacaagtgtctctctaccaaggtcaatccacaccccagtgatgttagcagaccctccatctttgagtggtcctttcacccttaagccttttgctctggagccatgttctcagcttcagcacaatttacagcttctccaagcatcgccccgtgggatgttttgagacttctctcctcaatggtgacagttggtcaccctgttctgcttcagggtttcagtactgctcagtgttgtttaagagaatcaaaagttcttatggtttggtctgggatcaatagggaaacacaggtagccaactaggaggaaatgtactgaatgctagtacccaagaccttgagcaggaaagtcacccagacacctctgctttcttttgccatctgacctgcagcactgtcaggacatggcctgtggctgtgtgttcaaacacccctcccacaggactcactttgtcccaacaattcagattgcctagaaatacctttctcttacctgtttgttatttatcaatttttcccagtatttttatacggaaaaaattgtattgaagacactttgtatgcagttgataagaggaattcagtataattatggttggtgattatttttataagcacatgccaacgctttactactgtggaaagacaagtgttttaataaaaagatttacattccatgatgtggacgtcatttctttttttttttaacatcatgtgtttggagagaaaaattgtcttcatgcatgtcctttttcttttcgatgctacaagcatgtgaagaggcactgtgttgggctggggtggtttctgcacatgagcgcctgcctggccttacagaagcactgatactttgcgtcattttgtgtcctcacttgtggttctgccttatcagatttaaatggattcaaatgtgggctaagcttgctagctagcacgttaggagtataaaggaaataagattcgtgtgtgtgtgtgtgtgtgtgtgtacatacatacaagtgtgtgtgtagctgctcatgaaaatcaggaggccagaaggggatgctgggtcccttagagctggatacaagtgtttgtgagatagatactgggatttgaactcataacagagcggcaaatgccctcacctctccagccctatagttctgtttaatcatcacaggcctttgcttctttgaatgaacacctatt

SEQ ID NO: 17778 - DNA, 1209 bp, Mus musculus
cttatatgaatcaggtgacaccagctgtttttctctttaatcttcttgtttgtttttgtttgtttgcttttgtcgttgtttcatgagacagggtttctctgtgtgtccctggatgtggtacactcagtctgtagacagggctgtcctcaaactcagagatctgcctgcctctgcctccctaatgctgggagcaaattcgtgcacgacgacgcctgccctctctttaatgtttaattaaactattttgtatctaggatctctgcgaacctaaaatatatattttttaattctccaatcccattttaattttccatatttgtaaaatttaaaaggagctgaatgaatcactggttggtcctctgaaatgatcttggtggtagtgttaagtcttaacactggcctggaagatattaaatgttatgatgaagaaatgcttcatcattagaaatgtgatcttggacttcctgctctgtatggattttcgtcctgttccagtgttctgcccatcctgtgagtcagaacacagagtaactctctgcctgcgatgtccctaccttccagaatggtgccatgacaacggtgtcaactacaagatcggagagaagtgggatcggcagggagaaaatggccagcggatgagctgcacatgcctcgggaatggaaagggagaattcaagtgtgatccccgtacgtcatcctaaaaatgctttctagactttttaagtactcccatgttcctaactgagccgaaacacccatttacaggctgggctggacgtggtgggcttgtcagtctgtggttggtaagtcagtagcttgcttcagaaagtgaatcatgactgaatggcacgtctaagcactttagcactttcacaacttgagcactttggtcatctgcagtgaagtgctatgtagactcagtttttaaaacataacttcaaagccaagcagtggtggcacatgtctttaatcccagcacttgggaggcagaggcaggaggatttctgagttggaggacagcttggtctacacagagagaacctgtctcaaaaaaccaaaaaaaaaaaaagacttcaatcgttccatctggcctagtctaccaaggctttggaacatctccttgtgattcacctaagttgatgagatttggcccgtgctcattcaggtcgagggcagatgcatcaacttgagtgtacctgattgtccttg

SEQ ID NO: 17779 - DNA, 1380 bp, Mus musculus
atggtgggagtaaaacctttctgatttgggtcgatttatttattatttgatttctgaacttcaaacacttcagttcgttgcaaagccttaattggagcagagatggctttctgtggggctcagcggttcaaagctttgtctgtatgagaattcatactaacttttttttttttctgtctgaactataaagaaatctgtgagaaaaaaaaaatcacgatttctttctctaagagtgttttgtgatctgagaaccgctggttgtgtgggagctctgatcgggttgataaacagttgttgcctgggttgacagtgattggttgcttcttcttcgagcttaacttttgcgctttgcttttttggctctaacctctcttggctagatgagcttccccaactggttacccttccacaccccaatcttcatggaccagagatcttggatgttccctccacagttcaaaagacccccttcatcaccaaccctgggtatgacaccgaaaatggtattcagcttcctggcacaacccaccagcaacccagtgttgggcaacaaatgatctttgaggaacatggctttaggcggacaacgccacccactgcggccacccccgtcaggcttaggccaagaccatacctgccgaatgtagatgaggaggtccaaatcggtcatgttcccaggggagacgtagactaccacctctatcctcatgttccgggcctcaatccaaatgcctctacaggacaggaagctctctctcagacaaccatctcttggacgccgttccaggagagttctgagtacatcatttcatgccaaccagttggcaccgacgaagagcccttacaggtacatgacagcccttgcaaagtgtctctctatgtaactgtgtcttcagaaacaaccacagcttcatgtctgatgcccactgtcttagtcagggtttctattcctgcacaaatatcatgaccaagaagcaagttggggaggaaagggtttattcggcttacacttccatactgctgttcatcaccaaaggaagtcaggactgcaattcaagcaggtcaggaagcaggagctgatgcagaagccatggagggatgttccttactggcttgcttcccctggcttgctcagcctgctctcttatagaacccaagtctaccagcccagagatggtcccacccacaaggggcctttgccccttgatcactaattgagaaaataccccatagctggatctcatggaggcatttcccccaactaaagctcctttctttgtgataaccccagcctgtgtcaagttgacacataacaccagccagtatacccaccctcccagggcagaggctacgactctgactggaggttgtttgactcag

SEQ ID NO: 17780 - DNA, 4035 bp, Mus musculus
ttgatcgccctaaaggactggcattcactgatgtggatgtcgattccatcaaaattgcttgggaaagcccacaggggcaagtttccaggtacagggtgacctactcgagccctgaggatggaatccgggagcttttccctgcacctgatggtgaagacgacactgcagagctgcagggcctcaggccggggtctgagtacacagtcagtgtggttgccttgcacgatgatatggagagccagcccctgattggaatccagtccacaggtatatcgttaaccgcacccaccacccgggtgcttctgggaacagtggctttatgccttgctggcgttatactttactgggctattgagtcccatgtaagggagagtagaaaaatgccttcaaactcttagtaaagaaaggccctctttaatgaggaatggttgtgaacaatgaaagtcaggtgatgtttaggtaactaagtctaggaaagagaaatttaaagtagctaagcacagacgtgcaaacatatgaaatatataaatatttaaagattatgaagcaagacatttgaaggtactaaattacggattgtttcctaagtgagacacctcggtggtgaccctccctctccacacatggaggaaagaagtctagaatcatagagcttactctgagaattgaccctcttaagccaggcattttcttgcaacatgatcaaagaatacatgggtaagacctcccctggctagctctcctgtgctgggccttcatttgcttaaaggatgatgatgcagatgcacaggacagcgtcattaggaccagtgcttcttaccagcctcttatgcttttaccgctggagcaagattggaatgctcaaagcatacagaggtgacagtctgtggaactgctctctgcttctctctcctgcctctattgtaaaccaattttcttcttatgctacgccgcagagaatacttcaaatttagcagtgctatctgccgtggggtccaaataaaagagacaaataaaaacaattctatctctaggatggaatagtctgtgaaattgtttcctgtacaaagataatttatatagaaaaaggggccattgctcatctttttcatacaaatggaaaaaaaatcaattctaatgactaataagggaattcaactcttggcttctaaaggcgtagggtagggagataagacccaaagtctctcggaaccctggtgtttatgcagatgtttgcagtggttctgagagttgctggtataaatactcctctcgtttttattatctgtttgtgcagactctcctgggagtctccagggagtccaccagtccctacgaggaccatccattctccttcttcaagtttgctttctttccccgttcctcgttccctataagataaccttttaaccaatgaccatcctgacagccattcctgcgcccaccaatctgaagttcagtcaggtgacacccaccagctttactgcccagtggatagcacccagtgttcagctcactggctaccgggtgcgggtgaacccgaaagagaagacaggaccaatgaaagaaatcaacctttctccagacagctcatcggtgattgtgtcaggactcatggtaagaagtgagcttccctctgcagagtaaggcaggaggtcatttcatagagttcataggtgcaatctcataataaacctagtgttctttgcttctaccatcaaatagggttgtcacaaatgtgtacaatagaattcttttatgtagacctaggattttctagataccctaagatgactattggattagaatggtgtaaatagctttggatttcgtgcaggtctttgacagaagtattccacttatttaaaagaagtggtattcggtagggagcaatttatatacacacacacacacacacacacacacacactctggctgagtttatggcttttatgagtgatgtttccctggcaagacgcattctccagttagtaccagcctaacttgacactacccccattaaaacatttgacaatcagccagctgtgctttaatcttgggaggcagaataagcaggtggatttctgagttcgagcccagcttggtctacaagaatgagttccaggacagccagagatacacaaagagaccctgccgcaaacaagcaagcaagtagtatttaaaactttttctagccatgcagaaattagctaggatcctataagggcttaatgcacatcttaacacaaggccaattcttagagaagtagcagtagaatagaagctttctcttgctttttttgtgatcaggaaaaaagcaaaacctgatttatatctgtcatatcataaaggcaaaaaaaaaaaaaggctaagactgatttctttcttattctttttttgctgctccttgtggattgtggacttaacccctgagaacattttaaaattcacttaatttaaatgtaaatgtattgtcactcataggtaacagtgaagttgctctgggaacctgggggtttggggtttgctgggctatgcagatggtcttttataatcaccgcatttctctaatgctttggtaagaactccgggcatcatgcaacaccattgccaaagtttctggtacctctgcttccaggtggccactaaatacgaagtcagtgtctatgctctcaaggacacactgacaagcagaccagcccagggagtcatcactactctggagagtgagtaatccgatgagtgacatgttttaatcctgacacaccctgagtggaagtcaaaagaaaagatctttacatttaagccactgacttagcaatagaatttggaagttgatagaacagcttgtcgtttcgggaatccatccaggaaatgacctgccgaaacaaaatggaatcacttcactgtgttgtgttggtgctggtgggttaaaactcacagctggcttatgcggtactggtgagggtctgtattcgtagggttcaatgtggggaagatgaactggcttccaccatagggaatgtggggctaaattagatctgtggtctagtctgttgatgtttcatcacctatggaatgattaacacgtgaagccttatagaaatgaccgaagattcgccacccagacagacgttattactaattgtctgtgttataattcctaccatacatccttacatattagtaaagtaatcattgtcacacttgtttgacatagctctagacactagagagtcaaccctgggcaccactgatagtatttagaaagcttttctgtttagtgaacatttccatatttcctcaataccgttaacccatctttctgtaacctccacattactttttagtgtatttcctgaagtggatgtatttgcataatgaggactctttttaaaatatccaaaccttacatgtatgagccaagcgtgctttaatctctggctctgctcctacacagatgttagccctccaagaagggcccgtgtgacggacgctacagagaccaccatcactattagctggagaacaaagacagagacaatcactggcttccaagtcgatgccatcccagccaatggccagaccccagttcagaggagcatcagcccggatgttagaagctacaccattacaggtcagtgtactcgtggtctgcctgtgtgcgcccgcaggagaccctggctcggtagatagtctggtctggtattgagaatgtgggcaccattccacgatctgttggcttcctgatgtttgcttgacctataaatctcattcattgaatttgttgttttataaatgctcattcattattgtctaatgaaaatctgcacactgtagtcataggcaggagtctgaggcaggaggatgtgagtttgagactagacatagtgaaaccctactttttttaaagttaatatagagaacataaagatacaaaatagtaaaattagcatgcctagattttaaaaggcataatgaaatttatgattacaaacagcattatgtataataaaaccggaaactgtaatcaga

SEQ ID NO: 17781 - DNA, 1225 bp, Mus musculus
gtgtggcgtgagtcaagccctagattttggctttaagcacagatagatatattttcagtgacaatgactgggagacctgttatcagaacaatctgtagcttagctgtgaataggggcgtgtgtgaccactatttccaaataacacatagttaagggtgcatggggtgggatctctgtgagttccaggccagcctggtctacaaagcgagttccaggacagacagggctgttataacacacagagaaaccctgtcttcaaaaaccaaaagaaaaaagaaaagtgcatggtgagtgctgctgtagtttttataacttctgtgatttaaattatttcccaaagagactgttgaggaaaaaaggaattcacaattgggatggtctccatagccccttcccttgacctcgccatagaatttaactctgctaattcagtgttgcatttagatttttgtttgaagaggatgtgtgtaatcgttatctgggaaaggacaaagtgaacctgagctttctttggaagttatacatgtgaagttttcctgtgatttttttttttctagtttctgatattccgagagatctggaggtcattgcctccacccccaccagcctgctcatcagttgggaaccccctgccgtctctgtgcgctattacagaatcacctacggagagacaggtctgttcattttgggccatttcacccttagaggatcagggttcgggtgggtaacttggaaatctgacagtgggaacaggattaaatgcaaacaggcccatttagaaaacccccctccctccctccctccctcccctcccctcccctccccctctttctttctttctttctttctttctttctttctttctttctttctttctttctttctttttctgtccaaaaatgcatgggagctacatttaattgattgtaatgaagttcaaaggtggtttatacactacagcaagggtgggaagcagagctgagaaaaaaaagtttatatatttacaaatattaccattggtaattcttactattctttcttttcagtgttctctaaatttaacaaatattctgttaacccttttgtaaagacttcattccattttaggttgagtgagccacattcttgtcccctttttctatttaatttaaacaattaattaaatataattacatgatttcctccttccctttcctcttccaaactatcccacacccctctcgct

SEQ ID NO: 17782 - DNA, 1186 bp, Mus musculus
actcaagcagggcaggaacttggaggcaggagctgatacccggggccatggaggagtgctgcttactgactggcttctaccatgacctgctcagcctggtttcttatagaatccaggaccatgagcccagagaaggcactgtcccgcccacagtgggcagggccctgccctgtcaatcactgataaagagaaagccctacaagcttgcctagatcttacagaggcattttcttaattaacgactccttcctcttagataactttagcttggtcaagtttatgatataaagctacccagaacaacgctgaagccctcagaagtatcagtgtttcggtataatgtagaaatcggctataattttacatattgtttcaattacttttaaaaggaaaaaaagaaagaaatgcttgtgtaagctgattgcggtcagctatcagtcccgtataacagtgtcagttgcgttccccacatcctccatcctcgatgtctaagctcgtggttgttgtcttttgctcccctccttgggtgggaaaaacaggtctcgattccccaactggttttgattcttctgatatcaccgccaactcattcactgtccactgggtggctcctcgggcccccatcaccggctacatcatccgccatcacgccgagcattctgtcggaagacccaggcaggatcgagtgccgccctcgcggaattccatcaccctcaccaaccttaatccgggcaccgagtacgttgtcagcatcattgctgttaatggcagagaggagagcccgccactgattggccagcaagccacaggtaattttgtttttttaatccgcaaagaaatcccttggtgtggactttgtataggtttggtgtagactgtgaaaaagcttcatgttagacacaaagagcagtggtggagccaggcgcagctgtgcgcgctcatgcacgcaggcacgcgcgcacacacgcgcacacacacacacacgcacgcgtacgcacacacacgcacgcacgcctttgatcccagcgcttggaggcaggtggatttctggattggaggtcagcttggtctacagagtgagttccagactagccagagctacacaacaagatcttatctcaataaaaagggaaagaggacagtgatagactgtgtggtaaacatttctccctctaaaaacatattt

SEQ ID NO: 17783 - DNA, 1182 bp, Mus musculus
gtaagtagagttcactgaatggaattatggcaatgcagtagtgtgtagatatctcactccggggaaactgaggaccccttgtcttttttgtcttcgtgcatgtgtttcttcggaaagtactgctatgtgtctttgctgtgtggcaacttaagcctcttcagcctgggagaaacatcttccgtggtatcgatgtactaaaacggcaatagcagccaccaaaaaaaaagcctacctatttgaaaagtagactaaaattcttttaaaatgcattgatcatggcagaaaggttaaaggggcctaacagtgttctctatagtgttttgtttatttttttaacagtagcgtgtcatgatttagattagattagattagactgtttgcatggttgtaactgtttcttttctgcatgaaatactggtttttaccttttcagctattttttttttttagctttgactttaaaatcgcattaactcaatcctccttatttgatatcagctgtccctcctcccacggatctgcgattcaccaatatcggtccagacacgatgcgggtcacttgggccccgcctccgtccatcgagctgaccaacctcttggtgcgctactcacccgtgaagaatgaagaggacgttgcagagctatccatttcaccttcagacaatgccgtggtcctaacaagtaagccctcaaacatagcttgtcccgtagatacgcagatccgtagatctggagcacaaggcatggatcctgagttttcctggaggaccacctaagagaaaggagaactgtgaccgagagacacgctctccaagttcagtaggcggctctgtaaactgtgaaagatgtaatgattctgccggagtggcagacctttgatcgctacaaatcgtagtcgaaggcacggtctgtgaagcaccaaggtgtcagacattctctaatcagtgcacaaaagatacgtgactcccaagtgaattctgtaactaaggcaagagtgagaaacatggagatcagcgcatctggtttattgtcctttcttgtgtgagatctaccaccaccaggggatctatttagcactagaaaacttagaatggcttttgcgtggagacaggcagacgtttagttcatatttcagaaagcacgtgtttgcaccatttccctgaagctgggagagtttagaaa

SEQ ID NO: 17784 - DNA, 1198 bp, Mus musculus
atgccatcatggcttttgaacatggaaaataagtcaattagccagccaatttttttttaaaaaacctttggaagattttattttcttactaaaggttttgtgttctccccactcccaaccccccaccccgccaacattgctagtgtcttttatagatcagttcaggctctgagaatgattttgacattgtaaatgggtttatgattaattttttttaacacttgagaagttaaaactgtaccattcagggacattttctaaatgggaggaagcccctgaaagaatgtggtaacctgcattagtctcccaggggagcaaattactcatgatgcttgggacgtcttttcagataatttgggatacattgcatataccatcattgcttgagcattccgtcaatttcactaccggtcacctgatgtacactgctttattttttcctttgttttttgcctctacttttcttttgcctcctctttgcttcgtaactcaatagaggtgccccagctcactgacctaagctttgttgatataactgattcaagcatcggcctgaggtggaccccgctaaactcttccaccattatcgggtaccgaatcacagtagttgcggcaggagaagggatccctatttttgaagattttgtggactcctcagtaggatactacacagttacagggctggagcctggcattgactatgacatcagcgttatcactctcattaatggcggagagagtgcccctactacactgacacagcaaacgggtgaatcttgaagtcttctgtgtttgagacatggatggtgttgcatgctgctcagtcgctgtggttaaatctggatgtttccaagccagtgattggctacggagatgaagacggggcccgctcagagataagggatacattagtctggttgcatgaaagtatgcgtaaatagtctcaagcactttcagtcaaagcacaaacagatgtgaaggggaagagctctagatctctgatttatgaaatgcaaaggagattacatttgcagatcttgagggtgtttgtttttttttaaagtatgactatcaaactgaacaatgagcactcatttacactaagacaggcctccaaagtgtgccactgcgtgcttcctcttaccttgataagctccttttgtagctaataaaacacctaccaaaaatgagtgtggaa

SEQ ID NO: 17785 - DNA, 1229 bp, Mus musculus
cccccccccccccgttcccatagttcaaacttttacactcttcggagaatgtttaagtggaaagcaacctcagagcattcaaaaaaaaaaatgtagatttcctagctctcccacaggtcgcccattaaggaaaaacaggataaaatagtaaaaagaggctggaatttgtagacaggaaactctcaggtcttctctaagatttccttatctttgttaaaggtcccatgattttactttgtagttaacacatttatatgggttgtaagatcgcccaatggatgcaatgtagaatgatcgagttagcatttccatctaaaacattcatgtctaagtgctggacactctcagactctagttattatgaaattatcataagttgctgtggactagtcacccggcagagtaattcctactttctgactgttggtacattacagccctgccccttggtcccaccttttcctctctaggtccatcattggtgtacagtttaatataccctgagtcacattggttctgtatggtaacttcctctctgcatttactccagatatcactggctacagaataactactacccccacgaacgggcagcaggggacctctctggaagaagtggtccatgctgatcagagttcctgcacttttgagaacctgaatcctggcctggagtacaacgtcagtgtttacactgtcaaagatgacaaggaaagtgcccctatctctgataccgttgtcccaggtaatagaaaaataagctgttatccttagagtggcagttttgagtagcgatggggataagcatcttaatccgagatagctgagtgtgtcagatacagttgggatttaatgccaacctcccagggcgctctccaaaaccacaaagccaaaaagcaactgtttggatgaaggctttcctgtttcctctgcttcactatctgtgcttccctgggatgctgtttgttgccatgggtacctgatgagtgcggccacggcattaactctgtactgtttgctcacacggaaagattactaaacagtgtcgcgtgtctgtacccagtgctgacaggctaaaagtaatgtggtaaatgcatccctttggggcttttgtgcccgggttttacagtccatctccacctccaactgttatctagaaaacagcctttgtctccatatgtgagcactgaaacacacttggttgacaatccaaatctttatcttgcagcttc

SEQ ID NO: 17786 - DNA, 1216 bp, Mus musculus
gaaatagaccgagggtcactctgctttttagtatgcaaatagccatcttgatgagtgggctgctcaggtacagaggggacctttatgaagaccgccacggcacctttttagtttcccttaataatgtcgttcagagttttagaagccacagagaatctgaagggtttctctggagctgagtactgtttgataatgtcacctaagcttttgtagttaggaacacacggacgtcttcgtgggaatgtgtttttcatttccgtgtgtcaaagtggctgcagataacttattaaagagagagcctagagcatttcttccctgtgtactgctggtatgcaccagaagggtttgtgtcaaacagttatactgacatttctctagaacctttctattataaaggaccctagtaccaaaggaagatacctccagctaattgcaagatcactaaagtgagccctcaatgtgttatccacccagtaaatgcagtgtggagttgtaacggacttccccctgtgtaaatctacaacctctcgggatctctggaatattcatccttcatgctgattttgctgtcttccttccagctgggtgtacgaccgagccagggaggtgaggcaccccgagaagtgacttcagactctgggagcattgttgtgtctggcttgactccaggcgtggaatacacttacaccatccaagtcctgcgagatggccaggagagagatgcaccgattgtcaacagagtagtgacacgtgaggagagccttccttcttcttttaacttgtaaactattttaaaagattgccaaagccaggtgtggtagggtgtgcctttaatcctagtgcttgggaaagttaagaatgatgatgggagttcaagaccagccaaaaactggaggcggagctgggttttataatacacacctctagtcccagtacttaggaagcagagagaggcagatattggagaatttatggctagcctggtctacatagtaagttctaggccaaccaacagtgagagcctgtccccccaaaaaagaaacatattcctctaattatttgaatgttagcgtcccagctttcttttgagacagaacaagggaagaacctctctcttatttatatcagcagagtcttcagaactggatgtagtttagctggtgtcatgcaggccacagaattagaagtgttccttccatgtcaaaagtcttccaaa

SEQ ID NO: 17787 - DNA, 2740 bp, Mus musculus
cctaatacctgcatctgcaacctataaggccagccccgctgttcactgcagtgggcagttcccgggctgtacaggtgggtgattcctgcagagctgctgctcactgctgaagagggagctgagtcgccgctctagcttcaccagtgaagttcccaaaggtgcaaacactgctcaggctgattccattcctctgctccgagaagggaaagccgctagtactatgaatgtctcacgtcatggcatcacttactgacattcattaaggatctctgggttcaaggatgctatttgattattaaaagcttcctatcaacttattcttatttctgtgcccgtcaggcattatcagaggaagtggtaacattgaaagacccggaaagaatcttgctgattcttagccatgagaaaggagagttataatttgtctagcctccgcttctgaagaccatgtgtctaaacgctgttctcctaaacctgcagggtatagaattgtctattcaccttcagtagaaggcagtagcacagagctcaacctccctgaaacggccaactccgtcaccctcagcgacctgcagcccggtgttcagtacaacatcactatctatgctgtggaggagaaccaggagagcacacccgttttcatccaacaagagaccactggcaccccaagatctggtaacttaaaaacagcccattccctgatgtctgatctcttaggactagaccagagagccgctctaaccttccaggggaagataaagcccacgtggattagactcattctttagccttcagggaggactgaggtgcaggtcacgtgggtgacagatccctgagagggagctgtttttgtctttgccagctctttctatgtcccccatcacccaaatcaatggctctcacccttcctaatgctgtggtgacccccaactataaaattagtgtcatgctgctctatagccacactgtcgtgaatcataatgtaagtatctgtgtagaattctgatggtcttaggtgacccctgtgaaagggtcatctgccaccaaaggggtctcaactcacaggttgagaactaccgagttaaatgctaaaatgtcagcacttggaaggaatttatttatccaaggcaactattgggttttctggttaaaaactcacagcatctcctctttcttttcctgggaggcttaagaattactgttctcttaactaccattttcttaagaaaatctgttctcttaactaccataaaatgagtcagttaaacaaacacaccagctgtcttgtaaagtgaaaacatttatttttgtatattattttaacttggttttatgttataacatgcctatctatagatactaaatagagattccaatatcagtttgactaaccatgagtatacacacacacacacacacacacacacacacacacacacacacacatttattttttgattaagaggcaaagcccagtattggcctagaatgagtgggtctaagagatggcggaattgttcagggagctaacttctagcatcaaccttcagtgggaattgtgactgactgactcatcgctcttgtctgctagataacgtcccccctccgacggacctacagtttgtggaactgactgatgtgaaagtcaccatcatgtggacccctcctgatagtgtggtgtctggataccgtgtggaggtcctgcctgtcagcctgcccggggaacatgggcagaggctgcctgtcaacagaaatacctttgctgaaatcactgggctgtcccctggggtcacgtacctcttcaaagtctttgctgtgcaccagggcagggaaagcaatcctctgacggcacaacagaccaccagtacgttccaggcctgcctgcctgtcttgtggccccctccttccagctctgaaccctcagctctacctgggataactccatagcatgctgctcactcccaggttcacagctcagcagttagggaacatcgagttgaaaggaatgttgaaggtggaatgaaactagcgttctgagaatgctgactccaacatacatgcttccaacacgcatgtcatgtccaacatgctcactgctggagttagagttttctttgctaatggagatgcaatttcagtgcttttgtctctctgtttcccctcccttcttccctcctccttccctcttttttcttccttccctccctccctttctccctcccttcccttcccttaaccttcctttctttaagctgtgaatcaaaaaatgctctaccactatacaacatccccagcccttaagtgcatttttaaaaaatatatggccgggcgtggtggtgcacgcctttaatcccagcactcgggaggcagaggcaggcggatttctgagttggaggccagcctggtctacaaagtgagttccaggacagccagggctacacagagaaaccctgtctcgaaaaaccaaagggaaaaaaaaatatatgtagttagatatagtagaattcatttgaggctagcagttgccaggcagcagggtgtgtaaatgtatgtctgggatgtgtgaggccctgggttctctctctagcaccacacaacgagttgataccttaagtaattcatcctaaacatttagtggccctgggcagcgaggtatcatctatttagctctttatcagcagaacctggctggctcttaagtctttagctgacatgtgcaaagggaaatgctacttctgtt

SEQ ID NO: 17788 - DNA, 1167 bp, Mus musculus
actggcctgcaggccagtgttgtgcagacagttttctcaatcgagattctctcatctcagatctgtgtagattatgtcaagttggtaaaacccaaccagcgcacactgctctccatcccagaaaggagactaccacatggtggtgtatgctatgtaaatttctctcttcgtcttagggtaacaaccaaaaatttaactaaaatcatcaactaaatgaggatgttagaggaactaaggcatgcctttgttgagaaattagtttctccacaggaaactatattttaccatggcttttagtttaatggactgtaatccctgacaattacaagtctattagtcagaataagaggggagtaaaaattaatattattaagctttgaaaaaaagattattctgtgccagtagaaaatgtattttagcaggtgttaaatccagcagtagaactgactgccttgaaaaaatgcagtttcttttgatttcattagtcaaagcttatcactcacccaactgttccctggacagaccagtgcatcgttgatgacattacttacaatgtgaacgacacgttccacaagcgtcacgaggagggacatatgctgaactgtacctgctttggtcagggccggggcagatggaagtgtgaccccattggtaagtggccgcctctgcttggttggttttcaccgaggacgttggctggttggttggttggttggttggccacttgcagataaggaaagctatttggtatcgccagacttccttctctccaaacctgcctcatccatcagtctgcagagagccttgcaaatgtgttggtaacaagggtggctttactgcagtgagtgagtggggttagctttgttggttctgagtcatgacaaaggaagtttcgttactgactgcagaaaagaaacatgggtataggactcagccagtagatgcctgcctccggccaaaacacttcagcttttgcctctctgtacaataagtagataaatagatagggctgggccatcactgagcgatcaacattaaaaggagcctattccccaaatccaaagtttaagataatcagttcttactcctttactgaaggaggcagactgcttactgagacagcaaattgatcccagcagtttgttcggcctgcgattgtaaagccga

SEQ ID NO: 17789 - DNA, 2055 bp, Mus musculus
tttgaacccacagctaatcccttagcagaggcaggcagtttccatgtcccttagcgccactggggaaatgtcactgagggaaaagccctatggtttgattatttcgacacatggggattatgatgtgattaaagacactcaagtattgaaatcagtggatgatcccacagagccgatgaacacacaggataaatgtcaagggtgccggtacttatcttctgtgtagagtcgaattttacacaaagctatcatttaatcttttttttccccccttggctgggaaaatgagaaaacatgagatttaaatctattttgaaagtgaagatgaaaatccactaagaagcttagggctgtattatcagatatctttttatttgtggataggccctctgggacttaacagccggaacctggctctgtctaagcctgcggtagtctctccttgtcgtacacaacacagctcagctgtaatcttcgggtttgtgtgttgtcttgggcagttttggttcagactcgaggcggaaattccaatggtgctctgtgccacttccccttcctgtacaacaaccggaattacaccgactgtacttctgagggtcgcagggacaacatgaaatggtgcggcaccacccagaactacgatgccgatcagaagtttggattctgcccaatggctggtaagaggaagccctgtgagttatgggtgtggacccgctagcagcctgttgatggtctgggagagtacgatgtgcatctatgtattatatcttacatttgcaaattgagaaaactgtcaatggcaatgtattctggcaaatacagagctgtcctcattttacctggatacagaaagaggaatcagggattgcttattgtttttaagtttcgagagtccggtagaagacatcttttccagttgtagaaccaatagcctgagggtcatggagagtcatgtgctcagacgcaaggaaactacactttttgtttttctcatttcaacagaagatgacattgggtttaagagggacagtcacttttacctgggattttatgctcacagtttccctttgaacttgagtgaaccaggtgaagtcacaaggctatagttaaatccagtcctctagacaacgagaatcaatgagtatatgagattttcctagtctaatcttcttcagcccttttggtatttctctccaatctcctctggaccggttctttcctggagagttcaaaactccaccttcatccagctacatgcatgcaagtcttcttcccaaaggagagagaattgtcaggattatcaaacaagactgctatcttcacataactatccatttgtattccatggctgtttaccaagtgtttctcctccatttccaaccagcccacgaggagatctgcacaaccaatgaaggggtcatgtatcgcattggggatcagtgggataagcagcatgacctgggccacatgatgaggtgcacgtgtgtggggaacggtcgtggagaatgggcctgcatcccctactcccagctccgaggtatgctggtgtgttgaccagagagtttgtgtgaaagcctgtagttgcaaaagcagagagggaagcatgcagtgtgtagctatccactcacccgctgtgctgaagaggtctcttgattccaggagcccgctgagaaaagctggcgagtgagttgaatagttctagggctctggaaatattctcaggatgtaagcatttaggttgagccaaaaggatggctttcccaaagagagatcaatatttgaaatccttttagctcaaggttctgcccgtgtttatgtctagagaagatggtatcatttctccaagccgggggtggggggggtggggggggtgggaggggcgggaatggatggatattttctatttgtcaaatttaaggtgatgaatacatcacatcctcagactaatttctttttttcaaatcagctttttttcccctttggactcagatgtgtgataggaggagctgttaatgtattaaagcaatttcagcttctttgattggaaaagtaaca

SEQ ID NO: 17790 - DNA, 1196 bp, Mus musculus
gctctccagggtgtcctcctgagagccaagttttagagaaggcaggatatcccctgtgggtcttcaggggtctctcaggaagaggaaaggccacacacagagcatatgagagctatgagggaagacaggcaaggcagaccatttcagatgagtggggagccatagggagaaggcaggagcatggtacccaggaatgatgagcagctcagtgggttgaagcttagaacagggcagggaaggctagcagccaggcgggaggggagagtggtagaggggtgtggagctcacagatggatcgcttcctagcgtgactgaaggtttgtgaaagataacctgttgtgttgtgcggcaggataatgttgtcgcttagatgtgctgttcaggtgtggctccgatgaggattatatgaggagtcttgtgaaccacttcttgggctgagtgcggaagttccgggtcaagccaagaagactctggactcattgacttctcccttccagttttataactttttcattctcctgcccttaggatctggctccttcactgatgtccgaacagctatttaccaaccgcagactcacccccagcccgctccctacggccactgtgtcaccgacagtggtgtggtctactctgtgggaatgcagtggctgaagtcgcaaggaaacaagcaaatgctgtgcacgtgcctgggcaatggcgtcagctgccaggagacaggtaggcaccatctgcccacggatgccagaggacctacattcagtgtctgcagtatcttagctgttcgtaaaaaaaaatgtaaaaccataaatccagaaaagtttataatcctgtgataaaaatcatagtagctgacattttcttctctggtctttttttttttttttggttttttgagacagggtttctctgtgtatccctggctgtggccttgaactcagaaatccccctgcctctgcttcctgaatgctgggattaaaggcgtgtgccaccacgcccggctcttctctagtattataacttgtatattttcttcctatcatgaggatcaaactgctttgtagtatctgtatttgccgaaagggatgctgcaagaacaccatttttttcctgtttgtttttgttttttctcaactagccaataatctgtactctgagttcaatttggaattatagatgtcttttagcagcacatg

SEQ ID NO: 17791 - DNA, 2390 bp, Mus musculus
tcgatggtacacttgtgaccctgcgtacaattcagccattggatttcacagcctaagaaagtatcagggtttccaaccctcatgagtgtgtctgcttgctttctgccagagtgctatttccaccctggagtagaatgcaggctctccgtcctccaggagatcggaatgctatgcccaagtagctcaccttgctgtctaggaggacagttcccccagctcttctctgtctagggaacagattgcctgtgatgtctccggggaaccacaatttatgacttcttgccattcagagttctccatggctttcctttttgtgctttaacgattgacccaaagtgggctgatatggtgttagccttctttctgcttttttttttttttttggcaggagagctgcctgccaaaaaaatccctcaggattagggattgcattttggccaacatacatacttatttatctcaggcagaacatgagatgagcaccccctgaattctctcaatcccctaacgtttgcctttgatctgtaacagatcgctgccatgaagggggtcagtcctacaagattggcgacaagtggaggaggccacatgagactggtggctacatgttagagtgtctgtgtctgggaaatggaaaaggggaatggacctgcaaacctataggtaagtggctcgtgtgtgtgatcgaggggaacggagccacaagcagatagcctaagcaaaccagtggccgggatagctgaatcacagcataaaaaccagtgaaatgtgctgcgagtcaccagccttaaggaaatcagatcctgaactatggaacataaaggaatcttaattttgtttgaaaagcacaaggtggagttaaaatctttaggaagaagtgatttcttttgtttatatactatgctgtccccttggtgaagaagacatgttatttaaaggaggaaaaattacactattgacacatttcttgttggaacacagtttgttaaagcacaaaatgccacgtggctccggtcacaccttggcaatttccttaaaaacaaacattaaaggttgtgggggatttttgttggtttgttttatttattttttctgtttttttgtcttagccttggttgtactctgaagcccaaagttttgggttctctttcttagatctccaagtcagacgtgtgttttttcaaatttgttttgtttttgttttttacattagtctaaaatttaaagagcgctcctctcattctttgtaagtcgttcatattttatagtggtttagtttagggacacacagatcagtggtagagagcacttgctgaggctaacataaggttctgggttcaattcccaggactgaattaatgagttaaaagagaaaggttgggattttgcatagggtcgtctcccacagggtaaagacttgcatttctttccacttgaaatgttagtgggaagcttgggacaggcagaaaaatccggtctgtgtactcattaggacaacagaatttacttgcagcaaggctggggcttcctcttgctccggcttcttgctccgtgcttagctgcagggcgtgcctgctcatctgaacagagtgccactttaagaaatgtggctggggttttgattccatgctacactgtaaattatagggagacgctatcattttaaatcgctcttcctcctttctttttgctttcccatttcttctccagctgagaagtgttttgatcatgctgctgggacgtcctacgtcgtgggggagacctgggaaaagccctaccaaggctggatgatggtggactgtacttgtctaggcgaaggcaatggacgcatcacctgtacctccagaagtaggtttagctcttttctgttgacaatgcagcccactgttgcttctggatccctagagagagttgtgatgccttggtgactctgtggtatcataagatgtccagaaaaactgtataaccatcaccttctgcttcttcagaggacactcaataactaggaaaggcagttctcagttcaaccctgccttaggcagtcagctagtaaaaatgaaaagagccttagtggtattcgcttgctggatgggtcttccttgatctgggaattatctcagagatacctttctggtaccgaggacaattaaatccctaaagtagcatgtaaatgaatcctttgacctgggggagcgattggaaataaaaggctctaccccatgttcggatttccttctatgtttgaagtttaaataaggtttactgactctaaacaagaacctagtggaaatgagtccgtgcccagtattatccttcaaataggaaagtggaatgaatttctgtgtgttgtttgttcatcgattgggcagagagactgttaaattataacc

SEQ ID NO: 17792 - DNA, 2576 bp, Mus musculus
cctgaacacacacacacctgaacacacacacacacacacacacacacacacacacacacacacacagaggctcacctgaacacattccccccccccacctcctgcacatacgtatgctcacattacaaaatattggtggaaatgtcttggataatgtaaataaaggggtaaggcaagtctctaagacttgaagtttgtaatgagtgttttacttgcctccacatcaggctttatcctgacttggcaagcttgcttttctcttttcttcttacactgcaggaccggctcattgctctcgatgctgctgaggacttctttaagattgctagccaaatgtaccccaagaaacctggggtcccatgcctggtggacggccagagaaaactgcactgccttccatttccaagcccctgaagggaggcccagaagagcggagttcttttaccacgacacaggaatttaccaaagttggacggctgcctacggtttcgagcgagccaggagagggccttctccagtcaaacactatcgtgaatcctacaaatataaggtcttcttcctcaggaccttggcctaaggatgctctggttacattaaaacacccggctgccaccatgcatcgagaaaggaaggctaaagattagttggtgggtgggtagttcttcctggatagtcaggttccaagaacctgtggcctcattggctatataagctacagttgttcattctgtgcaggactggtgttttctaatcaacacaatggcatgactaatagagaagggtgtaaccgagccctcacctacatcaccaacttcaaggtagtcattattaggtgtaatactagacaaggagccccagacttcataaaaccctaggcctcgcgtgacctgtttgattcggaaacacctgcagcagctgagatgctgtttggggcgtccctctgagcatcagggggtgttatttacaagtataggtgagccagacagtagaagtgtgcagacgtgcagctaagtgtcttcacctgtgccacgaacaccccgaaccctcatcttaacccccagcactgacgttacccagttgcctcgacttttttttttttttttaacatgttgcccatttctgatacaaaagcccttggcatttttatgaagaatagcatctgtaaactggagtgtttggcctctacttcctatcttgaatctgtgtcctgagggttgcagctgcctagggaccttttggtgcagacttgcaggtatgcaggcagtggtgtatgctgacagaggtcgctgctgggtcttcacgctgaaggtgattttcagactggagctctgctagcagtgcagcttgcccacagaatgccaagccccacttccaagatcgtaaggagcttgccaagaggaccggggctcgttctgttgaaaagcctttcaagatttgtgggatttatctgtagacttctgagaacagtagaaatatttttattttttaatgattttgcacttctgaattcaggtggaaaataaatttgtattagtttgttcaggggattgtgacttgaaaaatttcatatcctgagggttttttttttttttttttgcttgtatactccatgtttaaaatatttactaggaaatacatgtcccctgttcattaatatattgtagactaatttaacaggtgcatttcagggaaattcttcctagtttaataagtaagctaaaagttttattttatttttttagtatttagtgcatattctctacttcatgctgtttaaaattagcctgcaaatattttcagtcacttctgtgggctattagaagataaagaataaaataaacaaaagacatcctagaatgttgtactgttttaatctcagaatttgttttggcttttgttttctttgatgtcaaaatagatgaaattgtctgtgtctgtgaattgtaaaccattcaccatagtttttattctttggtaacaaacaagtaaggataaaattatctctgcagtaacgaaaatacgtgcaattacccaaggaattaaaagactttgctgtgtgcctttaagttgagtgtgtgttatatttctgataaatgagaagaaactctgggttccttccatcatccctttaagttagagggagaagaggctgagaggcagatgggtttaaggaccttctgcctccctaaatccagtcaaggagcagacaaatgctcaaatgagtagacactgcagtgtgagaggctcggcctgactgaagtgggcccttcaggaaccacaggcttctcagaaggaccaggggctgcagatgggctgaggccacagggctcacctactttaatcagcatctccttgtggaccacttcagtacttccctgattcatctgtgtgctgggtggttctcagtggcatatgggaacatatttcttattctactggacatcgtggggaaagaaaatccctgtaactagcaggtcaaatacctgcgttcatatttcctggatgttattggacaggacagtaaaatatttcttcgggaaaacatttaccacggtgatgaggaatgtgttcgtagg

SEQ ID NO: 17793 - DNA, 1197 bp, Mus musculus
tgtgtgtgtgtgtgtgtgtgtgtgtgtgaaggggtggggcaggagagagcaattcagtccctaagagatgattgccctgccttagggctaggggcatccagttactgtcattgagtaattgatcccacttaggggatgagctcaccatgaggcagtctgtctgtgagtgaggcttctgtgttcctggaacccatgtgactataagtcgagagaatattagaaatgtctaggctggagtccaggagatccagagcaggatattgtaaaagctgacagctggatgttgctccagtctggaaagcaccttacttatcttatcttcatgcttttggtcttgagggatgagataggttaggtaaattcagtgctaatcaactttgtattgccggtttttcaacagacaccccttaaatgattaacatgcccatgtgcagactagaacgagaatctgaagttgtaagacaaaggagacaaaggaaaacagaagacgggcacaccaagctctatcccgctcttggctgcccatggggcctccaagagaagggtcagcactaatgagcaaaaccggtctctcaactcctgctgtgacatggctgctcagtgactcccagacaagaacctcacctgggaagattgtcagcctttcctcggagacgtttagttcttagctaacaagtgggatagtgaccctcacccttcctgtcccaggcggctgtataacaggaggggtggaatggaagaacccttgatacaagtgtggagtctaaggtgccacggcttacaggctgcaagagctagtaggcaaaagggaccccccgctcagccgccatgcttctcaccgtcatgctgatgttggacgaagcccctgaagctgtgaacaagcccccaattaaatgttttgtaagagttgcctttgtcatggtgtctcttcacagcagtagaactgtgactaaggcacacagtcctcctcatgtgacagttgattgtgacactgcccccaactatgcaatttccttattcctccttgagagttattgctctaccaccctttgatctgacctgtcacagctcaatgggacagaagcctggactagcactgtcctcagcctgacatcaaatcaccctgcgtcttcactgtctcactgtagtgtgggcgcaagagcttgaatttccccagcctgtgggtgcctggggcct

SEQ ID NO: 17794 - DNA, 1208 bp, Mus musculus
gaaagaagactcccgagcagtttgggtctcatgccctgaggtaaggtgaggatgaaatgcaagacctctcccctttgggagtgagagtggcttctgcacggggtgcaacatctgagcagcttctcaagtgccccaggttcattaaatatttattatcagcagatggtggccaggggcgaagcgactgctctcactttctttagaccctttcagacttggtttataggagggaggaagagagagggggaagctgctggctggctggaagtccccttccttcttcctcccaagactcctagggctcctgccctaccccccggcccccaacacacacacagttcagttcacacgcctgccctgcgcacttcatgggcagggccttacagaggtcccggagctgtgtttcctcaggtgatttgctttattcgtttcagtctggcctctcctggctgctttcagagtgaggtaaattgatagagttgctggagtcatcccggagcctgtggtgatcaagactgaggactcaggagctggccagacaagacctgtctaaagagctcgcagccatggctctctctgaagtatgtgtgtgtatgtgtgtatgcacgcacatgcacttgtgtgggtgtatttggagaccaaagaacggccttggtgtcattcttcaggagctgtccatcttccttttgggacagggttcccttgccaactcagaactcaccagtagtctgggctgggattacagccttaccttaccatacatacctgtgctgcagaggcagccagtttccacactgagtgagctattcttccagccccttgactgcccttttggaaatcattgctcgaataatcagttatttagtggcaggagtccaccttccctctgattctaaagaagacttagtagtactgaagaacatggccacttgggccctggtggggagatgtcggggtggggtggggtgaggtggatgtggctgtccagagacgggtgggctcagatgggggcatctgatgaaggagggcgtgaccctggagaggtttactcagggcagcccccggtgggtcttttcctcctttctattgtctcctgagtttcagtgactaggcagagcttgagcctctccatgggctaacttcaaaaccgtacccttaattagaactctgtagaccctcctgcctctgcctctgcctctggagtgcta

SEQ ID NO: 17795 - DNA, 1234 bp, Mus musculus
aggtcttttaagatgtggtgacacatgcttttaatcccagcattccataccagaggtgggtgtatctctgtggatctgaggcccacctgatctacatagagagttccaggtcagccaggatgacacagtggcacacacacacacacacacacacacacacacacacacacacaccaaattcaagccaacctcggttatatagtgagttcaaggtcaggttgggatataccagaccctacttgaataagaaagaagatgtgactccttgtctgtctggttaaaacctgtctgtagggggccaggagtggtggctcagctgttaaagggcgtgccttgcaggcatgaggtttgatgagcagcacccgtggaaacaaaagtcaggcatgatagtgtgtgcttgcagtcccagaattggagcctcctgttagctgtggaggtgtgggaatatgtcctccctccttccctttgttcctccctttcttcccccctccttctctctctcccttcctctttccccctctccttttctttttttctctttcttttctcctccagggctgtgaggttggaactcaatgccttgttcatacgagccaagtgctctcctacggccccagcccctgaagtagacattgctaacacaagacagtttaagaacagacataggcctggagaaaggactcggccagatcttagcacagtttatagtctgaaagaaagcacaggtttctttggatcatatactcactgttcactgcccgtgggatggaagtcttataagtactaatcacagtaacatgaccatatcaaccatccatgtaaggtttaagttctgagtgccattgttcccacattgaccacattcccaaaatagggtaaaaagtgattggattagcatccacaaaccattgcattgaggaaagagccacagtgcagatggcttgctctgagatggctaaatcattggccacccatcatctctcaagtactgaatgccttcatgttggttgggtcaacattttaagttgttaattataagaaacatgtgaggtatggatcaaggctgtcacaataacaaagtggtggcttacggccacagaaatgtgttccttcatggttctttgattctctcctaagccacttgaatggacacggaagcttccagatatcacgctccctgcttgtttcaggcacccacctgcagcttcaggatgctcacactggtgggcaaggg

SEQ ID NO: 17796 - DNA, 1264 bp, Mus musculus
atccctgcaccgccctctcgacttggaagctgtctctccgcgggccggagaagctcgtctgtcagctcacgtaagcgcaaactaggaacagtgggtgtgctcttttctgccaccatgcgccactgcgtctcccctggagcatctcccaccacaatgccgtatcctttttccttggaggccgtagcaggagcgttctcagcggttctaaaacccgcgcgcaggcaggcagaggagtttcagtgcagtggtggcggggcatgcaaatcatactcggcgtgcgcgctcgagaacgccgggagagccggggtcgtggacgttgtagctgaagctgtgggtgctggagtgggagtgaggcgtggaggatgcaagacgcgcacgggaggaggaaggagccgcggggaaggcaggaagtgagggttgcgagcggtcaccacgaagttaatgtgtctcgcggacgcagagcacggctgcatggtgtgtgctgggtatcgcttctcggccttttggctaagatcaagtgtagtatctgttcttatcagtttaatatctgatacgtcctctatccgaggacaatatattaaatggatttttggaactaggagttggaataggagcttgctccgtccactccacgcatcgacctggtattgcagtacctccaggaacggtgcaccccctctggggaataatattggttaaatataagacatttggaacatactataactcttatgtatgtgctgcagttactttttctctctttttctaccttttagttacccgggtcttgttgattctttattgctttacttttaccgttattattcaggcttcatatttccactacccgactttttaggcagagcagctcgcttctttaccttttcagacactggtcaataattgtgattaggtgggaagactctaaggttttcatcttttttttttttttttttttttacgtaaatggatttgggtaatgtgtatatgtggttgcttttttggtgattcatgtgttgaagcaaaacttcatgttgtacagaagtctggttgtttccctttttgttgctgcatcttcaggctaagttgctatgaaatgcaatctaacaagttacatttctttgcactgtcagagaagtaatgcctagccggtgctttctgttacagctttttctctggttttggatatttacataactaaaattagacattagaggactgtgctacttaaagggccacttaaaaaaaaaaagtcttcactatt

SEQ ID NO: 17797 - DNA, 1299 bp, Mus musculus
gaagattgtcttaagacaacgcgaactaggagcagtaggtccacccttcagccaccgtcctgcctcagagtttatccagtgcatctggccgtggacatgcccccttcaggtctttctatttccggtggattccaaaccgcaatagtctgtgagtcggcctgtgaatcgcggaggccgcggggaagagctgatttgcacgtcctgcctccacgcgaggggcgtggcgacgtgcacaggcctaatttgggcttgtgttgtcacgcccttcgcgagggggcggggcatgcaaatcatactcggcgtgcgcgctcgggaacgccgggagagcccgggtcgtggacgttgaatctgaagccgtgggtgctggagtgggagtgaggtgtggagggcgcagacgcggatcggaggaggaaggaaccgcgggggaggcaggaagtgagggttgcgagcggtcaccacaaaggtaatgtgtctcacggacgcagagcatggctgcgtggtctgtatttggtatcgcttctcggccttttggctaagatcaagtgtagtatctgttcttatcagtttaatatctgatacgtcctctatccgaggacaatatattaaatggatttttggaactaggagttggaataggagcttgctccgtccactccacgcatcgacctggtattgcagtacctccaggaacggtgcaacccctctggggaacaatgttggttaaatgtaagacatttaggactattatagctcgtaaatacaggctgcagttactttttctgtcttcttttctactttgtagttacccgggtctcgttaacccctctttgatagaccaggctggcctctaactcggaagtccgcctgcttgccgccagttgatctttttctattgctttacttttcttattattattcaggtttcatatttccactaccaggcttttcaggcagagcagctcgcttctttacttttttacacagtctttccatccactggtcaataactgtgattaggtgggaaagactctaaggtttttatctctttttttcccctctggggaataatgctggtttaataagagacctagaaattaggccaacgtggatttcttaccaacctgttagttttactgcacatcactctacattgctgcataatattctacataatgtctagcttttgatctggaaagagctgtgaggctgtaaggttactaagatggacaagttattttcagcttactgtcacaaaacacttgctagttatgtaagtctggtggcattaaaaactcttag

SEQ ID NO: 17798 - DNA, 1288 bp, Mus musculus
ttgtgcatcttgggacaccccgcccccccaccccaaatactgacataagtgacataaacgtcaactttaaaagctcgtcttccggataatgcgaactagacaagtaggtcggccctttgaccaccatccctgtactgtacttctcaggtacagccggctgcaaaccctcctctagcgctcttgttctcagtggagtgggagaataaaccggaagtgtccgggagcccatgtgtgctccttgcagaagcaccagggaagaggctccagtctcggccgccacaccctccacgagggggcggggcatgcaaattatactcggcgtgcgcgctccggaacgccgggagagctggggtcgtggacgttgtagctgaagctgtgggtgctggagtgggagtgacgcatgcaggatgcaagacgcggacgggagaaggaaggagctgcggggaaggcaggaagtgagggttgcgagcggtcaccacgaagttaatgtgtctcgcggacgcagagcacggctgcatggtgtgtgctaggtatcgcttctcggccttttggctaagatcaagtgtagtatctgttcttatcagtttaatatctgatacgccctctatctgaggacaatatattaaatggatttttggaactaggagttggaataggagcttgctccgtccactccacgcatcgacctggtattgcagtacctccaggaacggtgcaccccctctggggaataacactggttaaacaatagacattacagcatgtttgttagccaactgggtggtagtcgtttttgtgcacttcagttaatcccaccataggtggcacgggagggtactgcttgcatatgcatggggctaaggttcaaagtatcagtttaaaatagaggcccagttgtgggccgtggcgagtggtattctttgtgaaaataccacaaaggtggtagagaaaacagtaatgtagagtcaccattgatactcaggcccttgccagtggagaggaggcataggttccagtcacatctcccacatggtcaggcacaggcagctctctgggcatgtagatcacggtggtcctcacaacagctgggttgttgggttcccccagctcagtcacccttactcctctttgattgtcccatagcttggaggaagtccggcattgggcaagaaagcttggaaattgtggctcatggtattgactctgaaacatcctgtctggaggatggctgctgctacctaggttctgtaggcctgcccgttctctcctctcttcagttttaagatct

SEQ ID NO: 17799 - DNA, 1151 bp, Mus musculus
cctacctgctgggacttattctggcacccggtttcccgaggaaggcagctaagggccatggagtcagcgaccagggccaaagctgcttgctttatctctggcagttctgtctttaactttaactctgctattaagatattccctttatttacatttcaagttttatcccctttcctgtttcccctccgaaaaccccccataccctcccctctccccctgcttaccaacccacccactccaattcctggccctggcattcccctatactgtggcatagaaccttcacaggaccaaggcctctcctcccattgatgaccaactaggccatcctctgctacatatgcagctagagccatgagtcccaccatgtgtgttctgtggttggtggtttagtcccagggagctctgggggttactggttagttcatattgttgctcctcctatagggctgcaaaccctttcagctccttgggtactttctctagctccttcattggggaccctgtgctccatatccaatggatggctgtgagcatccacttctgtatttgtcaggcactggcagagaactctgctattctatggctgaaagccacctacttttggcaattcttctaactttaactctttgctgttgtgtggccaagagctgcttgcttttggtaatgtttctcttcctataactctttgctattctcaggtcaaaagccactgatttctgataatttgattccaactgatagcagcaggagaattagaaaaaaggtttggtatctccctggctcaagggcctctggcaggccaggcaagaggcttggagtttgttaactttttgtgagcccgagagagaagagaggaagaaagcgagaaatcaagcacacacacagacacacacagacgcactttggccgggcctgaccacctgtctcaacaattccaccagtgttaatgcatacttatatacatacatacatttggtggaagggactgactccaaatgccacactttatttcttttctctggcagtttataccttcttagacataagttctttatagaattatctcatagatagaatgttacgcaacaggggagttacaaaaggatgttgacagttcaaagcagtgtttcattctgtgagctcatcat

SEQ ID NO: 17800 - DNA, 1164 bp, Mus musculus
tctgaaattcatattacctggaggccctgtatcttttctgccaagtaactgagatattacaaatctagctgtcactgtgggaaatagcttctttgttaaattagaaaattaaatagatctggactcatttagatatcagaaactctgagtttctgaaacacacacagaattcctgaggaattgtagttctaactagtaacaagttgacttcctctatggaaattttaataacattctagcttcatgtattatctaggattccttcagctgtggagagtatcggttactctttgtctctctaaccacaattcctggcagagaaggcttagtgggggaagggtttgtttgggctcctggtttcagaggacttgcatccatcacagtgagccaggaagcagagatcagaagatgctggtactcagccagctgctcctttgtcctttatcctcacctcttgggatgacactgcccaccttcaaggcagataggtctccccacccccctccccttctcacagtgaaccctagtgaattctctcaggaaacatcttcacagacacactcaagaggtatgccttaagaaatgtggcactctccatctcttgcaaagctctacgtagtcctgtggcattcacaccatgtgtggtgcagacggcagagtgcagctcttcacgcaggcactgggagatgcccatgtggaggtcatgaaggaagggttacattgaaagtcctttgtgctgggccttggggtagggagcagagctgctgtggctaagggcctgagcgcctgagactgtcccagctcaccctgacaggcaacttagcacaccacgagaatgaaatctggggagaccaagctagaacttacagaggctgtgtgacctgggtaccatgtgccgtgatgtttgattgccagtttttaactgccagtatgtcagttgcgcatttgacacattttcaggggttccgcacgcctgcttgtatgcgcggaccagtcttgtatgcttctgggttttttcatattgctgagaactttttttttaatgtatttttttctaggatatttaaattagctatccaataatatgctccagataaggtaaggatcaggttatgaacaaacctatttaaagcgatcaggtatactaaccacttagtaccaaga

SEQ ID NO: 17801 - DNA, 1189 bp, Mus musculus
caccacgcccggcagagaatgacttcttaatgtgttcattctgtcttttagagggaagaagtttgggaagaagcatattgaagtgttcactgacctcagcagcccgttcagccaggaccaactggacgttataatttgtaacttgaagaagtctggcatctctctgcagttcttgtaagatcctgagagtaaagcataggggatctcggcatccctcatgcagggggcagggcctacatagatggctcccagggggcttctgtctcagctgaacagggggagctgctaggtgggattggccaccttgcatgtatcggccattcctgtgttcatggaactgttctgagctgaggtaagaaagagaaggaaaatagtgatattgggctcaatagcagatcactgcttttagaaccaaagaatcaaggaatttaaaaaacaaacaatcagactccatcttttgaggatgtttagtttgtctcctgtctgcatagatggcatcaacaccctgatagttccttttttgtgtggctcagagagtgatatctacaaacagcagtagattgagggtagacagaactgttatgttgggaatcatcttatagcacatagagtatgtatgtttaaccctttctcaggatgcagacacataataaaatgtaatatgtatattataaaattttgggagaaaacgtgtattttataatgtaaaaggaagagggtccctcctctcctagtaacttgaatttctcctctagcctttactttctgtgtcttacatccccactaaaacttactgtcatactaatccttcctgctgcatttaaaacccattttttctcgtcctatttttggccgaagcagagtgatgatacagggtgttgaattattaatctgatcagggacgttcacttttcaaattgagaactgcactaagaagccttcagttcagagtggtaagcctgcggcctcttagactgcctgccatgggggagtatgaacccctctagcatgcacgtgtgtcccccttaagactgctgagggacaccttcccaggggactatagagaagacttcagaagagcccaccacatcggcactcgttaagatggtacttcagagaaattaagtgctttttaagtggcacttgtcaccgagctggggtttctcagtgctgcggaaggccagcttag

SEQ ID NO: 17802 - DNA, 1186 bp, Mus musculus
caacatgagcttccttgtccccccctttatgctgaaagtataactaaatctgagaaataaatatacagatatttttgaatgtttaagaacttaattcccaagtacatgatgagaaccatagaggtaattttgagttattttggtttctgtcaaggccaaaagagcatgcctagggatgaaaatatactctcacagtttcctttgttggcttcttcctctctttgatgatggcaaaatgtattctccctctttattagtcaatttgagagttttctatagaaagtatatgtgtattcagaaatcagtttgtgcctatagcctaccaaaggagaaaaggggaatgtagaaacagctataaggcattcccatttgaaataaaccaaaatttaataaaaggagagaagaggcttaatactgtaggtagaatagttgttcagagagtctgtcagatttccattttctttggtcagtatcttgtctctcctcattttctatctatcttttgataatagattgtacaggagaaatttaagaagagttgggtagttgtggacgcaagaacgctaaagaaggaagatatacaaaaagagactgtttattgcctaaatgacgatgatgaaactgaagtttccaaagaggacactattcaaggtatgaagcaagtgtctgcactttcacccaagagagattttctctaaggtggtgggaggcagcgtagattggtcaccaagagacacttctttgagatacaggggtgcagcagaaacactgggtcctgtaggccagtggggactccagcaagatggctctgggggaaggacctgtgtatttgatccttccaaatttaaatgtgtcaagtgacaggacttgtccttggctttcttccctctcgcagattcactcgctaggagtgtgcttatcaagcgctgaagcagctctcgcccttcctcttcaagcgccaatgtcaggtcttagagcctactggctatgcttccttaggggaaaatattatctgtggttgttgtcgtggcttaaacacactaggctctttaaagctgggctaaatatacccaacccatgtggcctaaatagtatgtttagacgacatctttatccagaggacttggaaactagctgagaatatctgaatattcaagagctcaaatcgtcagatgccagatgatgc

SEQ ID NO: 17803 - DNA, 1186 bp, Mus musculus
aactttggaggggtgtttgagagggccacttttattcaggaaacacttgggtgggtgttgagagcagaaagtgaatccttgtccctaggcttggtcatcagtcattgtaaggcttcagaagaagggaaatgcatagctgcttagaaagtagaaatcctgtggctagagtgggttcagtggttaagagcactgactgctcttccagaggtcctgagttcaattcccagcaacatggtggctcacaaccatctgtaatgggattccatgccctcttctggtgtgtctgaagacagctacagtgtactcacatatatgaaataaatatataatcaaataaacaaataaataaaaggattaaaaaaagaaggtagcaatcccagagctggacctagagaggaggggtgaggagggctgagaggaggtgagagggggtgagaggaagggaaagtgagtgaattaaccatgggcatgtttgtggttttcaccccgggttcccatatgataaccacaaaaccaagatggtcgaaactatagctggcattgcccagtttatgtgctgtactgggtgacaatggtgaaggggaagttgatgtctggaattacttccacccaggcacaggtgttctcagagtacagaagaccaaagtttgatgagaacatgagaaagaaccttccagagaatctcttccatcttaggaaaacatggttcctttgagccacagcaataggggtttgaatcagtcttaggcattaacaaggcaaacagaccacatggcatataggttataagaggtatggttatattcattttgctgatgaaaaacaatgttacattggaagagatggacctaaaaatcacacaggggtttgaacataagcctcattcacatactggatttccctattttgccagattgtttccctacatttaatttgtgcgtgtgcacgtatgcacgtatgcgttcatgcatgcgtgtgtgtgtgtgtgtgtgtgtgtgtgtgcgtgcgcgcgccagaagacaacctgcagcagttggttttctccttctgtcacgtgggtctccagaatccacctgaggtcatcaggcttggcatcgagcagctttacccactacactattttggtggcccctttccctacttcgtacataatatcacatatctaaagccacgagtctgtggtggg

SEQ ID NO: 17804 - DNA, 2261 bp, Mus musculus
agtgcgatctgggattggtaaagggtaggccgtgctagctcgttacttttcattgcctggtgctgtttgacagttacttaccctaagtctcagagttgggggaggaactggaggattcatttctgatgaatattttaagcaaggtagttttgaattgttcaaactaaaacaacaacaacaacaacaacaacaaaacatcaccaccaccaccaaaccaccaaccctccccccccaagatttataatgaaacaagcaaataaaaacataaaacaaaccatcctactacaacctgcagaaggaaaacttaggtataattttaggcacttaatttctaggcactaaaattctagaaatttaattttatttcttgacaaatagtgttaccaaatttctttattcaaaagatttactatttttaattatatgtgtgtgtatgtgtctgtgtaagtgtatatgcatgtgactgcagtgcccacaggagccagaagagggcatcagctatcctagatctagattaagagactgttgtgagctgcccgatgtgggtgttgggaacagaactctcagcctctagaagaacagtacatcacgtgctcgtaactactgaactgtttctctacctctttaccaaatctctttccttttccttttccttttccttttccttttccttttccttttccttttccttttccttttcctttttctccttgcctcgcctctctgcctcgcctctcccctctgcctctcccctctgcctctcccctctgcctctcctctcctctgcctctcctctcctctcctctcctctcctctcctctcctctcctctcctctcctctcctctcccctcccctcccctcccctcccctcccctcccctcccctcccctcccctcccctcccctcccctcccctcccctcccctcttcttcttttctttcctttcctttcctttcctttcctttcctttccttttcttttcttttcttttcttttctttctgtgtttgtttggttggttttgctctgttttgtttcgtgagatagggttcctttgtgtagccctggctgtcctgcccgtgctttgtagaccaggctggcctcaaacttaaatagatctgcctgtctttgtctcctgaatactgggactaaaggcgttcaccaccatgtcttgcaccaaagttcttaaatacctacttttaagataggattttgcatcatctccctccctaaagaaacttggcaagtatgcatgcagattccgagactcttgaccaagagttcacccttacagctgtgttccaagaattgtactatgttctcacaaacatccccatgcctgagagaataaatctattatcttatattctagcgagtctccagttaataagtcacatcgaacaatttttggataccaatgaaacactgtattttatgaaaagtatggactgcatcaaagctttccgggaggaggccattcaggtgagtgtgctcacccgtctcccagcagctgacggcaggggcacgcagcgtcccacaggtaagcctagcttgtggaaagcatcgttctcacggtcaattgtgcagtatgccaagtggaaatgaccaaacgtgcctgtcatcgtcatctctcgggaggagtggaggtcgtggtgtggtaggtggggataaactaactcatctaggaaaattgatgaaaggtatatatgagtgtgagtgctgagagggatttatagagatgggataggtgtatgaatgccaggagaaacaaagaaccctacacacagcagtagtttcccagtgctgtaagtgagttttcttcattttgttagggacttacagaaaacacttataaacctctatcagattatttgtgggcctttttccctctaagcaagaagtgagccagtttgaaatggaaggtgtgttttaaagttggcacagtggttgagtgtgtctttgtgcaggtgctgatgaaatatctgctgaataaataaatatttgattaattcaggtgcttatggagaatgacaggaaaattagaaaatggctgaaattagaataaaagactcggaagtagatgatacagacacgccacagattaaaaacaatgaaattttggaaaagcagaaccaagaaaaggctaagggtggtccagacgagtgccctgttcccaccacgagtcaggttaggacttgggtgggaaaacagaaggaaggctaggactgttcctctcagcagcctgtgtggacgggccctgt

SEQ ID NO: 17805 - DNA, 1147 bp, Mus musculus
tatacataaaaactttccttttaagtttttcattttcgtgtgtggtatgcatgtatgtgagtatgcatgtttgtatgtttggggcacttacatgcgtgcgtgtgtgtgtgtgtgtgtgtgtgtgtgtgtgtgtgtgcacatgcatgtggaagcccatggttgattctggaaagcatctccattgttttccaccttactttgtagatggagttactctgatcaccaaagacgaaggcccaggaagctctatcacagctgaggaagccacaaaggtatcgagagccaatgccctccctgtctttagacgagttaccccatgagggagctccttacacagtgaacacattccttaccagccaggtcaacagcctcagctgcagctgcactcccagaacaggcacgcagcctgttcttgttcccatggttgtgtctctagaagccacctgtagtcctggcttcagtaactacagaactgttaaacgtcatagcccatttcctttgtagcccagatcctaatacaagctgtgacagaccactctcccacccctctctttcccaccttaaatttttgtttaaatgacattgggtgggtgggtgggtgtgggtgtggtggagtgtgtgacatgcagtggttcatgacgcatgcatgaatgtctgaaacaagtgcgggcattggtcggctcctaccgtcgtgtgggttccaggggttaaattagtttgtcagacttgatggcaaacacacttacccactgagccatgggctgcaccctcccagtctctcttaaatactggttaaacagcaaaggctgcgcggcgatccacggtagagttattggctaaaatagcatgcctgaggtactggatttgttcccttgcactaaaaacaaaacaaagagagagactccaaagattctgctggtttgaggcaggtctgaggagtgatttgtttgtggttttaaagctattcttgtgaatatgttgtggagctggtagagaaagactcccattctagcactggactagccaggtgttttcaatgaatgacctccacatatacagaacccacagcttttgattggcacatttgttaggctaaggcctccttgtttgatgttttgaatattaaatctgactcagctgtcagtca

SEQ ID NO: 17806 - DNA, 1197 bp, Mus musculus
cattacaaatctaatcatataggtaatctcataatgggaattcctatgttctgtggtttcaattatagtgttcattcagactaatcctcccctctgaagagctagaaaagagccggggaagccattcccttagaagaaaaatgttataatttactgaaattgttcttaaccagaaataagcagtgtatcgtgcagtttgtgtgggttgacaaatacaaacatccttttaaaagcccacttcctaaatgttctcaattagctaaatagaaacaaagcagactgataggcctttgaaggcagccctcgacacaccatgctgtgggtgctaggaagttgcaaatgtgggcttttgcagccatgtttgggaaaaacatgcactttagtatcacaggaaaactggagtgatgaccacacactatgctgtcagcctttttgtggaaaagtttttagggttgaaatgagaagatatttagtgtttaggtcctaaaatagttggcagagaataccagtacaggtttttgtgtgtagctaactggaactgcagatctgagagtggcctggttcctttctgaatatgttgttcttgtttacagctggacatgatatagatcatggatgtgtggggaatccaagagtgccagctctgtgctgctgagagctctggcagcatccctgaggccgtgcaggggatgtgaagctctggacgtcatcctagcagacaacttgggaatgagtcactccaggtctctacagagtgaccataaggacatatattacaagaaataacttagaccctattcaaatttataaagagccattattttctgattggtatatcatttcttgtgtgaagtctcattcttattggtatattatacgtatgcgtagaagtttctagaaaatagacttcatcctaccctgctgtgatggtgaggaatcagtcaggtgaggttagtggactcttggagccacggcgtggccccgggtatgattcttggcccagttcaggagtcatccaccaggtctgccagtggtaagaacaccacatgcagagggagcagcagtgcctggtttttaccaggtaggcggtggggaaagccataagtaatggctgaccttaaagcattttcgcccccactttagcttgttcaggtgactttgacgggtgggaagggcagtgtcaccctgcacgtcagt

SEQ ID NO: 17807 - DNA, 1152 bp, Mus musculus
atgtttaacccgtgcagccccgagttcttatgctcactgtattagttagggttctctagagtcacagaacttatgggtagtctctatatagtaaaggaatgtattgatgacttacagtctgcagtccagttcccaacaatggttcagtcgcagctgtgaatggaagtccaaggatctagcagttactcagtctcacaccagcaaacaggcaaaggagcaagagcaagactccctttttccaatgtccttatattgtctccagcagaaggtgtagcccagattaaagttgtgttccaccacacctttaatcccggatgaccttgaatttggagatttaatcttctggaatccatagccactgtgcctcaagatctccataccaagttccagatcagaaacttctatctccaagcctccagataagggtcactggtgagccttcgaatctggattgtagttcattccaaatatagtcaagttgacaaccaggaatagccactacactcacttcatgtgatcagatgtttaacccttgcagccctgagctctcacccacacttcatgtggtcagatatttacacttcgacttttgccaggccagtaaatgagctctgattctgttctcgcttccatttgcattgctctgaaaatatttcttttttttttgggggggggggcggttacaagagtcagtttggcttattctatgaggatcctgtttgcacctattttgccctatttttctattggcttgcctttttcttgttgactaaaagaaattctttataaattctggatattaatcagttgtctttttttttacttcattaacttctttttgcataaaagattgattgttttagttacatgtcaagtttattcatgtcttgttttgtagcttatgttttttgttactaatttaaggggtttttcactaagtaaggctatgacagttttctcttggagtttttccctgtgagttgtagcggtggatcttcaaggttacttcttggtttaattcttgcatacaaaatggtttaggaacagactgaaggaactaaatctgtaacctctagaagagcttctgggctttccaggaatccaagacaattacaaaactattacaatgtataataaacagtttagtacaat

SEQ ID NO: 17808 - DNA, 1222 bp, Mus musculus
gggaaaacaggattcagccgagtttgtgctcagcggcgcgttggcgtgcaccgactggctcaatgtctctgctccgttcctttcctctgtcaacaggctaaacgcaccaagaaggtcggcatcgtcggcaagtacgggacccgctatggtgcctccctccggaaaatggtgaagaaaattgaaatcagccagcacgccaagtacacttgctccttctgtggcaaggcaagtcggcctcgggttagggaggagggtgccattgctcccgagctaaggcggtttgggctcgctttttgcggagcattcgttgtttacttgcaactagtgaggaacttaagggtgaatggtttggagaggaaaaagtccgatcttgggaaattgatagcgatgtcagcgcatctgtaccaaccccaaagaggtctgtttagcctgtaaataatactctgcttgggttactagaatttaactgctaatggataagctggcttttccatagtttactctctggaagtctcagggattttttttttatatatatttcataacaagatcttaactacttacagaccaagatgaagagacgagccgtcggcatctggcactgtggttcctgcatgaaaacagtggccggtggggcctggacctacaagtgagtgttttctcctgtggtataggaaaggctatggactgcacagcccgtgttccaggtctggtgcatatcggatttgttttagtttaaagcaaatcatgagtttgggtttaaaagttaatagtttttggtcagggctatacagtgaaaccctgtctcaaaaacaaagttatggttatagataaaagctcagagccgggcgtggtggcgcacgcctttaatcccagcactcgggaggtagaggtaggcggatttctgagttcgagcccagcctggtctacaaagtgagttccaggacagccagggctacacagagaaaccctgtctcgggggaaaaaaaaaaaaagaagaagttcagactttgattctcatattccttttgaattgtacagtcaccatgctctttggaaaattacagttgatctaagtccattggtgtttgtgctggacttgacttaacactacaagttatttctataaaatggtttgaggttaattgactcgggattgtatagaacattggaggctgtttgggcatatttagtgctatgaccttgacagagccagatgttg

SEQ ID NO: 17809 - DNA, 1210 bp, Mus musculus
gctgtggggagtcggtgtgagctccgaaatctttaaggtcaagactgcttttgtgtttccccggcagtcagttcacagccggccacgtgggaagtgagcaaactaagtccttccaaatcgaactaaactaaaagacaggagacaaaagcacaggctctttcccactccacgccgattctacccacgcttgcaagttattcttactctcccggagcggacaaacccaggctgaagggagcaaagtcctaaccagggaagaacagaggggtccgcttgaatcccctaggaacgtagggtgggcgagtgggcgtgtgcacaagcacgtgccctcacgcaagagtgcgggggggggcggtgcgggggggggcggtgcggggggggggggaagggagtggtctccataagggggaggggagaaggcaggggggcggggagaagcaggctttttaggacccggcagaggcgggggaggagaaagaaggcaaggaggcgtctcccgcattcgtctgggccgtgccacctgcccgctagctcgctgcactaccgttgcccacaagccaacatgctgccgagattgggcggccccgcgctgccgctgctcctgccgtcgttgctcttgctgctgctcttgggcgcgggcggctgcggccccggggtgcgcgccgaggtgctgttccgctgcccaccctgcacgcccgagcgtctggccgcttgcgggcccccacccgacgcgccctgcgccgagctggtgcgagagcccggctgcggctgctgctccgtgtgcgcacggcaggagggcgaagcatgcggcgtctacatcccgcgctgcgcccagacgctacgctgctatcccaacccgggctccgagctgcccctgaaggcgcttgtcacaggcgcgggtacctgtgaaaagagacgcgtgggcaccaccccacagcaggttgcaggtaatgcggactgtgagcactagttttgggcttgggagaaactctctcgtagctcagcgggttctcctggctggtgactctcacgtgggaaaagagagtccgacgggaccctgggactgatgtagaggagaaagagcttagaccttaatcagatccagggagactcttgagagcgggaacccgaaagacaaacccgggagggaggctgcgggtggagcaagcgggatttgatggggtaaaggaggagaggaaagataccttgc

SEQ ID NO: 17810 - DNA, 1298 bp, Mus musculus
cagcgcctggcacacagtcagtctcttgggatgtgagggttttcatcttagaccatggctgaagtctggggtctcccacaggagctgagccttcttgaggtctttgtctccagcagcattggtaatgggcacagcctctgggcctaggttatcagcatccttctactgcttgtaggccaggcagaagtttagtgccacctgtctgcattttgacaagctgccaagtgctcgattaaggttgggacaggcccctgttctgcagaaccctgcacctgggaactgcatgcatccagcatccagcatgcatccatgttttcctctttttacccttcagtgcaagatgtctctgaacggacagcgcggggagtgctggtgtgtgaaccccaataccgggaagcccatccagggagctcccaccatccggggagaccccgagtgccatctcttctacaacgagcagcaggagactggtggggcccatgcccaaagtgtgcagtaaaccccagccagtcggtgcctggcttccccatcccgaacaccagcagaaatggagggcgtcagggtgacgggtgtggaggagttcccagttttgacacatgtatttatatttggaaagagaccaacactgagctcagaagcccccctctgaccccccccagcggctgttaagctgaacctcccttgcttctgttagagaggggaagggtggtatggagggcactgggtacaggcctgggaatggggaaagaaatttttatttttgaatccctgtgtctcttttacttaagattaaaggaaggaaaaataaaaagtgtgtgtcttacttgagtctttggggtgtcccgggaaagagtcttggggggggatggtctgctgagctcatgcccaccttgtccctaatacctggaatggcggggaagtcactgtttccatcttacatggggacaagaaaaaggcttctgaacccagatgccggcctgcggtggaacccagggctctgctgcactaaggaaggtttccacccccctggactgactgaggaagatgggtagtgaggacaagagtgtggacactggacactggacgcacagtccacaatcccagcttttgggaggctgaagcaggtaagactgagagtctagtctagcctgggctacacagcatataaacacccatacaaagcaacatcggtagaaagcttcagatgatattgcagtgggagatgggaaatggggaacattgaaattgggactctcctaccccctgaaataaggagttttcaggtatcttaggggttt

SEQ ID NO: 17811 - DNA, 1229 bp, Mus musculus
acatctgccccacaggatacggaggaggtcagctgtgctcactcctcttctccttccaagaccctcttccgaccatgacttatctccatggtaacatcctcaccatcattctcccactaccaagggttgccatggcaacctcccaaccacctgcccatcccaggcagggcagctgtccttctgctcagaaccctagaggactctaggtgaaattttacagcttaagagaggagtgagccaaggagaagagaccctgtagtcctctggctttcaagagaaagaaggctatgatttaaaacacagtagaagggaaagaggtctcgtcgacctctcccggggagcttaggggttgtactgtctttattttttaaaccactaaagtgcaatgtttcctgcactcttgttaccccgcctctcttccctgttaggttttcatttccttgagcagactttcttggttttttaatggagtatagactttcaccacttcacagactctggcctcctctccaagtctctctggatggggaaaaggaaggtagagggtcagaggggaaggggtccctcgtcaccccgcatccattcacccccacttctctggtccctagtcaccggcttcagcccccatctccgacaccatcactgtcacacagtagcctgtcacacggatagtacagttcagacaagactccttcagattccgagacgcctaccggttgtttttggtttttgttttgttttcttttgtttgtttgtttgttttttacaacagcaataaccacatcacatattactgtagctctctatagtgttacgttcagacaccgtagctctgtcctctcttattttgttggttttgacttaaaaaaaaatacttatgctttttactggtgaaacagattgaaaaaaaaattgaacaacaaaccagtttgtgaaaaaaaaaaaatgggaaaaaaaatcaccccgatgtggaagagctcggctcctctttagcattttgtacttaaggaaataaaaaagaaaaacctggaagatctcacattttattacaaagtgaagatttctgtattctatttattcaacttataatttatgttactccttgatctttgtcttttgtcgtgacaaagcatttatttaataaaagtgtgcattcagctagcttgcatcgccttcctcctggggcagagggctctgtgagcacccaggctgccaacaggaggggaagg

SEQ ID NO: 17812 - DNA, 4139 bp, Mus musculus
aagcagggcagcaccacagacaacgcttgccacctcttcgcagagcttgaccccaaccagcctgcgtctgccatcgtcaacttcgtctccaaggtcatgctgagtgctggccagaagagatgaacgaaatcgggagccctcgcccaaggctagggcatcggggatggggtgtgtggggaggggacctgtgaatcctgaccaccttgaatccagaaccaggactttgggtcgcccgtggagaaggaaagaagaaagtgcaatgttgggagaggaaagtgaatggcggaggggggaggcaagcaagcgggaggaagaggaaggaaggaagaagagaggcactcagaatcccctgtatggatggaagccacacccccaaagcctctccagctagctggggctcctcccccttctgagagacttgcgctcccgcagggaacacacaggcctccttgggggcgggggaccatatttcacagagcaatggaaaagctccctctccccaaccctcctgctctgagagaagaaatcgaactgaggcttcttctctggaggtaaggttgctggtggccagcgtatgacatcaagcagtgacagtttttcacattttgctcacccggggcacccgtggtctgtgcttgctctgactccttgttgcagggcataaatgtgcccccccctccacgcgctgatcgatactctgcctgtgtccactcaactcagattacaaacagctctctctgcttgtctgtgtcccttgtgatacacttaaacacactgtccaaagaaggctagggagggttggttacagggtggcagggtcccaggtcggatgacaagctgtctcctgcggaagtgtagcttgtgggtatagagttctgtctgcacctgccctctagtgaccctgggcctgtcctctgtagagactctggtacagagggcatgggcacctgcagcattatagctgttctgtctcctggagaccaaagctggcttggaggaaaaaatgatgcccacagtcttgggaaaaatacctgctgggaaggatggcatcttttctgcgcggtggggctcccggagaactgggcatgcgcattgtgccgtggggcttaggatgagttggacacgcgcactgacaatgcctaggactgccttactcccttccctcaggccagttcctgggccagcactagccttgaatttgctcatccgcttgaaacctactgggggatggggcccgtgcctttctgacctaccctgtcctatatggtcctcgtgttggcttatcccaggagcctacttcccagagtcctgcctagggcacccggggaagcccgtccccacttccccactctgtaagtgttttggagtctgactattgcagacaccctctggctgggctgctcagggtgacatcatagcacctctgggaatgctgccgaagaaccccatggtcctcccacaataccaaagcttccctgtttccccttctgcctccgtttccccagcaggaccacactgcctgtgggacaaaggacaggatgtatgaatttaggccaaaggtcctatggtccatttgcagggttggaaaggcccttgccatctcttaggcctccatttaagcccatgggggcccctaggggtggcattgtactgataaataaatatatataatatatacatgagacatactgatagaatctgtaagctaataaaaaatataagaaaaaggttaaaaaaaaaagaataggtaaattgacaagaaatatttattgttttcccttattgccttattgtccctggccacaaactgttcatctcttctctaatgtgtaagtggagcctgaactgcaggggctctttatattccaaacaacccagggttagccttggcctcgatcctggccttggcctccctaggctatatctgggactggggggatgacatgctcccactctggctccttgttctctggcaaaccgtagcgtggctgccagcatcctgtagcgcggatagctgcttccatggccacaggcctgaaccggtgtgtatttggggatctggatgtgtatggccacggtgtggcagcttttggatttttttcctccggggagcattgactgtgtggacattgtttgaggagctagaaagaagatcggctggggatcacgagcccctacttcccaaagaataaatgggcttagtgatcaaggttcttcaaggggtctttctccctctgagatattcaaggcaaatgtctggatgtcgcatttcctcaccccccacctcatgaatcctacttctccccaacatagaagtagacatttctcatcccattctttgtaaatgtccacaccctaccgcaaagtctggggagtcttctggctggaatgctgttcacgtctgcatccagccctgggatcggccttcgtgtatggtttcaccttcccatgctgcactctttcctgagccatgtgggagtcgtgtgaatgaccaaggcagatgctagcaagtggtgcttccttctcagcacgtctctaggaagcatggacacccgagtgtggcttttctcaaagaaaggtgaagaaggggcctcagttcttacagtggggaccacactgctgcctgcccccttcccaactgtgattctcacacactcacatgcgtgcacacacacacacacacacagaccacacgtgcacacagcactccatatgcaactctgtattcttgccaaagatttcctttaaacaagagcacttttacccaatggctcttttgtgaatgatctgtttcgttattgtttattgttgagtctgtatatcaacagggagagtgttgtctgctcttaaacaggaatgaaaggggggaggggagacaggagagaacacggagaccagtgatgtccttaacaagacccctcagctacagcccaggtccaaactgcctctggccactcagaagatgaggttggcttggcacttcactgtccctgatatctggaggtgagatggcagagaggggcaccagtggagccaggattggggcctagggaagcccccaatggttctggaggcagggataagtgtgaagggctgggctaggacaggatggacaggaaggctgggagaactaacagttggatactgaagttgctactgcggacctgtggctcccttggccagccatgttttgggaaagagttcacatcttaggtttgaaagggagcatttgagtcttctcactgacctcttcctagcagcttagatagcctcagacatgactgccaggattcctgatatgccctggctttggagagtccctagggatgcccactcgggggtgtagggaagacactggctgtgcgtccttctaggaaggggctttcaggagagagagttcttgtgctgtctgagaagtgcaggggagacaaatgaatgcagtgtccatccagctctgggttttctttatcctgcctcccgagacttctgacccccctttcccagcttcagatcttggggagatccatccaaggggttcagccctctcctgcctccatgccttgggtccctgaagagcttagaacccaaagctagggccacccctgcacttaggccttggctgaagatcttgagactggtgtttccgtggtcattggtgacaggatgtgtgcgctcgagtgtgtaagtgtgggtgtgtgggtgtgtgtgtgtggtctgctcatctctttagggaactttgaggtgggcggtggcatatggaggggtgtcaggttctatgtgacccagtaatgagaagagcttgaaggtgaggcctgaggggccacagatgagtcatgttttagtgctgatgacagaggggccggtcgcatgggatgaggctcggtgggcctcttgcttgttgtctcctgtctcctcaaatggctgaaaacttggagggtctcggttgttttccatgcctggcccctcacagcagcgaggccactgaagagcaacacacccagtgtgtgtcagtgttctcagcccagccctccctgagaacccacatttggctcgtatgtatgtgagcacgttggggtgcgcataagctatcaccatcttcttctcttctatcatccaaatcaaatgtaagaagtccctca

SEQ ID NO: 17813 - DNA, 1213 bp, Mus musculus
ggtgtgccacagctgggcactgacctggtccagtctggtcagtcttatgccctaccttgcttgaggctgaatgcacgtgaagagttcccccagaaacctggctggggtgctggtgtactcccctttgccatccacagggtagtgagaagaggtttggggttcaggggatgggggtcttttagctccttttgggggattatgattgatgagtgcacctggctgacctgtgctgcctgctgtctcgcttgctgtccctgcagaagtggtgggacacacccaagggccgctggatgggagcctgtacgccaaggtgaagaagaaggattccctgaatggcagttcggggcctgtcactactgcacggcctgccctgtcagccactcccaaccacgtggaacacaccctgtctgtgagcagcgactctggcaactccacagcctccactaagacagacaagaccgatgagccagtctctggggctaccactgcccctgctgccctgagtcctcaggagaagaaagagctggaccgcctactaagtggctttggtgtggatagagaaaagcaaggcgccatgtaccgggctcagcaactcagatcccatccaggcgggggcccgactgtgccctcccctggccgccacattgtcccagcccaggttcacgtcaatggtggggccctggcatctgagcgggagacagacattctagatgatgagctgcccatccaggacgggcagagtgggggcagcatgggaacgctgtcctccctggatggggtcaccaacaccagtgaaagtggctacccagagaccctgtccccactgaccaatggcctggacaaaccctattccacagaacctgtgctcaacggcggaggctacccctatgaggctgccaaccgggtgattcctgtccacagcagtcactcggcccccattcgaccctcctactctgctcaggagggtttagctggctaccagcgtgagggaccccacccagcctggtcacagcaagtgaccagtgcccactgtggctgtgaccccagtggtctattcagatcccagtcctttccagatgtggagccccagctgccccaagctccaacccgtgggggtagtagccgagaggctgtgcagaggggtctgaattcatggcaacagcagcagccccacccacctccccgccagcaggagagatccccactgcagagt

SEQ ID NO: 17814 - DNA, 1217 bp, Mus musculus
cttgcagcccttacagtgaaagcttaattctgaaggcacacagcttctcgggcccctggtatgtcagggatgccaagaggctgtgtcattttgcatgaagcattgagattggcccactcatgaagctgggtccttatgtgactgtgggctgcccagagttagtgctatgtggtttttgtcaagctcatagccctcctggggatgcatgcagttcccagggagccccttcaaggcacctcaatactggcctagtcactggtgtatgggtgggtggttctgagatgtcacatggtctcatccgtcttcttcacttgccattggtgcctctgagccctgtctgcgtgcctccctgtctgctttctgctgcttctttgtcttggagagcagaaagagcatgtggccaaggccatcttgagctagtgcctagctgttacattgggctggcagtatggaggccattgaaagacacctggtcaggcacagacccttggtgaatggctacaggcattgattcagtctcctttgcaccccgaactcatctgtccttctctgccgtctccttcccggatgaggaggcttctggagcacatctgtgctgagagccgtgaggtgaggagaggcaggagggctacgaacagatgtccctctaccccttatccgtccgatgcatatatctactgggagctgacagtccccctcctgcataatcttatcctattcccagggaacatatccccagactggctctgcctgctgccttcctggaataggtatggagacccccaaaaggctgactctccaaagcctgtcctacccctgtagccctgagctgcacttcttcaggtcttttgggctactgtgggggggggggtagggtcctagggcattctgagagtatgtttctatcacacacacacacacacacacatacacacacacacacacacacacacacacacacacacacacacacacagagcctcggtgcgcagtcagctcaggcagcaagccctcctcctttctttctcagtgtccttccctctcccccttcccttctccccctgcaccttcagcaccttgctgccatgtctgtcatggggtggggggtgcttcttcctgcccccacccttctgactatgcctgctgcctccttgatgatcctgggttcgctctagaacaagacattttagagctccaagctttcctctgtgtatttt

SEQ ID NO: 17815 - DNA, 1215 bp, Mus musculus
accttccacagagcactcagatttttggagtgtggggcagcaacctcagtcagtggggcattgggcttggtggcagggcctggggttgtctataaggggcctcagtggacatcagggtgaagtgcctggtgttcagagcttgcggatgggactggagcacccactcaatccttgcctgtacgtttgcaccatagacatcccagcacagtggctggcacaggagcctactgggaccccaaagacttcaaagaatgcctgtgcatggggaagatggtgtggctttgttagaaaggatggatctagaagcagcagggtctaactcctgcctgccaggggaaagccagtgggtctcatcttgacccatgtatacaagctcacttaccttagctcttccttctgtgtgtccttgcaccctgctgagcctggggccagctgaccttcctggagctgtgtcgtcaatgtcagctcctgaatgagaagtgaagaggacagataacagtcaccataacacaggagcatgactgctgttcctgggtgactaactgttaagctccaggggcaacacaacaaatcgctatccctaggagaggaggactcagatgcctgggctccactgactcatgtcctagctgtgtgactccagcaagttgctcaacctctcggtgcctcagtttctttaaaatgaggcttggtaggatggctggttggttagtgtcaatctttccccggtaaggggcaagtggcagagtctgacgggcagaaggaatgtggagatctatagctgagtgttccagccctctgcactctcttctgtcttagagagaggctgtgggtgtccaactcagggtaaagagaatgcattgcaggggaagagcagagggcgacctttggccatgtgaagactgcagagcaaggcacttaggagaaactcaggagaacctgggaagtctggggtctcggagtcagaggaccatgaactatgctccgaatgagactcctgggagatcacgagctgccctgcccttgaccacattgcagctagttatctgctcaaaagggcccgaggggaggtgagaagtgtcccaaaggtcagatcattttgacagataagtaatttgcctttccaaattaaacaaacaaacaaacaaacaaaaaacaaacatagctaacactttaaaatgtgcatttttccatatttttaaatcaatttttaca

SEQ ID NO: 17816 - DNA, 1233 bp, Mus musculus
cttttaagagattttaagaatatttcttaaaagtcagatgtggtatctcatgtctgccatcccaggttgtgattctagcacttgggagggctgggcaggaaaatcagaagcccagatcatcctcagctacgtattgagtttgaggccagtgggttgcatgggactctgtttcaaaaatgaaaataaagctgtgtgtttggggtggggagggaggaccaggggttgggggggaggaacatgccttaatcccagcacttggaaggcagaggcaggggttgaacttgagtcctcaggcttggtagcagtgcctttactcactgagtctgaagctcgagcagatggtaagcagtaaatgtttcatcttcttagtctattacatggactatcactatgattttattttaaaccataaagcagaacaagctagctgtagtgtatccctgtgacctagcatgtaggaggtggaggcagctcaaaacaagcctcagctacaaaataggtttgaggaagcctaggctacatgagattctgtctcaaaaataaaccaattaaaatacagtaataatggaggcagaggcaggcagatctcaattcaggacaagcagagaaaccttgtcttgaaaagtagaactaacggggctggcgagatggcttagtgggtaagagcactgactgctcttccgtaggtcctgagttcaaaagccagcaagcacatggtggctcacaactgtccgtaaggagatctgatgccttcttctggtgcttctgaagacagctacagtgtgtacttatatacataatgtatatgtataataaataaatctttgggccagagtgagcagggactgagtaagaggagttggccagagacagcggggctgaccagagcgagcagaagtcctaaagttcaattcccaacaaccacatgaaggctcacaaacaaccatctgtacagctacagtatgctcatctacattaaataaataaatcttttttttaaaaaagaaaagtagaattagcttgctcgagctctctcgctcctcccatctctgccccccctccacacacacacacacacacacacacacacacacacacacacacacacacacacagaagcagaggaggtgggaagggcactcctgtgcttggggctaagcaatgattgtcacagtgttttacattcagcattttccttgttggggcacagagcttacagatctccagctccag

SEQ ID NO: 17817 - DNA, 1105 bp, Mus musculus
tctgtggtcctcctatgttaggggcttccttcactggttcttctgcagtttgcatgggcatagttgaatcagctccctggctttgggagaagggtctgagaagcaagtgcagattcaggcaggggctgatggtagaggcgatgctggagccactatatcaggacccctgggagtgggcttgcactgggcctcagcttcctctgtcctttgacccctgtgttctgtctacagagatgcttccctggtggtgaccacatcaggagaccacaaagcaaaagtattttgtgtccagagacctgaccgttaacagctgtagcctctggcatggtgtctggtgttaagggggataaagggacgcccctgcccccagcagagttgcggggtgcagagggaagaggaggggagaccactggactgctttctgaccccttcagctgacctgcttactccttgtccttttcctccctggagacccgccttgccaggccctccctcccctgcccagccctggggccttgtaggaggccgtgtctctttgactttgattcgctggtgtgagccatggggtgcgtctttgtatgttggggttaggtctttgaggttcccgttctttcccttcccaactctctgggaaaggaaaggaggaagagagactagttacagattttaaaaatgtaaataaaatatacttcccattggcagtgtctgtgtgcattttgtggggggtgggtgagtggagtcttcctgtggtgcttagtgtgtctctgggtccttctagggcagtctactggcccctcccacttctggagatatggaaggaataatctgccctgatggccagagatttatttggtctgggtgaggtctcatggagtgagggttccaatccaaagaagtggggcactgtgagatagaagagtgttctgggaggcagcagtagctgctgcttccctaattcaagtccaggtcaatgctgcattggctactggtgtggtaggcagtgctggggcctggattgtccctcttggctcttcctcgaagcactcgtagacacctttgggcagctgtcctccagggggctgtgtagcgctgatcacccagcccc

SEQ ID NO: 17818 - DNA, 1099 bp, Mus musculus
acggagatgaagagatcattgaggtggtagagctggatccaggcccgccggacccgggtgagaactgacgctcctgaggccacgggacaagaggcgctcacccctggcctctgacccctgcttctccccagtcccccctccccccttccctaccggtcgttcctaccgacatttctctcccagacctcctcccctaccccccacctttagtttctaggcctggctgggtgggggttccctgacgcctcccctagcccttcccctcacacacccccttcccatcatgccctctgtcctctcttcccacacggtcgctggccaacaccagatcttcagacctagcctctctccccctccccgccccccaagtgctctcttcctgctcggtacgtgtgagacaacatcttaacctttggccacacgacccaccctagcttcacctttttcattctttaacccttaccccattccttgtattatctttggagctccatcttttaacgcttctctcaaagcagatgatctggcccaggagatggaagacgtggactttgaggaagaggaagaagaagaagagggcaatgacgagggctgggtcttggaaccccaggaaggggtggtcggtagcatggagggcccggatgatagtgaggtcacctttgcattgcactcaggtaggcctttgaacatctcagatcagtgcagatgggcttttgagtatggcctgttggtcctaggcagctattataagagaccaaagtgaaagccacctactttggcctgcaggatattcaaaggaagggccatagggcactggggttaagtgtgacccctgggttcaaatcctacctctgctgtttagcagtctgtcagctttgttagctttctggatcttggtattctttaaaatatatatatatatatatatatatataaaatcttgtatgaaagtgaatggaagtaacctaagtggaaattaaaggtagtttacattccagaaggggcattaataataatctcggatgccagcctcatgaaactctcataacttaattcatacctagcctggtatggcctgtcctgtcagctgtgcacctca

SEQ ID NO: 17819 - DNA, 1181 bp, Mus musculus
gtgagagccatgatgctgggatcactggcacctcttagcccttggtgggcttggtaagaactagtctgaaggtgtatctccttccctttacccatgacgagtatgcaccaaactctgtgtgtgtgtgtgggtgggtgtgtgtgggtgtgtgtaggggagtagggagcctgtgaacacaggagctctgaggggaagaggctcccctcccacctcggccacagggttctaggctaggagctggagctgtctccctcctggatccaataaagccagatgctttgcctccagctccagtgctcataggccacttatgctgtctgaactctttaggcttggcatctcttagctttagaagctagaagagatctgtgccctggggtctctctgttccaaccccatcttccagtaacatgtatcagttatttatctggctaggggaaaaaagacagtgagcagagtttcatcagtatgggggctaaaccagaatggcatccaccctgcctggcgcccagcctggctaccatccagacccaaagtgccttggggccttctgaggcttttaaaatcggacctagagggacctcctattttgctctgacacacagaggtggattgtgggattctgggtgtggctgggaagcagtctgggtgagagataagtggggacagggaaagcgccttgggtgccctctctggtctgagaaacactgaagtctactctggtacacaagttcaatctgttctgtattcccattgggagatttcagactaaaaccccctcttcaagccagctgctgctttctatgtaatccaagtgcctcctccggctggtaccaggatgggaacagaagccggtttatcaggtggggtagaaaccttactagcccaaggacatagttagagctattctgtccagtacttgattctgaatatatcacagagggacacaactagaaatgtaataaagttttatgtttggcaggaagacccttgagttgctgtggctttcttaactctaaggtgggaacccagtatttggaagaaagactttcctgaacagttcttggtggtgggtgagacaggctgctgcaatggtaaaagctgcctgaggaacggagctcaagtctgcagcactggctccaggagcactggctccagaaggggcttctcagccaccccgc

SEQ ID NO: 17820 - DNA, 1184 bp, Mus musculus
cagattctcagaggggaaggacctaaggagagggcactttaggcaaagaccctatggggcacgaatttccactgggtgggacctgtttccctaagacagtgactgggaagaagagagcatgggaagtggaggattcttaagtgagaagaaagtaaccctgggtggattcccagagagccgccaaggctaaggctgtcttggagaaaggagcatgtctgcccaccaagtctggaccacaggagctcagcctggagactcggcagccttgccctgcactcgggcactgtgtgtgtctgtgtctgtgtgtgtgtgtgtgtgtgtgtgtgtgtgtgtgtctgtgtgtgtgtctgtgtgtgtgtgtgtgtgtgtgtgtgtgtgtgtgtgtctgtgtctgtgtctgtgtctgtgtgtgtgtgtcggggggtggggtggggaagggggatcacaccagctctgccagagagtaactgggctgagctcccatgaagagggagtaggaaagctgccctatctggttcttaaccctgcctttgtgtaccttataccatactgtgtcctccttgatgatcccacatgatcccaatgtaggacggaccttcgaaggcacagcggagaccatgctgagctcactggacactgtgttagacctgggggatgacaccctgctgtggcctggtgaggtgcccctcctcctcctctcaggcccttgttttgcctggtacctgaaccctcccagtccctcactttcctagagactggcaagctcagctcatggcctaaaggtcacgcagccgatccacggggcagtgttgggggagcagacactgacctccctcctgggacgttagactggctgtgtgatgtccatgcctcacacactactgtcccattccccagacagaccttggctgcttgtgacccctgagcacccagagtcctggagagatatctaattgttcagataactatggtcagctccccaaacagaaagtagcatttgcttatcggagaaaactgtaaatctggtccacatgtactgattggcctgaatttgatacagaatatgcacacaccccatatctcccccaaatccatctcccctcccctaaccatccaacttctttttttttctttctttcttttattttttttttctgacgtgttattgtcttctccgtttgcta

SEQ ID NO: 17821 - DNA, 1650 bp, Mus musculus
ggaccaatcgccagatcatgaaggctgcatttggctcctgctccagaggccacaccaccactagagccctagaacccaggagaagagagtcctgaccaggctagtctatcttccaccttcccccatgcagggttgtaggggaagctcaccccaaaaatgatctaacgtgtggtgcctgggaaagtggtcatcaaccagggcagccagactctgggtgactgagactctaagtcccaccctacctaccttgctaagacattgccaggcagagccattcctaagaacacctaaggactggaagcctggttctggcccatccctgcctcagtggatgtcctgaaggccagagagagaggttcctggttgccaaggaatcttctgcttcaggccagggagtcaaaggatgatggcacacagagccacacaccacgcacatctgttctgggtctgccattgtcccgggtcataagggcctgcctgccttcccaggggagagtgaactgtggtctgcctcagagacctgcttctcctttccgcccttgttcttaggaattcctgcctgcctgctgtctcacttaacctctcttgctctatcttcaccccctttcctctctgagtcattaaaggctgactttcttccagcctggtactcatccggctctttgcagtttgccaaaaaccttcattcccacgtcatttcccactggatcccagggccctcttgttgtcagtgtgcagatagcagaggtctgggaataggaagctccagtgagtggcagcttccaggacctcaggcctggccataccccactgctcatccccctccagatctgcttgtcctctggtctcaggtcaagggccctttgtggccacaggagcactatggtcgttttgcaagcacaccttaggtgagttagccaggagccacatctttctgtgtcagagccttccactgggctgtgcagtgccctctgttgttcctctgagatgcccctgcctcagtttcccctctcatttggcttcggctgccctctccaggcacagcctttggaactcactctagcaataccaccggactagttagccttcccggccccaagacactcgcagtttcatgcctttgtgcctttcgctcatgcggtttcttcagctggaatgccttcccgctcctgccgcctcctctgcctggcaaacacctgttagcctctcccaggcccctcccccaggaaggcacccttcacccctctcttccaggctacctctgcacctgtaaatgcttctctcgtggcacctatcacaccgtactttacttgtttacatgtttgtctccccttctagactgtgaatccttaagggcatggactgtatcttatgcatctctgtatttctgcgcctagcacggtgcctggcacacagtaggcgctcaataaatgttgaatgaatgatttaaccaaggtctgagctctcaatggcttatctatgctgcccatgggtaacaacagcagagaatctgctcactgtttcctgactccattccgggtcccacaactcagggtacttcgtgggaaaagctctggacaggaaaggctccaagggcaccagaacaacccagaaaaaatgcctccacatgctccttccacagcccctgtg

SEQ ID NO: 17822 - DNA, 1282 bp, Mus musculus
ggtcttctgtctgtcccaaccctttttactcttcattcaaaagacatttattgagtaccttcagtgcccagcagtgagctagtcccaccagcttagtgggagggggttgtctctgcttcatttttaggtgcctctaaaccccagatgtcacgtgccttcagagtatcaacagggggtggaaccttcttgtggggttagggagtctccaaaccttaaccaagctggctcctcctgtgccaactcctccttccctgttccgtgcagcctcctccatggccccccgctggctgggggcagctcctgggtttctgccttctgtttttaaagcccctccccatacctgcagagtctgcagttcaagcccttaggctctctccccagattatgagggttaagtgaacccacaaacaagtgccaagggggttggtgaagggagagaagatggccggaatcagatgaccttcccaattaagtgccttctctgtgacctgagcacctcagagtgataactaaagagaaagctagaccccctcctattccgcctctgtggtttttggggaagggacctgaagtgcgagaatgtctcacatctgtgactgcagttttgactatttttcataaccctgctggacaggaggaagttagccaagagggactgcctgggcactcgatctgagttcgattgctagagcccacgtgatggaaagagaaaacgaactcccacaagttgtcctctgacctcctcacatgcaccatggcacgagctctacccaccccccacccccagatacacgcactctaaacaaataaaaaatacacaaaaagcacggtgcccccacctctggaatgcggggcggggcggggcgggagacggaaggctgggcagattaaggcggccctcggccgacagccttccgggcaatggggccagcaaggaggagactgggtggggcgggcgccaagaggcctcctgcccgcatttgccctggccacgcctcgcggcctctggccagcgttagccacgccccttcggccaaattcgtcttccgtgaaccccgcctgggcggggcaggaagtgcggggccaagctgttgcttgccgctaggggcctccctgcccttgtggaccaacactgggctccgaagcttggcgctcccagggagctgataccgtccaccttcctctgaaagcgtggagcttcagacatcgtccacacacagtggagaaggggtggtgtacacctcccaaatactggtccctatcctctaactcaacctcctca

SEQ ID NO: 17823 - DNA, 2813 bp, Mus musculus
cacctcttctaaagctctgaactgctgacgtgtgcctcggggctttgactgctgagaaactctgactccaccatctgccagcacacattgttatagtgaatgttccacagtggcacggggagggtatgcagcagtttacaacagagaaaaacatttgtttttaaagctaactttaaattgtgttgtttcacctcgagcaggagtctccttttgtcttgtttttcttgaaagtgactggttgtcttgagcacccagggtgatgatggtgtgctttagtgagttctcttgtctctactggagaacttcgagcagttgaaatgatgaggaagtttatttaatttaaaaaaaaaaaaaggctctgcatcatggcatgaggacgcagacatgatgccctcagtctggactgcctcctgggcatctggaccactctcatacctgcttgtgtccctgttgacttagaaggccgtggctcgccacagagcctgattccttttgactcccatgtcttgggcaggacttgtgttagttataaatagttactccttgcaaatttaggatttgaattttatgtccagtccatatgatgacctgtcagcttccctgctcccttctttcctttaactgactgcttgactccaaatggcaatctcacctagactgtattgatagggtactggttgttctaagctgcctgtgtctattttaaaattatgagtaaatatagtctctttttttaatactgtgatcaaagaattgggggatagaacagttaacatgttaggctaagaaggggcagattattagataggaacagagggtgttggttcccttcagtcagcataataactttcctgtataaaatgccaaatgtatggttatgttactttaaatgactgaactggaattttatagcaactagtactctatgcagtcttctcatcttagccaaaactgggaaagagaataaactaaaaagttgattttccacccccacccgccatgttatgcagagttaaaaagctgcatgtgaatgttgtttattttaatagccaagaccgtcacttaaatctatagggaggcagtgctcttgtttcgtagggatagtgtgtgtacacacactcataagctttgtcccagcaggaagaataagtaaatacatgaattgtttattttctgattccaaattggtttcttactttctatgatcaggtttaacctaaacagctcagcagtagcagacatagcaaatgtagatgtatgtacattttaaggtgtagtgcttacaaatcggttaactctgagtgcaaatattggacttcacttttttttatcttctagacgaagtataaaacttaggggaaagctctaatagttcaaacctcagcatagtgactgagtttttccctccatccctcagttgctgtggtgtggtgtagacccatatgcagatctcataactagatcgaagttcatgtggaccttgtacatacaccgacactttcagaaacttcagcccagcacataaaagttgcataaaactgtccactcttctgcctgctttatagtaacatccccctgcaaatacagctttctgccctctaacacccttgtagtgcattacttaaaactctgtctatattgtcttaccatctggagaactattttattgaaaaactctatagtttgttggccgttttataacaggggtactctgtatgtcgccacagtagactccttggtggcttgctttagttactagatctgagcagtctcatttatacacaattaggaaactgtactttccatgagtgccgcgtgtctaaggtctggaggttttaattataggtgttcccatatgaataaacattttaatgacagtagacttaaaacttagagataggagatagtcctcaggcctgagagaaagctggatgacagtcaagatccaggtgtatcaagccagaccaagaacaaagggcagttgtctgaactagtcagtcagaataggagagggcaagagggaggccattgtagcgtgtgcacctgtgcccttgctgccttcctcttcacacttcctcctcgccctccctggcctcttggtagaggttcttcatgcctgggggagggaacaagtgaggttcctgcactttgctgattgagccactcccaggtttgctggcagctttggccacgttatttgtgaggtggctttttttcctttgtgttcagagtgacttgggttctgattattgacgtttgtgtggaacggcgctttatctgtgttttagcagaactgttcctcttttcctttaagggttttccctggttttgttttctttttaaattatacagatttggtttttttgttttgttttgttttaatgtgtgagagacattaaagcctttattaacctcatattagtttgatttatttgtttaaagggacatgttcctggggacactggataaccagttttaagagaaaatcacctattggcttctgattggacttcacgtagcaaacccatgttcctggtgttgtcatttgaggagtctgtggagctttgcaaaggctctgggttagagctgtaagcccagctttggccttagccctcccttttgagtgtgaggagggtaagatcaggataagatcctgagtgagtgacggtgccagagaaacccccagacgctaatgtctcctggagtacttagctgtccatctaagaaaagaaaactctacaagatttccatgggtctgtggcatgcgtctgaaggaatgggcaaattactattataaacaaaaggaattgtca

SEQ ID NO: 17824 - DNA, 1285 bp, Mus musculus
atgtgcaacgctccatgctgttttatggaaaccttggtcgcatctatagctgattatcctctttttcttctacaagagtgccgcttccttttgtcttaggaatgaatacatactgtaaatatatatgtacatacccacacgcatatactgaatgaatggagccttaaagagctaggatgagccaacagaagtagtgctcttgctcacagtgaatgctgcagctgtttggccgagaaatcaaagtgtccaagcacattcatttgaggcagtgtgggggtgcgcatagcgtttggctcttaactttggggctttttgggttggtttttttttttttttttttttttttttgtcttttgaatggcttcactcaagtccaacattttatgtttgttgtaagtaaagctctctgggaagctagttacactaaaaacagtttattttccttgcaagaggtatttctgtagcctgatttgagttttatttttcttttgattttatgactctcatgctgtttacatgcagtttccaaacaatggattgttggtgcttcggagtgttccagccccacacttgctgtttatcatgcccttggcattttctctcagatgcctccacacggtgtgttcatcatcgtcttctgtggcgtgctgatggtaaagctagaagcttatattttcttctgtatcattttcccatggaacaggcatgacccaatggattacagcctcggttataaaaggttcaaagacagcttcaactgggactgacagggatgcttagggcagggaggaacactagtctctgtcctgcaggcagagaaagcaggggcatgccactttttacagtgcagattctgggccactaaagctaaaagctaaacactgtgttgctagggtgaaaataagtagtgggaggggattccaggagctatcaatcaaaggtgcctagtacatatcttacttgttagtgctccgagtgagaccaagtgtcagtgcagcggcaagtactgcatgagtcactctgcccacgtgacctgcctgggtaagcagctaacgaaaccatgatgagcctggggaatctgtcagcacaagtgtcattaggattgcacagaccttagcaacatgaagtctgcatttgttttgttccctattttttcttctattattaatgggagggttgctgtgagttctgagttagatatgaaaccatgttagattttcagaagatgttaaaacccatcactgaagatgcagcatcttttctggaagagtgtattcagagagct

SEQ ID NO: 17825 - DNA, 1203 bp, Mus musculus
cacgaattgcgcatgctcaagcggttgcgcgtgaggaaaatggtaggagggccaaagttggtaaagtggacggtgcgcatgtgtattacagtgtcgtcacggcgggggcggggccgcccgggttaggggctgggcatggtgaggggcagagcgaatgcttgaggggcgggacttgcgcgcttacgcgcacgcgcctggactggttgcgtcgagagtgcgtgcgtccgtacgtgtttgcgtgtagtcatagttcccgccatcagcgggtttaggtgtgctaggagagagaccggcctcgctctctggggctagtagagccccttccttccgagcctttcggctccaccccctccgcgggaactttgtgcttccggcaagcttgtccggagctgggaccctctagcgcaggtaagacgagccgggacagcttctgaattgagccgttttccccggcacccccaccccacccctgcggtccgcccactcggcgtccacttcagagttctcccggctgctgcttagcccgccccgggtccttggatacccaatgccttacaggtgccccgttcgagtgttgccccctttacttctcctttaacgcgtccgtgttgtcacttgctttctgcattctaaatctggcctctcttcaccaaggttcaggtggtctcagcgtacctccctgcaaggcctgctgtctttacaggtgactttgttgccacatatccattaaaaccttgactgcgatattcacacgcccgcttgaccattctttactttcctactcctcttagacattactcgctgaaagggagtgtaatttttgtcgtgcctttggttgctacccatatctagccaggacactgacggtgtctattgaaccaattttaaatcaaaatctggagaaaaataaaaaggtaataaagttccgtgtcgttggagagttgtactgtagtgtttttcagatattcctttggcgagttaacagtacctgatgagtctatagttgaaagaactaatctaagagggaatgttaagggggcattttggtttattgtgttaagtattagaggaggcttctgggccagacagataggctctagtgtgtttgtatgatgtttgtcatttgtcatgttaatatttgggtgaatattcaaaagaatagtgttgcatactggcaaaaggaaaaggagggactgaagaccc

SEQ ID NO: 17826 - DNA, 1201 bp, Mus musculus
atgctgtggggatacgagggccagtagtttgcagacgtcattttgatcccgaatctgaaggttcaaagaacatactttgagattatttgctaggccgaggtccgggaggcgggaaagggctgggtgggcggagggtcagaggtgagaggtcaaaggcccgcgaagggggcggagcgaggcggaggcggatggcggcacttcatcttgggcatcagagccgctgaagctgggacgcgggtccggtgcgtccggcgggaggaggagtgcggcggccgctccaaacatgcacagcctggcaacggcagcggtgagtggttgctcccgctcggatgtccgtctcagcctgttttctagctcccagatccgggccctgagtccagctgctcctgcccctagtcgcaaggtctgggggtctccacacgccgaccgtggcggagccggacccccgctgttccctctcatcccctcccgccccctctcctggcctggcgcgcggcctctcgcgttgtttgccagcgccaaggcctggtcccgcgccccgcgctgccccagcaggccattcattgattcctttgcgcctggcgtcagtttatctggacgcgggttgtgaatgctgggcgtcggcggggatgaggatactgccacggccattcgctctggtcccgtgatcctagacttcctcgcctaggcacatctcagtggttcggaaatgggcttctagctcaagccacttgctttttgcatgaggaaagacttcctcacgcctcgcgttttatcttttaacaagaaaagcaaatcatgtattatacctccctagagtcgtactatggctttcggttaaatttagagaaagtagactccttccctggcctacaagccctgtatgatgtggtccttagtcacgtttatgggcttggtttttgtcacttgctccctaagctccgaccaagaagtatatgaacttttctgttacatattctctacctggaatgtctttcttaggactctgcctccatacatacacacaagtttacctcagagtgactttttccgaccatattcatagtagcttgtaaccccaacattttctcatatagagcaccgatcccacggtttaattactagacttttatattttattttacttttacttgtgggttgtctgtactctgtaagtcaggggcaagtatttggtgaggcc

SEQ ID NO: 17827 - DNA, 2285 bp, Mus musculus
cacaactggtgaagaacctgcaagagggccaggtcaccgatccccgggggattcccctgccccctcagtgatcctcgttccctctcactgctcccctttgctggggagtgagggtggaacctatgaggaaaacagctcaggttttattgctgggaatagacaacctcagtgctgaactgtactggagaaaaggggcaaggtacccgctgaggtgtgtgggctgactggaggtcctggatccccctactgctcccaggaattgggctcctgacagcagtctgctaccacaaccccaggcgggtgtcaacaccagcaaatgctgtgtttgcagcatgcccaagatgaccctgctcctgaacctctacctagccactggtagagagaggagagaacgtggtaatggcagcaacactctaggcatgagagcaccggggaccaagccatgtggctttttttttttttttttaaactttgccttcctggacaacttaaggtgtgtctcttaattctctcttacagtatttgtttactttggatttttgtttttaatctcaaaagagagagatgtgtttaatggacacaagctgtagttctcagcaaaactttgtcagttggcactgtttacaagtctgttagctgcataagctcaataaaaagttggtctgggcattgcatcccctctgacagaccgatagctgcatcaggctgttgggtggaatgggaggcaagggaataggaaagccaaaggccaagcaggaactctgtgcctgctctctgctcctgttctttccctcccatacctggctgctgtgaggacactcaccttgttctggcttcagctgctagcctacccacatctcagcgctttccccttttttaccacttagacttaaagcaggtgtcttaatttactcaaccttccctaaaagagaattgtattggggcaggagggatcgcagttcttcaaattcaggtcttcgaagataatttccaggtgtcttctcaaacggagtaagcgcctggatccaaatggtagactacttgaccccgttctctagcgtgagttttcatagtgccatctcctcatgattgtagaagcagctgaatgagtttcttcagatttaaaatgaatagctggactctgctggctcagtctcctctcctttttaacacactttcttaggtctatggaaactacagggttgccactgaaatgtttttttacttgttgatagtgtcagggccccccttccatccccatgggcttgactctcaacctgttactgtaaactgcgatccttcccaccgtcagcctttgtttctcatcctcacctccaaagatgggattattaatccaactctagaaagagtccaaatcttcagcccgtgtctcatacacttgaagatgtctatattgagtttgaagaggttataaagggacagatggtcatagaaacctttgcagaggcagttgtgccaacccaagggctctttcattgttcgttggcttctgtctttaaagccaagaaagtagtaattaagtagcctagatttaaggagggtagaataagcatttattcccctgccttccaaattgaagaggaggacttggcctcaagcctgaagaacaaaagtctcagaaagcaaagaacagcatcaccttgataaatgtcttgactcagtctgcggcttgtgatctgaaaagttctctagggtaccctggtttttgaaatatgccttcctgctgagctgaagtctttcattccacttcactgggggagcagctgaggcttggggccttgctccctgggacattctctccatcttttggtgcattggccatattactgtgccaatagtgtcttaactcatgtcccatctatcctcagctggccttggacctacataggagttgaatggggaggggctacaatgggtcttcctgtggttggtcctgatgttgtatgtactatataaagagacccctccccttatattgtgttttccatccctcaccctcaacaggattaaaataaaacatgctgggtttttttgttttgttttgttttgtttttaaattcttttaattggagagtttattctgtcagcatagaaatgtctaggcactttaatctgatgatcattgttagacctgcctctaccctgactgcttacacacagactgtcctgcctagaggaccgtggtggttcctttgtggctagacttttaggcagttaaaaggctacagcttctagctgtctcggatagtggcccttacctgata

SEQ ID NO: 17828 - DNA, 1214 bp, Mus musculus
ctactcaagattacgtttctataggaagtagtttaggaattctggtagaacactttactagcatgcacaaagccctgactgagtccaatccccagcaccttgtcggggttgggagtatgagcagtatagagactagagaggcccagctctgaagctaggctgtctttgtccatcccttcttttgcaacctttcggctggctcttaacttctgtgccttggcctcacctataaagtagaaatacctatttcacgggatggtggagggctggtgaaatcagctggttcacctgcagcacagagtgcagacccagcccaaagtattttgtcagtgactgttgactgttatgatttattgttgtgattgactcttctctgcccttctccccagataccaatgcaaccagtgctcctaccgctgccatcgagctgatcagctgagcagccacaaactacggcaccagggcaagtccctcatgtgtgaggtgtgtgcctttgcctgcaagcggaagtatgagctacagaagcacatggcttcccagcaccaccctggcacacctgccccactctacccctgccgctattgtagctatcagagccgccacaagcaggccctcctgagccatgagaactgcaagcacacccatctccgtgagtttcactgcgccctctgtgactaccgtacctttagcaataccacactcttcttccacaagcgtaaggtccatggctacatgccaggggaccaggtttggcagttctgcaatgctagccaagagttggagggggctaggcagtgcctggcacctccttcagactcaggaccttcaagccagctgtctgcccagcctgagagagaagaccgtgaacatgaaattgtggctaactccaatatggaccaggccctgccagagacaaatgaggaggccagccccaaaagacaagatggcattgaggctccccaagaggatgatcaggttgacagccccagcctgggggaggtggaagagggtggctgcacactacacttggaggccctgagagtagagctagaacctgagactgagccactaccccttgaggagctcaccgaaacagccactgtggagttcaggcctctggatccctcaggaccattgggaacagaaagaccaggtggactagaagagccagcactgtccagctttgacagtattgagacgcctgccttggttgc

SEQ ID NO: 17829 - DNA, 1241 bp, Mus musculus
taatacagcttgccagcttgacaccatctgggataaaactacccttagactttaaggggatgggattttatccttaggctctttcttccttagttgcattaaaagacaagccatctggctgtagtggtacatgcctttaatcctagatcttgggaagctaaggcagacagatgtctgagggctagaggttgtcctggtctacataatgagtttcagaattgccaaagctgtatagtgagaccccatcaaaaaaaaaaaaaaacaaagagcaaaccagcgggtgtctgggtgtcaggccactgtgttctgtgctcctggctcacgtgattacctggtaggatgcagagaggaaattgcgcagtggttctgtctgacagctgtggaggaaggtgggactatctgtggtattaataaggaatgtatggaatggttttgatgtttcattcatgaaggcttggactagaacttagaaagcatagagatgaatgtgaagtcattagtgaggttgctttttagggcgtattggccttaggttttatttccttagctcctgtgtcctattgctttggtgtatctattgtgttgcattggtagggtaagatgtgggttcctgaaagaggactgaattaaattgttagtcttttgagtgtatccagcattcattcatgcatgtgggaagtcttacaaagtcattggtaaggcgtggttccttcagtgctagtcttctctattgtatgtatacaaggtgattgtccctcatatacagtttccatgtttggacttggtagaggtgcatttttgtcttttctttttgaggacattgatctcaatactgtttttagcattcacagtgttttttcgctcagcctcgtagttttgttgtgttgtacctgtttgtattcttgaaagaacttcctgtgggtcagcatttgtagggaaggagggtaatgtcacatgtcttctttaggttctttgttggtattttcctcctagtagttgtagactagaatcttggttcttggacagtactctgatctgaattctgtctgttgcctggtaaatagacagatgtgagttatttccctgtgggtgtggtcatgtagggagacacctttccctacaactttgaaaactagataatgttttgtgagtttatttagagattgaccatactgaagaaattgctgtgaaacaaggcaggttccctgctccagagagcagccaactagagtctggggcct

SEQ ID NO: 17830 - DNA, 1204 bp, Mus musculus
gtcccttctgcagctaaaccacttcccaggctccttccagattgggaggaaggaccggctgtggcggaacctgtctcgcatgcaaagccgttttggcaagaaggagttcagtttctttcctcagtcctttatcctgccccaggattccaagctcttgcgcaaagcctgggagagcagcagccgccagaagtggattgtgaagccagtaagtgaggcagagggagaagtagatggtgggatgagggtggagagacagcagatctcatctcttgccctttgacttgtagccagcatctgctcgaggcattggcattcaggtcattcacaaatggagtcagctccccaagcgcaggcccctcctggtacagaggtgagcccatagctcacagtcctctctccatcttcctgtcttgttggtctctgagttaccttcttagagtgttgtacctcgtgttctcccagccaaaggccttcctttgttatctgtttagggtcatctggctggcaataaggttagcctttccttttataggtatctacacaagccctacctcattagtggcagcaaatttgatcttcggatctatgtttacgtgacttcttatgatcctctacggatttacctcttttcggatggactcgtccgttttgccagttgcaagtatgtgctggtgatgaggcattcccctgacacgggggattttctgtccttgggaggacactgagcagaaaactaacaagaggtcatggttgcttccgtcagtaaggaggagggtgggaggctgggaaatgaggaaagttttcctgcaggcctgaggttgccaaggagattagttgttgtttttctataactttggcctttcaggaactgaacaggtctgtgcactagtcctttatcgccttcctggggaaacgcttggcctgacgtttctttgttcttaccatcttgttctgccactcttctcactcgcaggtattccccttccatgaagagtcttagcaacaagttcatgcacctgaccaactacagtgtcaataaaaagaacacagaataccaggctaatgctgatgagactgcatgccaagggcacaaatggtactgagagcagtgttcgtcttgaacctgggaaggaagggttttgcctttgggaggtttgcgacagtcgctgagtattagtgcagagtctggaggttatgcaagtgc

SEQ ID NO: 17831 - DNA, 1094 bp, Mus musculus
ttagaagcctgtatacatcatcaggtgtcgtttgtagtcccacgggagtcctggagacgtagagcgccagagcttccttgcctgccccagctgcttgcttcagtgccagtgtctcactgtccgtcacattgcccttctccctattccctggggcacaggacttctatgcgtccgtgctggacgtcttgacaccagatgatgttcgggttttggtggagatggaagatgagttttctcgtcgtggtcaatttgaaagaatttttccttcccgaatctcttctcgatatcttcggttttttgagcagccacgatatttcaacattctcaccacccagtgggaacagaagtaccatggaaacaagctcaaaggtgatatgcctgtcttgcccacaggaggccatagttagtagattaaatcccaatcggtttctctggacaggaggtagggaattgattgttccccattaagtcccggcctctgctcatctcgtccaggagtagatctgcttcggaattggtgctacaaaggcttccacacggggattgtctctgactcagccccactggtaagtgatgccacgcaggaacacagctttttctcagctcctgagtgtgttatggttggcctatgggttaccctcctttcctctctcccagtcccacctctttggctcgctttcaaggatacagttactcacagaatgtcctaggtgcctatctttgaaggatcaaaaagtgatgagtagccttaactttctggttctttgggaatgagccaagagttgctcatgactccatgatgtggtgtagggcaggtgagaaccctgtgtgtaaaggtgagagcggcagagctgagcacgagtcccaagaccctgagtgttccttcctgaactcagcctgctcccttaaacttactgcttcctttgttatagtggtctctgccaacatcgctcatgactacctcaaagggtgatgggacaccaaattccgccagcaagtcacggtgagtactagttcagcaagagaaggtttatggagttggggagtctctttcctctttccccagatcatgacagtaagaggaactctccacc

SEQ ID NO: 17832 - DNA, 2952 bp, Mus musculus
ttgaccagttggcatggagccctggaaagatgacctaactgggttcaaggtcacagaatgggtgaacatgacagtcagtcctaatgctgtgttgacagttgtgaagaaagctggatagcaaagtcctaagccgtgcttcctgcttaatgataaaggcttcaaagtcagacagtggagagtccaagctgtactggaaaatctgttctgatatcaacagccaacaccctcttgtcctggttacagtatcctagtgcacatgtgacaaagaggcctgttttagctgattcactccttcaaagtagactcttaattcctcagcctgcctctgagagtctcccatcatagtttccaactctgtagctgcagaaacaggccaacactgaccagcccactagttgcctggagtccaccagacttggggaccccttgatgagacacagcagtatactggcagttctgttttgtgttctggggtgatccagccttgcctgggacttgtaatctttgcctcaaaaatgccagattgtctgggtgtgttgcgcccagctaaatacacagtattcagtcttcgttacatttgaaggctggtgaatctgtttgctagttggagaaaaagatagggcttgtatatcacatttcattttcaagagtgtaatcttaagttatttcacatgcatgttttagcactggctagtcaacaatagatagcattcggctgaatgaggacttttaaagtaaaagcttttgaaagttttaaatttgtaagtgtacttgaatacaatttatcagtacatcagatgtttttccaagttggtaagttacccagcctctggaggaaggctcctgagacaaggaataaagtcgtcttttcctttataatggaacgtgagacctaccctgcagggttgtttagtaagctaagccaaagtattggggattgcagtttccgtttgttggtttattgtccaaacattgttctgtgaaagaaatgtaaaaaaatctttccttgaaactgagtatgatagctcatacccttaatcctagcactctgggaaggcaggagtgggttgataaaacctctcctttaaagaaaagaacagctacagaagtctcagaagaggccagagcagtgtctatacctatcacccttcactcagagcttgccgaagcacaattttcataattccctctaatctttatcgttccagcgggagtctcttgtctggcttcatctttatagcatcccaggaaagggaacattaaacataaatgtgtgtgaagtgatagtttggttctcccaagagccttgattggcaaagaataacaagagtgtctaggacagaaactcacagaatacagaccatgaggactgctgtgtggacctagcaactaccaggggattgtgtcatttctggcccatcgtcagggtggcagctcttttgctgaaagcgaccatagccaaagaactttcttgggctaatccacacagtgatttccacttctcctgggatacgacaatggttaaggctgctagggaacttgccctgttggcttcttgttagctctgaagaacccctccgattactgctccaacaaatgtctagtttgctctgggcctggaaacaatggtttctagagagctgcatcttatcgtttggaattttggttcaagcctcttcagcatgcttagccttgaacattaatctgtagtccctggggaccagcgtgtattcaccagcttcaggtcagtgggagcagcaagcagtcagtagaatttcctatgtgagtgaatgatcacagcagcatcggcaggcatgtgacattctcagacctgtttctgcttttgtcattagaatggactaagatttggtacatcagggattaccacagaagtcaacaaatttcagtttagtaaccagggatatcagtttcttagctgtagtaacggggattaaattgtgtttaaaaagtgcctcataactcagataattcctaaaatatcaaatgattcccccaaaaccatttcctcagagcagcaggagtgcggcgccaggaattgcagtactcttagcttagcagttctgtggcggagctgtcacagctcagctagtgtgctcaggcctgtggtcaccgtttgataggatcaggcttgttttgttagtgttcctaaactgtgcaactatttgcatagcatttccgatgtgttgggtatagagttaatctagactccatttgaagtccacaggaggatgtgtgcaggttaaacttgagcagcaaatgcagctccatgttgcctaagggattgaacccctgtgtgctttggtatctgagaagttgtagaagcagtccccacagaggctgcagaactgctgtggtcctgtctgtgggagattattagagctgaagatttgatcaagataattaccttaagagtttagacccctctctgcttcccgagaggcacaagtaaaacttaacactaagtggtccagctggaatgccagtgtctggaaatggagagccattggtagggatgcgtgtattgctggcaaggtgcacaggtccactgatggtttggtagtttctttaaaagtagaacagcccatgtggacagcagtcaatgaaagaacaaattatttagtagatactgtctaaacatctgcaaggaaaaaccaatgccacatctgggatgatctctacagtattgtgctgagtgaaagaagccagaagcaagcctatatgcagattccagtctagaaaatgaaacaaagcttacaaaacacagggattccttggggactacatctggaggggacatgggattgactgtaaagaggcacatgggaatattctttgtcttaattgtggttgtggtaacaactgtatatagttggccgacctcaaaattgtcctgttgaaatgagtattatacataaattttataaataaagt

SEQ ID NO: 17833 - DNA, 1180 bp, Mus musculus
ttcgaaatgcccgtaagccacttcaacgtccccagatcccaaactctgcggttgcaatactagactatctacattttactaattgcatacaactatgaccgtttaagagcgcggctaaggctccttccatggccacttaaggggcctgggtgaaggagagtccagaaagccagtcacctgcaaccctgcaggggctccgcgggagctccgtaggcagacgcccaaccccacgcccgggcctccgcaggcccagctcccctccagcagccgagccagacttccgcggaccagcgaagaacacggctagccagcttaaaaggcaccgactccggggagctggagctcgcctctcacttccgcactgggaaccggagatctcgcgagatctcgctacagctagcgttctagccccggcggggtcaacccgggtcagcaccccggcctccccctccatcactgcccactgcttgttctgtttcctgggctcccagtttttccaaggaccggtttgcattagcacgaacaagggtactaaagcctttggttctttacatgctgtagctagtcgcattggtggttcagtggtagaattctcgcctgccacgcgggaggcccgggtttgattcccggccaatgcattgcttacttttcttaaatggctgtctcaaatcagaaaacagcgctaaagattcggaccaggaggcggtgacacccttgcaccgctttgggtgcatcacataggtctctatccgtgtgatctagtcctcatagtaacttctacagagatgcatgctttttcctcccctactcttcttatggaactgggtaaatcatggctccaggagcagccgtcgatcgctgacaacagttaaaacgtggtcctacctcagctctaagacctcctttctgtagtacagcaattgtcaacagatctctccacctcttggcttcccagggaatgccgttgcctagatttagatccaccacagcctcaaaggaacatgaaaatccatatattttttttaaagatttgtttatttatgtaaaagtacactgtagctgtcttcagacacaccagaagagggcatcagatctcactacagatggtcgtgagccaccatgtggttgctgggaattgaactcaggaccttcggaagagcagttggtgctcttaactact

SEQ ID NO: 17834 - DNA, 1125 bp, Mus musculus
ctatctatctacaggtcatctttggtctgaagttctgttcatagcctcatttcctatcagagtccatcttacttcaaacactttacccttgccttaggccctggatttgctgtgttcctggtaaccacagggcctttgcatctgctgtttacctagaacactctgactcctgccttctatccaactagctgcccctctctccatctcttacatctcgtctcacttcttcaagagtatttctcctagtcgggtgtggtgattcacccctgtaattacaacacttgctaggtacaggcaggaggacctggagtttaaagccatccttgactacattgcaagttcaagaccgaccaaggctatgtgagatcctgtctcaaaataaagggggaggaggaataagagctgggagaagtctatggatagaacatgaccactgcactcatgaactctcagcagctgtggccacatgcacaggacccatacaaggtcaaggcaatcaccactccagcactgaagcatgagtggagtaaaggctcgtgaggcttcacccctagctgaggagctatgctaggtgatggctgctagggaaggacagccattttccttcagagaaggtgcttcccgtgttcttcattccccaccccatgcacatgtgggcagcactgattggactccgtgaataatttttttaaaggccatgaaaagggagtgggaagctgggcgtggtggcgcacgcctttgatcccagcactcgggaggcagaggcaggcagatttctgagttcgaggccagcctggtctacaaagtgagttccaggacagtcagggctacatagagaaaccctgtcttgaacaaaaccaaaaaccaaaaacaaacaaacaaacaaacaaaaaaaaacaaaaaacaaaaaaaagaaaaggaagtggggatgtgctggtggggagtgggaggaggagcaagatgcattgtatatgtgtatgggacatatcaaaaaacaaaattactcttaaaaagagcacttctaaaaataaatcatctaaattttaaaaaataaaaccaattctttcaacctctctaatagtatcattattgctcattattttctctcaccataaagcctagttg

SEQ ID NO: 17835 - DNA, 1157 bp, Mus musculus
tagtggatgtgatgaaggctaggggcatccttccgtagcctgcagttgcttccctgcctcatcccttgtcattctactgtgtcctaagccctggtggtcgaccttttctttttcttcctatcctcagggacctgtgctgctccaccctcgtgtcccacttggttgtttagttgaggcactttataattttctctactgtcccacactcccgttggctttatttccctgctgtctcctgtcctttgcagcgtgacccccactctttgccaactcctccttcccacaggcactggccaagctttagggcaggttctcttctgagggaactgggtggtgtcaggccagcagtgctgtgcttgggtcactgtcgccttgaacctacactgtacccttgtccagctcagcactcatgatgcaggacagcagggtcccctagcactttgccagcactgaggatggcatgttctcttctcttttggaggcgagggacttcccttctgtattaggggagaagaacagaacctactcgtctggaccacagttgagactccctgctagggtgtaaagtggatagtaagatctgtgtaggtgttaactggaaaaataaactgttgattggctagaactgctgcctgtctgcctgcttgtctccctgtgagccacctcccatactgcactctgtcccctcctcacccagcactgcctctcttggctattttccttgtaaacagccagaggcagggattatcctgacaaccctacctgcttctcggtcatacaaagtgagatttagcatgtgtgaatacattacatgcaggaggaaattgccctgtcttcccagtcagtgggacatggagtcatgataaccgtgcctttaatactgtttctgtaagtcatgtatctacatgctcacaactcaatcttaattgtctgtagtaggacaactaaccagcagtggttatataagttggttaaatatttatataaactggttaaaggccaagagactagtatccaagattttttaaaagtatatgttcttggcactgttcttatttatttatttatttatttatttatttatttatttatttatttcagagacaggatctctccgtgtagttctgactggcctgaaacacagatctgcctgcctc

SEQ ID NO: 17836 - DNA, 1176 bp, Mus musculus
gccataccaatggcagtaattctgataaataccatgttgactatagaaagtaaagatggaggtcacactctaaagtactcagtaccatgataagctcttcctttccagttctcaggaggaagacgacttggcgttagcacaggcactgtcagccagtgaggcagaataccaacagcagcaggtaagaggactgtgtgggctgggtcctgtgttggtcctgcccagctgtgggtagtattgctgtggggtggggatcgtccctttgcttccttccagtgactccagctcaccctgagccctgaaaggaagcctgtcccctctggtctttgacatcacaccatctcctccttctcctctccttgctccaggcgcagagtcgtagcttgaagccgtccaactgcagcctgtgctagggccctgggcttggggagagaggctcacccaaggactgtgaccctcacatctccagggtccacagggaaaggaagcacagagaagcctggacagcagtgccaagcaggagtgacgtggaggacgctccatggagcccggagaggaaggacactcatgcagctaagctagctctgctgctgcagaagagggtggccgggaagtgctctctggttggggccttggtaggtgctaaccagactcaatccctacagcctttttcatcatgttactcccttttccctggggctgccacatgtagcagacagggagagggccgggaagagtaaagactggcaatcagtaagatgtatgagtgctgtttctttttcgggaatgttcattcagctcaaggggagagaccccttgcagtaccccacacaaccaaaccacagccgtccttgcgcaggccatttatttcctcacgatgctttctggaaggtcccttttccttacaatagctagcaccaaactcctacaccaggatgaaatgaaggcaagagaggggacatatctttttctcctgagttcgcctttggaaggaaagaggtcccttttattactatgccgtgtcctgaggtttagattcttcagggacagtttcttgtccttgctgctgcagctgccacatctcggcataaacgccacctcgggacagcagggcttcgtgcctgggatgataaagcaaggttaagtcccactcattggtttcacttcaatctcaag

SEQ ID NO: 17837 - DNA, 1183 bp, Mus musculus
tttcctttcctccacaggtataggcaaggcggtagctggttcccatgctccaggatggaggtggcagctgccctgccatcccttctgtctgccatgagagggactctctgagtgtcgcctggccccacgtgtggtgttttgtgtgttcctgcctggccaagggaggtgccaatgctgggcttaccatagtccaggaagaatatgaggactaggggcacacaagagtctagcttcgtctccaggactcccttggctcagagtgtggtgctagaaactggtccccagcccagtcccagtactgccatctttgcatccacccctgcaagtctccagagggcttcctgccacagaagtgctgccaagcagaagaacctgtgccaactgtggagtggggaggcagggcctgaaccctcaatccctgcagcctagcctccccaccctccagaacctggaatagctgagcagctcaggctgtggcccttacctccagtcctcacctcaacctgcgctgcagcctccctcccccctgcacatcactggcatgtgtgctgcttgaccacccccccttctgttcacctgccccccttctgtttggctttggctttttgttggggtgagagccctagctcccagctcccctcactatcttttgacactaagatggaaggttactaagttgcaggaacaggatgaaaattctttattaccctcttcaacttttaggacgagcacttgggagtgtgaggccttcctggctgcttctatgtagtcctaccacctgcacagaggggctggcagggcagaagtgtgacctcagttatatatacatcccagctctgcccagtatccctcacttaccaagaggagaatggagggataatggactcaccctagcctagggcttcgacattgcatgctgggatccagctcctacccttcctgcactcccttccccagttctgctcagctcagctgtgggaggtaaacttaagctgaaggtggcggactctactgtcgcaggccacagcagacagggtgggagccctgtacagcttgataacccttaataaagaagggactttgatctggttgtggcatctttttttttcccccacgcagcagtttgggggggggggggggggtcttaggactgtaaaagagtcctggccgggaggcttgggaa

SEQ ID NO: 17838 - DNA, 1159 bp, Mus musculus
gatttggccaatttggaatcttagcagttctaggtggccttcagtcctctgccttccccctcccacaggcattcttcagcattgcgacagctattgtcttctatgatgactgtggacccccagcagaggcctcacatccctgtcctcctcagtcagttggaggcattgcagccaccagctcctggccagcacaccacccaaatctgatcaaatcagtggacatattgggaagatgaccttgaagtggctttcatccctcattggaactccttccattcttccaggatggctctcacagctagtggcaaggatagtgggtccttgtatattctgccttcttaccccaatacctgggcaaggaacctagggtgagttgggggaaaatgaaacagaaaatatggctcaaagctaggctgctgggtgcacatctcattctgtctccagatctgggagcaggagaatacataaaaaggagaataaagtaaaaacagaccgtgtatattttaggtcaatgtgtctggagggaaagaatgaactctctgcttgctatttccaagggaagctcctggcaagaagtactggtatgatgtcttgaggtagatctacttcttgagttctggcagcaggcaggtcttttaagctggcttagtcaaaaccagagagcttcaagcttgagctggtttctgtctgtgccaagaagtgggaccagggtctccttgaaagcacactcaaccagttctgtcattcattcccagggtgggtagcttagaacagcccagctccgcaggtttgccaagtccatgtgacctctgggtggaagcacaccgggtcttttcccttcttcagcagaggacaaagggagtggagctggcagccatttttttccagtttccctgactattctagctcacacatggttaataattgatgaggctggtggcctgtggcagtacccagcagccacttcctgccctatttgctgagtaaacaggcacctgccttagttgggtttcaaactttcctcagggaagggcactgcttccctgagtcaccagggaggggagacaagggcagggatggtgctcctgttctggagattccacccctacatgctgacgtcaacatgagtcctagggtgcctattagtgaagtataattt

SEQ ID NO: 17839 - DNA, 3315 bp, Mus musculus
ggttgagacacctctttgcccacaggaaagaaggggagagggttgtgagaattttcaaggcaaagattaaccagggaggaagctgctggctataaactataaaacatatttctagacgctgcacgatctggaagcaactggaaagtcttctgtctctcggtgtctatccctctctgtgtctttctctccctgcacccttattataattgctgaagccctgcctgtcaggtgtgcatgtcctctctgtcctgtgtatcctgtggatgtaacaggattatacagctctcacttggtaaattctctactgagaagtaggctaaggggttggtctgccctgctggctacctccagtctggggagccctgtgctgaggagactggagaggctgccagctgcttctgaccaccatgagtcccaaccttaccatacttttaccaactgagtaatctcagccaataggcaaaagggtgagaaagaaccgaatgaagtgggtagttgtgggtaaggacttatgctgtgaccttctctgtatccctcagcgcgagtgcatttcagtccatgtggggcaggcaggtgtccagatgggcaatgcctgctgggagctctactgtctggaacatgggattcagcctgatgggcagatgcccagcgataagaccattggtggaggggacgactccttcaccaccttcttctgtgaaactggagctggaaaacatgtgcctcgggcagtctttgtggacctggagcctactgtaatcggtgagcaagggggggaggggtccccttttgaggaaagtggagtgtctcttgaagaatgtcttggctgggtttttgtgatctttgaagcctcttggtttatttgaagctgaagatggatgctggcagaaggatgagctagctcttttatctatctggcttcagctgccactcagtgggtggggagggggaaggagcagagtcaggtggtttttgcaatgtgatatatggtttttcagatgagatccgaaatggcccataccgtcagctcttccacccagagcagcttatcactgggaaagaagatgcagccaacaactatgcccgtggtcattacaccattggcaaggagatcatcgacccagtgctggaccggatccgcaagctggtgagactacatacagcctggcagggaggagggagctttggactctgtgctcaggaaaagtatttttttcggatccatttctaggatgatcactagttgtgtctcagaaattgatgctgttaggggatattcagactttgtcctaacatctgagatactttagaccttacaaaactagaaaattcctcaggcctttcccctacctatattgctctttcttccttgcctttcagtctgatcagtgcacaggacttcagggcttcctagtattccacagctttggagggggcaccggctctggcttcacctctctgctgatggagcggctttctgttgactatggcaaaaagtccaagctggaattctccatctacccagccccccaagtgtccacggctgtagtggagccctacaactccatcctgaccacccataccaccctggaacactcagactgtgccttcatggtggacaacgaagccatttatgatatctgccgccgtaacctagatattgagcgtccaacctataccaacctcaaccgcctcatcagccaaattgtctcctccatcacagcttccttgcgctttgatggggccctcaatgtggacctgacagagttccagaccaacctggtgccctaccctcgcatccacttccccttggctacctatgcaccagtcatttctgcagagaaggcctaccatgagcagctgtcagtggcagagatcaccaatgcctgttttgagcctgccaaccagatggtgaaatgtgaccctcggcacggcaagtacatggcctgctgcctgctgtaccgtggagatgtggtgcccaaagatgtgaatgctgccatagctgccatcaagacgaagcgcagcatccagtttgtggactggtgccccacaggcttcaaggttggcatcaactaccaaccacccactgtggtgcctgggggtgacctggccaaggtgcagcgtgctgtgtgcatgctgagcaacacaaccgccattgctgaagcctgggcccgtctggaccacaagtttgacttgatgtatgccaagagggcttttgtacactggtatgtgggtgagggaatggaggagggggagttctctgaggctcgagaggatatggctgccctggaaaaagattatgaggaagtaggcatcgactcctatgaggacgaggatgagggagaagagtagaccgctacttggagcctgttcactgtgtttattgcaaaatcctttcgaaataaacagtctccttgcatggtttcttgtcccctttgtaactgcttgagcctctgcttgtccccctttctgctttggctgctacctcccgctattggccgcttgtgaccttttaattttaccttcacatggctgacagtgagacttgccaagggggccccatattgagccccagaaagcaggaacccaaggacttcaatgtaaggtcctaaggactcgcagaataggaaagaaacaaggaccaaaccctggacctgtctgtctagctacaagctattgcaagatacaagtcttcactttctgaaatatctgatagtctgtgttggatgattggactactttattcttcttgctgctgcttcactcaacagctctagaaggcttggcccaggcgtcattgaacactgaggatttgggaatgggggctgggcgggcccaaagttcccgggcatacagccacctcacaaacttgggggatgggcaggaacaagggcaatctagttgtttgtgccacagcacctctggcagctttgcatagcttgctgtctatcttgctttctggggctggagccatgctattaaaagtcaggtcgtctcccctctgtttgtgctttcttttggcttcagcctctgctcggggtggaagcctcctgcctggaccctagggataaattatacttcactaataggcaccctaggactcatgttgacgtcagcatgtaggggtggaatctccagaacaggagcaccatccctgcccttgtctcccctccctggtgactcagggaagcagtgcccttccctgaggaaagtttgaaacccaactaaggcaggtgcctgtttactcagcaaatagggcaggaagtggctgctgggtactgccacaggccaccagcctcatcaattattaaccat

SEQ ID NO: 17840 - DNA, 2243 bp, Mus musculus
gagtatcactgcctgcccacagagtctctagttgtatactggctctgtgaccccgtactttgctcatggcccctttttcccctgcccagtgggagatccagaataccagccgactggctgctgatggggagagagcctctgcctggccagtgggcatcccagcaccgtctcgccctgcctcacgctttgaggttctgcgctgggactacttcacagaacaatacgcgttctcctgcgccgatggctctccccgctgcccgttgcgtggggccgaccaggctgatgtggctgacgtcctggggacagccttagaggagctcaaccgccgttaccagccagcgctgcagctccagaagcaacagctggtgaacggctaccggcgttttgatccagcccgaggcatggagtacacactagacctgcagctggaagcgctgacaccccagggtggccgctggcccctcacccgcagggtgcagctccttcggcccttgagccgagtggagatcttgcctgtaccctatgtcaccgaggcttctcggctcactgtgctactgccgctggctgcagcggaacgagacctggcttctggcttcttagaagcctttgccactgcagccctggaacctggtgatgcagcagccttgaccctgctgctgctgtatgagccacgccaggcccagcgggcagcccactcagacgtcttcgcacctgtcaaggcccacgtggcagagctagagcggcgtttccctggtgcccgggtgccctggctcagtgtgcagacagcagcgccctctccactgcgtctcatggatctgctgtccaagaagcacccactagacactctgttcctgctggccgggccagacacggtactcacacctgatttcctgaaccgctgccgcatgcatgccatctctggctggcaggccttcttccccatgcacttccaggccttccaccctgctgtggctccacctcagggccctgggccaccagagctgggccgtgacaccggtcactttgatcgccaggctgccagtgaggcatgcttctacaactccgactatgtggcggcccgtggccggctggtggcggcctcggagcaggaggaggagctgctggagagcctggatgtgtacgagttgtttctgcgcttctccaacttgcacgtgctgagagcagtagagccagccttgctgcagcgctaccgggcccagccgtgcagtgcacggctcagtgaagacctttaccaccgctgtcgccagagcgtacttgagggccttggctcccgcacccagcttgccatgctgctctttgagcaggaacaggggaacagcacctaagcccctgcacctgtccctgctcttccccaggaacctggagccacgtgccagcctcgctggacagggctggctgtagcctcagtccctagggcagcccactggtcccttgtctcttgctttgttggacccatgggctcaggacaagccctgagacagatgccctagagccatcctttcttgtccagtccccctgcccccttgacgctgctgattcaggctgtggcctctgtttatgcctgacgccagccttgcctcctgggctcctgtcctgggagctgggctgtagatggattgttggaggaggtgaagctgagaaaggaggggtacgttatctactgccttctcccttctggatccacgataaagctctggctttaataaactggttaagtgtagaataatgagtggaaactggtaatttagtgttggcaaggtaggcatgggaggaccgacccctaaggatggaggaaccctgggtctggagccttcttttcctgttacagggatcaagtcagatagatgcccagcctccagcaagttcatgtggatgctctccctctccctctctctgtccctctccctctccccccacctctctctcacacacacacagagaaacagacacagaattctttgtgcctctttattcccaatttcaccagcactttataaaaccaatctctagggagcaaggcctgagaaggccgctccccctccccctccccctatgctcagccaaggtctgaaaggtctttccacccactccccatgaagggaacttgtggtggggctggtacagggggaactgggagctgggccaggcctgctgggccgcccactccccctgccaagagggagctgggcctggaaagagggaaagagaaccagcccagcatg

SEQ ID NO: 17841 - DNA, 1187 bp, Mus musculus
cctgtgtgaaatccatgatgagtcggcttccttcaccatcaccgtcacaggtgtgggcctatcccagcccccagagtcaccagaggacaaccctgagcctcaggaatgttgagtgaatatttctccacatgcaagcttgttgtgtctgggagggagagtgtgggttgagggtgcatgcaccagggtccctgctggaaagagcctggaatcccaatcagaaacagcaagcccttctctggtgtcaacaaggccaggtctagctgtggtccaccagctcactgactgaatgccatccaggctgggtgcctggctggtggtcagttagctgccagactagctgggaaggcagttgctatccaggggtcacaaatggggagacccccttggactctgactctatgcagcccacagatgtgttttgtttggcctgcagagtcataccaaagtcaggacagtccaaataacaacccggagttttacgtcctcttgaaaaagccgaagacccggcggttctggtctcatttccccccatggcgacgaacggctggcactgagtagcagctgccccatagtatggggcccccatttctctgtcccaccctccctgccatttctcctgcctctccccagactccctgagccattaacttaacctatctggccctcacatttgcaacccctgtgttaaaccaataaacgcaccaataaacattccaagaaacctcatggtaaataagttcaattagggtccagggctccacagaacagccaggcagggagggcctgggcggaggtctcacagggtcactgtagtatgggctgggctccatgcattcgacagcatatgaacacacatgtatttcctcctcaaagaacacagcctagtaagaaagccagacacatgtcagggcataggctgtcaaggacagcataggaaaccctgggctcgtggctgctaacctggtcagggtaatgaggatgtttacctacttgtaatggagttaggctgagttaaggggtgggctgagaatagtccgggtaccggggagtcaaggacagctagaaatatggtggtgatttgtgccggccacctcaggactacagcccacggcaccattcccagggtgcatggtcgtaggggcatttagtcagttctggacatcacagaagaaccccagtggcagcac

SEQ ID NO: 17842 - DNA, 1111 bp, Mus musculus
ctgggcttgcgtggtctctttatggcactgtgggtaactcggtagactagcaacagcaaggccttgtccttgttaggacttggcatttttttggtaagttaggtaagtggccatggatggccaggctggcttttgtagatctccatctctatccaaaccagagccgagtccgtgtgaggcgggctagcatctctgagcccagtgacacagacccagagctccgaactctggacccctccccagctggtaagttgaccctccctgctcactcccttcccacctccttccagacctctctaatctcgatgttgccttacattttggcatcggaggagaaacttgattttggggtggtgtggattattgcggagggcccctcagtctgttgtctttttagtttagcccaaagagagatctgcttccaggcagcgttctcctaaggaacatggattttaaagggtgctaaagattctgtaataaagagatttatggccacagccatttggggagcacgggctgcagcaatgtgaagcaggtttcttcctacagctcgtcttagacctgagatgtgtggccgtggttgggaagcgccacacatttagttttgtgtgtggtccagactggcttgtgggcacagtattccataggacgctcctgaggacattctgcggaggggaggcctattgaagaggagccagagaaagaggctggggtcagccagggtctgggtgtggcctcagctctacatcctcctccatctcagggtggtttgtgcaacaacaccgggaactggagctgctggccagcttccgggagcggtttggctgtgactggctgcagtacaggagccacctggagaccatggggagctcccctcttagcaccaccaagactcctgcccttagcacccctcctctggatgtccagaacctggagactgtatgcagccctccagccatagaggacgacactaaggaatcgccagagaaggtgtcagaggaaggcagggtggagccagagccccaggaagaagagagggaagaacaggataaagaagagggatcgagagaggacctggaggaggaggaggagcaggagcagaaggcagtgg

SEQ ID NO: 17843 - DNA, 1145 bp, Mus musculus
gggtgattggctagatatgttccactcatcctgtcaagaggccccgggccattgcttggctggtgtgctggctcccttagtatagcactgcagggcttttggctgttagtggtccctggagtttgtggaaatacagtgctgatctgtggccaactctttttttttttttttaaatgtctcaaaatgtttaataaatatttcctctcagtagcaatgttacatgagttttatatagatatagacagccttacttacaatgctttgtgttttttttttctttttctttttttttttaattaggtattttcctcatttacattttcaatgctatcccaaaggtcccccatacccacacccctgtggccaactcttaagtgtggctcacacctcttctccaggacagcactgggacactagtcctggggatctaggtccagcatagcctttcactgtaggcatcatcttgtctctctctctctgcaggctcctctacctgtcctgtgtccctgttgctgacgttgtccaccctgtacctattagatgaagaccctggagggtcccatgcagagtctcctctcccagtggtgtctgatgaaacctcagagcagcctgcttctctggggccaggtccttccctgcaggtcagggagcagcaaccactcagctgtctgagttctgtgcagctgtatcgcacaagccctttggacctgcggctgatcttctatgatgaggtgtgtgtgtgtgtgtgtgtgtgtgtgtgtgtgtgtacacagtgtacagtgcatctccgaaggatggggatagattgggatggtgctaaggaaggcgcaggtgtatagtggggacagagtcctgatgtgaggacgtgggtttggataagcagcaggtgtagaaagcagcagtcaactgtggcagtgtcctggccttggagcccggtactgaaatacctagctggtgtgagttggtgtgatcagcctacccacactgtatgccaactggttgaccttcacaactccaacatgaggaggaggtgctgttgttgatcctgtcttacagatgatggaactaaggctcagagacatgaaacttgtgcaggtcacaagagtagagtcaggagttgaacctgcacagttcttggaattgac

SEQ ID NO: 17844 - DNA, 1148 bp, Mus musculus
atggtaagtaccacatatgcatatgctgtcccttttattacttttttccttttcttttgttaggctaccaaaacaataacagtaataacacccaatagtacaaaaatatttttgaggtactaaatactgtgctaggtttatatattctatcatttggtcctgaaatccctggaatgtggctaccacagtgtttcctattttatagctgtggatatttaattccagtagtttaatgtgcacatctaaagttctaactattaaggagcacagccaagattagaagtacctgtgcagcctgacactctgtctgccatcatagtaattctccttacactgttctatggtctttaaaacattgtttacaatcataccatttatcctccaccacaacaaggtagaagatatcttcatttttaagaatgcaattgagtcattgatctagttgagacttttattatacacatgcatcttacgttctggtctatcctctttctatgatacagcttattttttctcttctctctctctctctctctctctctctctctctctctctctctctcttattttaactcctctgaattttctcctccctacctctctatccctaaatctggatttgtagcatgtgaacaaaacagtaaataatttattgggataaaacaaaacaaaacaaaacaaaacaaaaattcaaagtaaagaatgcatttttgtaccttactatcttagtcccaaataaatgaatgcaaatgctattgaacataaatttaataacctttatttattacctctatgtgttaaatgtgcttgaggcaattaaaatatgtatcacacacagagagacacagacagagacaaggagacatagagcgagagtgtaatcaagaacgagagagagagagagagagagagagagagagagagagagaacaggagcaaaaaggatgtagactgtacaaacctcatcaggtaagccacttctcttctggtgtttgtttgttttccaaaacatctcctttatctcctgcagtggtctgaatatgcttggcccatgggaagtggcactattaggaggtgtggccttgctgaagtaggtgtggcttgctggtggaagttcattgttgtagctgtgggctttgagagtctat

SEQ ID NO: 17845 - DNA, 2470 bp, Mus musculus
tccatatttcattcctgtacggccccgctgcatccgtgtggcagcaagtgaccatatgttacaggttttactatggacgccaggtcaggcgccaccacgcagaacaaagccagttccgcaagctgcctccgatacgcaatgctaaagtgacattttacccagggtgtgccattgcagtgatataaatatatttttttcctagactaaaatatgacctgaatatctcttttgatgtgtgtacatagagtgtgtgtgtgtgtgtgtgtgtgtgtgtgtatgtgagtgtgtatggggtgtgtgtgtgtgtgtgtgtgtgtgtgtgtaacctcatgcttagaactgcctgtgaatgttgtggaatgctatacctggagagttctggtttattaccagttcaaagataaggaaagagtcacatgatatacaagacccggagaccatgtccgtccccttgggaagacagcttggaaacgctacatgttctttatctgtaagtgtaatgtgtctgtcacattcatcctaagaagcagttctttggacagatgttttcaccttgatggtggaatgatttttagatataagcctgactcgccgatttcacaatggagagagaaggggatggaatccaatttgtgaccccagatggagtataagtcgcctttgtttccctgcataaatgaacttgttgaatgcgaacaaatatatgcaattcatatacttttggaagatgaacttaagatatgtgtgtcagccttgagatgatgtgtctggagtaatactttgtgtcccagtgtcacagaaaaatacatacatgccagtggctcttgaggttaatgtagttgggatgaaatggcctctagcaattccaggttccccaattacatgtggaaagttctggtaattaatatgcagctaactacttatgcccttgaaagtataccagtcttctagaatcggagttctggtgtatgaagattcagtatcgacaggatatgtataccaaactccagccagcatactgccattttacttaacctgagaggctgccttgcttattctgagctatggtcacagaaactgtggccatttatataagctataacatcaaatcagggaattagaaaaaaaaaaaacggggaaaagattctgaaccatatattgttgaataagtaaagaaaatcaccaataaatatttattgcattctgacagggtgtatggcattgtattctcataactatgccagagtgacaaagttatttcaccccttttgaggggaccttaatatatttttaaagggatgtgcctatgcattgatgcctgaaaaataggtgtaaaaaaaaaaaaaaagatgaacctctgagtgcatcatctttcccagaggtcaggtgggaggaggtcaacttctgggtctgtgtccagcccaggagcaagcgctggccttgggagctggaaggctaaaatctagtcaaatctactaaacagctttgagctgttccctgcaccaaatcaagccgtttcaccacgtgtctgcaggctctgaggtttttattttttggcgatcttctaaatgaaatgttctggtgtgttttaaagactagaggaaaggttgtgttcacaacatgattactgtgtgtgttctgagacctcttgtattcatctgtgaaggggacgtgtattaatccatacactcctatagcctcgactatttgtctgaagacacttaaattttgaccagtaaaggaaagttctagaagcaatattttcactcctttagcattgtccaaataacatcaagtattaataaacgctgaagagtgtatttattttgtattactccaagtctgttggaatatgcaaggactgtggttataattagaatgtataaggcatattataatttagttcattctgaaaaagaagttagctgaacatctcttggttcatacatgttccaaattttgaacaatcttttgagttagccatagatttttctattttgtttttatttgtcaaggtatttttttcttcccttcatgaactttaggtacacataacttatgtcatttatttatggtcttttatacctagtttgtaaagttgtaaaatagcaaactaaatgcaaagagtttgcatttgaaagtaataaagtagttgccgtatacaaacctgaaatctggttgtctttgttctgtttcattttcttcagtgttggggacaccttttggacaaatgtttcaccaaagagctaagcccagcctcttgttccatcaagacaagctcttggtaggttgctgagcatggcctgatactcgtgttaacgcccattcctaccgtgaactgcaaatcatttggcttctgcctcactagtagctgggattataagcttataccactcttctttggttggctatggttatatcttttcaatatgttcaatttatatgctattgctatataatttgtcatttg

SEQ ID NO: 17846 - DNA, 1462 bp, Mus musculus
ctgcagcgacctggcgagaattggcatcaccgccatcacgcaccagaataagattttgagcagcgtccaggcgatgcgaacccagatgcagcagatgcatggcaggatggttcctgtctgagccagtaccgaatagactcaaaactctcgaatagtttacctcatccatgcactttaattgaagaactgcactttttttactttgtcttcgccctctgaaattaaaggaaaacaaacaaacaaaaaacaaaaacaaaaatatctgcagcgttgcttggtgtaagagattgctgaaaccatggggcttataatgaatgaccttgatcatcagaattaaacctggagccagtaatttctcagaagaactctgtccatcgctggtgtgtaaaatacatgtacttatataaataaaactctgcctctgagtttcgatgctgtatttcccgtcagaggcttttcaagtcaccctaatcctttctctgtctggaatttcaagggaaggatttcatctgtggcattaataacagtcatcactccttaccagaaagaagacctgctgtgcccaggagcactgttaaaggactcaatggtggctttcagggctcggtttataccacagaagaaaatccaggtgaaagccacttggcccattcatgctgcctcttcaatggccaggacacctggtggatttttatgacatagggggggttagaaagaaaagaaaatggatttttaaaacatgcgaactcccaagacctattaaccctaactggacaaatgaggtctctttggggctgaggctgtgccatataaagtcttctttgagaatgctacaaacttctcataactaccttatggatagtgggctgagacaatcctgaatggagaattttcacacacacacacacacaccccttcaaagaggcaactcccaaatttacaaggtaagttgaaagaatgagcaatgactttctggcaaatctctctctctctctctttctctctctcactctctctgtctctctctctctctctatctgtctctctcttagcttgtttcctattgaaacactcatgtcaggtgccaggttgtgtgagattccaattctctttgcatagtagaagacaccaagactaatatggctcccctgttattcttcaagaaggatcattccttgaagtgaggtcaaggtcatgtggccggatcctatactcaccactggctgtctttctctcaagaagggtccctttgccctttaatgccattcactgaggccaggcctgttggttaatacctggatctcagatgtagtgttaggagcctaagtactgaactgtgctctctatcttttgggggagtcccttaaataaggaaccgtttataactctcttatcctggtaacccctagaccagaccagtttagccctggaggatttatcgagtcaatggtgtgactggaaa

SEQ ID NO: 17847 - DNA, 1224 bp, Mus musculus
ggtaaataagtgaatgcactttcattttgttacattttatctcttgggcatgcgcatgtgtgtagaggtcagaggacaacttgcaggggtctgtctcctcctccttctcctccccctccccttcccccctccccctcctcttcctcctctttcttccatcatgaagggtctggggaatgaacccaggtcttcaggcttggcagcagatgcctttaaccaatgaactgtcccaacagtctctaatttacattttatggtattatagatctgtgcttaggttatcatttcaggaggatatctgctttccagagcacccaactgcccttgctatagatgtgacactggagtactgtcatgagaatttttatcccaactatatacatattctcttaaagagcaaatcaccgtttcccctgtttatatatatgtgtgtgtgtgtgtgtgtgtgtgtgtgtgtgtgtgtgtgtgtgtgtgtatggtctcaagtttaaccaccttctttactgctttttaaacatctctttcaaaggactgttaatagttatataattaaacgcaacttgaaacccaggacctcccagactgacagactgcattaaatttctctgataacccttcccctgttttagcaatgatttcagattatttatttatttatttagcatgtgtgtatgtgcactcatgtatgccatagcatgcatgtgcaggtcaaaggacaacgttcagggattgagttttttcttctaccaccggagtcccaaagatcaaacctagatccgcgggcttggcagcaagtacctttacccactgagccatcctgccggccctcaacagcatgttattgttcaaacatgggaaacaatgttaagaacatgactaaaatatgggaagagcccttgggtgttcttaaaggactcttcggttaaaggatagcaggatctgatggtccaagaacatgcgctgacttcaagatggtccagttgtgatagccagtgctcctgggtttccatttgcacaaggattataacatggccctttccccagattacaaagaaccaaattgattttaaggaaaacagtgtaacatccatggaaaaatttagatgtttatcagggcctgtaatctttgaatagatgacattgaatgtatgaaacaaattcagaattaatttgtctcataccggaggctcacattctgcactttggagctgacagacagctcaa

SEQ ID NO: 17848 - DNA, 1220 bp, Mus musculus
gtggctatcatcatcttcaggtcatacaatggtcagtgtaccattgacatccacccattcagggttctaaactttgaagggctgtttttgctcttccttacccatagggaggagctggtttatttcctgccttattcgccactgccccaaaccctaattgagccaggaatgtacagcagttgggttatttgagctgtttcctttccccctttaaatccacaccccaacagttttcattcatagcccacgattctcactggatacaagaaagcagtggactacagcccaggagttgagtagtacatctttccctgggtcttttctccttgtctccttttctcttcctcatctcatctgggtatctcaagcaccaaactgaggcagtaaaatgacttgtaggtgtttaatggcaagtcattgaggaagtgaataaaagaaaattgcagtattcacatcagtagggagcaaggagaactgctgagctttgaaccaaagaaagttaaatttaccacattcttaaagggagccacctctgtttgacatcaaagcgtcccctgtaattctttctcccggtgaaatgtgccaccgttagtcacgatggagccctctaatctatgcggtttctgtttatccaaaacacacacggagataaaaccgcatgtgccttctgaatgcttttgtggtcttttcacaaaccagatacaaccttaggtacagagcgaatggagagtctaaattctcattttctcagggatatgttgaatttggaatgtcagataatgggggttggcggtagttggagatgtgtgaaatttatcttggttttctattagaaagctcagttcattcaacttccaaacctgggtgaatcttccccttttgtcttctctagcttttgctttattttacaaataactttacttgtttccgctggtgtgtggaaaggcagtctgttccgattgttaaatcttggtgttccaagtctgactgcagagggccctcgattcctcttatgtggcatgatggatattcccagggatatacagggatgtctcccgctgcagctgtttgtctgcagtggtccatacagtcttgtataataaaaggaatgttggggaccttctgagtttcaggaaatgacctagaaacctcaactatgtccttcctcacaattaagatgtcaggaaaactattcgcatccatcctagaggtacagatga

SEQ ID NO: 17849 - DNA, 1214 bp, Mus musculus
acccaccactaattaactgataactgtcttcctttggcaagttcaactcttcctgcccttaatttgcaggtttcttctttagtggttgaaacaaatacacatacaggtttttttcacttatgagtaaatgttgccacttgtagctggagctcttgtaataggcgaatttgaagttgctggactacagcaagaactgctgagaacacacaagcagtaaatccactgtggctgcctttctgtttcaggcggaaaagtgaagcaatgtgggagggggaggaagaggagggtcacagtgaggtgcgggaagctgggggagggctttcttaataaaatagcaaaatagtccataagatactcccgcccgtggatggggggggggtggggggcgcacagtaattttcttcttcactcttgaaaggataactgtcctcagagtgtgaaatagattggatgaatctctgatgagacgttctcattgataacgttttcctctggatctttgcagtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaaggtaagaacagccatactgtacttttcattagggcttagtgcacgt

SEQ ID NO: 17850 - DNA, 1197 bp, Mus musculus
ctaacaaccaaccgaattaaaaaaacaaaacaaaacaaaaagctgggcatggtggctcacacctttaatcccagcacttgggaggcagaggcaggcggatttctgaattcgaggccagcctggtctacagagtgagttccaggacagccagggctacacagagaaaccctgtcttgaaaaacaaaacaaaacaaaacaaataagattcacagaggctctgaagtagtgttcacaccatagccaagagggtctaaaatgctgagctgaggctcttctagacactgggaattctacagcagattcacaaatacagtatgcactgtacaggactagtctgcagctcttcttgcctctatgttcagaagttttgggtgtttttgtttttgttttttctatatttccttttaacaagctgtattctaaaagcctttataactacttttactctgattttttttttttaatgcataaccaaccatttaatgcacttaacagcagcaaatgcacaaggctcgcatgagaacttaggaggaaaacagaaaacacaaaaaggaaaccaggatcatctcgaagggcaactttcataggacagacggccgtaggtaaatgcccctggttactaggcaaatgatatgctgtggaagcagtggggttgatcacagactcctcctgtcgcatgtgttcatgtgccatgaacagaaactgtgtccaggtcattcaggagatactcacagaaggattgtatgagggttccagtgtcaccggcaacgacattttcccttgaagattcaactttgttaaataaaaaatctttcctttcttcatgcgatggacaccgtatagtctaaacctaactgcatagtttccagtcatctcggattcaacgtggttacatttgaatgtttctgtgaagacagggcatggtcctctctggatgctggttttggctctctgtttttttataggtagaagaacaaggtgtacctgccacgttttactctgatttttaaaaatgttattaattcataatctgctttctttaaaaattagaaatattttattgtgaatttgggtcaatggttcatcttttgttttgatttttcttttacttatgtactactacatttgggaaactaaagaaacacagtaaaaaataaacaagaattattcggcaaactatcatatgtgaacgtaatg

SEQ ID NO: 17851 - DNA, 1182 bp, Mus musculus
aagtgttcgctcgtgtccattaaggagagctttcccagaatgcctccccactgcctccacactgctctgagaagtgactgtactacactcatcccacctaggtttctacgtctcgattggaaataatgtagtacgtgttctgcagaaagctcttttggtatttaatagtatttgggtggtatcatgaatatagaatctgaatcatcagctggtacctgtgtttacagcacattttacaagcaggttctgtagtgaagccttttgacttcaggccagcccagaaagctagccactcctcccccatagtaaacacctttgaaaacttggtgactaaaaagtttggtcttttcatgaaagtctgaggctggatgcttctcttgatgtcaaatagtctgttaatctctttttgttaactttgttcaggttgcttaaataatggctaatgtgacccgatgaccaagtcttttttgatttcctagatgtaggtgcgaaaaactacaggcatctctgtgctgtttattacaacaagactcccgggtttgagatcatccatggcttgctggacagaattatgcagctgctcgatgtgcctcctggtgaggaaagcgggggctacatgatcaaagcgtctgcaggtaagataccagggttggcaagcctgatgaaaggccacatcctggttttgataaagtccactttcctttcattttgcttttgatttagagagcgtgagcagcaaagggcagagaactttatttcaattgttagtattttctaggaaatactgttccctctccctccagaacctcaaggggtttgctcttcaaacttgctaggaactgctgctctgtgttgcttttgtaagtagctgagttgtggtagtctctgtggcaccattgcgccaccagcactggtgagcccgagcgtgcaggctgcaggttcagtacaccgaagtgcagcctgcactcactacctgtgtgcctgcactgtgaaaactgcacttattaatcaaggagcaaggtggagtccactgccaaaagcccagtccagtctctggctttaatttaggccgatagatgccacgtgtgtgtgtgctgcggcctaatatgctggtttctccttgtctgaggcattctgaagcttttgctctttgttctcctgtggcttgagtctaagtttatt

SEQ ID NO: 17852 - DNA, 1224 bp, Mus musculus
cctcaagcttagcatgcaggaagtgttaactggtgaaaaccgttctttctctgtgtctattcagtcaggagttactgagaagataatcttcataaattaaaatactattgatggacacagattccagatttaaaaaaaaataatttatttcagtgacttaaaaaattttaagaatcataaaaacttgggagaagtaaaacatctgtttttttgtactaaaaatgtttcaagaatgcacgtctttgactgtattaaacaactatatggcaaggcatgcatttattcttatactgttaacctcctaaatcctttatggtgcaccgtagggcagtggagagagaatgcggtttagtcagtcctgagcacgacctgatttgtaacttcatagctgtgggattgataatgattaacctgagctcgactttgggcaacttcccttcattgccttgatttggctctccatctgcttcatagacgcagtaatccttgctgtgtagtgtctagagtgtagtggtgacattgatggctgcctggtagatactcagtccctggtcagagcttaccggcagcctgactgcctcggtatctggctattgggacgataaaaggccatctgtgccagcatggctagtagcttttacctgtggaaaagctgtgctgagcttttgttcagcccatgtgaacagaggtagctcgctgtgttcatgtcatttcccaagacaggtgttgtcattcttcttttttcttaatttaaaaagcaaaatgaggccaaatgcattcgcatttgtatttagagctatatgtctcgtgtctctagtttaagggtcatggtttttacctaagttgtaggctagtttaaatttaaatcctgctgttgactttaaatgttcctttatgtgctatgtcccttttaaaccatccccctgagatcctgaacaccgtcaccctggaaatcctccatgttttcccagtttagtcacatttcccctacattttactttatacaactaccatctagtctcagttgcttgaaaaatgcttttccacccctgacatgaatggatcatgtgtcctgtggccttctgtggctgactcctttcattcactactgtgcctctgagaacctccaccgcttaggtccattgacagttgctgaagttggatctgtgagtagtgtctcactgtttatacgctggtccattatccagttatccattggggttc

SEQ ID NO: 17853 - DNA, 1175 bp, Mus musculus
tgttagcaggcactgcacccagaaggaagcttgaaactgaagaagacgagtagctgacatactgcacacagcagagacatgatgagaatcaggcctttgcatgactactgcttgaccctggtctcgtttcctgtacactgagcttaagagtcccatgtcgtccatatgcagatgttttgtttccattgtgagcagtcactattttatacacattgaaatataaaatttagcattgagaaatgcatgttttaaagttcataagtgacagcaggaatcagcacactctcaccctggagattttaactttataaaacaaagcaagcactcaccttcctctctctacttgggactctggtttccttccccaaactaactgcagttaccacttaggctgtactcctcactgcctctgttggtgctttttgattctgtaacttagtcccatgtacataagctgccttctgctagaggctgctgtccaggagggtttactctgcactgatactgtgtgcacgtggtaccaattcttctcggagggttcctgtcctccacagcagttagagtaacttctctcagtccctccattccccatacagccataggcatgtgtccaagattccagcgcagacccgttaggagccagagcttgtgactgaattgtagcactagagtaactgagcagtgagctcggctgtccaggtactcagttatgttcattgtctgggagaagaggcgtgaggagctagaatgttagaggtcacaaagttttctattcagagttttagcaggggcaggagagatggcttggagggttagagcactggctactcttgcagagaacccaggttcaagctctagcacccacagtgtctgtaactccagtctcagggcatccgatggcctcttctggctttggtaggcaccgtacagtcctgcagacaaaaatacctgtatgcataaaataaacaaatcattaaaatttgtataaagttgtgatttttataaacttagaacttaacattgctggtctgtattgccacatccagtgtgcataggagtgacaatcagtcttccaaagctgctcctgacttcttaataagcagccactttggaacacggcatgctagttactgtcttctaccaagtgactcaattttagaacaaaatgcctactt

SEQ ID NO: 17854 - DNA, 1114 bp, Mus musculus
gccagatacggtggtacatatcttaatcctagcacgtaggagacagttgcagggagtttgttataagtttaaggccagcctagttgaaagccagccaggactataggtagaacttgtctaaaacaacagcaaagaaaactacatatttattaatggtgagaaaccctacttttagatactttgtgtggatctagaaacaagttaatttgttcaaaagataatattgatggtgacattttatattcttaaatagaagagaaaactgatatatgatataaaagcaaattatttcttaataattgaagcttgtcaaaatgcactgatttggaggtgtgtgagtgtgtgtgtatatgtgtgtgtgagtgtgtgtatgtgtgtgagtgtgtgtatgtgtgtgtgagtgtatgtgtgtgtgtgagtgtgtgtgtatgtgtgagtgtgtgtgtgtgtgtgaatgtatgtgtgtgtgagtgtgtgtgagtgtatctgtgtgttatgtgtgtgtgagtgtgtgtgtgtatgtgtgtgtgtgagtgtgtgtgtgtatgtgtgtgtgtgtgtttgtatctgtggtatataagggatgggctagggacagtttagaggagaattctagatattttcttcagtggtgaaaaatgcttaaaattacgagtcagacttggcagctagtgttcccttcataacggatctttgctcagatagtgcacacatgtccctagggctttaagtacattctcagtctcattatattaaaatctatgtattagcttgctgacatatgtcattactaagcaaaataataaacgaactatgaatttattttgaagaaagaagtttattgtacattgtaagagtgtagtgggcaagggtggtaaaatgggaacaacttgcctgagcaaagtagaatatggttttaaaggaataaggtcaaggtctcacaggcagtgagagctaggagatgagtggcagactattgttttagacatagttattaaacattcttccctccctccctcctccttcccctggcctcttcctctctctccctccctttttccctccctttttctcaccctcttttcctccttccctccctccctccttcccttct

SEQ ID NO: 17855 - DNA, 1102 bp, Mus musculus
tgcaccgcggcctcctccgcgggcgcgggcacgtgggtggggtcgtcccgctccacgcggccgcgcggcgtccgtgggaggtaccagcgcccagagggtccctgaaaactgcgggtgtgggacaggaaatgcgggtgcgggcggtgggaatggcgtggggaacctctggtgtctcctcctaagtgcgttttagtctcggacgagtcagtcatgagatgcatacataggcagccccgggggtcacttgtgatccccgtgatgggatttcacagatgaagatccaactgtatggtccgttctggttctagaacaggtattccgatcacttgtacatagagcccctcaacttagaaagggcaggacagtttttgggaatccagtggaaactagagaggggggattgataactgcctagaatgacagagctggcatttactgagctttttttaaaggccacacaccaagaactttgtgcatggctatgtttacattgttagtccaccgggacggtcgcacattctcagttttacagcgagagagcctgcactgtggacacgttaacttagcccagatctgagctactaggagaagcttgagccccaggagggcctgtctgaatctagaacaaatctctgatggctttagtagcaacagccctctgttggtgtttgaatggtttccgtggctttgggtttctaggttcttttgggtcttaggggttctgcagagctgtagtttggtgtttttgtttttcctgtttgttttaggctgttttgtatgcgcactttggctctgagtgttgttgaagggtgctgctgagttgcccctagaagtgcatgcaaagcttattacagagagggaagtgttgggacttgagagtgcgttttctggtgtctccctgagcacccctcacatgtagagttgaaggctgattgtattttctaacttaggctctgattcttctgtcataaagtgccttgactccagtgtggccacaggagagggtcacctggtatctttggagtccagttactggatttgtaggacatttgggccgagtgactggtaccctgtgagtcccaagatgtcctccttggagaaa

SEQ ID NO: 17856 - DNA, 1177 bp, Mus musculus
ctctgctgcccagctctcccctctcccaacagaggttttgatcttatgtttttaatgttgaaggaggctttgtggagagggtattggaataggagtgagtgagcaagggttacttacctgactaagttgctgggcatgggaaggcttggtgcttgggcttttataatcagtacagattctggtagatgctttcccatgaaggctcttttttagcaatctttattttaattaacatagctttattttctttgtttctagttttcaaattctttagtattttacatatcttaattatttcacaaaggactgtagggaaactcacaaacactctttgccttgagtggtttctttgtaagtactagtcatcattttgccaattctgtgcattagttctagcttcctgtaagaattgttgtgagattttaaataagtgtctgcagtattgtcaataaacatgaaccaaaaaccactttatttgtttttagagaatgtaggtttttcatattttactgcccccccccccctgtttttcaagacagggtctctctgtatagtcctgaatgttctagaacgtgcgctgtagaccatgctggcctcaaactcaacagagatctatctgcctttctctgcctcctgagtgcttgggattaaaggtgtgcatcaccgttgcctaactttgccttctttcatgaaatagtatcattaagcttctatatatagtcccaccttaaggaagtatcttatgtattaggaacctttttagtagagttggagatgtatgtaaatagaaaactgtaacttgggaccattaactggattttgttctattatttaaaaaattacaagtgcatgtatatgaatgtctgcatgtgtgtgtacgtatgtctgagtgtctgtgtgtgtgtgcacattcattggagcccttgagagtccatctgagtgcatgcacaatacacaggtgaaggtcagagaacagcattggagttggttctttctctcctttatgtgggttctgggtactgaactcagttcactaggcttcagtggcaagcctttacttgctgagccgtctcactgactgcatcctttaggtttgttctcttttagttaatatcagttaactgtgacgtgggctttaggtttcctgggaaaataaatttctacatgttagcacatt

SEQ ID NO: 17857 - DNA, 1177 bp, Mus musculus; identical to SEQ ID NO: 17856

SEQ ID NO: 17858 - DNA, 1145 bp, Mus musculus
cctgggatatatagcaagaggagaagatgagggtcttttcacttgttacatacaggaagtgtattgagaagtgcgtcttgagttgcttgccatgatgttactaagacttgtgatatggcattgtccacaaccatttgggcttcctattgcacttaatttcctgtccgatctcttgtatctttatcatgattcattcttttcatttcccttttctttgctttggcttgaggtttttgttacctgtgttaaaattttcaggtgacagacagatagacagacagacacagatacggagacggagacttctgtagcctaggctggccttgtacatcaccatcctggttgacttgtacattttatgtgttgactacattgaaattactggggtatttatctgggtcttttcttctttagacatctcaataaataaggttctcagaaaacatctatgtcagagacagtgggcagtaaatagatgaagccaaagatgagaccagatccttcttcaagagctaacaggccctgtgagaagaaggaggctgctaccatgaacatggccaggaatgtgacagaccttctggctttgagccagcaggaagaactagtggatttgccagaaaactatccactgagtacgagtgaagatgagggggacagtgatggagaaggaaaacgtcaaaaacttctggaagcagtcagttcccttggtagaaagaataaatggaagttggcagagagatctgaggctagtcggatggtttcagagttcaatgtcacttctgaaggatcaggtgaaaagctggtcctttccgatttgcttgggtctgctacagcattatcttcggtggctgctgtgaaaaaacagctgcatagagtcaagtcaaagacgctcaccccaccccttaacaaagaagaggctgaccgagccctcagggaagcagcattcagcaaaacctcacaaatgctctccaggtgggatccggtggttctgaagaaccggcaggcagagcagttgatttttcccatggagaaggagccgccagcggttgcacccattgaacatgtttttactgactggaaagtaagaacccctctggaacgagaagtttttaaccttcttcataagaacaagcagccagtaacag

SEQ ID NO: 17859 - DNA, 1246 bp, Mus musculus
agagacccccttccctcagcattcactgccagacctggatcctgctgacccaccagttctgaacttcacttcatccattcctgcctggtgtgtaaagaagaatgggaccgcagacctcgcttcagcccatccttccctgcctggcatactgtggaattcagctctgctccatccttccttccccttggtgtccagcagtcctggacattccaagggaagacgcagaataacggaagcacaaagtgacagaatctgggctactgaaaaataagttatggagggccttaaatgttttgcagagtaatttacacttgatcttagccaaaaggccgagaagcgatttgcagagtaatttaaactatacttttcatctcttctcttaggcaaagtagaggaattaagacttagataggggaccattgtgacatttgtgttaaaggagtgagtgccaagctggcagcatgcatgtaggatgtattgtattaatgggggtaagagttgaaaatgtcagctgtagaagttagagtgagcatgggcaggagggctggatgacaggaagtcatcacctggcaagagtgctgtagagaataagagaggaaagggattttattggatacctggaagtttgagcagggttttggacctgggaggatttagctttccatttttacttatttttggaaagatggaaggatatattgaagtgggatggagaattcaggttttagaaaattcttgtatatttttgaaatgtaaaggtatgaatggcaggcatccctgcagtcccagcacttgggagcaggcagaggcagaaggatagctgaaagttaaaggccaggaagggtctacataattccagttcagaggaggagggctcttgaggtaggtgatggctggatggtggatcaagggagtggtaaagttgacttcttgaatatgggatcagacgcttatgttttataataattggtgctcaagacttttatcaagaatgtgattgccagagaatccatctgtgaatccttgggaccagaccacccatggggtgaggggtcatgtctagagtataggtcagagagagcagatcaatacatgaaggactttgaggtgcttagaggccattataactgttcatttttaaaatgttgaattttctattgataggaattgttctagggatccacacatcaaacttttttgtatttcgtcttgtttagtttgggtcattttagtgaggcacttttgg

SEQ ID NO: 17860 - DNA, 1131 bp, Mus musculus
aggaagcaaaggagacacatccgtgctgaagccaacactgatggcagctgttccggtaagaactgcccattcaggaagtgctgtcagccacaggccatggggtggtaatagcactttcaaacaaattatgattttacctaagatttttagttctgataaaatatatctttaaaatgaattcatatcttgccagtgaggtcactgaatggatgaggtgcttgctgtgcaagtctgaggactgagttagttccaagaatccacgtaaaggtggaaggagacactcaagtccatgtaattgtcctctagccgccatgtatgcaccacggcacaggctgcatgcattgtcctatatcacatagacaacagttggaagtattaatcatatgggtgtgatttaaatatgaaggttgctcatagagttaatgaactcatttatgcatctaggaaatcatggatcggatctacaaaaatgtcatgaataaagtgaatgaaatgagtgcttttcaacgaaacttgtttattttggcatataattataagatggaacagatttcaaaagggtgtagtactccactgtgtgaccggtaagtaaagccagttctctgtgtcaatgacagagttcaaatcaacagcccagggacgtgaggcacttataagtagtacaattactttaagatgggtgtggtggcacaggtttgtaatctctgaagtaaggggaggaggatccagagttcaaagctggaggctggaaagttgtgtcattgttagagcaaaaggatgggtggagggagagcaatagtcggacaccagtgacttccttatgcgctcattctctctctctcaagacagtttccctggctagaactcagaggttcacatgcctctgccttctgagtgctaggattaagagtctggatagcttagttggcaaagtgtcagattgaaggggcacacactgccacatcagcctcaatacagcttctaaaatggttgccattgagtcttactccctttcaaaaggcttaccagtttttaattcccatggttccgggcattaaacctaggctgagctggtaagcaagcactaccactaagctgtgttcctagccttactccttgcttttgagttat

SEQ ID NO: 17861 - DNA, 1145 bp, Mus musculus
ttctaagaaacctttaatagctgctaggggttgtgttcagggagcctctatcacccagctgccattcacctcccacctcttgaattgtttccttcctctttatgcttcagtgtttgagttgacacagctccggtcaataaaagtcacttcaggccccacttgcaaggattccttcccagcccacaagttggctgtgttgtgtgggtgctgtgtttctgttcctctttcctggtgtgcctttgcccattgcagtgcaaagctgctttccctctgcactagtgagtgtcaggagcgcagcagctcagcagaatatattcaagccataaggatgatgtcccttaagtacaatattttccacaagagaatttacttaattgtaaaagattagggtctgactttattgtataatctcaactttagggcagccatccatgcttagttgagaaaagttttaaatgacttggtgagagtattcctatgtgcttaaggtgttaatgactgttctcaatatttctgcctttgccctttgcagaccgtaaaaaggaccttgtgaaactacaggcaggagagtacgtttctctcgggaaagtagaggcagctttgaagaacctcccactgatagataacatttgtgcgtatgcaaacaggtgagctcctggagtctgggctgcggtctagaagttggcaggtgtgccgtgagcagttgcagccgtgtgctgcggtataaaagttggtgggtgtgctgggtgtgccgtgagcagtcgaagcccctgtggggccaccacctcctctgcatagctagtgagccggaacttcctgggatgctctcctctgtaagtgtcctgagtgacagagttggggaaataagttcttatgctgcctcagtacctctgcacagggaggctttgcagacccagtcagctgcaagggcataagtagtagctccctacagtcctctcttctgtcctgacctgcagcttggccatgcttcctgctggcctggctcaccacaacctcacagcccaggatatcataggcagcagggaatggaagtgtaaatttagaagcctagaggtgtattgggaactgatggaatctgagattagacctgactgcatttctgtaatagtaagtgaagtaactta

SEQ ID NO: 17862 - DNA, 2140 bp, Mus musculus
ttgtagcttgatcatgggttggatccccatgtaaatgagttgttttaatggcagaactgctttctgtatatcttacacctatatcatttatttaatttattctcctatggataaataatttgttaaatgttttttgctattatagttctcatatttcaaaaacatatctttgaatatcaagagtgggcctgatgctattggggttgcttgttctgttgggtacttggtgggcgggcctcaaagagcacccgtttgctgagaactttgacttcatctcttgtgggtgtgggtttttagtgttgtgttttcttcatttcagcaagtctggaaaagtttgaaattccactaaaaatacgtttgagccctgacccatggactcccgaaactggtctggtgacagatgccttcaagttgaaacgtaaagagcttaaaacacactaccaggcagacattgagcggatgtatggaagaaaataattagttttggcattggtttgctacagcgagctcagatcaaataggaaaatacttgaaatgtatgtctcgggccgaggcaaactccattcctcatattaaatcccggctgttacttctcactacgtcaccatttttaactgacaggattagtaaagtattaagacagcaaactcgtgtctgtctgttccttcccctgctccagtttgcttctggcatctgtgactgtgcttgtcaacaggagactttttcagaatcgtactggggaagcagcgattttacagcctcaagtttttaaacatgatttatatgttctgtacagttgttcagtttgtaactttttaaagtttggatgtatagaaggataaataggaaatataaaaattggttatttggggggcttttttacttattgtatttaaaaataaaagggtatcaatgtgaaattatgtacattttaaatgcttatgaatcaagtcattgttgaacaaaagatttgttgctgtgtaattattgtcttgtatgcatttgagagaaataaatatactcagacttatgttttaagaaatttcgaatatatgcctgacactgttgggtttatatacttgctttttctgttggggaaaacagtttgcttggcactgcattgaagtgaaagagcaagtaggggtacataacagttcactcacagagcagctcaccacagagcagcggtggccatgggtgtggtggtgggtgaggggaaccagggctctggagtttcgctcacatcacaaagtacttgtttagagacatcctaggacagtgttctctgtgttctcgtatgttgtgtgttggacagttttgtccttgttgaaatttaactcttacctttggagaaactttgtaaaggaggggaagtgtgttaatactaggagccgaaaatttaccatggttgctggagagcatttgtgtctgcctgatggcttgccttcagaatgattgtgttaaaatatttttataaaaatgatttaagtcacgtgtgtatgtgtgcatgcagtgattaaagatgtcagaagggggcgtctgatcctctgaaatgagttaaaagctgtggtgaaccaaattctactttctgtaagactggagcatgctcttaaatgctgagctgtcgttccagcactctttcaaaggatttgtttttcttttttaaaaaatagaatgtaagtaagcttcaatgcttttggaaagatactaacaattgtgacttgaaatgtcagcttaaaaggcagtgtctcaccagtacagtaatggctgattgaacagcaaataaagctggttagtccgcatcagagcctcttcagagtcttgtataatttacgtttagaactgcgtttagtctaaggcgttagagggcagggcttttttttttttttttttaagatttattttatttctttcatatatatgagtacattgtcgctgtcttcagaaacaccagaaggagatattggatcccattacagatggttatgagccaccatgtggttgctgggaattgaactcaggacctctggaagagcagtcaacactgttagacactccagctccataagtcatgactttgcttgcttgctttccccctcccctcccctcctctccctcccttccttctttccttcctctg

SEQ ID NO: 17863 - DNA, 1180 bp, Mus musculus
tctggagatgaaatgttacagcatctcctgcttttaccataatcctgagaggaagagctatggcaacatttatatagcaataattgtgaacatgagatacaaatgatattagatactttattttcagatatctcattccttgtgagcctttaaaacatattttaatgtaagatgaatctttaaggcttccttaagttatgtgtatttcattgtactcttcatgggaggtgactccctcccttccttccttccttccttccttccttccttccttccttccttccttcctccctccctccctccctccctccctccctccctctctctctctctctctctctctctctctctctctctctctctctcctctttcccagaaaaatatttttgctgactgtaattgctgtgaccatgttaccttcacgcttccaaaacagaagttctgcatagctgggtactgagtctgctcagacatgaagtaggaagctgcctgtattgtagcatttcttcgaggtgtctctggctgcagttttgtatatgtgttctccatgtaagtgttgaggtttggtggccgttgtacctgagtgctaggacttctgtggttaagacaatagggagatctcatacagtggacccttagagaatgtggttgtcatctttggttcatctcatcagacatacttaagggaagatggcaagaccagagaagaacagacagacagatggacccattccttagaataaccatttatttaaaagcaataattcagattgcatatgagctaataactgggcttttaatagctgatttatcttcaaattaatataattttggtggcttgttctttctgaacatctttgtttcagcagtcttcagttttgtgcattaacttttttaaaaagtttggtaaaggtctttgtttttcaagcatctttgtaaaactgaactttctgtaacttcggaggaaagtgtcttttgggcttcactaaatgtactacttacattctgttttttttttttttttccattttttattaggtatttagctcatttacatttccaatgctataccaaaagtcccccttacccacccacccccactcccctacccacccactccccccctttggccctggcgttcccctgtaccggggcacacaaagtctgcgtgtccaatgg

SEQ ID NO: 17864 - DNA, 3084 bp, Mus musculus
gcctaaaaaaacaaatcaatattttttaaaagaaaaaaatctatataaaggtgtgtttgggggtatttgtggaaattgtctaaaaggtctgtccacaacggactcctaaggagtagaatttcctcagcaaaactgcctcatgaacattgaaccagtgggtaaggagggaacaatgaagggtttagaaggaaaaatttttaaatgaaaaaggttagtgcttagaacttcttaaatgcaaacccatgagcacacatggagtctcccgagagggtccttgaggcccctgagagtactcagatacacaaccaggggctgggggagagctttctgtctttcttcaggggaggtggccagatgtgagaaacctatgcttgccatacaaatgtcctctacaccgagttactgataaacctcatcaaggtacctgttctgtcaggtggtgtcctaatctgctcttgggtttggctcactctagttgtttctgtcccagccagtgtcccctgggtgaacctttacagctgtcatataacaagacagagcacattcatctccttctcccaaacctgccctgtggacaaagctttcttttatggtgctgatgtacaagcctcctgacattttttttctttgtagctagtcatgacccatggcaaactcagctaccaccatggtggtgatgcgtgccagcagcctactccatggaacagcccagtcttgctaactgatacatttgtttgtagtcccaagaccaagcccttgttatatggtagcaagttatgcccctcagaagtactctggcgcttctgtattatgttgtagctgtgaccagtgttagtcatgtgtcatagaaagaaattggtggcccattgctaaaattatcagtcaggtcttgtacagtaatccctaacctgcaaatcacttacatagcatttagaaaagctgttgtatgaaatgtgttgtccaatttttggccagattaccaagagatgtttgtgtgtgtttgtgtaaacagaaagtagcacatgaactattccagtagaaccgtgggagcctgctgcttgccggtaggaaaggcctactgctttaacggatgaataatgactacctacagcatccgtgtgactcttgctaatgggtatggatttaaaatctcactgtagcactgtgttgggttacatcaagatcaaggccattctgccagagaggactaaggctttatcactttaccaacatggctaacaaggaggtggcgcacgcctttaatcccagcactcgggaggcagaggcaggcagttttatgagttcgaggccagcctggtctacaaactgagttccaggacagccagggctacacagagaaaccctgtctcaaaaaaacaaaaaacaaaaaaaaaaaaaaaaaaaaaaacaggcagaaaagctatggggtcacaatggataaaacacaaacaatgaggaaaggaaaggcagccaggcataatgggctctgtatttacagagagctcttgacttgagaaataagaccaaaggatgttttgccccctttatgttttatgtagcgtcacttttaactgctggtttttcattggattccccttacactatacaagatgtggattgctccagtgctttggacaagagagtgggtgacgtcgtgaaaccacaatgtagaatgctctcctcgctgcttggtttagctcagcctgtggttctgcccacgcaagggaaacagaccatggcggagtcattgccctgtggaatagtgctgagccaggcgtgggtttattttcttaaaagcatctgtaaaatgtgacttttggatatctgtggtagatcaaactgaatattccctctcctttttaaagcctcctgatagaaaaccccgtgcctcatagagagcatgtagtggttggtttgagccttttaagaggctattagaaatcaaggaggaaaaattatatttaaagaagaattagagggagggaccttaggagggaatgcaggctgaatgcacttcgctcctcacttgagcctgtggtcacatctcctttcaaaaacgtgcttgccaggctcccctatgtgtcaggtagcaaagggggccatattttttatagagggtgaagattatattctcaagtttactgactgaagggacaataaggctcaggctttttgccttatttggattctgttgctaaacacatcacttaagagagttcctcaagtaacaactatgtcctttccatcccagaattctcaagctaatttgtacagacaaggatcaagaagtagagggtgttagacaagagtcttgaacttagatctagtatgtaataaagtgatgccgagtctttattctcaatgtgttctttactggtcctttattagttggtcctagtgatagcaataggcctgtatgttggtagaaaccacttcttattcactagactgtaattgtttactatgtcccagttttaacttgctgcctagtgggcagcaatagacactgttgctgtagactatgctttgttctcccgcaccagtgattcagtttgttaacatctatatttattaaacttgtcaaaattgataaatagagtagcagctcagacccaagaagatatttttgaaaatcagggtttcattaaaagtactttctaatatctcctaaatgacaagcatcaagttactgttaatgacagtgatctgctcattctacatgggaggcttaacaaataagtaatatatgctgacttctgcaagtgtctgttgcttaattgttaattgtgagcagattattgaatgcctcatctattttctgcagtttactacacaataactctttgaataagttgaagtttaatcgtgcaacaaatttctatcagagaacaatgtaaagtattttactctgtagcctttttttgttttttgacttgggaagcaaaaggtgacattaagtaagtcaatgtgtccttgtacaactgtgtttccatagagtaggatgccttgtgtatccgagagacgctgcaaatttttgttctttctacttgtgggttccatttttgtgggcttttttattttatt

SEQ ID NO: 17865 - DNA, 1192 bp, Mus musculus
gtatagttccttattcttttatctcatgtttgatatgtcttcattatgtatcagagctgatcaatccaacactgaagcttctagccacttgtggctacttaacctaaactctattaaaatgacacataattaaaatgacagcgtcttagactgtcctcaactcagctcctcatttgagtagttcttgtggcgtcgcttgcgcagtgaaggcggagactattcctgcctttggagaaagttctatggaatggcacagctgagcaacaggatagccatggctccttctctccccagcatgcagcactctccgtcttgcaccgaagattcattttatgatgccagacattatttctctttaaccctctaggtgccatcttgttcctgggccaggtgaacaagccctgaaggacagacaaaggaaagccacgcaaagccaagacgacttggctctgaagagagactccctccccacatctttcatagttctgttaaatatttttatatactgctttcttttttgaaactggttcatagcagcagttaagtgacgcaagtgtttctggtcggggctgtgtcagaagaaagggctggatgcctgggatgctggatgcctgggatgctggatgcctgggatgctggatgcctgggatgctggatgcctgggatgctggatgcctgggatgctgtagtgaaggatgagcaggccggtttcacgatgtctagaagatttctttaaactactgatcagttatctaggttaacaaccctctcgagtatttgctgtctgtcaagttcagcatctttgtttcattcctgttgatatgtgtgactttccaggagaggattaatcagtgtggcaggagaggttaaaaaaaaaaaagacattttatagtagtttttatgtttttatggaaaacaatatcatttgcctttttaattctttttcctctcacttccacccaaaggcttgagggtggcaagggatggagctagcaaaagccgtagcctcttcgtgtgttgtttctgttgctgttgctcttgttgttttatatactgcatgtgttcactaaaataaagttggaaaactaacgtctcgctggacaccatttgctgtcaagccgcgtacctgtcactactggtctgtactctttggattggcatttttgtattttgtataaagtaaaaaaaaaaa

SEQ ID NO: 17866 - DNA, 1199 bp, Mus musculus
ttgtgtcattacgtggcctacttgagaacatctcaatttcactgatgccagccctccttgctcatcatcctaggggaagaaaggttgcattagtggtccactccaaaagatcaactgccagcaaaagatggcctgacaataagttggtaagaaaacaacctcttagaagctgtctagagcccagagccccggagtcaaagccggttgtcaacccagccctgtcccgcactcgcctgcctcttctttttttgctttcaacatgacagatgccgctgtgtccttccccaaggacttcttggccggtggagtggccgcagccatctccaagatggcggtagcacccatcgagagggtcaagctgctgctgcaggtgcagcatgccagcaagcaaatcatgtcagataagcaatacaagggcatcatagactgcgtggttcgtatccccaaggaacagggagtcctgtacttctggcgtgggaacctggccaatgacatcagatacttccccacccaggctctcaactttgccttcaaagataaatacaagcagatctttctgggtggtgtggacaagaggacccagttctggcgctactttgcagggaacctggcatcaggtggtggtgccgctggggctacatccttgtgctttgtgtaccctcttgattttgcccatacccgtctagcagctgatgtgggcaaagctggatctgaaaaaggccttggtgactgcctggttaagatctacaaatctgatgggattaagggcctgtaccaaggctttaatgtgtcagtacagggcattatcatctacggagctgcctactttggtatctatgacactgcaaagggaatgctcccagatcccaagaatactcacatcttcatcagctggatgattgcacagtttgtcactgctgtcgctagcctgacttcctatccttttgacacggttcgccgtcgtatgatgatgcagtctggacgcaaaggaactgatatcatgtacacaggcacgcttgactgctggtggaagatggcgcgcgatgaagggagcaaggcttttttcaagggcacatggttcaacgttctcagaggcatgggtggcgcctttgtgcttgtcttgtacgatgagatcaagaaatacacataattatgtcctacgtgttctccccaagaacaggcatgttgtacaatatacc

SEQ ID NO: 17867 - DNA, 1877 bp, Mus musculus
tttatttggacatcaatacataccctgacttgtttttctctattgtaatctgaggttttccaaattaagttctaagattattaggttttgctctgagttatttctagagaaagaaaatattttagtatgtataaattgtacaataatttttttgctgttgtacttactgctaacagtggattgtatagggtggtgtttttatttcatttattgtagacaaaataaataaatttagtattcacatacacactaactcaagtatgtcagagcacaaaggtggcagctggttctatttaatttagttcctttgaaaagcacatccatccattctaccatttgtttataaatatatcccccatccccccacacacagtttaaatatatattttggtgaagctgtggtacaccattaattgtttcaaaatgcaatctaaagatgcaataaatagagtaccttgatagtttgaaggaattcttcagttcttgcagctgtgttttagaaagtgattaagcaatatttttcaaacgtggatatttagctatccattgtcctctgaagagtccttttcatgttttcaaagatgtgctttgtgctgaagatttgtgtgtccgttcctctgtgcttccaactatcactgaagtcttctacctgattgatctgccaaggattatagtttgctttaacttcagagtatttttatcttccattttatttaattttgttcctttttcttttctttcaagataatgttttagatatgtaattggggaaaaccactagatttctgtcaaaaaaatgaaatgttactgaattcaagtaaccaactctccattgaatatcaatactgttgatatacttattagaatgtatgtctcagaagatggtttctgttaaatatatgaagttacaattactgaattctaatatggattaaaagctccacataaatattttccccatgcgtcttggattataattttccttttagacttgcttttattgcatttaaatttgcttttatatgtactgttaattttaagtcttaggatcttaatctctacatgttctccacctttccatgagacagtaaaggtgtgggcagtacggacaggttctcggtgcaccttgctgtgcttgcacaggtacggtgggacactgatggattgctttctggtgtaaatagaatttttacgaaggaagctacttttaacagtttggaagtgaagacagctcagctgtacagattaggtctaatgtatatgtagggacataaaggtttgctaattgttctggtagatgcttgcttctgagttaaagtaaatgtatttgttgggcaatgctggctctgctaccttacaaaattcatgtgatgcatttggtatttctcagcaataggtcattgacatttttatcctctaaatgttttaaaagaataatgtgatgagattcttttttgtgacttgaattttaggaaagatggataatttttccagctataaaaaatgatgtcattaattgttaagttattctttgctgtcattctttgtgggacagcatttttttatttgtcatttaaatattgaaaatttattccaattaggaaacagcttcacaaaataaaaaatatggttgtaattccaaggattctttatgtcagtgaactacaaatggaattaaagggatgcatgtgtggggcattgtgagcacagggcaggaaggcactggttcaagatctggaagatactaatacgcctttgcagtgagattctcaagaacagtgaagtagcgctgacgtttgtttcctcagtatgcaggacaaacagaaaggcttaggtaagagccaatgctctaaagataatgtgtacatttccagaaa

SEQ ID NO: 17868 - DNA, 2270 bp, Mus musculus
gaagtcaggacagtcattttttttttctcctttgatgtgggccccagggttccaacaagtacgtttacatgcagagccatcccttggaccctgttgtatttctgatatacgtgtgaaagaatccttacatttcattactaacatttgagcatatatacaaactggaaaataatcatctgtaaaattaattctgaacacataattaccaacaatgttaaggtaaggctagatcataagtattttacttacaagagcatttttataatgtttcctaaattgttttttatttggtagggcttattggatctaaagagtaggtttgatcgcttcctccaagaatccttcaataatgaccggctctttaaacagactattgctggggacttcgagtatttcttaaacctcaactctaggtctcctgaatacctctcattatttattgatgataaactgaaaaagggagtcaaaggggtaagtagtaatccatctaaagtgcgttagattgtcctcctcagtgaactgaagtttggaaatgaagttaagagattttacagataaacatgtttaaaacggtagggctctttactacacttacaggaaggttttgagacagttcttttttttaaagtcttagacatacttaaaagttgtttgacattcatatatacatccttatgtaattgttattttaaaaattactcccccccccccaaaaaggcataaacatcacacctacaggttttaaaatgattgcccttgtagctgaaaattagtgtgaaaatgacagcactggagaacttgccagcagttgcagattgttgctgcttttatatggttctgggtctagagtattaagcagggcttggttttgaggaatgtgaaaggtgtactgagttctgaaacttacatcctgaagtttcaatttttttcatcctcaggaccttgggtgctcacttggaaccacagaaaaatcaaattaagctattttgatcatgtgtggtcttttaaaacctcatcttagagattttgagacaaaggagaaaagcagcaaaaagcttgggggttacagaggcaatagctgagtgagaaccaaatcactgactgcaaagaaatcttgtctagtttaatctctctcatttctaaaatcacaagcatactacggcctactatgctattttctttcctttatttaagagatgaggtataaagactttatactttggatataacaaaaacttacccacttgtttgccaattttgagttttcaagtgaaattttttgaaaaaaattcttagctctgtaagtttctacagaaagttttactctatcccttgtcaatacatttttctgttcttgattatcccttacttagcccagtcctataataatgtatgtcccatctgagtggtagcagtctactctttaaatgcagtagagaggataggagtgtgtgaagtggggcacagttccagattaccttcattcctttagccaattattgtgtttttaaaactaaactgtctttggttaatttttcagctaacagaacaagaagtagaaacaatattggataaggcaatggtcctttttaggtttatgcaagaaaaagatgtatttgaacgttattataaacaacacctggcaagaagactgctcacaaataaaagtgtttctgatgactctgagaaaaatatgatttctaaattaaaggtaagctttatttaagatgagtgcaatattctcaacttacattgatttatgatactagtgttcatccaaaaattatggtggtgattttgggcaggacacagccttttcttctgtgtgttaaaggtgcagagcatcaaagttgtctaccactgtcacatgactagtttctaacctaatctgtgcccatagtaacctgagatgtctggaggacacttcaatatactctactttccctggagtatattgggatctggacgagcctagaaattatgttttaaactaaaatcttatattataaaatcttatattaaagtattagagcagctactagaaagacttttagaagaataattagggacggcaatatcatgaaagactttgtttctatactttctcatgggaaagttcactgttcgtacatatttgtgatctttttgcatagactgagtgtggatgtcaattcacatcgaaactggaaggaatgtttagggatatgagcatctcaaacacaactatggatgagttcaggcaacatctacaggcaacgggggtaagcgtc

SEQ ID NO: 17869 - DNA, 1244 bp, Mus musculus
taaattttaaaaggtgagagttttattaagggctaaatttgtgtattggagagtggaatattctggcagataatcttcttgtggcctaatattagccgacttgtccatctacaggaactcttggatatagagattcaagaaccgagaattggatattctgtctcctgtcctgtcaggtcccattcttctgagtgccaggagcttcattgacttaagaatatatgtattatagcttgaacttagttttattactgaaaaataaaagatttccttttgattcaataattctactttaatcttcgctcaagttcaaatttttaaaaatgtaagaaaaagctgtattcacgtaaataaatagtatacaaacctagtttgttacactattagtttaatatgttaaagttatgtaataattccagcattttacattttttacatttacattttacaatgcttgtttaactgtagtttttgacaaggtccaacttgaaaattttattaccaattttttaatgaatatatacaaattggcttttattttcatgtatagttctttatgagttttagcatgtatatagattgatgcagctgccactaccttcaatgtggaacagctcctttacccccacaaaactctgaatactccttcatagctatgtactccttgtcttctcatctctgtaactactgaccagttctcttttctctataatcttgatttggaaggatgttttgtgactgacaccacaatttacgaccagcttctttgagcataattatttctaccaattcagttggttccttttgttaatgactaactcatactctgttgtctcagagtattaccatttgttcatccagctacctgtgtttagtgaaagatgattcttgtatacagtttttgagattttaataatgcttataaatatgtgtgcaaactttatgtggataaattttaattcctctgggataaatacttagaatgagattgctagggcatatgataagtgtgtatgtatgtaacttcataaaaatgcctagctccatatatggctgtactaatttgctttcatttggtccttctctttgtcagcacttgatactgtcagattactttagaattctagcatggttaatagtttcttcttgaaaaattgccttctgcttttcctctttcatgaagtgtctgttcaagactttaaagagtcctttgacttctttattgagttgtatgtctgatttat

SEQ ID NO: 17870 - DNA, 1144 bp, Mus musculus
ataaagagggtagccatataaaacgggatgttgtataccaaaacaaaaatggtgatcacttccatcttttagaactcaaaatgttgatgacttaccaaccacaaagaatttttaaggatgctccaataaaatcactttcaggtaacttgaaaaatcattttgagacaaggctaactatgtagcccttggctagttaggcacttgctgtattaatcaggttagacttgaacaccatatgggcattctcttgcctttccttcgcaagtgctggaattcccagtgtgctcaccataccacctgttttaaataacattttgtttatgcatactaactatatatcagcattctaggcctagggttaatagacttgagtttagcaactaagctgtcactaaatgttgttctgggaaattgttctcacgcctttatttccctacacagaaaggaagtttattaatgtttcagccttaattcattccatgtgaattccatttaaacagctttatgaatagagtacccttctttgttgatgagtaaatttcaaaatatttcctgtggctttacattggaataatactggaaagaaatctgatatgacaaataaaaattcctgaatgaacaaaggtgagaattgtgttgcataggcgccatatcgccaaggtctgaagttgcttaatccaagagtataaagcttggactatgtcttcgatccctgtgaacaaaggctgaactctggaggaagtgggacagctgttgttcagctatgctgtgagaaaagaaaaatctctactgatttcacagggatgcacagtccacccttctcaggttatcagcaattcactcattccttaatgcctacctcagagcccattgttctcatcacgacagctgttgaggcaccctcaagttatttagtttatgccttctgtatgcagtcatcatgggtattttatcatgtaatttcatatgtaatacgctcccaggttgtttttctttgttttgttttgtttttaatgtcctagctttctgtaaattcttgcaaccaaatactcaaggataacaaattgggctaatcagcttgaaaccctcattttgggaggcactcactgcttattttttcccataatttatgtttttattcaca

SEQ ID NO: 17871 - DNA, 1116 bp, Mus musculus
tcccagggcgttccgttctctttcacgcaggctcctccgggtgctcaggctaccaagtctgcctgatgttcacatctcctgccttattccacatgtagaatgtctaacaggaggggaataagaaagatctaaggtaggaaaagaacccaactcactcattagatatcatgtggcaccagcaatttgggttcagagccaccccctccaggagtgggcgacttaactgctccacagagcggcaacaggtgccacacacacacagagcaaagccaacgtgttgactggggttctcacagggaatcccccttgcagcaagtatttttttttccttcatgaaagtgccttctcattggctactctggctgtagttggtcataaacaagtgtgtgaaaaatgccccagggaagtgctgtgtccgagtcacttaaggcatttctgtttcttgtgttctgagaataaaaaggcaaagacaggatgttgccacctcctcagagtcagggaggatttagatcaaagggagttaggagcaacaaatggtgttcctccgactcttatgcaccctccctgcatagtttccaatgagaatgggtgtagacaggctttcctatgcacaacgcacacacctaggatggaatactaagtggcgatacccatcagctctgggggacaggcacataggacctgactttctttgtttacagttttatattctatttttttaaagcgtgtgtgcaagtgtctgctgctttcagaagattactttatacaatgaatcaagaaacatgtagtcagtaaaacaaaccctaagctaagtactctttgtccattaagaaaaatcatagactgggcatggtggcacacatttctaatcccagcactcaggattcagaggaaggaggatctatgagttcaaagccagcctggtctacatatggagttctaagccagccagaacacacacacacccttatacaccaaaaccctgtctcaaaaaagagggaggaagagtgggggggggagaaggaagatgatgaaggaaggaaagaaatcacagtatttaaataaaggtacaactgctcatttttaaaaggcactggtgcccaaggccaacatttc

SEQ ID NO: 17872 - DNA, 1733 bp, Mus musculus
gtattgccatgtggagaaggcatgcttagtattctgattatgtgtaccaaacatatagcaatgtgtctgagtggcatatcagagggcccactatcgtaggtaatatggggctctcgggtatcagagtggactgagatcacaagttgtgcaggtccaaggatgcacaactgaggctcatggaggaggcccaaagaggagcaggcatcctgtgctccttcttctgtgatagacccatcagacacaggtcctgtttcccaccagaaaagcctagtgcaacagtgtccttacacacactccctaattcagacttacagagtggaaatgaagaagtgtatttaaatcagtttaagccattgtgggtagtattttgttttcttttataattttgttcattttgatccagaatggaactttatatgtaatgatttctttgacaagtttatatacgacttttttaaaaatctgattgctgtatgcatgcaatagtaccattttgtattttgtatttgtctttcacttagataatcaaattaaatagacgtctccaacttctggaagaggagaataaagagcgtgctaaaagagaaatggtcatgtattcaatcactgtagcgttctggctgcttaacagctggctctggtttcgacgctagaggtaacctcagcattcacatatattgtctcaacacctggaaatataaaggatttgcaaacttcattgtttctgtctttgcatcatcgtatgacggccctgaaaatgtatttctccagagtgcagggaaggccctgtatctgtagagtgaaggcctgtggtgctgctgatgggcgttcagccagttgtgcagtggcacctatacactctccttttgcatgtcttgtaaataggctctaggtttgttttgtttttaaagaaaataatttttgtggcctcaccagtctgtacagctaattctctaaacagaaatggcagtcataaagagtgagtttagaaaactgtctgtgaaagaaaagtgttttgtcctgttttcagatgatgaagcgatttctttgatagatgctttttgtatctacatctcaactgtaatgctttctaagtcacagtgctgtgcaggactgaagtcaaaccacctgactctgcttcatcgcctacctgcacaggcggggctaaaaactcctaacagttcagcagtctgtctgtgtgcaatgctgttttgactttcatcttagttttctatcaagtatgtttttaccaagtccatgtgtgaatgatttaaaaacctaaaaaataaggtataaatgtagtgtatttaataaactgtcaaccaaagcaatgtctatggaaagatttatttcatcctatggggctgtggactgaatatcttatccaagtctcctgtcccaggggcaagtagtgaattagtgacttgtgggtcacaagagccacctgggtttctcagatctccaccccagcacagggcttgctagcactgtaaatggtttgctcatttattgtatctatgagaatgattcaggtttatttttaaaaaagcaaaaacaaaacctttataagcctatgtaccttttttctattgtaatacttccttgctaatatcgagcctttagtattcaaaagtgtatttttttcaagaacagttagacttcagctacaatattctttgcacatcatcagtttcctttttactaagagggtgaggaaagttccaaggcttagt

SEQ ID NO: 17873 - DNA, 1120 bp, Mus musculus
acgtgaacatgacggtcggctcgttcgtgtgcacctcctgctccggcagcctgtgagtgcggacgggggtcgtgggtaccgggccgtggcggcggggcccgttggggatgcggccagcctaggccttgggggccggagatgctcttgctctttggccgggcgagggtccagccttggggtggccggcgtgggtggggcgtgggtggggtcggggtcagccagcggccggcccggcggagcatcccggcttcccgccgctcagcgggcgtggccgcgcctcggggggcgcaggcggggagcatccccgggagggcggtgcggggcctttgtgcgacccgcagctccgtggttggggggcccggcctctgctcggtgccgcggagctggtggggagggtgagagcagggacgcagaaagctggggatcttcctccggtccacagcactcaggtagctggggcgtgttgggggcgggcggggggcgttaataggtcttgatggctgaggtgtgaatcccaggagaaaagttctccctagaggattaattacgtgaggcggggaggcagcaaaagcacgagggttgtggctgcatggctccaagtgtcctcagttggggaaagttttactggaaaagggtaatcaggagttgtgcgcttcaaaataaggatggagctcgatgagatttctgtatcagaacccaagtgtcctatctgtctggagaaatggggactgggaagacaatattgagaaaggagatggaggtgaccgcctgaaattactcagatggcatgtctaggcctctctgtttaagctgtgttgtgatgggaatttttgttcttgtgaaatttcacttggaaaggttgcaggtgactctggaactgattagatgcaattattttctggttatcttgaattcaatgcatttttaatgatctggtagttaatattccttgggtcttaaaaaatattaccgtgcatgtcgcagtgtggggacacgtgtgcatgttttgtatacctgggttcacttttacaggctgaaccttttcctgggccctcccaaaattttttattatattaatagcaatgtacataacacgtaggaaattttgtaaaaagttgaa

SEQ ID NO: 17874 - DNA, 1200 bp, Mus musculus
ctgtggaaacaggaagctcaggctcagtgaagagccctgcctcaaaagagaggaggaagagagcagccagggaatacacttgagtcagcttctgccctctgttgatctatacacaagtagatacaattaaaaatttaaaaattggggctagcctggtctacagagcaagttccaggacaggcaaggctacacagagaaactctgtcgcaaagagacagagcagagcagagcgagagtgagagcgagagaatatatgagaatatttgtggatgacatccacagttttgtttactaagaggaatatatttagggctctgaattagctttcttttgttactagagtcttttagaatagtgttgtaactgtgacaattcaaggatactatgaatagattatccctttacaaaaactttgggagatttctgggtatttagtatatattactaattgggctaatactggtagcatttaaatgaattctttctaaagtgagttgtactgcattgacattttcatgaaattcttaaattcatttgtcatgtcttttcagttgtagttttcatattcattaacatatgttgtccttgccatttacagctcagaattctgcaaatgcagattttgcaaactttgatgcatttggacagtctagtggttcgagtaattttggaggtttccccacagcaagtcactcttcttttcagccccagactacaggtagagcctctccagccttgtgcttaaatgtttactttcaaaaactaaattttccaagtgtagttttgaaaaactaaattctttcatgacctaattttaaagtagctctatcttacaacgctctggggaaacctgaagtctgtttctctgaactctgtctgctgtgcgttacctcctgtcctccttttcctgcacatgctctcctgcgagtctccatccgccgaggttggaaacaccacacgttgttagtacatgagacaccgtgactaaggctcatgctgtgtcttaggctaagggaagctagttggtggcttccatagaaatagaaatgttattttatgggtcagcaaattgttgtatttgtttagtcaagtataaattattaatggccgctttaaatgtggaagtagttctgtgcaggaattggtttcaaacattgaaaattcttctgtaaaagtgtactgttttcagaaatctgttga

SEQ ID NO: 17875 - DNA, 1570 bp, Mus musculus
taatattcaaatgaactgtttaaatatttatatgtagtaatgcctcgttcatcccaggataatctggccctttcatcaaaaccaaatacaactaagaattgaaatgattaaaaagaaatctttgaacaatacccctaagttatgaattttgtatgtagagtatatgcatttctttgaatgtgtttaatagtttggtaacttgatttattggtccatagcatattaatgttaacgaaaggaagggtccagaacaaggatggaaagcacgtcctgccaaaggctccgtagggacagccagcccagttgagaagtagtaactctgtgccatcaaaaaagctgaaattgcatacacagtatgtaatgcctgttagaaagtaacttaaaaaaattttaaagcattggtttaagtgatataagcatcacttttctcacatgttgtatttatagtggatgtatttttgcagtgatggctgtctattctcatactctaaagtcgcggtgtttactttaagcactgcagttgggtgccatccttactgggaagttgtgctttgtatgtacttgacaggtgacgtgcctgagacttagtcccctctgaccaacctgccactgagaatctagctggtgttgttgaggcttgcctgcattttgggcatagtcttgaactctttgtacattttggggatctcatctgttttcatggagggaaaacttaaatctttaaactttggtttgagattgtgtcagatccaaatcaattcatatgtacaagttaaactatataattataggccattacccagatgacccaccaggctttccatctattgagtaaattaaacagttatcaaaataactttaaagactattttttcaaaaagctctgaggtgtataatgaagtgggggtggagggactgttctgacttccagtgagtgcctatagtaaaaatagaagttcttaggttcagagcagttccagtgtcacagtgggtcttcgcatggtttttgtcttttaaaattccccatcttttaggcttaaatttggggttgcttctagttttcggcactgtgttgagcattgaaagggtagtgctcagagtgatggctgagggtcttcacagtgtgggctcagtgctcacagcacacttcctgctctgtctctcatcagaagtgaagttctgtgttgataaatttaaaatcatcttggtctttatgatttaaggaatgttttattttagacttttttttttttaaatagaggttagtttgtcatctcccataagatcatttgttctgtaaattaaatacccgttctatggggggtacttggtaactcttcccgtcagttgcaaagtggagagagtggctggctgtgtacagacagtcactgtgctggcatttatgaaacaagctgtttcacagtcatagttcttataactgttgatggtcccggcaggagctttagtttatgagacttgacgctttcataaggttagtatattacaaataaatacagagggatttctaaagcacaccttttagatttgactgtaatagccctattacttg

SEQ ID NO: 17876 - DNA, 1105 bp, Mus musculus
ggcttacctttatttatgtagtctgttccccctacagtttcaaaatttgcttttttaaaggtaattaaaagtttgtataaattagcttattgtattgaatttatcagttagttgaaccttgtgtattttaaagcggtgttattactttgctttttgtatggttgtgtttgaacaaatgaagatgtgagcgtaaccaggcctgtgtggtgggtgtttcacagccatctctgaagaaaagatgaaggaaccagctttgtagtagcaggcttatttttactagtggtctggggtcttgaaatgctgccattgaaacgaacaggagtggatctgctgagcctgcgctagacagctgcagcatagccctggtgtgtgaccccagaactgactaggtttactgctcctttcatgactacatccgggctttgaaaaccttcagtttatatttttaatgatgcattctataagcttatttctgaaagttcactataatttggaaatgtccaagtgctgggaaagattggggcagatgctagtcttccccggtgtggggctgtacaggtgcttgctgtctgcagatgtgccggtagagaactcctagaactgggttcagatcccacaggagcagagcatgcgcttgcaaagggctcctgactccatgtccttcctcgggcagctttgcttccttccgttttaggagtttgggttagtgtttccagtgaagacttctgccgagaaggtctatctgatatcttacccattctgcatggtttatgcctgtagttgagcccattgttgtgaaatctgtccttgtccagtacctagatctgtggaggtcaatgaaaacggaatgtttgattcagaatttcataaaaagaaaatcctagacagaacattttaattgcctatagacatgcccattagttaatttttaaattgttttgttctccagagtcttgagcacttgttgtctgagtcacaatcttaaacaagtagccttctgattataacacttgaggtagggaaggttataaactactgttccacagtgttcctagaaagtggtgaatagagccagatttttacagacttagaagtctttatatgt

SEQ ID NO: 17877 - DNA, 1129 bp, Mus musculus
gtgttgaggaatgctttctattatgtctgtctacacatctgtgcatgcctttcatggttctgccttttaaaaatgcagacttttcagctttctcctttgttttaacgtggacacctttccatttgccatgtgcagcactatctcattgtgtgaatggcatcaggatccaggagtggatgtcctttgcaggaacatttttgcacgtatatgcatatacatatatacatgtttatatgcatatgtatacacacatatattacatacatgtgcatgcttacatggaaattcttgattttggcagatagggaactttcaacaaaacagataattctattttgaggctcatcagctatttatatatggtattttatttcttcctgagaaaaatttcaggtctttcaaatagttgtaaaatgccagcatttacattaaactgtgtgggcagtcagtgcactcactgagagactatggaatctcatgtcttattttatatcttactctttctgtcacccctacctgtgaccctaaagtttctaaaagaacagcttgaaagcttcctcttccagtttgtcagtattgtgaatctcctcattcccacgagcttggaatgaatgaaccctatatttatgaaagaaagtacaagtctattttttcacaactagagtcttcagaattagcttttgctttgggaaacaactcataaaagttttgggttttggcttcttaccgaaatatgcatttagtactagttgtacatagaacttgcttcctagaaaagtttgtttttcatgaggaacacttacctactaactgacttgaaaacccctctgcatgtggagggtaggagtgagggaagttcaaagggcagtagtcaggggctggcttctgtgggctgtgtttggaaaatgttgacatgctgaggtctttgaggctcagttttggtgcaggaagtggttttagatactgattttgataattgtttcttttctcttttggagatgctgaggattgaaccctcagtgttgcacatgaatgctctacaactaagtccagctaatttcttgttcattgtaaaatattgttgaaataattttttaaaataaagatatgactttgtgtaccctttggg

SEQ ID NO: 17878 - DNA, 1184 bp, Mus musculus
atcacaaaggcttcttcggccatccacttgtccatcatagcccacgtccatatgtaatgagatgggcagctggctcagtagtgattacattccagcatttggctggtgatctgcttgagatttcatataggaagtatcctatatgataacgtatatcaaataagccccatgggactttgtgttgtcataatgatagaaactaaccaccttttccatcttaggtatgagtaggagaagggagcaatgataaaaatggcaatagcagtaaaggggccaggaaactatccaaagtctaatttaaaaagagcctgctatctttgttgcttttttggttgagtgatctgaccctaccaagggtttagttgtcttcattatatttcctaaggatgcttttccttcaccagaaagaatgaacaggtttggtagtctcttaaaatacgtgatgatgtctagccatctccctctggttatcaaccttggttcatacaggacctactgctttcgtggctctgcaggtatttgtggtacagtgactaatattgactattgaaccccttaaatatggactcaaatcccagctgtgcacctcaggaagctcaagcctttgatgcctttgtaagatgtggatcatgatgctaatcttttattgctatcaaaattaattgagatggatggatgttctccactagtgataactacaatctatgaactgttatttagccacttaactagtttaatgatgaacatggattttatcttcaagtttccctcaggaagaataggttggaatcttattttaagagtaaggtatgagtctgtatgtttttattcactattaaaattctagcatcttctgcttggctcttcatgaagaacctagatttcactgaaatcacacattagttcatcaaattagtaaaaacacaatcgtcaaaccaaatgaaaactcacttttgttctcaggcaagctggtagtccccttaatgagagtgcacattagggaccacattgttttgttcaaatggatctgtggatcattgaactcactgtggaatttaaaagctaagtgggtttgtcctttggaaaaacaatgacctgggaagacccaggcttatggcattctaaggaccatttatgaacagatgtctgcctactgttctcaacacaccttatggacccgtccc

SEQ ID NO: 17879 - DNA, 1191 bp, Mus musculus
tgggtggtcctgggttctataagaaagcaggaggaccgcatgtgtttctctataatcccggctgtagctgtggctgcttctgaggattctcttctgtcatggccttgggaataagatgccttcgcctgctgcaccctgcttttcgcagttaccatgctgctttgaccagacctgtttcagaagtttccatgaagacagtgagtggaagacaacatgaccataggcagtactcagcctacccagcagtaccagttcgccattttgcaatcaagaaagccaaagctaaagggaaaggacagccccaggccagggtgaacattaatagagcctttgttgaggatataatcagcttggaagaggtggatgaagacatgaaatctgtgatggaagcacttaaggataatttcaataggactctcaacataaggactgcatcaggatcccttgatcatattactgtggtaactgctgatgggaaggttgctctaagtcagattggccagatctccatgaagtcgccacaggtgattctggtgaatatggccatcttcccagagtgcacagctgcagctatcaaggctataagaggaagtagaatgaatctgaacccagaagtggaaggaacactaattcgggtacccattcctaaattaaccagggaacacagagaaatgctggtaaaattggccaaacagaacaccaacaaggccaaagaaaatttacggaaggtttgcactaatgcaatgaataaactgaagaagtcaaaggacaaaacctcggaggacaccattagactcatggagaagcagatcagccaaattgcagacgacacggtggcagagttggaccagcatctggcagcaagaccaaagaactccttggatgaaagtcagcagtcacagccggacacccaagtcccgtgtctgctcatgccgtgggtggcaagctcgtgtctgcactgccctgaccatgcactcgaggctgacactgctgtgcctccatcagccattcagtctcctgttgcaatgctcagatttatggaatctcttccttgtttccgtgcacaggcttgttctgctctgaatctccccttgtgaatgtctctgttggcagaggacttttactctgacagtgaccttgactatggtgtcattacagcactagggccactgtcaggcttagcagctcctc

SEQ ID NO: 17880 - DNA, 1153 bp, Mus musculus
tccccctcaccattcactctatctctgtttcaaggtcaggctgtgcatggatattagccaagcatggcatatcaaatgacagtaagtctaggtacctcctctcttattaatgctagatgaggtgacccagtaagaggaaaaggtccccaaatcagatagaagagtcccttcctcttactattaggagtcccacaaaaagaccaagctacacgactgtagtttatgcagaggatctaggtcctatgtaggctacctggttgtggttcagtatctgtgagtcactgttagcccagattagttgaatctgtggcttttcttgctgtgtccctgatccctctagcttctataatccttctgccttctcttctgcacaattccccaagctctacctaatgtttgggtgtgggtctctgcatatcaatctataagtataacagaatatcattaagcatcatgtcattgactttttgctagtcacagcaaatcctaggtctctgggctatccagcctctaggtaggacaaattattaattaggggctgcagagatgcctcagtggtaaagagcacttgctattcttgcagaggctatgagttgtttccagtacctgcttgggtcagctaacaatctgtctatagtttcaattccagaggatccaacaccctattctgtcctccacagggcctatactacacacaaacatacacatacatataatttttaaaagtcgaaaatgtctttaaaaacttttaaaagattaatttgagagagaagggagggagggaggaacagagagagagagagagagagagagagagagagagagagagagagagaatgaggatacagcaagggttcaaattgagtttagacaattatttgggagaaagttgtatttgcaattaataaatagtccaagtatggggtatatggacaggcctgtcaatgtccagttaggagagttagatctgtctatagagctgcagacacggaacttgaaaactgtcgaggtttgaataaaaatggctgccataggttcatatagagtggcactattagaaggtgtggcctttgttggaggaagtctgtcattggtgataggctttgaggtatcaaaagctcaatctaggcctggtggctgactgtctcttctt

SEQ ID NO: 17881 - DNA, 1198 bp, Mus musculus
ataatgagctttactatgctaaaataaacttttagatgtattcataaaaaaaaatatgaaaaggtgggctggtgaattgcttagcaggtagaaatgctggctgtgaagcctgatgacctgagttaaatcgtccgaacttacctgtcagagggaggaaactgagaccccagggctcccctctgatgccatccattccaagaaatatatatgttaagttctatagctttatttaaacatcacatattgtatatagtataatagcattcaaggcagaaataaagggtatcatctaattgtatcttaaacaacaaatgatagtaactttactgtgagaagttcttaattgctttgataaagcatctctatttctttcaattgtttctacagagagactgtctcaaacaatagaactgaaacaaaatccaaaatattctatatttccaatgcttgctttaaattgaaaatatagttgtgaatatttgtaatctctactagcactcatgggaaatagttgatattttagactttgtgtaaccttgttgaatttactgcttacaacaaaggggaaaatatataaggaaaggacataaggaattcccagaatggagagggtctgcaacctccccagtgagaggctccttgaggacaatcagcttgctcacaacatctggctcagattcttcatgaataaaaacagaagcacaggacagaagtaacagaaaggaggagtgagagagtgagatgtgcataatcatatatatatgccaagatatctaactagaggaaacatcatctgataaaacaacaaccaagataattccatgggagaaagaagaatcttgtgagaccacaaggaaagaaataaaacgactagttataatttaaaaaaataaataaataaagcaaagcaaaatattgaggctgtgtgtgcagttgaagaaccccattcagtcaaaataccagttattgatgccttctctgaggaccatttatgatgctaatcacagaaattccatgtgtcatccatatgccttaacaaccactgctgtgttcttgtttgtgtgatcagatttctgccatctcctcttcactgtcagtatggaagaagattcaccatggaaacaacagcaacatcacactggtacatgggctagtggaacaactccttcatagaaacagcatttccaatgatcacgct

SEQ ID NO: 17882 - DNA, 1145 bp, Mus musculus
gatgttttcctgggccatgctccctgctttgagcactgaacataaatgaggaagcagatgacgttctccctgttttctttccttctcacttgcctacttcccattcaggatgtgactctgtcttctctctgaagattgtatgtcacttttcttgaggttctttgaattcaagtggaacagcagtacccccttagaattctggaaggatgtgtgtcttaggctctctatggcgggcataaagcaccatggcctaaaacaacttggtgaggaaagggcttattttatcttatatttccagatagtagcttaccactgagggaagtcagggcaggaactcaagcagggcagaaacctggaggcaggggcggaagcagaggccatggaggggtgttgctttattggcttgctcagcctgctttcttagaccatccaggaccacccacccaggactagcactggccacagtgagcggggccctcctgcatcaatcactatttaaggaaatgccctacagacttgcctagaaccccatctcctcaaaggcattttcttacttccgattcccttttctcaaatgattttagcttgggacaacttgacatgaaactagccagcacaatgtggttgatttatagtttcatgggactgaacagagacatttctgagctggaggttttactggccctatcatgtagtagttaattatataaaacggccagtccaagaagcgaaatccaacaactaaacttgtgagaaaagctcccaacttggacttaaacacacttaaaatcagcaccatatgtatctgtttcctacacttgagtttttgtgtttatgtgaccgggtgtgtatttaattaggatagtcatgctctggcatgttttttttctcattttaaacaaaagctaattttttttttttttttttttttacccattacctcccattcacatacatgaatccagtgatttctaatttacgtagattttccttttcaaaataagcttctttgaatatcaagacagaattcaagtagaacaaagaagaacataccagtcacttttgtgtcattgtagatgaatacctgacaccagcaacttaagcaaaggaaaggtttatttctttcatgatggcttaggctcatg

SEQ ID NO: 17883 - DNA, 1200 bp, Mus musculus
ttgcttattggttcactagagagcagggtctgttagtgttcaggtggccaacctgtgtggagttggatccaacctctagctttctgtgacttctccttctgtgaagaagaaaaacggtgtttgtgagtcaaggagtccccaagcattcccgtgtctgagactctctcctggttaactgatacacaagacacccagtcctgtgcctcagttaactctgtataaaatgggttttggcatcacagagtttgaatgcaattctatatagattgctgaaaactgcatacatgccgcatgtttattatcattgtcctttgtcatatgctcattatttatggcactcatctctgttctatcatcacttcctagtctagccacctgtctgcctatcatttatctatcatctgtcaattatccatctattatctatctatctatctatctatctatctatctatctatctatctataatctgtctacctatctaaccaccatacatctatctcatctatatattcatctatacacctatttaagtatctattgacctatgtagctactatgtatctacccatgtgtctacctgtgtgtctatttatcacatatctgtctgtctgtctgtctatcatttgcctatctacttatttacttaggaaacaaacatggagatgtttttgttcaagtgcaaggattttataaaagcatctataaaaatctgtgtcatggtctttgtcctcattgatataggactgtttagtaccagcacctgctatactctagccactgtttcagacctcctctttggaccactggaaatgagttagtacttccttgggggagaactataatcatcatttagtgaaaacaaagagctgttgtagacaggatagatttgggagggggggtgtatgggagtgatgacccgcagttgtttgcagtgaggccagatatggtagggcatccttagcagagcaaatagcatagtaaagagctttgtggagaggaagacatgcttcgagaatgggctggtttcatggggctgggagtgcatgataagaagggatgatacccctgcacaagaacaaggaccatgcccacaacgaccttgcagtgctgtgttgagcagactttctttaaaaacaaattatttgtaattatgtgcttctctgtgggtgtgttgtgggggtgtatgcacctgagtg

SEQ ID NO: 17884 - DNA, 1223 bp, Mus musculus
gtttcacagtctctactagaagtaaatttgaatgttactgaatagataaccttcttactgaattcctactgaattccaagtttgtcggcttcaaggattttctgggacattggaacactgatgaaggcttagctatgtcagaattaaatcttaaaaggcacttataataaaaataatactaaaagagagcatgtggatccatacaccagaccaattcggggatagggtattgaaagtataacaacgtaaaaacagaattctaggcctttaggcccaggcttgggaatgtggcctttgtaaaggtatgctaatcataaaagagatagcgacattcctctacccacccgcttcctgggttcaaagagtgctcattcaaagaaagtcaccctggccattaccagaacctgcaatgcaaatgtgctattgttagaggctcttagaagctgtcttgagagttaacaattaccaggtattccttgtgactcttgtaactttacacttccttgtgactcttaactggtatctttggtatcttccaacaacgccctccccacttccttgagtttcggtttcttcctttaaatacccccttacccagctactcggcgcgccacggtcctctacccctgcgtggtgtatgaccatgggcccgagagcgctcttgaataaaaatcctcttgcaatttgcagcaagacccgtttcttgtgggtgattttggggtgtcgcctctcctgagtcagaacgtgggggagccctcacattgtgggtctttcagtatgagtattcgggttatgagaatgccaaggttccaggaggtaagtttctctgaaactctttgcctcgtgagtgcttccaggcatctcggcctgtcaagcagactacactggagtgtgcatagcaaagggtctagagttatgtctctgtcaacatgtgtattagggattctttaaaaaaaaaaaaagtcagccgggcatggtggcgcacgactttaatcccagcactcgggaggcagaggcaggcggatttctgagttcacgaccagcctggtctacaaagtgagatccaggacagccagggctatacagagaaaccctgtctcaaaaaaacaaaaaaacaagactgaaaacaaacaaacaaacaaaaactaaaaaaaaaaaatcaacaaaaaacaaaaagaaaaaaagtcaatagatttcaattctacagttccttcctttctctg

SEQ ID NO: 17885 - DNA, 5652 bp, Mus musculus
gttggtgatattctgggcactaaatgaaggtgtttgtcgacagtttgactcattcagagatggatttgaatcggtcttcccgctctgccatcttcagtacttctacccagaagaggtgagcagcacatctaaaaaacacaggggccattgttgtctgtgtggtcaccacagcagaatagttaccctgttgcttaaaaaaccaccagtctataggactttggagtaagggcttggagttttggaaaagctagggaaataggaaagttagttaaatgagggagcagttctatagaggggaggtaggtagtcttgtgtgaagtaaagtacagagcagcattctagcccaaactgtaggccatgctgttcagtgtgaagggtcttggtagcgttgcacactggaagccatgttcttagagagacagctactgtcacccaagcatggagacttatttctgtactaattctttacccttatttcatctcatagctggaccagctcctgtgtggcagtaaagcagacacttgggatgcaaagacattgatggaatgctgcaggcctgatcatggctatactcatgacaggtaagtatagactgctagttcttcagttaatagctaggaattttgtgggaattctaaaattgtgtattattgaagttgttccctttagatttcagctattacaaaaagtgtgttgtaatgagagttcatatgtaatgatacctgaaaatggatgtcatcatgattataagtgaggtttggtatatttacagttccatcttaacgcaaagtaattttgttctacttttttgttttagtcgggctgtgaagttcttgtttgagattctcagtagttttgataatgagcagcagaggttgtttctccagtttgtgactggtagcccacgattgccagttggaggtgggtagtgtctgcttggcctttactctgtctctggaggcggtctattacttggtgcacactgtctgttatcccatcaccattgtgtctgagctgccagtctatctgcataggaatatgtaaagaaataatattgacacggaaaatcagactgccttaataactgtcaataaacacttgctaatggtcaggaatgttggttgcttagataaaattctagagtctttgcatgttttaaaatcatggttaaattacagtagctaaaaataagttgaattagtcttctttgggtgttttttaaatttgtattttgtgtatgagtgcttagcttgccatgcatgtctgaggccagaagaaggtgttgaatccttctttggactagagttatagatagctgtcagctgtcacatgggtgatgggaattgagcctgggtcctctggaagaatagcaatgatcttaaccaatgggccatcattaggcagaagagaggaatacttgggcaatttttaacaagtgctatatcttgtgataatggcatctaaaaaaaccttaattttctggaactttttctcttaattaggatttcggagtttaaatccacctctgacaattgtgcggaagacatttgaatcaacagaaaacccagatgacttcttaccatcagtaatgacttgtgtgaactatcttaaattgccggactactcgagcattgacataatgcgggacaaactcttgatagcagcaagagaaggccaacagtcgttccatctttcctgatcacaacaagaaatcagtgtctgcctgttacagcaaaagaaaaaaatcatgatttcttttctgtgtcacctgagtcaaggaaacatgttcctccctcttgttgtaggaaaacggcttgcagattataattcgtaatggccctgtggacttaagtgatcaggccctaaagcattgttgtgatgaggtttctttagcaagttcttgtttaaattatcatttatttgatgagtgaagtttttaacttgctttgctgtgtgaaatttcaaagggatgttttttcaggctggaacaataaatgtcgctgtgcagtttaattctgggctgtgtgtatccatctagctaagtctgcagtttgtttcttccaaagacaactcttgtacataagtacagacattaaattcatgtgtatttgacaactctagtatagtaaatgggttctgcgtgccttccacctaattttcttttccgagttcattgctgcctctgcagttcatacaggtttggtgtttggtttttgtttgtttgttttactttttaaatacaacacgtacagtttcattagccccaggccttgtcatcctgtgttcattcaaattgagatacaatctaaaattcattgaattgaaatatactctcaatataatacagcctttgtatctaggcaggtaggctttacttatagtttagtttaaaatagttacagagcacgcttggcttcttgccaggtgatacactaggtctgtttacatggtatttcccttgtcctctggaaaggaggaaggaaagctcactcatttttctgtataggttaaaaggtccacagtgtgggctgcccagtatttattctatggccaaaccattttgaattggtgtaaagttttaaatgaattaggtccgcccccccacccccttattggagttacaaaagatatttcccccactcctttgttcctgtttgtttctgttctcagtctttatttcattctcgtcttctcccagcgtgaattgcagacaagctgttcagcccttgtctacacatagatcaaagcacctgtaagcaatgctgtccatttgtttgtgtgctcatttctcagatctgcaataatccatcaggttaatgtttttacctaaaaataaaacagatttgcttcaccatttttgtttatagttctgtgctgtcacacacacacacacacacacctgtcttaatcacttacagtacaagtaagtcgtcctgtggtcagaagtcaagcaaggtcttgctgctgtttacagcttcttgaagaacattaaatgtggaaaggaagtggaagcagagctttcttcctgaggctcaaatgaagactaataaatttgaactctgacttcatctccttcaatatgagatgcattatttaaaaacaaacaaacaaacaaacctgaactttgaagaaactaattgtactgacatagagctgccttctttattccatcacccaaaaggaaggtagtgggttagtttactcctgtaactgtcattctacactgaccttgccttatgtggaaacatcccttgctgacagaaatctcttgacagtttgcccagtcagtggggaggagttggggccaggaagtctctgctcacagaggcttgcaaatgagcagtgttatctggagggagttgggttctgcagcttcaccttgatggctatgggatctgggcccctttgtctcctgttctcctgttttacaaactgagcacaaagatttttgtgtgaaaatagcattgtttcacctcactttttaaagatctgttaaaatgtagacatctgtataaaacaaagtgatgtttcatattaaaataatatgtatttgcattttacacctgtggtgctgacagatttgacttcattgattccttgtatccaatggttgttatggttctgactggaatatttcagagtccacggtcatcagcttttgatcatcaactaagtttgctcaatacctgggacctgtggttaattcggggtcaggaagagcacactttaagcactctctgagcagaggccttattgcacactaggggtgtgtacacttggtttgctgtgttccagtggtttgattcagggacctaccaacaggcatggttggtatgctttcaacactcagttactccagttgtcaggatgttaacagaacctcttcctggtcccagaagagtaagttacattctaggtctaggtggctgtggatgtctcggctcagttcagcaaaagcatttttcatatagccaccaacaataggaaagcagtaaggagttttgtgtctggttgtgaaactgagcacacctcttgagtcatgtagccaacgggtgccttctgcttctagagtgacttccttgggcatcttatgtatgaagggcaaggaccgagcaccagcttctgcatctcacagacagattgtctccatcccttcccctgcctagcaggggccctccatgcctttatcctccccctcctgccccgacactgtgcagccacacctatatttgtgtgtgtggggggggtggttgtttgttttttgttttttcaaatgtggctggtgatgacccaatatgtcctcatgcttgtggctcaagcatcaaccccactaagccatcttcccagccatcacttgggcagatttgagtttgtggtgttttctcaagtttattgtgtcttgagattcctttttcatttcttatcaattagtacaaggttaggaaataggaaggttggcattcttccaaaaacgattgccaagaacaatttgttggaaggaaatacatcaaagtgcattgatatgcctaccctttcctttgcattctgggtgttctactaatagaaatgccttccatttcttgtatgctttggttttctgaccaattttgttttctccattgtaatgagaatattgtctgatctgttttgctttgtttgattcttttgaaaggtgttacataggggttaggtttgatgctgcagtagatccacaataaagagtgacctagtaacaggccactggaaagtcgcggttacccagacaagtagtagctctggcacaactcagctttcactgggtcaaaaagctggcatatgctaagaagttcaaatgaacagttattaatgcaaagaagacatttcttaatgcttacagacttgttctgtatcaaggagacattcttcagtaatggaagagggagttttattttttaatacaagtggactcatgaccaaactgataagcagctggtctctataaaatgttttctttctcttttgatctgaaacatttatataaactgctggaataatggaacttcagactaccaagtgtgtatgtaaaattgcatcgatgccctgacttcctgactatatttttaataaacagcattatccttcgtggttagttttgttactttatgtacaaccagagggtgtttcctgaagtgtgtggatggtattttgagaagctacttctaaggagcagggatgatgttaacaatattgggggcaggttttctcgaacacagagcacttaatctctggagcaaggtgttcaccattaagagctcttgtgcattggtgaagccttcgtgtctttggagttgttgaaagacatgaatgtacagagacaatagatggggaattctttgagatcactgtccttgcctgtcatggctgattgttctacccacaacaatgggtcttatttctgaaacagtaatctggatgtgtgggggaggggtaggctgacatcacattagagaggtgctgctaaataaaagtttagcagtgaaaactgtgaaactctgtttctggctctgttggggactgggaagcagcaccttggggttgaagtagttcttggaattggtattggcatgttaatggacttttcaggtgttttagttttaatttttcattatgtg

SEQ ID NO: 17886 - DNA, 1085 bp, Mus musculus
acacctctagtgtgtgctttctatttgagccttgtaggggacggggaaaagtttattaccattactaggtagtacattatctgtattgttgtctacatattttactcttgagtatatacttagtttatattggcctagaatttagaaaaaaaatttttattttgctaaagtttaacaaagacatttaaggactttattatgtgatttgagtatgcttacagggagcaataactactccatatggaaatcttgtttcccttcacaaatgtaattggatcctgaggttaagattatttcctttgtgattccagtgacttacgttgaatgtgaccaaaatttgtaactaggcactaaaggaaccatcaattgttaaaggattatgttttataaatacagtataattttgcatgtatttttgtgcttccctccccattgttatcccccccattaaagaccaaagagagtctacaatatgcattggaaactcttacgatgaatggctgttcagtggaagatctgggattggattttacgctgcctgggtttcccaacattgaattgaagaaaggagggaaggatattccagttactatccacaatttggaagagtacctgagagtacgtattgtcccgtgggcacacctgccctcccccccccccccccattttgatctcagctgtgaaggagtttttatgttgtgctctttgcatgccattgggaccactcttgggaggtccttttagcctttgtaagcttctgtgtgctttgttgagaacacacagatattttatactaaagcaacagaacaccctaagaagttactgctctccgcactttgtcttccttccagatgagaagagctctatcaaacatgtttgtgtaaagagcttaccagttatttctccatatgaatatgatcttatattgacccatttttaaactttattgagtacagtgctttataccacaattttctcctctaagaagaaataccagcagaaaggagtcatcacttgtttgaaggcagctaactggcagattgcttttaaaaacaccagtatatgtactcaccctaaagtgtatt

SEQ ID NO: 17887 - DNA, 1898 bp, Mus musculus
caagaggttatagctccagttctagaggatccagcaccctcacacagacatacatgtagatgaaacaccagtcagtgcacataaataaaatagaaaaagaagaagaaaatgaacaagggacttggaatcgctgtcataatgaagtctgtcataagagaaaagaaagttgggctggagagatggctcagtggttaagaacactgacgtttttccagaggtcctgagttcaattcccagcaaccacatggtggcccacaaccatctgagatggaatctgatgtactcttctggtgtgtctgaatctaaagatagctacagtatactcataaacataaaataaatcttttttaaaaaagagagagataagaaagttaattgataaatctccacttgtgaaactgcttattaaaatgttttgttgtggagtgttgacttcagacggctgtgtttaatggtttttgttttgttaaatacataactctagcttcctggagaagagcctgttggaagagtagaaccagtgggccatgcacctttgctggcattggttcacaagatgaacaactgtctcagccaaatggagcaatttccagtcaaagtacatgatttccctagtgggaacggagctggaggaaggtaaggaccattacctgggtatgtccacttgccaccagaattgtgaaggaaaacgtggtgagaggtctggtaaggtgttggtcttttttaggaacagtgttctgtaatgacttaagtaatttgtgtcaattaattaaatgcatttttttatttaagatcatgcactgtatttgatctatttatttatttatttatttatttatttatttatttatttatttatttatttatttatttattgtgtgtgtgtgtgtgtgtgtgtgtgtgtgtgagacaaggtttctttgtgtacctctggctgtcctggaactcagatcagcctgcatctgcctcccaagtgctaggtgtgacaccatgctcagcctataccatgtattttaacaactgattttttgtttgttaattttgtttttgttttgttaatattttgtccttggctgttctagaaggctgttctatagaagctttctctatagctcaggctgtctttaaacttacagagatcaacctgcctctgcctcccaagtgctgggattaaagacatgtaccacaactgcctggcttacaactattattttttaaaatcagtaaatcagtgactggaaagacaaacattcaaaatttctggtttttgtttttcgagacaggatttctctttatagccctggctgtcctggaactcactttttagaccaggctggcctcgaacttagaaatccacctgcctctgcctccggagtgctgggattaaaggtgtgcatcaccatgcccaacacattaaaaatttctaagtagatatgttttaatatgtaatgattctcttaattttgcttttgtatattggcaataaaatattctgactcttttgatcagttctattttgatgggtatgtaagtatccattttcaagattgatttccaataaaaatttgttattcttactggttttaaggacttgtaagatactagagacaggtaaaattaatttgttagggaattctgtaagctttctggagtatttttattgaaaatataatgtaaattagtccacattctcacttttacaattttgaataaaaacagtatctatattccttcacagtatgactgaagttgttttctactatcttagaatagttttatgaaacaaagggacatcacaaaatatggtggaatacctgtaatccaaggaagttcccaaggaggggggaatattgtttttttgttttgttttgtttttttactttagattttacttacaa

SEQ ID NO: 17888 - DNA, 2351 bp, Mus musculus
tgtgtatacctcatttttacctcatttctttagggaacagtgatggacagtattagatatatttgtcctttatccagttattatgcaaatctgtgtttgggtatgaacaggaagttagaacacttgttactcttcacctgatgacaaaatacattccaagtacctaagcaattctttagctacatcttagtccattttgagagtgaagctgaatttgctttttttgagtcataataatgatagtaggccagtaagagttttaagtgtagctgttttatttctctcatatatgtatatgtattaagtacttgtagaggtcacaaaacaacttgcagaagttggttctcccaggcattgaactcagcaccgtaaccttctgaaatatcttacatttctaatctgactttggtgtagggtgttttttttttttttttttttttcccacctatccagagacatatctcctttttccttcttgtagagaaaaaattaaaggctggattaaggagcaggcacataaatttgttgagcgttattttagttctgagaatatggatggaagcaaccctgccttgaatgtccttcagagactttgtgctgcaactgaacaactcaacctccaggtactgtctgtgtccagtgcattgctgggacatcagttgggtggtgtttgcagaaactttgctttctacaatttcttccgacccttgtccattgccatgatttatcatctacagtacatactggaaaccttgccatttctttttgttctttgagttgcctatttcttgacaaaagacaaaatttcagaaatgtccccttttctaaatacttataaccacctctatctgcagactcgttgtatttacttgactgaaagattgaaaggcttgaggctttattgtgcaacccccccaccccccgtttttcccccacttaattttttgttcttgttttctaagttatttcatagacattttatgcttattaacttaaagccacatcacaatttatcatttttaatgtggctttctaaaaaaaccttattctaattttaaaaagttattaaagtatcaggtgtacaaagtcatggcctaatatgttcatacatgtatattttgtgcattgattctattctaattttctacccattgccccctcttgttcccctctctcctggttctcaagtagtagctgttctacttctgtgtttctgtttttaaatgtgttatatacatactagaggtagcatgccctaatttgcttaacatagtgacccttccagataatgacacaattatggaggagatattttgacaccatttaacaaaatagtagtaggttccttcttaggacctttgacctccattgccttttaaccaggtttacactatcaggaataaatttcctcttgtggagtgggcttcagatctaagcccagtagtgctctagccactgttgtaccagtgggcacaacttgcctggcaggttggtattgtagctcatagggttcatagctggctagtggtttttgtttgttttgattttaaggtattgagaaaaatttctttttgggaaatgtgaattgtagtgtttaaatcattacagactcttcttctccactcttttaggtggatggtggagctgagtgccttgtagaaatccgtagcatagtctcagagtcagatgtttcttcatttgaaatccaacatagtgggtttgtgaaacaactgttgctgtatttgacatctaagaatgaaaaggatgctgtcggcagagagatccggttaaaacgtttccttcatgtatttttttcttctccagtaagttgatagtgctcatgggtactaagagtcagagctagcaagtggatgtatttgtgtcccaatagaagtatactttgtgttgcttattcagttagattcctttgacagttattgacaaagtcttactatgtagatgaggctgggttgcaattcattcacagagatgtgcttgcctctgagtctcaggtgctggggttaaagataggaatctgctgtatctggctcttccaaaaatttttttgtgtcataaaataagtagtaaaatgaagctagacacgaagcccatgattagatctcagcacttggagggcaaggtaagatgatcagatacacagagagttttagaccctttcttaaatacaaaatagaaatcccctcctccccacttctagaaacctaaaggtgttacctatttttcttactttgcaagataagcattaatattagtctcatttatcaatatttgttggccgtttgataggcagttaaagtattactgcttaacataatctataatgtagatta

SEQ ID NO: 17889 - DNA, 1178 bp, Mus musculus
ttgcaagttattcagtgtattgatgtggcagagcaggccttgactgccttggagatgttgtcacggcgacacagtaaagccattttacaagcggtaagtgttatcgataaagtgtggggttgtttttgttttttttttgtttgtttttttgttttctctgtagccctggctgtcttggaactcactctctatagaccaggctgtcctcaaactcagtgatccgcctgcttctgcctctcaaattctgggattaaaggtgtgcgccatcactgcctggcttaaggtgtgttttctttattgttgaactacattgtgctaattccttgactgtagctctgtaagatgcacatgctgctctgaagtactgtgctagacattttagtagttgctttttataaaggatattattttctccactttaaaacagttttctatatttcagggtggtttggcagattgcttgttgtatctagaattcttcagcatcaatgcccaaagaaatgcactagcaattgcagccaattgctgccagagtatcacaccagatgagtttcattttgtggcagattccctaccattgcttacccaaaggctaactcatcaggtaaaatacgaatgtttcctgtgacatgaaaatttcaaattttgagttcttctaattggatatgtttaacacaaagcaatctgacttatgtttctattgaaatgtgttgtccagtcatataattgtcatttttataaggttttggcatattaacctaaatggtttataatttatatatttaataacttaattgatattaactaatgactttattattgcactaattaagatgttactttgtgagatcagtatttacttttagaaatattcctctaaaaggcatttggaacaaagggcttaggtaatgactaaaagggagagattgtccagaaatagaaatgaaaagtatagatttcacctgtactggggctggaggagagccagtagacatgtaaaggataaaacatcagtgatactgtttgaatagcagaattcatatcagatttgaatagaggagagtgagtgctatgtctggaggccagagagaagcaggtttttgttttttgtttttgttttttttattcttagactttacaagtgctgtatgagtagaagcaccttttaaggaatctcc

SEQ ID NO: 17890 - DNA, 1200 bp, Mus musculus
tactccatgtatgaattaggtgggtttgtacttatatctcagatgatagattttaatacactcccaatgtaaggggttgcaagagacattatgtgaaagtttcacattacttgaaagtttctgagataaatagcaattatttataaaagcttccccatgataccacttatgaacatagcttttctttacaactggtaaaagtggtttatgattttcatgcttctggacagggtgaccaaaatctttctgggaagtaatgttaataggaaaatgaggcaaggcttcttagtccatgacttacctaaaatactttgattttcttcaatagttgtaatctgtatacgttttaacttctctccaaaacttcatttttagaaatggcatggaggtgttttaacgtataataactaattaaatttgtgtatgtataatgttttagaaatctaatgtaatttctcgtaaaattcatagtgcaaagtaacgttgtgctaattgtgtgagatgaatcagttccttgacattttttaggagaagatcaattactttaaatcaactcaattattgcccttttttttttttcctttagctctgttagaggccaggggtcttcctcctcacctatttggtcctctcgggcctcggatgtcacaacttttccatagaacaattggaagcggagctagtaagtgaatattttacaatttttatttctcttagtaattagttatgtgttattcttattggttatttgttggcatataatttagtatcttttaggtttccttctatacttttatttttgactacccaactgaaattataaaaatccatattaaatattttaaaagttacttagaatttagatttatagttagatcatctgactgtacctttttttgttcaaagctttttatggtgtcacaaatttcatcccataagatagtgttaacataaacctgataggaagatttctcagcagcattacttctcaccagactatcagattaattataacccagagccattcatggttgacctaacactgactaatacatatagtcttgatttataactgaaatattgtcctataagtccagttaatgttttccttggcttgcatttagtaatttttctataactttggtcagcttggtagctgactgatgcatctcatcaagcattgatggtatttgtgtgtgt

SEQ ID NO: 17891 - DNA, 1485 bp, Mus musculus
aagtctaaagtacatttaaaaatcatagtactttccttccatttccaactatgaaaacgtttatagtagtagacttccgaggctttgtctcccaccacctttttcccctaaaggtccagagatataagggagttgggaacctaattgttagaagacaggtttactcatgacaggctacggctaacacttctcttatctaacttcttagaagctgcagttcatcatctgctgtcatagttccacaaccagaggatccagacagagccaatacttcagaaaggcagaaaacggggcaggtgcctaaaaaagacaattctcgaggagtgaaacgcagtgctagtccagactacaacaggaccaattctcctagctctgcgaaaaagcccagagcatttcagcatattgagtctttctcagaaaccaataagccacatagtaagtcaaagaagagacatttagaccaggagcaacaactgaaatctgcacaattgccgtcaacaagcaaggctcacaccagaaagagtgtggctgctggtagttcacggaatcagaaaagaaagaggacagagagttcttgtgttaaaagtggttctgggtccgaatcaactggtgccgaagagagatctgcaaaacccatcaagctggcttcaaaatcagccacctcagccaaagctgggtgtagcaccatcaccgattcttcttctgctgcctctacttcctcatcatcttcagctatagcctcggcctcttctactgtaccagcaggtgccagggtgaaacaaggaaaagaccagaacaaggccaggcgttcccgttcagcatccagccctagtcccagaagaagtagcagggaaaaggaacagagtaaaactggtggctcttcaaaatttgattgggctgctcgcttcagccccaaagttagcctacctaaaacaaaactgtctcttccagggtcttctaagtcagagacatcaaaacctggaccttctggattacaggccaaattagcaagtaagtttatgggaagatctttgtttactcaaagaacatgtcttggttggtcaggagtgattttgttttcaaatcagtttcattttatctccatataacaatgcatgttagttaaaattcaagttaaatttgtagagacagttaaggaatgtctttattactgctgagtaattacatttgtgtctgtttgtctttttagaatctgctattcaatgattttctagtgtcaacaccagcagagttatttattctgtactagatttaaaaaattatttttttcctgtattagattttaaaagcaatattttatgacttaagagtgcttcataagatggctgcttcatatattccacatatttaatttattgaaaattgtaggagagtagaaataatacatctaagcaaagtaacaggtggaataatcatagcgctgtatgttttccttttcaaaatagccttggagatggagattta

SEQ ID NO: 17892 - DNA, 1195 bp, Mus musculus
cagttataataaatgtttaaaaactatagtcatattgccttttattttaatgtaaaaaacccatacatttatgggttaatagtaaaagtattttgatacctgtatatattatgtaataatgttaaacttttatcaagttaaatatacctatgttatttgtcatttttttctccaaaacattcaaagttctcagtttttggaatatatattacattgtcatttagtcaacctatgccatgttattaaaagaagtgtgtgtgtggtatggtgagaaaatactagaatttctgtaatgaaatctgaaaaatattacttaataagcacaatgtacattttggtaactgatatttaggaatcttatcctttgggtatagaggtggttgattctaagacaaaattacttttctcagattatctgataggatcacaatttaattaatacttggaagacttgtaggtcaactgatttgggaggctttttaatgtaaaaatatttcactttcgatactgcatttgcatctcagtgtcctgatagatttctgttttgattttctgctgacaggtcacacttagggcaggcaaaacgtaagggatatatccctcctgagagtagaaaatctaattttaaggcacccaaagtgcaatctaatactacttctgaactgtcaaggggacacctttctaaaaggtaaattttcatattgcttatacagtttcaaggaagaattaggatttgaattatttcataatattaaagcttatgaggttatctcaaatgttagtacagttttttctctgtattttattcacttcagtggtcttgctgataactaccgtaggcgatgaagttttttccttgtttaggagtgatgaggttcctcatttgcttaacaaaaccatggtaggaatttaaaaaacagagaggggggagagagagcgagagtgagagtgagagagagagagagtgagtgtgtgtgtgtgtgtgtgtgtgtgtgtgtgtgtgtatgtatgtgtacgtggacgtgtacgtgtacacatgaacgccactgcccacggaggccagaagagagggcattggattccctgaagctgaagttagaggtagttgtaagctacctagtataggttttgggaactgaactcaagttctatggaagagcaacaactgctcttacttaaatgctttcccccagtt

SEQ ID NO: 17893 - DNA, 1189 bp, Mus musculus
taggtatatgagaagcatgagcatgctttgcatatctatatctgccagtacaattgctttctttaaatgtcactatacttttccattataataagaatccctttaaaaaatatatctatttatctgtgtgtcttatatacatgcatgttggagataaatcggaggaaaactttctgaagttggttctcctttccactgtgtgagtcctgaatcttagaaatagattgtcatatttggtggcaggtgattttactcatcaagccatcttgcaggccccagatttccattttaatgtagtctattctctctgccaatgttagcaatcctgcagaaatctcagagcacattgaatttctcctaacacatttattacaataacattttgggatccccaggatctgcaggcaaactcattaatctatcggccttttttgcttgttcatttgtcattatgttccttatactctcaaccatgttgtcctaagccagtaactcactgttatgatagcattcacttttttccctgtatccttttgtaggcttaacattattttcaagtagaccagatcctctttgctttagagtttttaaaagcattataccactagacttggtatcatatgcttgtaattcatatacttcagaaagagacgacaaggaggattatgggttacaggcatgcctgggctttgtaggaggctacttgaaaaactagctgggtgagggtggtggaagtctttatcccagtaggtgggttttctgtgagtgccaggccaacctggactttggagttttgaaagagaaaagaattacaccctctttacagaagataaatggaataactatggtggttttatcaaacatctcctagttacagcagcccttctgttcaatgtttcccattcatcttgaatggttgttacttctgttaactagattccttctatccattgcctagcctttaagagaaagcacaagacttttgttggcattcctgctcagatgggaaggtgtcctggggactcggattcccaggaaccacacaactctgggggaaaaaggtattgggtgttctgaaacacaggagctcaggaaccactcaggtcttagaggaagtctctgctgagatgaagcctcttcaggtgttgcagctcctcagctaagcagaggaatttaggagccttagccc

SEQ ID NO: 17894 - DNA, 1235 bp, Mus musculus
gtatttcatggtaatctgaaaaggagttgggaatcaaaacaagacaaaacaaacaaacctcctcattatgaggaccaaaacatggttactttcctaatttctgaacaaagtagctcaaaattggaatttaaagtgatttttaaatttttttctgaaatcgtagaccccactaaaattagttcccaatcactgacatgaagccctaatttaaggttgttagtatatatgtatatcatgttttgttctttgtatttgcttagtacattttgtaacatgtctttcaaccatttgcgacccttttttgttgttgttgttggtttttggagacagggtttctctgtatagccctggctctcctagaactcactctgtagaccaggctggccttgaactcagaaatccgcctgcctctgcctcctgagtgctgggattaaaggcgtgcgccaccacgcccagcggcaatccttaaatgtgcctctacttcgtgattttattgagagaccatttcatttattttaagcacttaggttttgacactcagtctggtgctggtggtgtgaggactagctagttgtacctatatccattatgagggtgtgagatgctttttagctctcagttttggtctgctgttgatctttttaattggaattgttttatataagacagcatgaagagtaacacagtcttttgaaagtaaaattatgggtttgaactagtgatggactgtcagtgtcagtgtttataaagtactcagaactagtcaagcatagttctctaatctagtgataccagtgattagcttgaagtgggtcaatgaattctagttattttagagtgattatctaaattaacattttagggcagtcatatatattggtaaattattaaaaagaaattggaaagttaaatgtaaataatgaataactagttgtgttcactgtaactacccatgagttatgagtaaggtctttgaaccaggataactgtgagttatgcctctgccatagaatttgcaatcctttggattaaggttgcagggagcattaattccttagtccttaggtgggtctgtttgtttcttagagttgcttataatcttaagtattgtaatgtgcatacttagtagagttcttaatgtttctacattcagtttataaaaagacatacttacttttatgctgatggtttaaaaatagcactaaattaatttgaataacattactttttgaaaa

SEQ ID NO: 17895 - DNA, 1132 bp, Mus musculus
tgggacggggggcccggaaacagggaaagggaggcgctgagctgtggacggcccggaaatggaaactagggagcagctcgagtgacaactgttgtgaggcgagggtctgaggagggagaggcgggagtgactttgggccgcggtaagggtcttcctgcttggggcggggggcggttgggggcgggcgagccgggccgagccgggccgaaccggcgcggggcggcttttccagccggggaagtcgaggctgagggaggacgaagacgcgccgagcttgcaggggccgcggtagaggccgaggaacttggctgagggaaagcaggctcctctaagaggactagcaggggaataggacggagaggtgaactgggacttggggggagggaggtgggacaattgtcaccccaatcgtattaacattcaaagcgactcaggcgatttaatatgtgtggattacataaaacctattacactgtttggccgtcagttcaactcttgggcctgtcgggtgggttgcatgcagagaagtttttacagggatgttcagaaaacgaaggttttaagacccagtcttctgtctaggacttccatggaataacagccttcattagttagaatgcagagacattactagaattaaaaaaaaatgcaggtggtggtggtggttgctaaattacatcttgtaactattttagggggacgtgagggaattgatccgcggtgagaggaaaatgggaaggggcggcttcccacccagatttgtttctgttaacgcgttttagcgtgtctcgtctcggagaggttttagttttagcttctgggctgggctttagtttgctggctccgttaattgggggcggggatgttactaggtaaacggggagtgggggtggggtgggggttggggtggggggcggttgatagcgcagtgactctgttctgagtggtctaaccgctctcctgtctccctagcctgagctcgcgatctggcctggctgccaaatcaccagatctccaggcattcttcggtttgtaggccacagtggtgtctaactttttcttgctttcgaatcttatttttggcatctaattttttttttttaaagactcagcaagttgaggcttagaatct

SEQ ID NO: 17896 - DNA, 1201 bp, Mus musculus
aggaagtgcatagagggtgcacatgtttagtgtcctgtaacgtttcctgtgggttccctcctcgtgcctacctcacctggctcctagaggaacactctgtgtgatgaccggtggtgtcacttatgaatggcattgtcatcgcttcatctgtaagcagtgtggcctctctgcagaggtggcagacgtgattagaactgtgtgtgtcttagaggtgacagtgtttatagcttattaaatagttgatacagatgcccttatgaaaactttcaagccaggcatgttggcaaatgcctgtaatcccagctttaggtggaggcaagagggtcagaggttcaaggttagcctgggctacatgagaccctgtatcaaaaaacaaaacaaaacaaaacaaacaaaaccacaaaaaagcccccctcctcttttccttcctcccactctctcctcctctcccctcccttcctctttctctctctctctccttcctttcctcccttccttcctctctctcctccctttctctcaccctctccttacctctttccattcactgagactagggttttatatgcaaagactggaaataaaaacactgcaactcacccacttctttgtaaggtaaaacccaagtgtctgtgtttccacagaaggtccagatatgtgggctttgaacacgagagtatgactgagttttgtaaattcttacaaggtggtggtctgctggtatcatgcaaaggcaggttatcatttcaaaagcagtgtagtctgtggactggaggaatggctaagaggttaggaggtgcttgctgctcttgcaaaggaccagaattcagttcccagcacccacatgttggttcacacccacctgtaactccagttccaggggatcaggcaccctcttctggtctatgtggcatgcatacatacactcagacaaaacacccatacacttaaaatttttttaaaaaaatctttaaaaaaggaatacatattagtacaattttgaaaaacagtttatatttttatgaaagattctgtagctaagaattacaatttctaactctcgtaagaaatgaaactggccatcctttctaactcagtaactgtgtcatggaagatgatgtcagccataaactgaactcagcacacatccttcccatgtggtctatgagtgatatccttagtctcaggagtgtttcttagt

SEQ ID NO: 17897 - DNA, 1180 bp, Mus musculus
gaagaggtattggaaatggtagcaagtcctaggaagagcccctgatggccagtgcctcacagctggaaccaagttccctgagccatcaaactcaggagctacttccacgggtctgcagccagtgtcacacagaggcatctgagaaagcaaagaacactcagcaccttctgcccaaagaagtggaggaccaagccgctccttcacttctgcattcgtgtccctctgatgatgcgcatggtctcagtctcctttccaggctcccgacacacactgtggtctataaagaggactaagacaggtatctctggagaaagcagaaatgacttccccacactagtacaggggaaatataacagagatgatgtaacaggggcacaagagaggcagttctgagcttctgtaaagcttggccagtacttcccgtttgccaccacctctacttgaaacccacaagcatttgttaccagctttcgctcagagccatagcctttctctttgaagttgttcaagtaacaggctgttgtccaaaaagaaaatgtaaaatacagatgataagtattttttaaagaaaagaatttctggccgggcggtggtggcgcacgcctttaatcccagcacttggggggcagaggcaggtggatttctgagtttgaggccagcctggtctacaaagtgagttccaggacagccagggctacacagagaaaccctgtctcaaaaaaaaaaaaaaaaaaaaaaacaaaagaaaaaaaaaaaaaggatttccccttagagtccccatttgtcaatgagcactgaggacaagtgagataacatcctgtggtacttgctctctctctctctctctctctctctctctttctctctctctttctctctctctctctctctctctctctcagataagcaaataagagtctcagcatcctttgcatcctaccccatcaggaatcttgctataattttcccatccccatccccagtaaaggatacagtaaagaaatgttgtttgtttgggggaccagaatgcactagacctaagccaatctataaatgatgttaaaacacacatgattaaccagctacagtcatgtaatcgataatcctaggagtctgagcaataatgtaaggaatcatggaactggcctggtctagtccacttgaggtacaagcgtcataa

SEQ ID NO: 17898 - DNA, 2088 bp, Mus musculus
gaggataaagttggtgtgcaaataaattgatactgaagcttagcaacttgtcaagtgtggagcttcataaggtcataagaaagtgtatatatgctttttcacagctttctagaactttgtgacatttgattttcttgaaacttgtaaacctggataggttgaagggtgttttaattttacttttgaaggtgttttaaaacagtagagctagcagcaacaccttatgtttcatttcaacactgcttacaggtttcttttgtatataattcttagaatgctcatttcttttaaatcgtttaatttgtacagcagaggaatgttattgtagtagtatgtaactattacctgagttttgcaacaaacaaaaaacaaaaaaaagaatgctcatatgtaattgaaatacttgagattacatgaaaatgctgattttaacatttaaggatcacagcattaaaagaaaaagaaccaatcccttgtattcagttacccaatggggcgccgttggcaggcagaactacatacctggaactctgtctgctacatattcttgcagaatattggccttattcatttaaaatgagtcctaaggttgccatatctatgaatgatacagattatgctaaataatgctggtttttttgttttgttttgttttgtttgtgagggacctcctatagagcaccgtttctttcttagagtaatatccagtacagtagccgagtaactgaataattctaactttggcttctctaagggaaagaagagccctggtcctgatgtcctgggagagatggatgggtttaatgtccttttccttaatgctgcagatgatcagtatttataaagtaaccgattttgcaccactttttgtgactgtgaccacagcagaacaatgtctcctagactgtatctacataaagttactagaatggtgtctgtctgtcttagtgacacacggatcacaactaacaacttaaaatcagagtttgcccgatccaattcagcatggctgtagctgactaaaaaaatttacataattattctttgttagcctctcttactaactgaattattcattggccagtaaaaggagcctcctagctgacgttttagcaggttttaaggtttccttcaaggaatacaagtcagaaaaaccactccagaaaatataggtctgttctatttcatctaaatggcagtctacagtaaagggtttccaaggctctctttacccatgtgcgtgcgtgtatagttgatggtctctagtagagatagagaaagcattcaggcttctggacaaggacattctcagctgggtagtgtgcagactcagctgtgctaagtgacccagtccttgccaccgcgttgtgagtcaggatttggtgacagagtggccatttcaccaagtggaaggagtgtctctttgccaagctagctcttagaacttgagacaacagaacagtttccacttgggctaacacagagagcggtgctagagtcttgctgtggaagatgggatgcagtgtgtcagggaactgtcactcacacattggaagctgagggctgagaaggctttctggattgtttttaaacagaacaatgtgaaaacattcaagattgaaaagttgcatttaaagtgtgatcactttctaggttcctattaccagaacgattatcctgggtgtggtttctttggtgttataaagggttaattttacttaaggcagttacttaatgtgatttttttttttttaacccttaaaaaaagtgggagatgtatacaattgttaatgacatgaaagtgtttcctttctcctgaggaaaagtgaatttcttatcagaatatctggctggccctgtaatttaaattaaaataaaattttggagaaactgtcttgtgatgtcctttagacagtcatatgtcactgtggagaattccatcaagagacaaaagcacgtgatttgtcagtgggtaggaaatagttaacacttttttccgtactcaaggtttagtgcgcctgcagttttacccttatcttgcccctgtgtgaggtgattattgtgtcacatagcccattcttgtctcca

SEQ ID NO: 17899 - DNA, 1833 bp, Mus musculus
gtctacccggaggcgtgagtgacagaccccagccagcctttgacagtatctggcctgacctcagcagcagctaataacctgactatagtgaatgtcgaccaagaactaagacctgccaggcattgccttacttagtgttgtcatcactatcgtcatatgtatttctgtgcgatttaagggaaactgaggcacagagaggctaaagtagcatcctgaaggttttattgtagggacatgacaggcacagtatgagactgacctaggcgctccctctacctaataatgctatttctgggtgccacctcctgggtctacctcacttgcctcgctgggtcccttttttcctctcaggcggaggctggagacatgcctgaccaggacttttcttttctttttccccagggatcaacaaacgtgggggcaagaactgcaacgccatccgccacttcgagaatacatttgtggtggagacgctcatctgtggggtggtgtgaggccttccctccaggctcacccctgccctgttctttctccttctggcctctctctggccctcctcctccctttgcttagcttgtaccttgggcacttttccatagatgtgacatgtctcacctatccttcccagaccgccctcctccctgtaccagggctgtgatctctcggggcctctgcctctgctgatctttcaggtgggaggtgggaggggacagtcgcccaagatggtttctctaactcattattttaagtcatctccccagtggctgggccaaggggaaggactaaagggaggggctggacatatggaagcctggggcaggggcaggggcgtggtgggatttggcatgaggctcacaaacagcccccacacttggggaagccctgaaagacttttttccttgcatagcacacttcccctgtcctcctggttcttaggcctgggtgtggactaaggatagggaaatgtgtcctgggttggacccatcagagcacaagagaaggtggctatcctggggtcttcccaggactcctgtcagtgccttcagcccaccagcaggagcctggagttagagggtgggatgagtctgccaagcacaattgtcctctgagtggaaccaaagaaatgaagagccgggccgccctggcctggcgcctgggaacacaggggcaggtgggtatagaagtcaccggctgtgagctgcaggccctgggcagtggatagaacccatgccttcctacacatctgggctactgtgaatgatggaagcgggagggagagccacctggtactttcgtccctgcctcctcttccgttctggatctttcccctctgtccaggggcgtgtgatgttttttcctgcatgtttttactgatgttcgtgctggctgccctcagccctgagtctgggagaggctttggtgcctcgggtcagacttgggtgctccatggtagtggagcccttaaatgctttgtatattttctctattagatctcttttcagaagtgtctgtagaaaattaaaaaaaaacaacaaaaaaaacccaaaacctcttctgactttggccctggtgttgtggctaaatagtggcatcttggggtggggtgggggggatgtgctctgaggacaaagtggtgggggtggtgggcagggagaagctaacacacggccttccctgggtcaccaagggagtgtggggtgtcccctccattgtcttctctgatcccctggactgagccaattagtgttcccattctgtctccggaagaacccacagagctttaggaaactgcccaaggtcaagctgcttttaagttcgggtaaagcaccctgc

SEQ ID NO: 17900 - DNA, 1180 bp, Mus musculus
ttgcatcacaaaactaacttctaaacagggttactttttttttttttagtttttgttttgtttgttttatttttaagtttaaatcatagccaggtagtgatggtgcatgcctttaatcccagtacttgggaagcaaaggcaggcaaatttctgggttcagggcagcttgaactacactgagaaaccctgtctggaaaaacttaaaaaacaaagggggccaggcgtggtggcgcacacctttaatcccagcactcaggaggcagaggcaggcggatttctgagtttgaggccaacctggtctacaaagtgagctccaggatagccagagctatacagagaaaccctgtcttgaaaaatcaaaaccaaacaaacaaagggggaaggggaattaaaagaatttggttctaaatatacataactacatatgtaactacataactacatatgtaactagataacgatatgtctttaaattgtgtctttcagaatgatgtcccaggaatgctagcttacagcctcaaactctgcatgtctttaatgcagaataaacagtttcggaataaagtattgagagtcttggttaaaatctacatgaacttggaaaagcctgatttcatcaatgtttgtcaggtactcactctgatttcctcactctgttacaccactgcatgttactgcataggctgagttgctgtggtcgctttgcacaggtaagctcagttgctctctccacatcctgtgaggataggatacgtggaacatgttccttttactgataaatggaatctcacaacacttaaaaataattgcgtttgttcttaattcagtttgatataatctatgggttcattacttaaaatgtaagtgaacactgggtacattttatctcttttgattttgataccacttaaaattttcaagtagcatagaaaatgtatgaaagcctgatttttttccccccctttctgtagtcctttccctaaaataatggtagatgtttttcccagttcatttcacattttgatctactacactcttctcagtgtctgtagcttccactgcctggagctatgcatgattgacttttacacaattaatatactatatatgcttttgtacactgcttaagaacatagcgtttttcatattcattgtagtgtgtaaatgtgtaatgtgtctt

SEQ ID NO: 17901 - DNA, 1884 bp, Mus musculus
caacggccagcttgggtgtaatccataaggtaatagattttattcattatgactggccagtgcagaggaatccattttggggggggctaaggaacataaatttattgcaattaatcaacacgtatatgttgtcagatcaggtcagtcctgggacagggaagagtgaagtaaagaaggcactaaataagtgtctgtttctttttagtaaaaggtagaattcctcttcctgtgagaactaagccattttctaacagtttattaaaatgctgtgtagtcaaagttatttggggaaacatttgtaaaacaaagtaaaaaatggatccagttagaatattttctaaccaggcctctctgggtctctacagtctcacgtttgaatggtggagctggtggatgagagcaagttctgtcccagccatcaagtgggcgctctggagaagtcgctgcagctgctttcctctgtttttcttacctctttgtgactcaaattcgcagggccatgagaaggaagcactacagttaatggcaacataccttcctaaggacacttctccaggatcagcctatcaggaagggggcggtctctatgcattgggtctcattcatgccaatcatggtggtgacataattgactatctccttaatcagctcaagaatgccagcaatgatgtaagtattagggtgaaaaaccaaatctccattgtttgagaatctaggacagtggttcttaacctgtgagtctcgacccctttgggagtcaaatgactctttcgcaggagttgtatatcagatatcctgtatatctgatatttacattataattcataacagctaaattatagttatgaggtagctatgaaactaattttatagttggaggtcaccacaacatgaggatctgtattagtgggttgcaggattagggagattaagaaccactgatcaaggaaattatgtatttgctcagtatttcagtgaatagatttcttaggatttgggaaaccaaaaacagtcctttcaatagtaattttggggtttgtgttgatgctgcttttgtttgagttttggttttcttgaaatagcgtcttgctatttagctcaagctgccttccagctcagacattctctacctcggcctcctgagcgctggaatcacagctctgagccatcagacttactaggcatttcccctcttaaaattgtgcttcttcaccctttcctgtgcccttttaaggttgatactgtactttaagaggctaacacagaagggtaaaggaactctccatcaaacccagagaagaggctccccacttcctctctggatcctgtctggagtcacagctggaaaaaaaaaaaagtgtgcttcttagtcctttaagaccagctgaaacaaggcagttttaagtgtctgaaacacagtggtctcagctgtgtggtactgatggcgaatacctttaacctcagcacctacgaggcagaggctgggggatctctgagtttcaggccagagtactggactgtagagtgagttctaggatatccagggctactcacagaaaccctgtcgtgagtgaatgaatgaatgaatgaatgaatgaatgaatgaatgaatgagtaaattaaaaagaccatgcagtggccttacttaaagatcatggaatgttatcactgtattgaccttactttacacctggttaactataccattttaaaggaaattcagggcatccagagtagcatgaaccattactggatggtttatggacacacacacacaaagcaaacaacaaaagacttagtaatagacgcctcttctcagtgaagcaaggacttcatcaaaagtatcttatataattagtgaagatgttaaacgaaccagctttt

SEQ ID NO: 17902 - DNA, 1235 bp, Mus musculus
aattcccagcatacacattaggcagctcaaaaccacttgtaataccagctccagggtatccaactccctctgacctttttaaacatgcatgtgtacagacacacacacacatacatacattaaataaataaataatagtaaaaagtacttttattaagggtggcaagggccgtggacatagttcagtagttaaaaacacttgttgctcttacagaagacctgggattggttcccaacacccgtgtggtggcttccaactactcataactctagttctaagaaatttaccatcctcttttggctttgctagcaccaggcatatctgtgattacacatacacacatgtaggcaaagcactcacacataaaataaatcttaaaaaaaaaatgttagttcttctcagaaggctaatagttattttgataactgatgcaaataggtgccactttcaattggatatctttactctacacattgctgttgttcattattttactctttactacaggggaggcagctggcctagccttaggtttggttatgttaggttctaaaaatgcccaggcgattgaggatatggttggctatgcacaagagactcaacacgagaagattctgcgcggtctggcagttggcattgcgttagtgatgtacgggaggatggaggaggctgatgctctcattgagtctctctgtcgtgacaaggtgagattctacttgctttctctcccaccccccccaccccccgcatcctacattttataatatttttgaatgcttaaatagttgtctgcttcaccctgcactccccaagttagggttggttggttgttttccagattttgagacaagttttctctgtaacagacctggctgtcctggtacttgctatgtagacctgtctctgcctcccagttgctaggattaaaggtgtgccttaagcatgagtcagggtttttctgtgtatccctggcttctggcaatttgctctgtagactaggttagtctcaaactcacagagatctgattgcctctaactgtgctgggaataaaggtatgtaccaccactgcctggcttaatactcctttaataaggtataatgtttgtcttactgggtttttttcttttttaatcataaaacattggcattctctgtacttacttgagtaaaggttttctgataccttttatttttgtgatggtgttgcatgcagcaggtagccagagtcactct

SEQ ID NO: 17903 - DNA, 1166 bp, Mus musculus
tagaggattcattttttgtgctgtcctagaaacatctaaaagactctgtaaatgccttgtcttctgtaacaaaatgcgtagtgcccagaaagtagggcagtgcatccagaggagtgtgccccgtgtgactgctgagtctccactttgagggcactaggaaatggccagcatgcagtaagcttgcttgaggagcctgctagggtccgctttctctgcgttttctaaatgtctactatcaatagaattctgtggaagatcaccacttgtgtcttccagtggctttgactttcctgtgtagtgctgtgctaaagtgatgaccaccctgcatctgtttcactagtgcttggggttataggtctgtgctaatgcgtctctcggtgggagatttttagttctacgacttacttgctaagtattatgttgtttcctgtatcgcagcaataaaaacttgtttaaaattcctccattttggtttataacatgttactcataacactcccttctttttctttacttcctatcaggacgcctgaacagtgtccaagtgtggtttctttgttgtcagagagttataaccctcacgtgcgctatggagctgcaatggccctgggaatctgctgtgctggtacaggaaacaaggtacagcccaaccagtggagccttctttcctgacactaggcttttcgcttgcagaaaagtgtgtgaaacaactgaaagtgggggtgcagtgtgatccctaagactgcggtgctcagggcttcacagtactcccccacttacttccctgaggactcctaagaacaacctgatatacacggctaaccattgtgaactgctctgtcattacatggttattcttactgtttaattagtaccatagacatgaagatagctgtctaaaaacacccaaaatcaactcattttttaaattatttttagttatatgtatatgtgtatgcctgtttgtggatgtttgcctgtggaagccataggtgtcagatctctcagaagctatagttacagatggttgtgtacatgcccttaaccactgagctctctagcccctaaaaatgttctagcagtgtgtgcgtgtgcgtgtctgtgtgcgtgtgcatgtgtaattagttctctccctccattaacaggttgtgggaatcaaactcagg

SEQ ID NO: 17904 - DNA, 1197 bp, Mus musculus
gcatacattgattaacagttaaagaccagccctgccattgattacatcatgtaatccttcctcggagagtggatctggagagtggaaggtgtgtctgagtgctctgccttgtacagccgtgatctctcagcctcagctttgcctgcagcaggcttgtgctgtgatctctcatctgtacattatttctgactcacggtagctcttccggcctcgcctactgcctcactgcgaccaacctggtcgtggagttcaagaaagagtgactgcaatgtgcacagctaaagctggattcttggaagttttttaaaggatgagattgaaatacttgatttgttaggaaatcagagattaacaatagtaacaaattggcataacaggcctgcagatgccaagcaggaactgggtttagattttgtgtagtaatttaaatttaaaaaaaagtttgtgagtaaaggacaatgccagcttctgccacttcgctttcccaggatcccgcctgcccagctgaagaagactgtcctggcgcacactgaaatgtcgtgagggaacccatgctgagacctgctcaatccacacaccattgcctacgctgacataaagaacctgtgtcccaagtctttggttaagaagatatacgactgttcagtgttctctttcacaaaatttggttttcaaataaatatattaaaatctccacattgaccagactttagttgatttgtttttcttgttttttggttcagttttttatggatatgacactaccaccatacgctaataggcctaacatcaccttcctataaccccagcacgtagggctctgaagcaggagagctttgctatagaggaactctttgtggcagtactggaggttgaatccagggttttctgcatgctgggcaagtgctataccactgagctatgagctactccccagcccaaaagacatgctcgaatctggagggaagtgaataaataaacaattctagagagatcagccctaatgcactcatcttgtccagtctaaagattactgattccctaggacggttccacacagctaatttcattgtataccctcctttgtaaactcctgtttcctcaatatcagatgattctataaaagaaatgatctaatttcctagcctctcattagctatgctcttcctggttaagctcttaatgttgcttgcattt

SEQ ID NO: 17905 - DNA, 1133 bp, Mus musculus
ctgaatccttatgtcttcttccgcagagggatttggtggcagcgtttgacagtggagaccagaaggcgttctttgacttgtgggaggggcacattcccagctccgtcagagacactgactccctggcccagaagctggagttctaccttcacatccactttgccatctaccttctcaagtactgcagaggcaggccggtaggctgcttagggtttgggttagtctgagctagctaacaggctaaccgagttcaaggaagcatgggtgtaggtgtgtgaccattttatcatgttgcattttgtgccccgagaaatgatttttggcttcattctcagaagattatttcctaatttatatggagattttgtaatttctgccatcagagttaaattgttttccttttaaatacctcaggtgtttgagtcttggagacttcatccgagtaagttggctttatcgggtaacttggtgtgtctgagagaagacctagaccatacatttcgatgcaaatattggagaagtagtgtgcctgtgtgtagagaaggcccgtgggcttgaatttagcatttgctacctttccctaggttggctggaggtatggatagcgaggcagacgactggagtgctgagcccacgcggtggatgagcctccagttacagagggcagagctggcattagatcactcactcataggaacactgccctgtagcagtgaattagttaaacagctttggctcctggtgggggctctggattcacgaatgaaagacatacacacatgccagttaaatttgatatgccttgattggctcaatggttgggcacttttaaacctccctgcagctagcaaacactcccctccagtatacctgaattaacaccctcctaatctacactttatctttgttgccctgttaccttctgggcagccccccactcctcccacccccacagggctgcttttcctctatactacatttcggcctctcaccctcctctccttcacggtgtagtctgtcctacgcccctctcatggtgctcctctcctcccccaaccccctctctgtcccaagctgggaatcctaaagtccctcctctgtctgccctgcccagccattggctgctggcatct

SEQ ID NO: 17906 - DNA, 2914 bp, Mus musculus
aaaaccagagctcaggggatggacagtggtctcttttcctggcaaaatgacagcatttcactgggttcatgcctggtactttatcctgtgttctgtcccattttgggggaacttaaggggttaaatggcccccttcccaaaattgttgttgggtttgggaccccagtagctgaatacacagtgcttcttgagttgggcagttagcatgagaaaagcagcaggttcctctgaccttccaggaagtagagtccactggcccatctatgggcccctaatcctcaggaggagtatgagtgccagctcaccttcctctctgctgctcccctttaggaagaaaaccctctacaagagtgtatgcctggctctggccctccttgtggctgtcaccgttttccagcgcagtgtgacccctggtcaattccttcaggatcctttaccgcccacgccggggccagccaaaactggaaatctggtcaaccccaacagcttctggaagagttcaaaggatgtagcggctcccactcccacagttcctcggggaccccaggtctgggatgtgatcaccactaactgctctatcaacatcaacctgacccatcagccctggttccagagtctggagccacacttccgacagtttctagcctatcggcattgccggtatttccccatgttgctgaaccacccagagaagtgtgctggcgatgtctatatgctggtggttgtcaagtcggtcatcacacagcatgaccgccgagaggtcattcgtcagacctggggccacgaatgggagtcagcgggtttgggcaggggtgcagtgcggactctcttcctgctcggcacggcctccaagcaagaggagcgaacccactatcagcagctgctggcctacgaggaccgtctctatgctgacatcctacagtgggatttccttgacagcttcttcaacctgaccctcaaggagatccacttcctcaagtggctcgacatttactgtcccaacgtccccttcgttttcaaaggtgatgatgatgtctttgtcaaccccaccaacctgctcgagtttctgtctgaccggcagccccaggaaaacctatttgtaggtgatgttctgaaacatgctcggcccatccgcaaaaaagataacaaatactacatcccagccgtcatgtatggtaaggccacctacccgccctatgctggtggagggggtttcctcatgtctggcagcttagctcggcaactccaccatgcctgtgacacactggaactcttccctattgatgatgtcttcctgggcatgtgcttggaggtgctgggagtgaagcccacaggccacgagggcttcaagacctttggcatctctcgggtccgaagcagccggatgaacaaggaaccgtgcttctaccgggccatgcttgtggtacacaagttgctccctgccgagctgctggccatgtgggatctggtgcatagcaatcttacctgttctgtcaagttccaggtgctctaatgttgctgagccaccagtgcgtttgtcctcgggggatacatggcattgtctttggtcccctgcaggaggtgaagggtttgggccctctgtgcccctaggtgtggtgaggtacagagatccagagagggactcccagaaattcccagaaagaggtccaggaatagccagaacttccctgactggaggtcatccgagaacctggatctctcctatcttgggcctctagcctgacctctctagcctggtaggaggccctggtggactctaaaggaacatttgctcaggtacctgagctagacctggccccaatgggtctgtggctgcttcttgtcctcacagggaagcccccttcctgtgaaatgcctctggctccctgagggtcaagcagcctttgtgggagctcaggcctgtgcaggtccacaggtgtcccctggcccacattgctggacctcctaagataggagctctctctccataggccctcagcacagccccaggcttgcctggagtcagctgccgaggcatggctcctggctctgacttctcttgtccagaagcctgactggccgctctgactacctcagcactcctctaaacctcagtgtgggctagtgccccaccttatgcccctgacacagagcaaaatagcagtgctcctgcaccctgcccaccccacccccacccccacaaggcacagtgatccttgagcatagtccaagccaagtctcacctttggcacctcaccaatactgactccctggccagaaactggccggatgggccctagatgtagacattcttctattactgtgaaattttatttatgaagaattggaaggaggccttgggaggtgtacctctttcctgtacactttccttcagcagctagcatctttaccactcaccccctgcctttcaagccctcccccactgacacccctacttttctggggcctgcccagatattttcccctgtgaaagaataccacctcccacctctggctggggtcacctggaaaagatggaggcatcttctctattttctcaataaaacaactggttgttgaaggtgtctgaattagctgcttccttggtcttggctaatgggcgtgaaagacctctagaggggccttagaggaagtggggagctgtggtggtgcaagaagcctgcgaggctctaacactcaggtgaccacatggccagctgaagccttagcctaagtatcaattagcaaaaggcaagagttcaggcccaaggctagtgttccagtgggtgcccttaggctcacaggctccctgatgtccttcggaaagcattgaagtagacttggctggaaggagagcccaacacatgcaggacttttgccaaagctgctgcttccggagaaaggagagcggtta

SEQ ID NO: 17907 - DNA, 1194 bp, Mus musculus
tctaatgctggatttggttgggcaggcagtcctataatctcaactacttagcaggctgagacaggagaatcatgaattaaaggcctatctgagatacagagtgggctgaaagccagtctgaacaacttagtgaagctcaagaaaaaaaatttaaaggttagggacatagcttaccaacgaagtcctagggtcaattcccagtacctgtttttaggggaagtctcatgccagaactgggtaaaaaccaggatgcaaaacccccatgggttattggggttccaggactcttcaatgatttgaacagctaatatgttgaaaacatctccagttccttgtcacttttactgactttttcagccaggggagggggcagtgagaacagtaatatatttctgcacatgaacttcagctgctgcagaatgccataccccatgtagaatttaggtttctcagcctccacaatcacacaagccaataacttgcaaaaaaccatgatataatatatacagtctaagggcggtgggtatattttagtggaggagtacttgcctagcatgctcaaggccctaccacaaacacaagattcagtgagacagaaaagggctagggttctcttgttaaagccttcaaggaaagagcatgagcatgccccaccactcttctttagcaaggctcctcctcttaaaggttccaccacggtcccttacagtaccaggaactggggaaccaagcctttcccatgtgagcttgtggaacattctagatgcaaagcccaaacataactcagtcctcattatccatagacttcatatttgcaaatttttctatttattaaaatttgtgactcctcttgtgagactaggccggagcctagcaaacacataagtggatgctcacagtcagctattggatggatcacagggcccccaatggaggagctagagaaagtatccaaggagctaaagagatctgcaaccctgtaggttcaacagcattatgaactaaccagtatcccggagctcttgactctagctgcatatgtatcaaaagatggcctagtcggccatcactggaaagagaggcccattggacacgcaaactttatatgccccagtacaggggaacgccagggtcaaaaagtggtaatgggtgggtaggggagttggggggagggtatgggggacttttgggata

SEQ ID NO: 17908 - DNA, 2566 bp, Mus musculus
tagctctccctaaacgaggcagacattttagaaaagcagcaaacctttctggaaatggttgtttgctttcttttctcattcttccagcaggtggcaacatgagaactgaagaaagggtggagggaaggcagttaatctgccttcacctaatagataaacacaaagctcttattctggtggtagagtagcttgtagaggtcttttaaagagcaacaaagctttctcatttgaaagattcacttcagctgggcgtggtggcgcacgcctttagtcccagcacttgggaggcagaggcaagtgattttctgagtgagttcgaggccagcctaggtctacagagtgagttctaggacagccagggctacacagagaaaccctgcctcaaaaaacaaaaagattcactcctgaccatttatcacctgcttttgactatacactaccccttcagtgtggcttttttcctacggatgctagtgataggagttacctaatgtagttttcagttcaatctgcctgaaccttttcaactcttaaggaacataggcagatgctaagggtgtaggtcttgaccctatactgaggtagaaaggaaggggaaatggaagaggagcatgtactctttacttctaagctggatctatagccttaggattaccatctataacaggctaatttcattcagttagtggtaaaaccctttgccatagaataaaagggctctcaaggttctagtagtaaaacaagttttggttgctgtcctccattaagtgcctactaaatgataagtgatggagaggatggaactgattccaagaaatactcaacagtgaggacttataggccacttaacctgtgtgtgcttgtgggatatttctaccttttgaagcagggtctcttattttcttactcactacaagctttcaagtacttctggcaatacgaatgggattagcaatgcatgccatttcagtggccttatctgggtttcaggggtcctggtcatcaggttctcgctggtaaatcttaaagaccaccgtcttttttttttttttttttttgagacagggtctttagctctgtggccatcatggaactcaataggtagactaggctgacctcaagatgtctgcctcttgagtgttgcattaaaggcctgtgccaccatgtcaggctccattatagaaacacactactatcagaaggatgataggctgaggcccattttttaaccctttgaaaaaaattctggctgggcagtggtgacactgcctttaatcccagcacttgggagacaggcaggtggatttctgagttcaaggccagctgggtctatagagtaagttccaggacagccagagctatacagagaaacaaaaaaaaaacaagggtttattggggagggaagggaagtacttattttgaataaggttttattgtgtatccctgattgtctttgaaattaatttgcttcaactcgaagtgctgagactgcaagtatgtacaaccacagtactcttaggttctaactgaattctcacccattatttttcaaatacggcctttcagttttattctctactggactcttagataaccagatactggcattgaaactagtttttttctctttgaatattaatttggatacattctattgttttggattctagttcactgattcttctgttaggccctttagtgaagctttcaggtgtctttagtttttttttaatttgtgtgtgtgggtatagtgtctgtatttctccatgtgcatgcaatgccacaggaggccagaagagggtggatcttccaaccttttttttttttttaaagatttttattttatgtatatgagtacactgtagctgtcttcagacacaccagaagagggcatagaatcccattacagattattgagagccaccatgtgattactggggattgaactcatgacctctgaaagagcagtcagtgctctgaactactgagccatctcaccagccgccttcaagttcttgtgaaccaccatgtgggtactgtgaatcaaacttgtgttttctggactcttaacagctgagtcatctctctagcccttcaagtgtttcctttctcttctaggtttccagtttatgaagcccccattttgtcatttaaattcttttcctgcaaattcctatacatctacaatcattgaagtcatttgtaaatttttttatgtgcattagtatttggtctttatgtgtgtgaggagtcagacccaccatgttacaaacagttgtgagctgctatgtgggtgctgggaattgaacttgggtcccctggaagagtgaccagtgcccttaagtcgccccttatttgtagttttaacaggagttatggttgagtacttgttaggattatgaagagttgtttctctttcattgcatgtctaaactggacattgacccatatttagaggccagccatgtgctaattcaagtacattttgtactggcattcttaagtagctagcaaaatctgagtttctgtttttcatagaatatgatgagatttactttaaagccag

SEQ ID NO: 17909 - DNA, 1816 bp, Mus musculus
tactttggtcactctacttgggtgacttggtacttattgtgttactttaaaatgtgtttacttaatgggtgaggtttttttgtttttcttttctgttttaggtttggttttgtagactttaatagtgaggaagatgccaaagctgccaaggaggccatggaagatggagaaattgacggaaacaaagttaccttggactgggccaaacctaagggtgaaggtggctttggtggtcgaggtggaggcagaggaggtttcggaggcagaggtggaggcagaggtggaagaggtggatttggaggaagaggccggggaggctttggaggtaaggaagggaaaggaactggaaacggattcctaaacctgtgtcctaaccaaccaccttaaatgggaaggtcagtcctaattgtatcaccctttgatgtttttccttcctataggtagaggaggcttccgaggcggcagaggaggagggggagacttcaagccacaaggaaagaagacgaagtttgaatagttccttccatcccattctttccctcttcattttaaagaaaggactctggggtttttactctgttacctgttcaatgacagagccttctaaggacattccaagacagtaaagatcctaaactctgttgccagacttaatacttcctagaggttacatttggattgttgcttaagagcttggcaagaccaactctgcccagtgggaatttcagttgtgttcctactgctttcaagaattcccagctacaaatgtggaaattggtggggaacagcttcatcatgattctgatctggaagatttaatttgtatcttagaagggtgtgtactggaaaagtggttgatagagcacatggatcagtgctggaaataccatacaagagcttgtgtggtatgtaattctattcccagcataataagaacaaacagtacagtgcaatctgaaatgacctggacaaggaatggtaccccattgggttgaaaaattcacatagccaggatggttgcacatgcctttaaccccagcacttgggagggagaggctggtagatctgagtttgatctggtgtacagagagttccagaacagccagggctgtttattagagaaaaaaccctgtcttgaaaaaacaagaaaaaaaaacctcacagacaaccaaatacagagttttagccactgagtaccaagtctcagcagcaagctgggagtgacgtaatccaatcccatgggaggctaaagcagtctatgacttcaatgccagttgggtctgcagaactgagttgctggatagtgagggatacttagaaactttgtcttgaaaaaaaaaacaagacctgtcaaatttgagagaagctttgggaaacaaggtttgtaagttccaacagagggaacagtggcctttttgacttaaaggttgtcagaggtccagtttaactagggataatacagtggcccttggcctgtgtacttaatgaatttttcagtgatctatcaaggatgtttggtttttttgttttttgtttgttttgtataaggcatgggtgcctagataaccttaatagaaactttcctgtaggtgtttttccaagtcccactcccaacaaactgattttcaagaaagaccagtcagctattctcaaccaaagaccctctgtagggttgcgcttagcacctgtctggtggcttgagtatgtggtatgaccattgcagtcgcagtcctgtctaaaagtgaggatggcgtgggcattagatttgtgtagcagggaacagtttggtgggttcttttgctgtggggagtggagc

SEQ ID NO: 17910 - DNA, 2251 bp, Mus musculus
ggatgggaaaagtaaagggtatgttttgtgtctttgagtgttaaagttttattaagtttagtgtcttcttcccctctccttgtccttgacagtctctagtctgctgcttcaaacttaacttcataaccagaaaattgaatatctggtcctctggcctctacctcccaagttctgacattaaaaatgctcaactgatgggttttgaagctgtgatcaattttacaggctcaatccaaattggcatcttttgccacaagtactatccttccctattttatgagagaaatgtgattctaggcagttcagtctattgtgttggctctttttcctcctcaccagtttaaaggatgaagatgagctaatacatagtaaaagaacagtaaaagcacatgtgactaagtccttcatgactgatgcttgagtaatattttctctaacgtagtaactgaattgtcttgtactctttcaggattgcttatattgaatttaagtctgaagctgatgcagagaaaaatttggaagaaaagcagggggcagaaattgatggacgatctgtttcactctactatactggagagaaaggtcaaaggcaagagagaactggaaagaccagcacttggagtggtaagttaaagggtttattgtgtagtgggaacaggaatcatttgtatctttgtattttaagtaattggttacctacaattagttcacctttgttcatatagctgatgtttagtcttcatgagtgaaagctatttgaaatcatttcctttggagtatagtaggcaaataaagctttttgttgggtatgttttctactttaaatggcttaaactattttagaaaatagtgtaagacaacaaagaacagttatctaattagaatgaaaatgaaaggagcaaagaaggcattactgtatataatggatatacactggtggttctagaattatggtatatggtacatggttgaagtgccattgtttcagttaacattccagtaaccttgtggattaggttggagacatgctttataggtgacccacttactgagtgtttaaatatacacagacatactctaacataccttgctaatgtgttatctttgtatttgcaggtgaatcaaagactttggttttaagtaacctttcctacagtgcaacaaaagaaactcttgaggaagtatttgagaaagcaacttttatcaaagtgccccagaacccacatggcaaacctaaagggtaaaataatttttacgttagatgtgggctggacatacatactcttacgtataagagtaagactgtcctgttagcttaaaaaaaaactaaagttttagctatacaaagggcagtaaatattgatagtaaattacatgctgatgccaagtgtttctaagctttattctgagaactgactttcaaccttcaggtatgcatttatagaatttgcttcatttgaagatgctaaagaagctttaaattcctgtaataaaatggaaattgagggcagaacaatcaggctggagttgcaaggatccaattcgagaagtcgtaagtcctttgacatgatatgacttggttgggtgatatttttttttatttttatgtgcctatatgctcatttggggctgtctttatgttgttgctgagaaaatgacaactggatatgatgactgattacctgagaaataattgatgaaatctcaagaaaattcctctagatagtcaagttctgatccagctatgtcaactcaaagcagcaaccttgattgccctctgagtacgctttttttttgatccagtgtagtctttttttttttaaccttaatttcttgtgttaattgctttttctggtaaaagggggaaaaaaagacataacaaaatcagtgtaagggaaggctcagtggttgagcactgagaggacctgggttcaaatcccagcactcacatggcacctatcgagacaggatttctctgtgtagtcctgcctgccgtggaactcactctgtagaccaggctggcctcaaactcagaaatctgcctgcctctgcctcctaggtgctgggattaaaggtgtgcgccaccactgcccaaccctgtctgtaactcttaagctctgacatagattgcagacaaaacactaatgcacataaaaaatttttttttttttaaaaaggaatctacttcagctgaatgtggcagtatggcagtattcaccaagggttcatagtgaaacaggaatttttctct

SEQ ID NO: 17911 - DNA, 1162 bp, Mus musculus
tactgctgttagttacaatatactgaatgaagaaatcgaggtgaatttgttgtaatgtcttggtacatggacttgttttgttttttgtttttttttctttaagatttgtttatgtatatgagcacactgtagctgtccagatggttttgagccttcatgtggttgttgggaattgaatttttaggatctcagctcgctctgctctcagtccttgcttgctctggcccaaagatttatttgttgttatacataagtacactgtagctgacttaagatgcatcagaagagggcattaggtctcattatgggtggtggtgagccaccatgtggttgctgggatttgaactcaggaccttcagaagagcagtcaatgtgcttacccgctgagccatctctccagcctttggacttggttttatggaagataagggtgatctagttttatttttgttagtgctgtagatgctctgtgtgtgtgccacatggtataagtgcagatcaccttctcatacctgtaatcttgttttttccatcttcaaggaaatttggttatgtggactttgagtctgctgaagacctagaaaaggccttggagctcactggtttaaaagtgtttggcaatgaaattaaactagaaaaaccaaaaggaagagatagtaagaaaggtatgtaagggggtctgggtgactggatactaacagacttaggcagtctggtgcctcttccttagtttcatcctcattgtgaaccaatgagatgtcataggtcatgtgcttgttgacaggtttgattcctgggatatataatgtcagggctgacaggaggaatagcttagtgagtaaagatgcttgctgcaaaatgtttgatctctagaagccacatgaagagagaagaacctttaatcccagcatttgggagacagaggcaggcagatttcagagttcgaggccagcctggtctacagagtgagttccaggacatccagggctacacagagaaaccctgtctcggaaaaaaagttttagcttatcctctgaccacatgtgtatcgtgacatgcttgaagcttacgtatctcttaaatgaattcttgatccctatattttgagtttcagaatttggattttaagtgtttgtttcttagttgtgctgaaaattgaacg

SEQ ID NO: 17912 - DNA, 1216 bp, Mus musculus
ttaatgtttatctttgtgtgtgcgcgcacccattaagcatgcttggtaccctcatactagaatgtacttggatcccctggaactggagttaaagccacatgtgaatgttacatgttacaagagtaacacatgtgcttaacttttgagtcatctctccagttcttggttgtttgtttttttttttttaagcctatctaatgtccattttcttgtgctcaaagttagtctcttaatgtagcattgggtataaaggaatgcttatgatttgtttgctttcaaggttgtcatccctcagaaaaaaggcaaaaaggctaccacaaccccagcaaagaaggtggttgtttcacaaacaaaaaaggctgcagttcccacaccagctaagaaagcagctgtgaccccaggcaaaaaggcagtagccacaccagctaagaaaaacattacaccagccaaagtcattccaacaccgggtaagaagggagctgcacaagcaaaagcgttggtaccaactcctggtaaaaagggagctgccactccagctaagggggctaagaacggtaagaatgccaagaaggaagacagtgatgaggatgaagatgaagaggatgaagatgatagcgatgaggatgaagatgatgaggaagaggatgagtttgagccaccaatagtaaaaggagtgaagccagcaaaagcagctcctgctgctcctgcctcagaggatgaggaagatgatgaggatgaagatgatgaggaagatgatgatgaagaggaggaagatggtgagttagatcttaggatatttagggtactgcatgtacattccctcactgtttcattagattaaaaactcattttgtgctcttagttctttccataacttaataggttttcatttgctaagtagtttttgttttttttaagtatttgtagcatttatcttgtctggattggtaggtagcaaatacatttgcctgatttgccatctttcttccagactctgaggaagaagttatggagatcacaacagccaaaggaaagaaaactcctgcaaaagttgttcctatgaaagccaagagtgtggctgaggaggaggatgatgaggaagaggatgaagatgacgaggatgaggatgatgaggaagaggatgacgaagatgatgatgaggaagaagaggaggaaggtaaccatattaacttttaaagtatgctgacctaagtaa

SEQ ID NO: 17913 - DNA, 2058 bp, Mus musculus
tgtggaggaggcagagaatggaagagatgcacctgccaatgggaacgctgtgagtgtccaagtagctggggcttgtgttcccagtttatacttttttaaattttcagcttagttcaggatgttggaccagacaagggaacttgtctgatttttgtttgggaggtggtgtggtagctgtatggtgtggggaggggcaaggtgcactagatatacaggcctgcttcagagctggctaatggcagatgtgttttctgttaaagcaaaatgaggaaaatggggagcaggaggctgacaatgaggtagatgaagaagaggaagaaggtggggaggaagaggaggaggaggaagaaggtgacggtgagtagtcttgttttctcaggttccttccttggcttttactgccagaagggagaggttgggtttctgggcagttggaccactttgaactgcagtgtactccaccctcctattggggccgttcttgatctgcagctgggaggatagtggtttatgtgggccttgattgattctccaggtgaggaggaggatggagatgaagatgaggaagctgaggctcctacgggcaagcgggtagctgaggatgatgaggtatgtgtgaggttcctttcctggggcactaaaagctttgggggtttctggcaaatggtgaagggttcttagtggaccccatcccagctttgctctctgggagttgtgggccaaggcctagggagcttatgtgtagtcacaggcctgatgttctctacaggatgacgatgtggacaccaagaagcagaagaccgaggaggatgactagacagcaaaaggaaaaataaccttacgcaccgtgacctattcaccctccacttcccgtctcagaatttaaacgtggtcaccttcgagtagagaagcaggccccgcccgcccacagcgggcaatgccacccacagatatgacatgcgctctccaccacccctccaaaactacaacatgaattggcaacatgggaggaaaaaagaaccagaacttcccaggccctactttttttcttaaaaatactttaaaaggaaaatttgtttgtattttttatttacattttatatttttgtacatattgttaggggtcagccatttttaatgataacgggtgaccaaaccagccttcagagcgttttctgtcctacttcagactttacttgtggtgtgaccatgttcattataatctcaaaggagaaaaaaaaaaccttgtaaaaaaaagcaaaaacaacaacaaaaaaacaatcttattccgagcattccagtaacttttgtgtatgtacctagctgtactataagtagttggtttgtatgagatggttaaaaaggccaaagataaaaagattttttttttccttttctttctgtctatgaagttgctgtttatttttttttggcctgtttgatgtatgtgtgaaacaatgtccaacaataaaccggaattttattttgctgagttgttctaacaatggtgtctcaaagcctggtttttctgtgtgtactttgtttgggatggggtcttttctatacccagaacgtcctgagtgagtggttatgtgccacaacacccgtttttctggggagagggtagtcctggaattggatggcatttttaaagttctacggggaaggtcaggacaaagctgcagttaatcatggggcattgggagaggttctttactgttgtgacaccaacatttcttcctgagacttaggccactagtcccaggcataaactggagagatgtgctgtacacagagcccttggtggcacaggccaagtcatcttgttccaagttgtgagtcttctggctgctgtccatgtaattagtatactgtttagtggctcctagtgttagctcgcctgccaagcctgtaggtcctgaagggtctatgcccatgactaacctgggcaagctctagctttacagtgactgttcaagtcccttacaggcactgcaggagggtgggcgacttgttctttagaagagtaagaagagcatcctgtaggggtgctttgct

SEQ ID NO: 17914 - DNA, 1207 bp, Mus musculus
cagttttagcagtgtaaataattgcagtgtatgtgattcactcactatcttttgggctcctccaaagggcctgggtcacttctctggctctactctgcagcacacacagctcgtcttctaggctctggctggctccactccactgctgcagctgttcttggtggtcgtcccgtggtgctggcatctccaaaatactggggtcttctgctgcactttcaccagtagtctctcctaggcttcatagccacgattcaagttctttttgactgcttctaaggctgcactttctccaatggcctctcagtgccaagcttcagcagctcttcatggcctcttcagaccttccaaaccagcatcattcttacacattactaagttcagctgacagtacaaggttcaacatcatagcttgtgtgtgttgaccctgaggcaacaattcccagatttcacctgagtgatgctgaccttaaacacggctagtttctcaacaccagctgaccagcatcagttgtcccagtaaagctaaagtttcacatcagtggtgctggtctcctgttgatcacagccgattcttcatttcccattagtcagaacctagcaaatggcctgttaaagagtctctacgagactctcaaactgccctctgaaactccgcaagccagcccttgttttcatttctctcaacattctttcttccaagctcctacagaacaccccgctgagctcttcaatactcagtgacttttctagcccaattttccaaagtcttccacaaccctcccaaaaacaacatggtcaggtctgtcccaacaatagctcataatcctggcactgatttctggtttcagattactattgctgtgatgaagcaccataaccagaagcaacttgggaaggaaggatttatttagcttacacttccacatgacacacagttctttattgaaagaaggcagagcagggagggcagggaccggaggcaggagctgacacagaggccatgaagaaggaagtgctgcttactagcttgcacttatggcttcagcctttcttatagaacccaggaccactggccagggttgggctgagcccttcccaatcaatcactaattaagaaaatggcctacagccctgtctcatggaggcatcttagttgaggctgttcctctcagatgcctctagcttgttgaaattgacataaaactag

SEQ ID NO: 17915 - DNA, 1114 bp, Mus musculus
gccagagactcattgattttcctttatactgtcttacacctctaaaagcgtctgttcgtcaggctgggacgtagttgtcatgcagtgaaaacagaactgtagaaccatctttcgctttccatttcctatttatttatttatttatttatttatttatttatttatttgaggggcaagatgaggctcccaagtgtggattacaacttgtgagctcagacctcttggttttttatttatttgtttggtatttgtggaacaggagttttttgtgtagtcctggctgtcctggaacttgctctgtagaccagactggccttgaactcacagagagccatctgcctctacttcctatatactgagattaaaggtgtatctcactactgatcagcctttttaccttttttaagggttataatataaggaaattgatgcccttctcagaactatagctctttttttttttaagttaggtaaagttcaagaatcactggatatagattttggtgacattcaagaacacaattctttgccttcaaataaggtgaaagaattaatctttggggaacatgcccctgaaagggggcatatgttatctcttctatctggaagtgctgggatacaagcaaggcaaagctagtcggtaagagtctttcagatgtgtctcttctggcttgtctgatgccagtttcaggtgcttaactgtaggtcagtacagtcgttgactctagaaaaagaaatgtttgtttcattgtctgacttggctaatgagaagactgtgttatgtttcaagtggtgatctctttctcattactaagttacttgcctgcactgttcccaggccagtctggatttagattgtctcttttccaagcacagcagcattgccaaagcaagagtattatttcacagtgataccaccatttgttacagcatattaagttccaaggatgctgaggcctgcgttctcagggacacatttatattttctctccatgtctcctataagtgggaacattgctgggaaattattgagtagagaagttggtttcattatatgtcaattagaattggctttcaagaatgtactaaaacagcaagatttcacagtaattta

SEQ ID NO: 17916 - DNA, 1756 bp, Mus musculus
ttctctgggtggtccttatacttagaacaggactcagtgagtttcagggatgaacacaagttttgtttctccctccaggttagcaacattaagaagacactcaaagcaacagcatcctcctcagctcaggaaatggagcagcagctggctgaacgggagtgtcccccccatactgagcagaggcaacccactaagaagatgtccaaagtgaaaggtctggtctccagccgccactagggccggctggggcagctggcactcagcaggcctgggtcaggtcgggaggggacacccagggcctatttccgtccctctctaactgcagtgagttccagatctgcccacccctcaccagtacctccccatccattggtaccattgcggaaaatgattgctcctcccttgcctccttccctagttgttcccttcagactcaggggctcaatggatgccatcgtaacagggtccagcactgcccggcttccctgcaggggtccttgtctctgtgatgggctacctccctcccagttgttctttgctctctgtcattttgtcaggctggtcctaagctggaggcagtttacccagccccaagggatgactgtggaggtggctcctctctgagtgaagagggggccttgcttctccagccccatgtaccacagtatccacaatggtgcaagtgtctctagccaggtagccacatgtcccctctcctgccttacccctgttggcagtgccagttgaggccatggagggatgtggtgctgggctatgtttactaaacctttgggttttcagcctcttaagcccagccaggatctctcatcaagttggggcactgggctgactaacccctggtgtctgacaccagtggagggtgcttgggtctgggggcagcagaaggtgtttctcctagcttggtgtcctctgctggctactcttgctgctgtctctgactgcacagccttgatttggcatttcgacccagctacccactgggattgtctgccaacaattgctctcccaagatctttcatgcctcctggctgcccctggggtaggagtggtggtgcccaagcccctcagactggtgaaggaccattgctgcttctttctccctccttgtctggcgacccagagccctctgatgacatcatactccactcctggccagagaaaaggacttgactagactttctgaacttgaacagtttcaggttatattttaattttttttttttgtacaggttgattctaatacatttcaacatgcttttttctccttttgtgtcaatatttgttatagtccaatcgccggggatgtctcacttggttggagggtgtgtgtgtaggtgtggaggattatatgggggtgggatagggtatgtgtatgtgtggagggcttgggggtatggaggggtgtgtgtgtgtatgtgtgtgtgtattttgtttcctaaggggagatggagaccctgtactgatttaaacctaattaagttttaaaaagtacattttaggaaaaaaaaaaaaagaaaaaagaaaagtgtagatttgacatatgcgactgtggagtatggggttgtacagctggtgggtttggagggcagtaatttgggttgttcagagaaatgtgatgctattttagtggcatggttaaaaagtgggttgatccagtgttaaagtattcctgtgttccttatttgctggtccatatgcccagatagcactatacctaactgtaggttaagtttga

SEQ ID NO: 17917 - DNA, 1162 bp, Mus musculus
tgagaaaatgtctggcacacacatacaaaatatccaccccaaaagtctcttttgaccttaaatataatagaaaggaacttgtatagagggctagagcaatggctcaaagcacgtactgtgaaagtgtaaggacctgagttttaacccccagaacccacataaagccaggttcaatagcacaagtctgtaaccccagtattcctacggtgaaatgtgagaaagagagaagagagtccttgaaggtcagatagcctggtatacagaaagcccctgtgccaaacactgtggaaggtgagaaccacattgaagttatcctctgattccatatttcttcatggcacacactcatgaacatttgcacataaatgtgtgtgtgtcacaccatacatatacaatcatacacgcatgcatggaaataaagcaggtgtaaaagagttggttaagagtaagaagtgtgttaggaaaccagccctccttttcaggccccaccctcctccccacccctccccagtactcgccccttgcctgcttatctgagtcagctgtgactttggccttggttgtggttctgtagccaccgactccccacttactacttctgtagtgatcctgtggctgtgtagttgggaggtggacacagatgcaaagtagtgtagccctgttagaaaatggccccagcataattttaaagtaccttttctctccttcaaagactgattctctgagtgtgtgttgtggtgtggtgtgagacagggacagtggtggtgagtgaggcagaagaaatatgccttgataatgctggtgctggtggtggtagtagtggtgatggtggtggtggggtgatggtggtggtgatgatggtgatggtggcagcagctcacatttgggcacctgctctgcattagactcatgggaaccagtgtgtgccattcctacttaaccctcatcacagcctgaagagtgctttcattactatgcactgcagaagctaaggcctagggaactctgccagctcactctaagtaatttacatacacagtcaactttaacatgtctacagtggaggaagactaggtggaagacagttgttaccactctgggaaaccatcctcaataaccagtagacccagcctagacttgagaacagtgtgttctggtatca

SEQ ID NO: 17918 - DNA, 1219 bp, Mus musculus
ttacaccagctaggtgccagtttttgactgggagtactgccatgggcattggtcctatgtcagatggctctgactccctggagccaccagcactcatttgccatctgtggccctggttgcttgtctcagtagtcatgtgtcagtactgtttttcttagagcaggtctgtcttacactctgctgcaggacagagatagtgtctgccctcctgctaggtttagtctaagctcataaggtctacatctttccctaggattcttgtttgctggattcccatttaacctggttaggaaagggaaaggatagtttccattcactccccactgttctccctttctgatacctggagacagttcatcttgacttgtaaagtcccataaacagatccttccaggacctaggagcctctgggactcctgccctgcagccgtagcaccctcctcaagacccagatgctactttcccttgctccccactctctttcctctcccaatgagctaccttttgcacttccactagaatgccaggcaggctgggcccccaaaggctcctttttcaaaacctctggaagccgcgattgaatgtgccatgaccctctccctctctggatggcaccatcattgaagctggcatcatcggagtctcttgttctgttggcgtgccacctggaagacccttctgtcctggacaagaggaacggaagagcatgttatcctttgagaacaggctgacagcagcaactactacaacagctgagatcacaaataaatggtgctaaaccagcttgtctcatgctcttgctctttatggtgcatcaagatgtggcctctggattgactgtcaccattttcaagggatggcacacagacttctccatgcagggccattcagggaacacaacttcatagccacaagcccattgtgtagtcacatggtactttattccgggactgttgtggtctgacattaaataatgaggtgacgtctaactcaagacccaactgcctggtgctcaagtgtactagtttccatccagttagaccaatggctggcccagagtggcggctgagttcaggtccagcttgaaagtctcttaaggttggaaaggggtatccttggcttttctttgctaacttccatttgcctttagttcatagaagtctcttgcttggaactaagccctgcttctgtctgtctgtggccgcacatacatactttt

SEQ ID NO: 17919 - DNA, 1351 bp, Mus musculus
cactggcccccaacttcacctcagactgctgggattagaggtgtgagccaccatgccagctctcatgcccagcttgtggctcctctgaataaagcagatttgagttttcataggtttgggtccttacatcaaatggctcacagcatcctctacttggggggggggggggggggactcctaccacagacagaattctgggaccactagggtactgctgccacaaaggcagttaacacagacagcactgttgtgagaaaattgcatctggcctgggatggcaaaaggaccctcttcccataatggagcacagtgctggagaagctgatgggagttctctgcagagcgtaaggaagaagggaagagagaggccaaattgtggagtcttccttcacctggtctagctatcattgtatttcaacattgaactttaatatacagatgagggccagctcattcactgccttagttcagtcataacctggtggtcctgggccactttaaacttagagctgtctgaccttgcattgtgtgctatatatacccagactagcaggtggctaaacccctttctagtgagggctggctgagagcaaggcactggtgcctgtaggctttgggtggagattagaaagcagggaattacaaacaaatgagatctggtgagataggatcagtggaccttaaagagtctttcttgctgtcactggaatctcctcagaattctcagtgggctttgttcatctctggtgtgttcgtttctagacactcaaatcataaggcaatttttaggataacttcctctttaaaagaagagcattttgaagttacctgatgtgcttgggctgccgagtggagggacagtgactagacattcacacctggctggcctctgaggacaggagtgggtgcaccattgctcacggccacgtgctttatttccctgaatccatgcaaggaaatttccagacccagaatcttcatgtctaagcatagaaaataggaagtcagtttagtgtgtcgtgtactagaggaacctcttcagccttccgggtcttcacccaatgaaccattgttaggcagagttagtagggactggcccttctggaaacaaagggataaatgagatggacttcaaccctgctgtgtgaccttgttgacctcttagttacttaaagtagaaattaaatcttgctgttaggttcccaggtcattgtccaagtgttggatttttacttgtcttcattgagagtaaagagggaagccgcctcccgcatcccttaggagccagagaacagctcatcactgtgtctccagaaagagctcgggaattgacaagttctggcatacttct

SEQ ID NO: 17920 - DNA, 1876 bp, Mus musculus
ttctctcccaccttcactgaggttggctgttgtgtatcagattgtcaattgatcttggaaatgtctccatataagctccttttttctctttaaggttgcagtataccactatgagaatgtgcatgcattaatatttcacctgcactgggggagttactaaccttttaccttgctaagcaacaggctggaagtttttgcacggacttggaaggcaggctgctgtttggctttagactggcagggaagggctgggtctggagagctggtcaagtcctcccccatatgtgtgtgctcatatctagatggcccatatattgaatactctattttctcccattttctctttcagggacaattcaagctttcgaaatacaaaaatcacattgtgaaagcgcacaagctggcagtaatccttttctctttgtgtgtttgtctgaattggatgcgaggctcaggcagttcttctgtctgttcactgaaggggtgtacctaaaccatgggctccccttctacactcgttcctggaagacggactctgctaaacaccttccagcattgctgaccttataaagtgggaagaatggggaaaatgtgactgtaacagacaaacactttttggtggggttctgtgtgggagtgcagctgtcttattgctgtgtactatccagatgcctcttggcatcctgctgtactcacctgctgagcgaaggacttgatgaccgaccatatgtatgtgtccggtgctgggtctgagctgagcgttatcagtattatgaatgcttgcacatccaggaacagcctctgcttagagttgaagagaatcaaatgtctcttccagctctaccgttaagttattgtgtgttcctctcccctaagcccaccactttgaacaagtgttaagatatgatgacagcctaggattctgtgtcctttgcgccttacacctccaatgggactcttcttcttgggcactgaagcacttaaattgtgatcccaggcagcacaggttttgctgaggagagctaaggcatctgccccctaagacaagctggagaagaatgcagttcagtgagaagccagatcatagtgtaggtcccacgtgtggggttgggctgagggcagtgactgaaaccagcctcccatgtgagcaggacttgtgtggtgagcatgccctgtcgggcttgcatggctgtcatggaggaagcaatggctagttagtgccacattaaaacagtgtgtagaacccacagtgctgaaacaaataactgaagaaatggcagccttgctgagtgctttcatttgatggctgtgtctgtaagctgtggttggaaaagacttttggtccttgacacctggatgtaaacaaattgtccagatccctcgatgcccagaaggctcctccaggtgtgtcttcatcagagaagcagactttgggagcctgaggccagaaaggtcaagagtacccaagaccaaggaagaaatgggcagttgcagcagcttcaagtgctctgaactgggctcttgtgagccaagatggcggtaccttaaattaaggcctctctttaaagcatatctgaagatgaagatgctgttactctgaaggtaacagcatctcctcgtgtccatcacactcttccagctttccagtcactgctggttgggaatgccctcccctgaaagaacaacacggggccaagagggaaggtgtttccgccgcgggtaaagccatctgagaagaaagtccaacagtgattgaagctccaggaatctgaagaatgcattctggggtggttgtgaagggcccggcaataccagagcatcattggctgtcaaggaggcaaaggctgcctctagaggcttgatgaagcaggaggcc

SEQ ID NO: 17921 - DNA, 1197 bp, Mus musculus
ctggagattgaacctagggctctgtgagtgctacttaagcactcttccaattaaggcacatctccggtcctctaattagtattagccattgccacaattcagcttataatttgattactctttgttgaccatgttgaccaagctgactgaccctgaaattaccatgaatcttaggcctctagttcgtaagtgctgtgattagaggtgtgttcaacctcaacctaaatattttttttttttttttaaaagatttatttatttattatatgtaagtacactgtagctgtcttcagacacaccagaagagggagtcagatctcattacggatggttgtgagccaccatgtggttgctgggatttgaacttctgaccttcggaagagcagtcgggtgctcttacccactgagccatctcaccagcccctcaacctaaatatttaacatcacaaaaatgctgttaattatccttaactggggataaggaatattggagtgaagatagaggaaaattcaaagaacctgggaggtgatagatcccaacactaacttcataaaaatggggttgttgacaagtggagactgggaaccctgcatagatctctgcagagcagcatttcagctgacctgcacagcgccagagcatgggttataactgcctgtgcagctgctcatggaaacagcaccctacagggaagggggctttagtttcaggagatctttgtcagcatttgagctgtcaaaatgaacaggctggctggctggccctgggagggcagacggacagaggacataagatcacctattggtggacccaagtggcaatcataagggtagaccagatgcctttttaagcctcatccagctgtggtgtcagaatggacctgccatttgagtgttcagtggtatcttagggttttactgctgtgaatgaacatgaacaaagcaaaaagcaaatctttttttttttttttttttttttggtttttcgagacagggtttctctttatagccctggctgtcctggaactcactttgtagaccaggcttggcctcaaactcagaaatccgcctgcctctgcctcctgagtgctgggattaaaggcgtgcgccaccacacccggctttttttttttttttttttaagattttatttattatatctaagtacactgtagctgtcttcagatacaccagaag

SEQ ID NO: 17922 - DNA, 1160 bp, Mus musculus
aatttacaatcctttctctgcttcttgacctgagtattggaattataggtgtgtactaccatacttggctttaaacttattttgggagacaggtctcatgtaggctggcttcaaatttgttatgcagctgagactggctttgaacttctagtcctcctgactctgttccaaatgctgtggttacagatatgtgccattagagacttcatagttactgatcccttcctgtgtttttttttttttttttttttttaagataagctcgcatggccttgaactactatgtagaattgcccagtggcctggtgctcatgagtgagattcttgcctttgctccataactgctggagttaagaagcatgtgcccagtttatggcaatttttcttagtggaacaattttttctaacgttatatgtttgttgacttacagttttcaattaaaatattttatagctaggtgtagtgatactttgccttaaatcccagcacttgggaggcagaagctgtcagatctcagagattgaggccaacctggtctacaaagtgagttctaggacagctagagctgcacaatgagacactatcgcaaaaacaaacaaatcattatagctcccttccatagatagatatattaaacccttttaacatttagtctgtgtgtatgtgtgtgtactaaaatgagtgtgtgtaggtcagaggaaggaaatacttttcccactatgtttgaagtcaagtttgtgagcatggtaacaggtgcttttatctgctgagccatctctccagttcacatacctaggttttttaaaatgtaaagcctaggaattactaataaaagtagtacattttttttttttcttttttgagacagggtttctctgtatagccctggctgtcctggaactcactttgtagaactcactttgtagaccaggctggccttgaactcagaaattcgcctgcctctgcctcccgagtgctgggattaaaggcgtgcgcaaccacgcccgactaaagtagtacatttatgtaacaatagccacaggttttacttattatacttcttttactggctggagatgttttggtatgtgccatgtacataggtatagattcatttttacatgtgtttatgtgcatgtgaaggtcagaggttgagatt

SEQ ID NO: 17923 - DNA, 1176 bp, Mus musculus
aaaacaaaagaacaaactgaaacaatgtgagactttcttatttgactacggcagataatagcttctgtttttttcaatatacttgtttttaatttattaatgggtagagaatctcatatttaggacagacaaaattgctttgaaatttccttagtatctgctttaagttaaatgtggagatattattccttcgatctgtactttggaataccagattcaatgtcaaatccaaaggaagtagctttatgggaggagagggtaggcggctggagtattttatttttgagatcgggtcttaaaaagatcctgctggccaaaaagtccctgtaggtcaggctgacctaaaagagatctgctttgcctctgcctccctctgctgagcgtaaagacgcatggcactatgcctggctatgactggagtttttaatgtaagtactgcataattaacagaaattaattgtaatcaaataagttcatggttagaaaacagtgccttttcttgagtttatcttcttgcaattggagaaatagcaatctctggccttatgtttatcacacagataccctttgatcttctggagaaagaattcctgcctatcctacaggaggagcccttgccaccattggctctagtaccctttacagaagaagagcaggtttgtacttcgctctgagccagatactacaggatacttagaggaaactataagaaacacaagttggcacaggttggcatctttactgatgcttggcttgtgaaaggctctgacttgtcaaggttttgttttttattctgaagctgttgagtgtaatgcaacgatcaggaaatctttctacactttttaacatatacatgtatatgggtgttttgccttttctatatatctttaccacatgtgtgcctggaccccaaggaggccagaagagtgcatcagagttacagatacttgtgagccaccatgtaggtgctgggaattggacccttttcctctggaagagcagttagtgctctttactgctaacctgtctctgaagctttgtttctagatcttttaagggcattataagaattatcccagctgggcgcggtggcgcatgcctttaatcccagcactggggaggcagaggcaggcggatttctgagttcgaggtcagcctggtctacaaagtgagttc

SEQ ID NO: 17924 - DNA, 1839 bp, Mus musculus
ctcccgcctagtgaccatggtttctcctcattggacacaacatacgttcaccattttctctgtcactctgcaacaaatcacagaaccaatcatctcaggcttttttttttcctagccctttgtgtccaagattactttagatcactgttggtgagcatctcagactgtacctagtggaccagcccttgtctcagggtggcagttggggctgctccccagcagagctaatgttgccagcacacattcactgtgcgttgatttcatctactgtctcctggaagtgtgttggaatctgccaatagcagatcactttctcttatcacttttcttgttctgttttgttctttctccccacccctctattccaccccataccggcaaagggccttaactggtgcagtcatgaagagagttaatggttaatagacattggccagcaacaaatcaccccctggacagtaacttctctattgccacaggcaggcataactctgtctgtaggttgcatgaccattgttaacgtggggattgcatcagaggcctgagaggggtgtagattggcttgtttgatgttgcacaccctcgctgttctttctgaagaaaggatgcgtgtgttcttcattagatagtaactttctaagcaagctgtgttctccctaacatattccaacgttactactggacaaaagaaaccctatggcctgggacagggacttaattttcctttcatataaaaactgatctcccctcctcccataaatatttttacttcaaggactaggaccagtttgttttgggcccttatgtgaaaatttgtctcgtttaagaggcatctttaccatatgtatgaatttgtgtaatttcaactcggatagggataaacttttgcttctgataaaagctgggaatttcatctgttcctcagagcaccgtgtgcatgttttgccatggccctgaaaaggtcttgtgaaaagattctgggatggcaagttgtttgccttttctgaaaagagaacatacaaagcctgaccatctttaagaccttcatccgtggaaaccactatgcaggaggatgcaatggggtatggggatggcaggcacaggagtgggaggcctgctccatagcaaggccaagtgtactcaagctctgtacagacagactctgactgcttctgctcctcgcctagtgaacatcacctgggatagtcgaacacctcggcggcagctgtgggtcagctgggcctgtgcaagaggtgctgtggtgggcagctcggcatctgtgcctggacaaggctggagttgctctcagagcagtttggtattggaagattatatttggtttctatttttattattttgcatcaccattctccctatcctttcttgcctctctccctcctaaatgtgtacaataactatacagagactgctacaaacttgtaaatagtttttggatcaaatagcataaggagataggaaccattaaaatgtgagactcctctcctttgctttgtaaattcaaaagggggggtggggaagagggatagttaaaatgtttacaaaactttaagctccctcggaacttttgccagtgtggaggaaaataaaaaaaaattaaataaaatgtgttgtggtctctctgagtgtcttgtactcgcctctcttgaggctgagcttggcatgaaactctccctcttgatggcatggagcagccgtggcaccacaggctttggagatgagaagcagtttgggccactctgggaggagcggtgactaggcctgtgtttgggaaggtggagtccggctgaaggttgggaagccttcctgcacggctacggc

SEQ ID NO: 17925 - DNA, 1228 bp, Mus musculus
ttagaatctcagaagtgatctgggctggacagactagctgaactggccagctctgggttcatcaagaaaccctacctccataacataaagtgtgatggagaaaggcacctaatgtcaacctcaaacccctacctgcatgtgcacacacatacatccacaccacacacacacacacacacacacacacacaccacacacacacacacacaaataaataagtaaataaataaaatatttagctctccagaccaaatcttggtgaaacccatgcatttgcatttgtgtgtgtcctacaaacactgaaggttaagaagcatgctccttagtaattttatagcagtttgcgtttccagattgaaaacagattctataggctacacagtgctaaatggattatgctcagatacagattgaaaaggatacagattgaaaagggtcggggtctgggccaggatgacgggccaactgatctttgccggggcttgtccttcagggaagggttacaggattcaccactggggtgtggcctatctgctgttaggacctgaattgcctggagtgtttctagttcccactagttgttgaactttaccttgaacctctgctcccagggaagtcatcaggactctgccatccctggagtctctgcagaggttgtttgaccaacagctctccccaggccttcgcccacgacctcaggtaaggggtttggatttggaaagatgcaattgctataggagggactctgaaggcagacagacgcaccgcctcctcacgttggctagtctaatataaacatcgcggtggatggtgaggatagactccatgcccttttgtgaaggcatttcctggcatcagctcctgacttcagacagtttcacccatcagacaaattgcctggtgttggaggaggaggtgagcagggccattcccatcatttctcctcagaaatggaaaggcaaggaaaacatgaggttcttcagacacttaatccctgggactgcaaaatggtggtgcccctcctccacagctgctcacggcggggcaggagatgagggccaaatgaagcatagatctagctattttttttttagtgccttcagtaaatttaaaatcaaataagggaagggacctagatctttatgttatggcattgttaaaagtgagaacttgtagccagggtgtggtggcgcacacctttaatcccagcacttgggaggcagaggca

SEQ ID NO: 17926 - DNA, 1202 bp, Mus musculus
ttgtaatatatgcatgaattaacatataaggcacttaggacagtgtggctctttcacattaattagcctgacctaacttacagcactaggggtcaaatctggcaaggccctgatagccctttctgttctcatcttacagtgagctgctggtgatcggagcctggaggaacagcacaaagcagacctgcgcctctctcaggatgcctctctcaggatgcctcttggaggacctcctgctagctcttcttgcctagcttcaagtcccaggctgtgtattttttttcaggaaacggcctcacttctctgtggtccaagaagtgtgctgctggctgccacactgtgcggcagatgctaaagctggatgacaaacgcacgccatacagacagcagacagcggcactgggtctcagaacttggattcctgggccttcttccagtcgccgttttaaagaaaggaactaacggagctgctcatccgagggtgaagatataaataataatattattaataataataacagtcaggtgccatgtgctgtgttaagtgctttatgaacatttgtcgggctggcctccagtgctgaggtgccagtcagcctgaaccctatgcccaggcccactaatcccaaatggtgggtcctgagatgtttttaaaaagcattaaagaaaaccatcggtctcttagagctaaccggccgggctctactgcagggacccgaacagtctgcatggctaagtggcacaaggagcctggccctgtccagcttcagagatccaagctgctttttgctggggttctgtcacaggcctgatcctcttggtttttatggggtttcaagtctgccagagtcagaaatcagctctaactcgccagtgaagagatctggccttaacttaagccagccacgtcaggcccctgctgagcctatggaccaataaatactccccgtgccactggaggtgggcagctatcaccataccctgagttgggccaagcccaccccacccctaccctgcaacatttctgatgtactgaggaagagtctccaccatagtccccaagggctgagttctccagcctgctatcagggaaggtgagcattggtcccaggctctcaaaatagtgcagcctcttcttcccaagctctggggtgcaccctgtgtccttggttaccaggagactagggttgtgatatcttttc

SEQ ID NO: 17927 - DNA, 1261 bp, Mus musculus
caaccactaagagcctgtgattggaaccaggacacagcattgtacagaaaacattaaatgtagtacctgggaatctcaggtgggttctggcagtgacagttacccttgttcccagttggggtttagaacagaaattggtctaacctgagaaaatggtctgccttgctcaaagccttgaaaacagtggagaagcagagaggcatcgttacttgctgtgcctggagttggttaaggcaggcttaggtgagggagacatgcagctcgagcctgctttcagttagtggaacggctcctgggcactagaacttttggtttaggacattgcaaagcttcattggtagtcagtcgttgtggtgagctgactgaggctgactgactcctgctgtggaggaggagttgggtagagcagagccataccttactgaggtcagtgatgattggtaaaaggtctgattgcactgaatgtcacagccccttccttgccctcgactcccagcagcccatttttttcctagcacattgaagttatgtgcatgggataatggggcagctgataatttaggattctgccagtgtgtgttcccgagagtgaacggttcacagctgactgctatccaacagaacctgtgatgcaggagtcttgatgagtggcggatgggtgtgacagtgcatgatctcaagttttcaatctgagacctcaggacagaatattcttacaaaggagagctgcatgaggtgaaaaagtcaggtcagctaccagatttccagcagttggacatgagcaggaaagtggacagtcacatcaccaaagcattaatatgtcccagtcggttagagaggtgctgcctccctgggctttgctgtacttggagcaaaacgtagacatcagctttgcaagtagttccatatccacttttgtgttggggaatatagtggtaccatctctttcttcccgtcacatgggatgcttttacctggtctcattctgaatgtgggtgttcattcgtgctaatcttagaaatgcccctgtgaaagggctgggcacagtgacacaagcttttaatcccaacactcaggaagcagagacaagagaatatgagtttaagggtcagcttgacctagaaatcaatttccaacctatctcaaaaaaaaaaaaaagatatttcacatgaagaacgtataattctcctaaaatagcacttttattgattttttttcaagtacaatatagattataaattttttttctgataagcaaaat

SEQ ID NO: 17928 - DNA, 1263 bp, Mus musculus
gatctgtctccactgggcatacacacagtaattagtaataattagttcagtagtagtaatagtagttcagtagtagtagtggtagtagtagtagtagtagtagtagtagtagtagtagtagcagcagtagttgtatataaaaatcaaagagctcgaacattaaatgccaacgtggaatgccgaactgctcttgtgaaggactagaattttgtttacaactactgtaacatcagctctgggtgacccagcatctttcagccccctggcaactgcagtggtgtgcacaagtgagtctttaaaaaagaagtaaaaataaaaagtcaggcatgtttgcacatgcctttaatcctagccctcagaaggtggctgtttccttccacataatgagatcttttctcaaaaaaagaaagaaagaaagagagagggagggagggagggagggagggagggagggagggagggagggagggagggacggagggagggaaaaagcctaccttggaaagaggtcagtgatgaatagtaaaaggtctgacttccgaggtcgcctcccagcagcctacatccccagctgcttacctctctcccatcatgctctagtagtgctatcatgggcaaacacagtagctgacatgcagtgatgtctccattctgtcttccctgacaagtccagagaaggcactggttggcatccaacagcttggtcacaagggatttggttgttgggagtgctggcgtccttggctatgatctgacattttaagctgagacctcttattttaaacaccccatagcatctaattgtgtatatggaattctgatgcttccttttgtaaattatgcctgcagtggccctgtcttttctcactttaagtacagactgactttcagtggcatgaataaaagaaagtcctgtctttgttactttgagttagacgtggtgcggtacacctgttaatcccagcactggagagccggaggcaagagcttttaaaacatcctcctcctgcttcctcctctctgcttttttggatttcaaggctttacagaattcagtgctgtttctaaggttgggtttgtatttctctttagtagaagattgccttgaccccttccagtgctggggtctagagccttgtatgtgctagacagtgctccaccactgagctatatcccaaagtcttactgtgttgcccaggctgattttgagtttacagattccaggaattcaagtactgggactgtgtatgtaatacctgcctt

SEQ ID NO: 17929 - DNA, 1300 bp, Mus musculus
tctgctctacggagctgagtgttctctttctgcttccctaagggctactcttggggtgaaccagataaggcctggttgctaatggagatgtcacctgtctagttcagtgctgttactgggacacagtgcagctttcatagcatacgcccctgctgtgggagggtgtgcctgtattttgcacgtgcatgggtctggtgtcttgctgactgaagtctcttctaattggtccttaagctcttctatcaatgcggtggcgtgggccccctcgggcttacatgttgtcagtgtggacaaaggaagcagagctgtgctgtgggcacagccttgatgctgcacccttaggagcaccgtgggaccccacggcccatcttggagaatgatgtgtcctcccagaaaagagctgaagccatgtggtgccgtagctttcttgagaactttgacttaaggtctctaatggctgagaagaaccaacactgaaccaaactgactctgcaagtccctagcagaggttcagatttttgtctgcatttgggtgggaaacactactaactctgaccttccatacctcatggggagtacagggtccctgctgggtctccccactggacacagtgccaaggacaaccccacacaccgggtattgggtcccctgtgctcttcccatctttccaaagtctgttgtagcctgatgctcgccccctttctgtggagtcacttacccagggggctcactgtaggcactgggtcagtggaaaccaaatccgggcctgtcctcctgtgacaaaggatgggtggagctgttttcagggctggtggtatgtctggtctcactgctgaaacctgcatcttcagctggccctcagaaccctgaactcccttcctgccaacacttgcacatagctttgtgtgtgtgtgaggaaaggactgtgccaacctttccctgtctggtagaatttgcagcagaggtgagaaacacatctttaccctgcatcactgcacgtgcacagcaggtggccgagcactcacctggagcagagagtggtgaggccagccactgcctgtgcgtgcagtgcagtgttggtaagagaagcctacctaggagctggtgatgatgaaggctgggctgggaaagcattctctgtcctgctcgcccgtgcacatggtctgagcgccacgtttgtctgtcacacttactttgcactttattttttgcttccacactgttctctggacagcagggacaacatgagtgctggagctcgggaagagggacagcagttctgcctgccctgcccgaaac

SEQ ID NO: 17930 - DNA, 1208 bp, Mus musculus
ttaggagaggcatgtgcactgtatcacctgcaggaaacagggcctcccctgctgagggacctcgctgtcctccctaggtgttctcatggctgctcataagagtctggcaaaactgagatcttcatctctctcggaatagaccccagcaaaggtcttcaaaaggaaggggttcttcccatcagctgtggcgcactgtgggggggaagggggcttttctagagtagacacagtgtaaaccagcatcggaacgaactctgtgccttctctacccaaactgtgattagggtcagcccctctgtatccagctctgtgtcctcaagatgagtcaggcccacagtggacatgtgcatactcttccttcacctttactcagggactcttcatcgcacacacttgctactggccagtgagcagcttgcaactctccttctttcccacagccctcctgtctgttcattttgttgtgactcctctcaactctgctctgctttggacagtgtcaagtgtgttgtcctgttttacagcatccagggccccttgtgagaagctggtgagcaaaggcctgtcactcggcagctctgcctcactccctcctggtacaggaagccgggacagcctgcctgctctgaacaccaagatcctatatccaagtaagtgacccactgcccccccacccccaccccaccccaccgtggggaggtgagtcttagcctggggtgcggtaccagggaggctagaggtgcttgctggaggtgcttagccggggtggggtaccagggaggctagaggtgcttgctggaggtgcttagccggggtggggtaccagggagggtagaggtgcttgctggccctggctgagcttatggcaccgtgggtcttggaaggaataggactgttgctgtcctcgaagagcttgcagttccatggaaacatacacagaactctgtaatttaactcatgtgactgtgtgaaaaatacctttttggtttacaagtgttttttattcctttgcaatttcatacatgtatgcaatgttttttgaccatacctacccccaacacctccctccagaccactgccagggccctccaatgtactctcccttctttatatcactctcttagtttttataatccattgagtctaattagtgtgtataggggtgggctacccactgcaacatgggcaacctagttgcagccaccttt

SEQ ID NO: 17931 - DNA, 1220 bp, Mus musculus
tttgaatgtttatcagttattggtagacagaacgtagtaaggccacataatagattgctttgcataaagataaactggttagaggaaaggagccagagcacattatctcattccatttatttgacaagccctggatgggcacatcccgaggatctgtgcttctagggcctgaacagtgaggcagttgccagtgcaagtgacggtggttctgaaactgatgaaagggctctgaagtgtaccagaaaccgttgagtcatgtacttagatgtggtagtgacttgctatgtgaataacatcttggtagagctcttaccaaaacaaacaaataccccacacaaaccctgaatcaggaccctgggttcaaactctaaacacagggaaaggaaacaaagcaaacctaagtgaaaaaaacaacaaaacacggaaaaagccgtgagttttgttctgcgggaaaaatggcaggacagtcacagaggaacctgtcatgcagagccattgagagactttaaactcacctttgcagagaatactacacagagaagtgtgtcatgaacaactattttggcattggcttggatgcaaagatatctctggacttcaacaacaagcgtgatgagcacccagagaaatgcaggtatgtactctttgttgtcagttttgttgtagaaagaggaaaccaagaagccagctcaaaaggggagggactccacccctggattggccatcttgggcagactggatatcaggaagccagtgatgtgtatgactgaagtgggctgtctcttacccaacatcggagtctatgatgatgtgttggaggaaggtgacatgagtgtgctacaaggtcaccattccagtaccgttcatgggtagagctttgcttgtccacaaactgcctagagcaccccctctccgtgcccccctcccctcaattgtcatcaggacatggagagcagatggcacagtgcatgtatagaggtcagaagaccacctgtcttagtcagggtttctattcctgcacaaacatcatgaccaagatgcaagttggcgaggaaagggtttattcggcttacacttccacattgctgttcatcaccaaggaagtcaagactggaactcaagcgggtcaggaagcaggagctgatgcagaggccatggagggatgttctttactggcttgcttcccctggcttgctcagcctgctctcttatagaaccaa

SEQ ID NO: 17932 - DNA, 2391 bp, Mus musculus
ctgctggctgtccttcacaacagtagtctttgtaggacacaggaaccatgcattgggtgtctgcatgactgacatttgtgctgatttccttcctatttcatccattgatcattttcctaatttgtacttgaaaaggagactgagaaagctttttggtggcagcccatttgtcagccctctggtctgagccctcttccaaatatccatgttgcctgtcttccttctctgttgcaggaccttggtgtgaccaaagtgggccatatgaagaggatcctttgtgggatcaaggagctgagccggagctcccctgccgccgaggcctagcctctgcgttctctgcctgcattctccgctcctcccgagactgaggcctagggaggacactgccagcactcagcccctggcctttctcatggtgctattccttttgttagagacaggaagcccaatgcccgttggtaacagctttggagtcttgaacataccaacacagctacctttgagagaatacttttcctagctgcagtcatttggggcagactgtgtcacatccacttgtggctcttgctaacctgccttgtgggccacagggaatgtggtgaatgaagcctgaccacccagcacctggcatccctgcagaaccttcttacctggggcacatgcttggattgtgctgtgcactccttttctgtgtcctttattggtcacactgggtagtaccatcttctgtctctattggctctcagaaacagagttgggtcaggcctcagtggccctcaccagaatgttctctgtgcctgctacccactctgtagttcttcacagcagccccacaaaggcagcccactgctgttgccccctttgttcacaaggtttcattgttttaaaaaacaagctatttactttcctggtttgaaaatggcatggatgtgtttccaggcttgttatagtctgtgaggaaggaggaaagtcctcctgcttaggccaggtctcaggacacttggttctccccactcttgtcctgtgggctgtgagcatgtggacagcccatgtatctcctcaggatgctacaggtgtctgcagtccagtctggggcagataaggattgccactaactcagcattcctgtggagaccaggcttcttggatgctggaagtgacatatgccatgagagaatgaataggggcagtcatctggagccatcttgggtggcttctcatctgcgctgaggtttgttgtcccaggagatgcctgttaggcctcttgactgttgctgccttgctactatctgctgggcagaaagctctccaaggcccagactacatcctgtgggcagttcccaggtgaggatgtcctgagtcttcactgccacctacttacccttctctacttttgagatagtcctccacagggactgatagaacagctggaaagggagggctgctggtctgtggtcctcaccagagatgacaggtctgtgggctctgccggtgcttccccatctgacatgggaaggaagtactgaatttgggctctaggtagagtctgcagcaattccagctgggaggcaaggttgacctgctgtttgttctgaagactagactccttgttcatcttccctttcctggtgacagatctgagagccctggtgagcagagtggagtatggaaagggcctacagtgttgttcctgctgtgttctgccccaggcctagagttccacccattgtctatcagctgtgggctgggagaatctttgccctgtgtgtggttgttgctgcctccctgaatggaaataattttcactttccacctgggattctattttccactgagcagtcaatgtagaccagaatgtggaagcagggataacctcagataattcacagagcttttgccagccagaccagctgaaacttaggtgactagggtcctgagaaacaactgagggcagtggccttcttgagaaagcttcatgtttgggtgagggtgttagaaatcattattgtcaacaaaaagtgaaaggtccagtctgagtgctggagggacctgccaggtggccatgctctccgcagatgtgttctggccatcaccaccctgccccaaacccatagcagttctctagagttctggagagggatagaatgaaggatcccaaggaattggagtaaaggttttgtgcctgcaggtggggctaccttaacccctcatatttataatcttaatttatagtgaccatctggagcagattcctcttgtattgttatgtacatagtctgcatcagagagttgtaaataagttcttctgtgtataataaaacaggcctgtttttgatcttccagtgagcattcctgtcctcatttctgtgctgacagttgctagcggttctg

SEQ ID NO: 17933 - DNA, 1830 bp, Mus musculus
cagctgctttgaggaagaagacctcagcagagacttttgtttctccttttggaggacggtccccagggcatcctgtgtactgagcagtcttccattgcagctccctgtagccacttggcctctgtccagccacctcccctgctccgtatcacagcatcatctctgtcctttcttgtgggatgttggtgccttgggcttctctagccagccttggccattactgtgtctctttatcttattcaggggattctcagtggcagttttcctcttaacatgaattacttacagtgtctctactccccactcccccatcttcaccttcctcacttctgcttctgagtaggtgagtgtccttcaggagagcacggtgttaaatccatgagttgagtcatgacagaacgctgttcacacctctcggcttagtcttaagagcgctggttgtgggggtgggggagatgttttatttggtttttgaggcagtcttgcatagcttgggctgaccttggactccttggatagtcaaggtaaccatgagttcctgatcctcctttccaaatgctgaggctagttttgttttctgatttatttccatggataaaaatactttgtgaactgtatttccctggttgaactgggtctctggctgcctggtgtggcaggaatccctggcagggtattcccaccagctatctccctttgctcttggccttgagctgtttgtctagctgcctcaacctcgtgagcccccttgactttcctagaccaaactgctatcgtggtgtgccttggtggcctgctccagaaatcactatggaagtgactgtgagagtggactcgtgtctaggtcaccttggggtaatctgagattctgatgagaagaaaggtcgctggagaccttagttcagaacctgcatccttttccagcctgtgtccccagctgtcccaagaatacagctgtgtcccttgcccacccatctgggcctgccttcagctccagagccaacgaaatcttgctactttgtctttaaagcctgtcttgctatatagcccaagctgatcttgaccttgtggtcctcctgcctcagccttcctaagaagctggggttatatgtgtgcagcgtgccctgcctttgaagtcccacctgcctggcactctacctggagaaaaccttgcttttcctgcagcccggagacctcgcttgcccaactactagcagggacttcgactttgcagagaatagaatcaagttgctggttagtggcagtcatagtgcctagagcttcttccctggtacccaggagttcctcaccactcccctggaagttactagcctatccttagggcctttaccagatgccttctctagttccatcttgagccacattaaacactaaatggcttcattttctgtttctttctatgtcagctataaattacttggagaggggaccaggtctctacattcagtgacaacatgaaggatattaggagctagttcttcctcctttgtgctagaccagtaaggcttttatataccttgctctatctagctaaggaccctttggtgatgtgggcagtctctcttaggaagacagtttgtgtctgctgactcctctaagttcactcaaattgggctgacatacccagggcaaactgccgggacagcagcaaccattatcattgctgctaccgtagtgtgccttgagttctttgacaacaggagatttcccacagtgggcataacacaggtgcctcggggtttacactgggcagtcaggatgaaaaagtgattttttttgataggaaaaatttaaagtttaaacattttg

SEQ ID NO: 17934 - DNA, 1830 bp, Mus musculus; identical to SEQ ID NO: 17933

SEQ ID NO: 17935 - DNA, 1830 bp, Mus musculus; identical to SEQ ID NO: 17933

SEQ ID NO: 17936 - DNA, 1851 bp, Mus musculus
agtggggttcaatcccccagctctgccagaagacaacccctcccaaaaattctgaaaatgttctaaaatgttaatcgaagtaaatgccctcataaaatggacaccaaattacctaccccctcaaggaacaagataacaatcaagaaacagcctataatcagaaatgggagagaaagtttattttaaaaccctaggataaaaatcacagattctgtcacgtttataatatcgttcagcacatttacacgcgtcttgtttttgaacactggctttccagactcctttcaggaccgttatttggatctggctttccccaagccttcccaagagctgggaaattggtagatccaggaaggagccttgacaggcaactcacccagaagcctctaggggacgcgggagtgccgcatgaagtaatgcgcatgttccacccgctccggcggaccctccctctcgtccctccccttctcgtttccaccggaagtgctccctgggagcggcggccggaaacgcgggcaggatcggttgcgtaaatacttttgaaagaccctattagcgcgcggggcgccacgtttgatctgtggacgggcttgggcgggtgcagtgccgggcagagagccacgtacgccatggagtctatgggtcggcaggaccgcaggctgcatcagcagcttaaggaaagcagtagccgcttccagacgttaatgaagcggctgatagcgaaggtaggctgggacggcggccgaggcgggcagggcgcggtgggcggggatccagcgccccggagtctgaccagctctcccttccccgcagtacaaccagccctttgaggacgacccgttggtggagatgaggacgttaacctacgagacgccccagggtacgaagccctcccttcctgttggcactgggccagaacagtgggcctagaatttgcaatgctgcatttgtcccccttgctcctagggaccttgaatccctgagttgctgatttccaatttaatttctctgaaagaaatgcctggagacacagtgcagcctggttttttaaaatgcctggcatggaagttcgagctaattgattagcggtacaagtgactctgtaaaataaggatgttgacaatcatgggtaagccgtatggttgtgtataacatcaccagagtacctgtcaggccattggaacagcacccaggactgctccgctctcatgggctttgctgtataaatgtagacccatctgttttggacagtccccattatctgccacctctgacgcattttatttaatgttgtgagtgtacttactaccttaaacctcatcggttctctaactgggataagtttgttatttgatgaggtcgtatccttccctaagacccatccctgatgtttgtctgaatttattgataaaatcggatttcggatcacagtctgccaggggtctacaagtgcagtctgtcttttgtcttattggctgttcagggcacgtgttgggtaagcattttaaataagcagaaactgaactaattctacaaagaggttgcttttctctggatgggatcaggacacagcaatataggaatccataagtgtgctgtctgactcttggcttttctgtgctcttgcggctgtttgtgaaggggtaggcagtgtctggagtattttggactgcccatctgtcttcaatgatatattctgtcagtgatatataactgatgtcagttatatgagaacagtgaagttgctgaagagtttgagactatacaagttggtataagagccctccctgaggtctggccaacacatagacacctagggctgcagttgtcggttaacaaatctatgtccta

SEQ ID NO: 17937 - DNA, 1851 bp, Mus musculus; identical to SEQ ID NO: 17936

SEQ ID NO: 17938 - DNA, 1122 bp, Mus musculus
tctaactgtgaaacacttagcttcataggttcctcggattcttctactctcctcgctctccatgtagaagtgaagaggggcagcccccaccccttcacatttcatgttgaaggtcaagctatttggccaaggaactcccttgtgacctgggaatgggcttacataaacagtgatgactgtgtctgtatagctagcatttctcaaacagctcagataagaacttccagaatggatagccagccccacccctggatcgaccgcattcaatgggtcagggttgaagcttgggagtcagctctctaacaagctcttttggataccatgctggtctggtctaggttcccagacttggctgcccagtgattactcatgaaaacaaaaactccacttctgtttgatgactgtcagcattcagtgtcccctcttcccactcctcaagacccatgtctagaaaacttgagaaggacatagaagttccttcctggcccatttgtctgactcccatgtgtctgcaatataaaaccatgatgccgtcatcactcctagatgccctttgctctagaagcccgggagagactgtaccacctaagcacgtgcagtagtctgtgtgacactttctcaggacactggaggcatcagtgctgacacattccagagaagcctgactattctccttggggcagtcacatgatggaggggagggcggggcttggaaacataatagcccagactctgttgaggttgcttgctggaggcaaccagggcattaggcctcccaagctattccaggcactgtatatcaggtactcaggatagaaggaaagtcttctgccagtgaggccccaggcagctgaggatgactaagaatgggcccacacacaaaattgtaaactttgcttaaagcagtgtttcttaacctgtgggtcatgacccctttgggggtcaaatgaccctttcacaggggtcgcctaagacaatgggaaaacacagatatttacattatgattcataactagcaaaagtatagccatgaagtagcaatgaatgcaattttatcgttgtgggtcaccataacatgaggaattatattgaagggtcttagcattctgaaggttgagaacc

SEQ ID NO: 17939 - DNA, 1236 bp, Mus musculus
tctgggttgagcgagaacccgcgaacaaagacaacgaaccaaagcgatgattcgaatttttaaaacacgatctctgtatccaaatacaggacttggagacttaagccgggtgtggaggctgcatagccacccatctcgtcacctgccccacccccccaccccagctcagaggaccttttgtctataatgcttgagctaccggtgggatagggtgggggggaccggtggggagtggacgtgaggacgcaagggtcccgtggtgtgccctctggccccaggtgggaagcttggatgtcagagagacaaaagcgatttcttcttgctccagcagggccagaagttcagactgcccagcccccactgcgggggggaatcacgtgtgagttacctgaggtatgcagttcacacagaaccctggggggggatacccgaaaggggacgggtaggcgctggagtgtactgatgggagggtggggatgaccgctcctttcattctggagctatggaaactgagtaattttatggcacagggcaggtccctgttgcgatttcatttgtcctactctgggcccaaaggaggtggtggtttgaggccatccagaggactgcctcggaccatgcggcagctggaaggcccaggatgctgtgtttctggacttggctgggaatggcctggaagacgccactttccaggggtgggtgtgtgtggttttgttgagaactgcttttcagcctgggatgagacctcttccagatggcctaggccctgtccgtgtgcaggtcattctctcgtaaagagaccaataaaacaaagaacagaaaaaccattggaggtggtggcagtacaggtgcttaaagggtgagggtctcgacattaatgctgtgtgtgtacgcgcgcgtgcgtgtgtatgtgtgtgtgtgtgtgtgcactcggtactgcataatcggcataaaaactggaccctctgggtggaatttaaaaatctctcagcctactgattggtttggaagaccacaccagctacagatgtgtgctgaattgcaaaatggttttcttaacaagggggagggggtctgataataatacacgtggtgataggtttcagacatttaaaaaaaaaaaccaacaaaaaacacttccacaaataaattatcttcaccttaggagaaaaggactttgcccttttgtggcccttggtactgcaagtgaagacatgttcagatttctgagctggg

SEQ ID NO: 17940 - DNA, 1237 bp, Mus musculus
tggtaagtatcattctaaagactaaaattccttttgtgcttaaaattcagctgagagcaacagctctcaaaggtgttctccagctactctctaaaccagctcccgacaggaggccggagactagcctcagctttacaatttgcatttaaataaagtacctagacttcccggaaagaagttctgctttcctactttctcactgtctttcaagattttgtctttcaagcaggtaaatcaacattcccgaggcagaccagtagatgtgcatccccgcccccctagagcacacaggtggcagctgttacccccagtctcaggacatttccagcatgtggctttcagtctgagttaaaaatttaggtttacctagagggctagaagagtagatttttctatattaataaagattggtttttattttaatagacaggcttagccccttagctgacctctggcttttcacccttgctgttactgcaaggtgtccttagctcaataggctgtaaaaaaaacagggatgaagagaaacgacttccagctcctattttacccacaaatcgtggtgttattaacgacataattcttgcttaggctttgctaattctgaggttgatagttctcctttaggagctgcacagcactcaaaactgtgcatactggtttgtgattgtacaaattcaatatgggcaccgcttggtgcagagatacttactgcaaggaaaggtccggcttgaccatttctgagtttcctgtgagataaacccggtttaaaagaggttggtaccaaattttggttaaaaataaaaaatattctccggctctacctcgcctccccaaaaggtaccaagagccacatgtgtgggttttacccacgggaagaatcgggtccatgtccacccaagccaaggttaaaagcccactcatctacggataaaaaaatcatttgatcacctcagttaagcgttgccttatttaacttaattaataggggggagagagattggagacgtactattgaaagggcaagcccttcactgcctcccacccaaataaaaaagccaattggccttgtactacaagagccggtcactccttctccctgtttcccacctatcttccaaaaatgcgaaggaattcaacttagtgttattttcacatcgttcagtcaaacttagccagagttccaacgccctacttaaaattcaactaaaaagttacctaccaagtactaattagc

SEQ ID NO: 17941 - DNA, 1258 bp, Mus musculus
cagagtggcttgtggcctttcttttgttttgcaaacagtgcctaaaaaagatttttccctgtgttcaagaaaaattctttttaacagtgttgcagatctattcagatgtttaaaataatgcttaaattcaaagagttttgcttctagtgaactgtaatcactaaaaaattttgcctctaggtatggctaatgtaactttacattatgtaaaaaaaattttattgtttctgcttctatacaagaagtcaagagttttaatctttcagtgtatattgtttcctaagtaaaaagtattttattaactaatgcttcttaaagtttaccttaaatccttgctctcacccaaaagattcagagacaatatccttttattacttagggttttagtttactacaaaagtttctacaaaaaataaagcttttataattgttattaattggtaattaaaaattggttgtgcccaaaacaattctttggccaaaaagaaaacattattgtaaagtcatttttctcatcctcccagccaatcgttggcccatgtgggcccaactagcttctgtggggcggagtcttaagacacagtttcccctgttccagcacagatgatctagttgtgtgctgtagatggtgttttaaaatgctgaactatcaaaccttaatttgtatattaatagtcaatgccatatctctgagctcacaattgcttaaattgttcatccctcaaatactattaattctcaaatttacaattgcttatgcatatttctagttaataaataaattatgcacatgtgactcttaataactttacaagccttctagttacaactgctccttaaaaaaattgattaaaagtgcaattagtcactgaccctttacagccaagtatttaaaatgttttgtcaactagttattaattcaaaagtttaggtattgtaaaattttaaaactttaacttcttaaaagacaaaaaagagagaaattgtatccccgtgcatgctatttagtgcattcccatgcacactattaaagtcttacctttattttcaaaatctaatattttaatgtcaaagagtttaataaatgctttatagtatcttaaagggatctacttattggcttatagattaatcctaaaacagctaccttattaaaaaagggaaaaacaggttttctccacagaacgctgcagaagcatattagtaaattcgtgtgacgagctggtaggtaagttgactcatgtcctgattaaattga

SEQ ID NO: 17942 - DNA, 1207 bp, Mus musculus
ggcaaaatacctgacaaaaccaaacaagtttattgtgccctcagttgaagggtgcagtctattgcagcaggaagagcggtgccactgtggtggcaggagagtgaggtggctgtcacgttacactagtcaggaagcagagagagatgaatgccggccctcagctggctttcccctttttacgcaggctaggatcccagcctgtgggatgaggacacgtgattacgtgtgtcttctcaccgcagttaacccactttggaagttccctacacatgtgcccagaggtcatctcataggtgctttaggtcctgtcaagttgacggtccaggtcaaaagtaactgttcctgttgttttaaagctttgctgtgtggcttctggaagcctgcttgcccgccttggtcagcgatcgatgggaggtcctgagctgctgcgagctagtccctaagtctgctctgaaaagtcagtggccggttcagaacgaggggattgacagaacctcagactcgctcacttttgggagccccttgttttgacatatgacaaggaggcccaagtaacaggaagggaggtttttgcatattaatgaaagtagaccagacatgggtggcaggggctcagctgcatcttgggcttctcattccactgtcaggcatgtgggtacccggtctcggctcagggcatgttctcaggtgagccatttgcctgcttgtgtccttgtttctgtcatgtacaggctggaaggcaagtagtgtcttctggttttctccttccctctgcacacagcagccaggccaacacagtttagagagtggggggttgggggatgggtgaggtgggtgggttcacctgagtgcactgaggatggtgggtgggctggttgttgcctccctgcctagagctcatcctcttcagcattggctttgaagaccaagagagcagagaaagccgcactctcctatccctgacttaggcatcagtttcacttctaggattgctgggtgactcttctctccatggttgaatgatgcactgctgtgcatagctgtttgtatattcacagtcctgaagtgagcagccctgtcctttgggtgggactggagtttatacccccttggactctgcctggcatggcatggaccttgtgggcatttggggcatgtggtcaacctggagtcccctcaccctctttgccctgccccagggttgagt

SEQ ID NO: 17943 - DNA, 1149 bp, Mus musculus
ggtgtccctgcggtgtgcttaggcctttgggtagattcccaggtacgggtgggtcatgtgatcttgccaattgttttaaattgaagccaggtttttggttgactcattctcatcagccaccagtagatggagggagtgagacatgcaaacagagtgctgtccccactgcccggagtctgtgacatccatccctaaagatgtgtgttcatattgttccgtgtggatgtgcccgagtgtgtgtagctgaaagaacccaacggaattagctgttggtagtaatatgaagcgggaaaagccatttatgaaaagtttagtcatctttgaaaattaaggaaagtgtatacgtttgtttggtttgcaaacactcatttttttggtaagtcagcagcagccagagtggactgtagaaatacggtggagaaccacggggttggtggtgtactgctaagtacagttgtacatcgagggtgggcacccctcctcacctggtagtggtctccaaagtggttggacagtgcttgggcacacagtggaatactgcagtcctgaggggacatcatactttcaggggtcactgtcttaatctgatttcacgttagtgacatggcaagctggccatgaatgctgagaatccaactctgcctgaggtgactagacaactccaaggtcagggtgccagccaggacacctggggctgcagaccctttcctgtgttcctctgtgttctcagctgatacatgcttacacctgggtgggaggagctaggcaagcgcaggaggttaaacttcttggagtccttggagagggtctgtggctcagaccagagccctctgggccttcaggatccatgtgctgagtcccggagacctccttccaggctgaattgtgcccagcagatatgagacacctagaattgtgtctctgatggactccaggcaatgcttgttggtccgggtgggtgcagaaggagctggggttcccactggtgtacttgccaggctggtagaagtagatgctagtgtttctgatgagttttgaatggcagggttctacagagaaggcaccttggagaacatattccctcctttcttattccttagtcctagagaagagatggatggtgactgtcaactgagactctggactggg

SEQ ID NO: 17944 - DNA, 1120 bp, Mus musculus
gcttggctttgtgtatctggctggccgagggggcgggagcttggctgcctctgtgagtgtccagtgtaggccaatgagctcatttttcctggagcaggttaaacaatgtgattactctgggtcctcgtatgggtcagctgacgcccggctgctgtgtttcacctgcagatgtgatgcttgaagccggcgtggatgtttctggatgcttgcagggggcacctgcgggtaccacagccagttgctttggagtgtgttgagggccccttggagatgcttgcttctagtcagcaaggtcgtacaaactgagtgtgttactctgtgtgtgtgtgtagacgcacagcctgagcaagtgtgcatctgtgtgtatgtgtgcatctgtgtgtatgcggtgccccggctgtgtgtgtgtgtgtgtgtgtgtgtgtgtgtgtgtgtatgtgagaatgtgtgtgtgtatctgcatgagtgtgcctatatgtgtacttcctcttcacttagtcctacccaagaacaaccagaggacagagcagatgatgtccaggaaggctggagacatgtccttatgcggtgtcccatacaggggaaggacaaggatgtgatccccgctagcaaactgtagtgtacttcaggaaggtgtgtttgaacacctaggcacaaggacatgaagagtggaatggaaaatgctgcagagttgagcgggtctcaactcgtgcaactcagacatgaccccaaaataaagtcaggaaaagcctccagaatagatgtcacagagtggccacacacaacggtggcatcattaccttggggagggtggggcctcctgtgggcatgaccctgccagctcctgcaggtttcttcctggacccttttgtgtgctcactctctcaggacttggtgtgcttcacacttcctgagttacggctgcagggtgagccgtgctcagctcgggggcctggtaggatgttgacccgtgctcctgtgtagctcactggggaatgagtgtcagtgaggttaataggtagtcttacctggcaaactaaagatgctgtggggtgctaactgtagctgctgtggtgcccagtttaccagcctccacatgaatggcttccccctcacaaat

SEQ ID NO: 17945 - DNA, 1122 bp, Mus musculus
gggatcggagatgttactcctggttttgtgcgaatcagaaaattcggagtttgaagttgagttatctggacaccttagagcaatctccttccctgggacaggtggacactgttgcaagtgtgctgagtgatgtaataaaaatgaagtctgtcctcctggagttcagagaaggcagcatgggtaggatctggtgagggctcggatttctagatgtcatcttgctgtgtctgtatgtgggaggaaggcgagaggaagagagagagagagagagagagagagagagagagagagagagggaggagagggcgctagcgccagggagtgtgctcttagcaccttggtgtctgtcataaaaacactaatcttgttgtggggggcggcatctttatggcttcatctaatcccaatagccttcgaaaagccctccttaaactactatgtattggggttttagatcactctagccagagcatgcaaccttcccccatttttttttctgagtagtttttttttttttaaggcagtgggcttccttgaagtctctatgttgctggagctgagtctaggtagagaggagcgacacacagtagggctgctgatatcctctgaaggcctcacctctgtggagcccttcctccccttgttctccttctggtcctttcatctgactcccacaggagtcttcctctctcctggaccttgtagcctccctggatattggctttcttctaggcttggaaccgtgatcggccacagttcctgggtgaagattctatcatttgacctcagcctcacttgttattttgccacttgctgtgtcccacacccggctcctggcacctcactgttacccagacgcctttccaggctgatgctccagagtaagagcccctgtgacccacataacactccggaggcaagaaattcaccctttcagatggtgagccttgtgaagtcagggtgagcggtggacagtatttctgggtcacatcatccgaagcattgtcataatgaatgggcactcaggagtagtcctcctgaagctggctgcatagccactctgccacctgggtggctctcatccccttcaggctgtgatttacaatgcctgcacatttagcc

SEQ ID NO: 17946 - DNA, 1206 bp, Mus musculus
aagcgcgcgtcccggcggtcggcggcgctggatgcagcccggcctcggagggcggcgcggcggccgcggcccctggggacatgtacctgctggacagcagcggcgaacccgcgtcttcgcccgcagacgcgatgtcgcgcgggacgccccccaggaagaccgtctaccgcatctcggtgaccatggtcaggaaggagcagctggccgctccggctccgcgtcctactcggcggccccggcccgcgcgctccccggaggcgcccgggcggctggaggaggaggccgaggaggcggcggctgaggatcctgagatcgggccgcgcgcctgggacttccgcgcctttcgcacacgcagcaccgggcagctggagctcgggcggctgcggccgtgctcacgcagcgcggagcccgcggacctgatgggcagccccacggctgaggcgcccagcagtcctgacggtgaggaggctcgggccgcgcccctgcggcggagcctcagctttaggcactggagcgagcccgaggcgccgcggagccctgcgttgagcggcgggaggcgccacagcagctctggaagtctggcttgggcgccggacgacgaagtcgaggcggacgtggtcccggagccggtggccggagcgcagccggcggcggagaagcgcaacaccttggacgtaggcgaggtgctcagcaagaacgatgcactctcagacctggagcgctgggagcgcagcaagagcaagaaccgcacgctggacaacagcgacctgcagcggctggagcgcgcgcgggccgcggctgccggccctggggccgcctcggagcaccggctgctgcgtttcttcagtggcatcttcgcgcgcagggacggcgggccctcaccccgcagcggcgccctgcgctctcgcggttacttcagcctgcggcgggccccggccgacacgcactcgtccagcgccgagagcatcgaggggtccccgcgcagaggtgggcagggcagcccagccggggactcctgggcaggagcggtgggggctgggtctgcgctccagccgactgcggtgtgagcactttgaggcccgggaacagagcgggcacctgcttttcccggtgtccagctggccagtggtcgcgagggtgtgaactagcctgctgctcagtacagcagcctgggtactactgaatgctgtctctccgttttatatg

SEQ ID NO: 17947 - DNA, 1234 bp, Mus musculus
aagaagcaagggacatgtacagccctgggcttctgatgatcatggcttgcacagcttcccagtgcagaggagaggaaatgcatgggttttcagattgggacgacacggttgtaaacatgagatgttacaaatagggcttttgccttctgtaagcatctcatgtttgaagataatttctagtatttcccctggaattgctaactattttttcaggggtttccgtgaatctggttctccaccaagacccatcatcacgtgcatgctgggattcggggtttaggctgaaggtctgacacaggagacaaggactggcagggcacctccaaggtgatggctgtatatacttggtatttctctgcatatttctgcactctaatgagtatttttcctaatacttgtactaataatttttaatggctcacaatgactaggtgacattttgatacattaatgaaccttatcaatgacttttgaaagttcttcatgtgtgaggtactttgtcatatattactttgccgtacatggttcctgaagggaggagaggggacatggacatggactccagcctacatgtgctctgaaatatacatggcaagtatcgtcctgaattatgtcttgtgccctaagctctacttcaaggtttatcacaaaggtttatctgctgatggaagcttctcatggtccaggaaggtaagcccggcaggtttctatgtggcagtgaactttctagagggcttactgagactgctaaacaacctgctgaaatggtgcttttgtacagaaaggtggtctgatagaattattacagatccttggaaggaggaagaatgttggtagtgatcttgacctttagattcctgtgatgggtatttgctagttgttctcaggtttctgggaaatgggtgtttcttgggcactggcagcgactgagttcccagaacagcaaagtagctgacctgtgttgctgacatgttccagggccatgccatgccagccccacccccgtcccccacccccacccttacctccacccccaccccaaccacggtatgcagaccttgaggtcaggaatccagtagtaatcctcctgtcactggtctatccagagctcccagagcagaccccaggcttaacctaggacgggggagtctgtcctcatagccatctttaagaagtgaagattgactgcactctcagagccacagagcttgggattggcagtgctgtagcccta

SEQ ID NO: 17948 - DNA, 1193 bp, Mus musculus
cttatcctgccctccgagaaactgttgtcctgatctaacactcacatggaagccggcgaaactcttcattccacacagtcctaaaatgttagtttgctttgtggtacctattttgttcatactgtagttaaatttcaatttaaaaatcaaaaaaaaaatgattggaagttaaattgtttaatgtgtggggaaaaaaaacattgaaatgagctagtaaaagtttaattttatgcacctgaccatttgggttcaaacgaaacatatagatgtgtttaatgccatctgtgaattagatatgttggctcttcttctagaatctagaacagttagacaccgtgtgtgatgtgattgtcttcatgcacccagcagggaatgagtgactgctctgtgggcagtggacagttctgactgctgtctgccctcaactccaggctctagctttctactctgccaagcactgactatgccagaaatgcattcccctgagtgcttagagatgggtgggggtcctcctcctcacaaatagggcagctgcactaccattgctcaagtcaggactcctccccgaggctgtggcgatgtggtgtgatgctggggcaccttgacagctgactgtggagtctctgaactttcagacaagcttgagagctggaggcttacttgtgccttaggtaaaattatcccaggaaagttgtttgctttgtttcattttgggttggttttttttttgggggggggggtctggttaaattcaataaatatcaccaaacagggagtggggaaggacgaaagagaaagaatgaataaaggatcaggagtatcatggcaggtgggccctgttgggacccgctgaggacattggctccaggaggtcacagcatggctggttttcaggagagaggcgtaaggggacaaaaccgcctaagctaaggccctgcctacagcacacgtgtccagcaatgttgccacctacagggctggactctcctcagaacaagaagcaaagatgggtttattctgggaagctcttaagcccagagtagctgatgtcagaaggattcgtgtagtctgtgtttgtgtttgaccacattctgtcagttcatcatccagggaaagctgaagttggcagcagggtgattcaaaaaggccaacccagaacaagccaagggctgccttggttcccagccttagag

SEQ ID NO: 17949 - DNA, 1117 bp, Mus musculus
gaatgctgagtcagttttagggttttttttttttaatgcatatgagtaaactaccattgctcccttcaaacacagcagaagagggcaccagaccttatgtgagccaccatgtggttgctgggaattgaactcgggacctctggaagagcagtcagtgctcttaactgctgagccatctctccagccccagttttagttttttaagatgagcccatcccctggtgttgaccacccttcccaggcctcagtttcccccacagaaactttctccccacctcagaggccccaggctccgggtctcttctcaatttctcccagactctagacaaccttactgtcccggaaaggcagtgtagtactagatagggcaggggctgggggcagggaccaagatcacccaggaagtgaccatggctcctacggtgcccttggggtacagactcccagacctagtagctggtctgcaccattgacgaccccaggatatggtccagccggctgcctttgtgaagtgccagccctgaggaggagggttcctttaggggcttgtatggttcctggccaggacaatggctgtccatcggggctaagggatcagtgtgtcccttaggtcccgtagggtggggcagagtgtgagctagtgcaaccctgagcagagccgctcttcctccctcgctgccccagccttgctgactgcatttttaaagccaaccctaatcatcatctactccttttttccccctttttcttcccctgcctagaaacaggctctgacagtccgaatgttggaaataattggattctaaattctaattcatctgtaaagtattcggtgattaaattagcctaatagatattatttcgtacatgactgcataattttaccctgattggatctccatggcacaatggtgtccccccaatttactattgactcgagagcctcagaaggcaagacatagccctctctctgcttctgcagcctgttttcccaggctaaaagttaaagtgatttatgcctaaaagccagcgtcctcctgctcaggggcaggggcactgtgcatgtcattcttcaggaagagcagagaaagaagtgttaccagacgtcatcctcagc

SEQ ID NO: 17950 - DNA, 2231 bp, Mus musculus
gacccctgttccagtggcctggagacggggcagggggaggggtagcaaggagaaggggcagcgtcccctagctggcagttaagcacatcagtacatttcacctcgaccaaaaggaggcttagatttcacgtcttctcgggggagcttgacggcataaatcagaagcaagcacagtttgtcaggtctgaagcccctatgatggtaggtgtcaaatcagttgtagctaatctgtccagggagagtaccagcttcattacacttgtatagtcgagttcctccagcattaccgctgtttaatagaacgtgattagtcatcaccgggaagaaggcatattagccgaggaggtagttacacggcacgctccggtgattgccacgatatgattgcagtgcgcctagcagcatcatattatcctagacgtgtctctccagcccttggagccctcctttctaaattcactgtcataatttagtatctgtttaatttttcagtccaaagagaggaaatcagttgctgggtattatttgacttcagtccccttacttggtgcaaaaacaaaatggaaaataaataaataagtaaataaagagtcacttggaaattctaaacgaaatcatgaattcggctgaaaacagctttcaaatatgttccaaaactaaatacataaaagacttttttttttctaagagatttttctgtactttggccacaacggatgtgtcaggcctcagtccacaaggtctggattacccaggtttctgtcgtagataagatgtgtgaaaatctatttgaataaaagaagttcataaatatgcattgatttttgcacagacaaatggcacccatgttaatttataaattgagctggatgggaactaataacgtgcaactggttgagctcagagggttacagatcattgtccgtgggaagtactcccagcagcgaacacttccattaatgtgataaacagctttttaaaaggtgcgtatcagaataagtcggtggcacaatttgcttattaaagtcaggacaggaagcagggaggggaaagagggtatgagccctcatcccagagcccagttttagagccgagaccatcttcccagtcaaaccgaggggctgtggcaagaaggggtgatttctcaaaacaccagacccacaaaggtaccctgtgagcagctgctagcggctctggcacagccggctcctgagtctgtagactccgcacagcacggcccgtctggctctaacatccgatttgccatcgtaggtcacagggctcatcagataccggacaccttcagcacggtgatcagacaggaacaccaaaccgtgacactatttagttcttaaaaaaataaattggggcagccttgccagagagccccccgcctggtgacagtgtggcagggagaagtccatcacactggaagacaggacgctgggcagagccaccaccggcagcctgtggagacactccctacgcttatatattgaactttatattttgtaagagtttttcctcctctttaactttttaaaaaaagaaaacaaaaaacaaatgtaaagtagatgggaaggaaagtgaagcttcacacagcctttatatgtggtgcgcgtcttgtggggatctccagtctgggcacagccggaactgaccgggatccagaaatgtcacagatgcgcaagccgcgggtctgaggcccctgaactcagtccataagccctgcgtttggtttctcttcctgctctccatcactgtgttgttactttaaatgtgaatagagaaaacaagctgtcattgcctatttttgaagaatgcgttagcatccgaccccgcgatccgcatacgcctccacgtagcctttaccatagacttctatagagaacacagatagagtataaatgagattcttaaattatttcagtgtagctaatccccactaggaatgcttctgtcgtaggggagcctacttcagaaaggaagcagagtcctttgtgaggtctctcttcggggtgtatatgagtgtgtacatattattgtgtgtttatatgatattttcccgaatgattccttgtttcacatcatcctccgctgcctgaatgcgcagttgctcgctctggttccctccctccctccctgacaccatcagttcttcctcggaacacatggccccctcccctgccagtttttgccgtgctgaactgtccaagagtagcccacttttc

SEQ ID NO: 17951 - DNA, 1592 bp, Mus musculus
ctcagtgtgccaccttctctttccattgtctcttagattctaaatggccctactcctgccaggccctggctagcagcacaccaagatgtgtgcctgggacataacaggaccaagtcatatccggtctaagagaaccacatgacccaactctttgtatctggcctgttttgggcccttctctttaaagcagctgagatgaatggggttttagccaaaatgtcacattcctccttgagaggtgagaaagggaaggggagaggccaggctactctgctggtgccacccagcagtcgaccatagaccatgggcttttagtcccacccctggaagcaagaagcagggacagttgattagagattccagtgcctggagtcggggctcatctctcacttcatggggaaagataccatctggggcctcagtgtttgaagaggcacagactccttctgctcagaagtcctgccctgacagggctctttcagatgctgagaccccacttagtttctggacctgctgttctttggaccctgggtcagagttgcagtgagagaaggtttcatcatggataattctagacagccaacaaggctctgtgtccttaggttttagcagatctgggtcaggcctgcttaagtgccataagcctggtggctccctgcccaaggcagtgcacactgaggatccagggagaagctgacctcccgcccctcgtctcaagaggccaagtttcctatagaagaacagtatttagtttgagtttgctcctgtctggtcagagcatcttaactgaggccttcctcttccatagtgagcctcaggtgggtgtggatacccagcactggcagctactcgagggtccaagcaagggcctcagggagcaagtgagcgagagagagagagagagagagagagagagagagagagagagaggaaggagagaggagagaggtcagctcagggcttgtctttattttgctgggcacgtggcatcttttggggacccccccaggggtcgggaatcaagccataagatagactctcctgccaaagggaggactgatctggaattctgtgtgcagggaatgacatggcctttgtcttgttgcgggtgaaatgaaggaaccgagaggtatgagtgggtgaggggggatgggattaagtcctgaggagagccccttaatacactgttgctgggaacagccgctctaggatcacattgtcccccagtgtctgggttcaggcctgggtccacactagcccacatgttagtgtgggtattagagatggctctcaaatgcttgcaggaagaaaagcatagcctcctgcgtggctcaggtggactcactgagggcatgcaccaaaacagaatttgtaaacagccctttgttcacagctgatgtgctcagaagatgctcggccccccaggctcacccagatggctagggacgggaccaagggtgctgtgagttgggggtccagcccacgtgtagcttctagttcctgctcttgcatgcacacacgcacattgttcacccaccaaccaagtcctgcagtttccttaccagggtagtcgagtagagagacctggctat

SEQ ID NO: 17952 - DNA, 1106 bp, Mus musculus
tttttttttttctaaaatgcaccaccttctaagatgagaactggtgctccagccctgagccctgaggactgaaagagtgttgagtcccaggaaggcacagaaggtggctggcccgttacaacagcctgagggtagaccctcttctttccttcccccagttccaccttgagtcttcttgccacagggccttctttgcaaaaaaaataaaataaaaaaaaaatgaaaccccagacaaggcagggcaccgctggcacttttctgggtaggggcgaggaaggccatctcgcctgcctggccacacatagaaggcagaagcccagtgagggcttctccagaggtgggtcgccaattgggcattttgatattacctcattccatgattttacgtttcccgatgactgatgctttatttatgctgtttgtcctgtaactaaaccacccacagacatttcgctttgcttgttcgttcatacgaccttgttcgggtttaaatatgctggtttgtattttcctgccttgggattttgtgtcagctgtacagtattctaaggggaaaaggagacagagaagcgtgtaaagtaacggagagaggtgcctataatggagagacctctttctaataaagaaaagaaaatatgtatacagtgcttctgtggagtgtcttcttgctacccatttgtcacaattaattggcttcctgctcccagaagaggtaaatcagagaagaggggcttcagtgactgcccaagggagacttgtcctagacacaggccacccttatttgaaggccctagtccctcagcctgcagccagagacccaggaaatagaacctcagaagctgggcaggcggctcccccataactcaatcacaggaacagaaaggccctaataagggtgagtttggcagttcccaaagctctgtggggggaggggaggctcagtattgccccacccaccttccccacaagagtgatagcaatgccatggactgctggggaagcatcactcccagttcagaaaaggtaagagctcccaccccggacatacccacacacactcccatccaggacacacacacccggacacacccacacagacactccca

SEQ ID NO: 17953 - DNA, 1199 bp, Mus musculus
accccaagattgtcgtccccatccctgttcacgttagcaggttcgctattcgaagtcaacaccagcagctggagcaggcccgaccctgagggcccagccagggtggacaccaccatggagaggccctaacacctgaaggaacccgtgtcagactccactgtttaaagcagaactcagaggcacctcctagatgtggacatccaagcaaattgagagtatattcattagacgggcttaaagggggctacagccacaccagaagatacactaaatatttattatacaaccctactttgtacatagatctctatctagactggatctcagctgcagtgttttgaaagggataggatcaaatctctctccttacactttccagatgaaacaaaaccaccactgtactctgtcgccttcagcgaccaccttcccatacgtgcccaaaggtaaacaggagacacaaggacaaacactgcggtttaaccttcttattgttattttttgtttgtttgtttctattttggctttttgagttgagtgcagagcagtcggttgattttggagcaatctagaactctgctctgctcgtttgctttgcctggctgtctttcctggccttgtatatcctatctgagccatgtcggaagcacgtctccgttgtgtttaatttatttcaatgtagcttattttcatataagttatgacatttaaacaatctcagtcttgtgaataataaaaaaaaaggcaaggaaaaactataagcttaatccttggggcctcgttagagtgcccaccacctgggcacctcgagggcactaccaatgtgtggtcagctaagtgacttgcgaccaggatggaggcttactggccataagccaagtagcacctgaacaggcttttaattggagaggaaaactgtgagtttaaggaagcctagttttcatcttaggaatcttgcatgtcctctttttgcatgtctttatctattatagcctggggactggcaaactttggccggaagaggagggaaagcaagctcgggtagtagtgggtttgtacagacacaggggctccaaatccgatgcagccagggaagaaacgcgtttccttagaagaaactccgaccctaaaagcagcggtctttgctggctctcagggcctcggatccataaatcaggctacaggcgttatcttccgacagg

SEQ ID NO: 17954 - DNA, 1149 bp, Mus musculus
aaagtacattttcctgatccaaacaagcttcattgctttcagctgactgtaagcccaggtaataaatactgcatacttcagtgttcatgtagcttccaagcagcaagtgtaaagatctgctcaaatctgtctttctgtggatgtgtcctgtggtctgttagcactctcccattccctcggatgatgtggcctatgtcttgcagccagataaagtacagcaggtgtgaggcacgcagtgtccaggtgactgaaagccaagcagccaacaccaaggaaaactgatggcaacctgctctgagtgtgggctttgaagtgggttttggtaatactccagtggagcttgactgaggtgtgattgcttagttgcaggaggagagtcatgaatcctgtcttagacaatgtcaggatctaatgggtttttgtatgcacaccacttgggccccgggtttagcagattaccagctgtcctccttaggactatatcaagtgcctagtctacaggggcagcagcatctatccttggtcagacttttcaaatgaaggtgctattaaaggagttactgatcatcaacccatgtctgccttcagtggccaaccattggtagccagttcatgctacttcaggataggtggagtaggaagagtaaggaaatcagttctcaaggtttctcaacaaaaacccagctcattgatgtttgtaaagggtgctagagtgagagggcatcccttttacactttgtatctgaagggactgctgtttcacatgctacactttgtatctgaagtgaaaatcttaaagtagccagaggaaaatattaaagtattcaaaagatgttaccagtacttcaaagatgtgaaaattattcaaaggattatgatgcagagaaaagggagagggatggtttgtgttcaggtcatgctgacaaggtaatgtgacacttgttaaggctggagtagtctgatctttggggttcatgagtatgtgtccagagttgttctggggcagttagtccacagatgtttcagatgttatttggcaacgctaaagttcatattgttacttaagatgcacagaaaaagaagaaaacaaacaggacagtttccttgcaaaaatagagggtgttgtcctatttggggtttggggataag

SEQ ID NO: 17955 - DNA, 1163 bp, Mus musculus
agtagaagccttgcgattgagcccactgggtagaggttagtggctactattggctcagccatgggaaaagttaatcctaaaggctatgctggccctgcccaaattggcaagatggctgaataggtgaatgtacaagaaagcctgatgaccctctggggctcaggatgggaggatgaaacagtctctcccaagatgtcacctggctgccacgtgtgtgctgtggtgcagatgcaagcatgtgttcaaacacaaggtgtaatttttaaaaagctacacccagaataaagcttctaaatgcttgttgtaataaaataccaattctgtgccacaacaagccaccaagcttgcagtcttctgtcccaaggtaccaggatgcctacaaaaccatcttgtaaaaggaactgccatcatagacagcaatctccagctctggccatgcagacacaggtttcctgggagggaaagaagggaggagcccttcagagtgactgctcagccaggtttatttcaggcttcctgccgcagaccctctgggtccctttgtctgcgtggaacgggtctctggggcagatggacaaggagtcggcaggtgacagacagaccaacacgcaagattgtatagaatctgaatgtattctcacaaaatgaacaccagtcttatgtagtacagaaaatacaaggggttggaagtcacagaaggcaaggtacattgaagttacctgatacaaaacaaaggaatgactacaaagggacttacaggaaccaggtagatgtttacagtaaagataacgcagtcctgcctagggtcagcttagagacaggtaaggatttcacactctagtgctatacctttgaaccttgtgaaggctagcaccagggggttctgctcttggcaggcctcatgaataatgcaatatcacaacccaacacccccccccatttcctaggccttgctaaattcttatatgagtgtaacttttaagtaactgaagaatttccatttgtcagaagaatttaccaacttgcttctaatatgcaatgtagcctgtactgaaaagttctatctcagtgggattcccttgctctttcatggtattccctagtttgggtgagatttgctactgtcctaggtaaatattttgcagaccagctctgagctactg

SEQ ID NO: 17956 - DNA, 1241 bp, Mus musculus
gactgagattacacatatgtgtgccattattctttttatttttagggtagtgagtggaaccagggctttccttaacgttaggcagccagccactcctcactgagctctcaggtcacctttgttcaggagcttgtggctgagacccttgttttttccctgtatcttaggttcattttgctggcttgcgacgggcttttcaaggtctttaccccagaagaagctgtgaacttcatcttgtcctgccttgaggtgagacatcttagagggtgtgccacttgtctcagctgctttgtttccattgccccgcaacccctgtgtcaggagtaatctgtgaactccgtcaacataagccctgttatggagctcaccaggcactgtcctgccagtctttgttagggacagagcaggccctgccctggtgtagtgtcttaaaagaatgacagaggctggtgccctgttcactcagatcccatccctttggtaggatgacaagatccagacccgggaagggaagcctgctgttgatgcccgctatgaagctgcatgcaacaggctggccaacaaggcagtgcagcggggctcagcagacaacgtgacggtgatggtggtgaggataggacactgaggccagcacactggcgtgtgctcttgacttgcaggttcattttgtttgtgcacgctgtgtgtactcctgtgggacttccatggttgtaaataaaggtttctttttttcctagttatttgagtgactggtcctgagttaactgtgtttgctctagaatgtgctctggatctgtccttgtcagaaccaccatgggcctcttggacaagctcatgatgacctgttagtagttcacaggctcttgctgtcattgtgaccctttggggaagtggggccttgcagtaagatgacaggataatagggctctgttcagttttctatacagagcacatttctggcaggagcccaggtgtggctgaaatggggtccataggtgaatttaccacataccatgccgtctcaccaggttcctagacaacttcattcatctcgttcctgtttccctgaagtgagccctgagaggatgactgtcgtcctggcttacacccagctgtcaatctcaggagtgcttggttcgctgcctgagtggatggtctagcccatggcagggaacctctgggcatgattggcccccgaagaactttctaacctgtctccaaatttaccttctgtgtaggaa

SEQ ID NO: 17957 - DNA, 1716 bp, Mus musculus
ctaggagaaatagctatagacttccctttttgtactgatggagagaaatgactgaaaactttcacgtctacgaataatcgcctcagtgagagcagtggcactaatgtggcaatgctgctagacatggccaaaggcattgctttcgcttctagaagtgttccagctctgtagagaacttaactaggcagcctctgagtgcgacaccattctgtgctacagcagactcctgccctttaactgctcagttggagggaagtgcctgttaccacggttggcagcctagagcacgcagatgcatactctcagggtctccagcagcatagttggcaactctactgattgggagtttttagaaatgggagtttttgggtcctcattaaattgtcaccagattaaatttctccttggggatcactttctcctgacccttagtcccacatccccattagtgtgaggcagcgcttctttgactctgatctccttaggtgcagctcacatgtctgtcacagctccaggctttgtggcagaaccctgaattgtggccacaaggaaatgccttgagggaatattgcttatttgtaccactgtgatgttgctgagctaggctgccgtagtacctcttatttgctctgggactagggcttctagagggtaaggcacagttttgtattggctttttgttttctttccccagcctcttcggtgatctttggtctgaaaggctatgtggcagagcggaagggtgagagggaggagatgcaggatgcccatgtcatcctgaacgatatcactcaggagtgtaatcctccatcatctctcatgtgagtgtttacagtccagcaagcctggctggtgctcatttctcctctgttctaagttttggactgtgtgaagatgtttctccaagaaagactgacgccatgagtaacctgccttttgcatcagtggatcttagatgggagaatatttttaagatagttgttaccatctgaggatatttttggagtaggccgtggctattggtatttggtgggtagagaaaagaatattacattgctaaacaagggactgcccctcagcaaagatctgcccaacctagatttcctcagtgttgcatctgagtgccgctgagtgagaactgtctcccctgctatggacttcaggcagttgtactctcacggggactgatcagcttcgggctgagtgctattactctgtgtcctagagagtggatgaattgaaagtcaccgagtaaactctgcaggaagtgtgggtgtggtggtacatgattgtcgtcctgtcctgagttcccagcactcagtggatgttgagttcctggaaagtcttagaactaccaaaaaggctttgcctccaaattaaacccagcggagtcttatggcattgggagaggctgtacagctagataatcagggcccagaaagaccaaagtagtcaaaatggcctggaagaaagaaagcggtgcacacatggaactgaagcctttgataagtgctcttactgatcaaaggaatgcaaagaagtttgaaagaaaagttcatcttaaccctaaatgtcatttctcattaatagttttctttctgatgtagttttaagttaaaattattgtgtgcatttatgatgcaggtggaactgtgctgtgtagttttgtcagtggataactttgtggggttggttttctccgtccaccattacacg

SEQ ID NO: 17958 - DNA, 1127 bp, Mus musculus
agagtgatgggtgtactgttatagctgcagactgtttattccgtctaactgacagcctctttgctgtgtggggactggggagaggctgcaggtggttctatttttttgaggttaaaagttcgatttgttgccaaatagaatatttactacttttctaaatagtttttttttaatccctgtgaaatcagtaggattgcttttaaaaagaacatttaattgtcttttatgagaatcccaaagttttcaggactagggactcgtatgaaaaactgcagcatgcttctaccagtcagccttgaaaactttcctaatagagtcagtgctcttaattatatgagggtaatatgcaaatcaagtgtttttgtagagttaactttaaaataattcagtctgtattggtactcattagaagacttaacacagcgtgtataatctggtactcagtattttggatttcttggaaaactgattcttctcaagagggcagatagtctgtgggagttgaccatgtgctagtctgtaagacaaggcctagtggagagtctttaacatatagaccgtgtcctgtggtgcagtggaactcacctagaggctgttaatagcagtgtacttctctattttgcaattagaaaggattcagaaaggaaaactggagcccaaacagtaagcagcgtgatgctgatggaaagacactgaggagacttaaaatgtccatgacattttctcattaagttgctcttttttatgcagtgtgtcatgcattttgtaataccattgtggatatgctcttttgcaaggagatgaatcttagcacagagctttttcttctttttcctaagaagtaggttgaatgaatggctacagagagcatttagggacatttggtgtaactggcaccacagtggctggtttatttcttgtccctatcgatgttcacacagtctggagggcattctctcaccatgttatgaagaaactgtggctggaagattagaaactgaagctagaccttatggtcccgcacacatgagtgctgctggagcagctaggtttgcttgatagagaggtagggcggccccagcagcactctgtgcttttagctcattgtaagccttttaggagtgtag

SEQ ID NO: 17959 - DNA, 1198 bp, Mus musculus
ctgctggctacatccagtgcatgcatgaggtgcacacgttcgtgtccacgtgccaagccatcgatgccactgtctcagctgaactcctgaaccacctgctagaatccatgccgctgcgtgagggtagcagctttcaggatctgctgggggactccctagctgggctgcctggaggctctgggaggagcagctggcctccaggagggtccccagaatccccattgtccagtcccccaggtcccggggacgacctgtgttctgacctagaggagatcccagaggctgaactaaaccgggtgcctgctgaggggccggatttggtgtctacatccttaggcagcctgactgcagctcgccgggctcagagtgtgtggaggccttggtgaccaacacttaccagggacctgtgaatggtggctgccatccttaagtttgcttcctccctgggtatcagataaggtggagacagctcaggatgccccccaggtatgccctccccactctccaacagatgacttgaatgacaaccctaatggccaggccctgcaggtccctagcactattttttcgtggaccctagagctctggatggtggctggggggccagggggtgcactaaagaaagacaggagacttttggagagctgccagggctccctcgtgttcacctctccctgccttttgggcattctgaggatctagggcagaagtggccaatcttgagactgagcattagggtcctgggcagggacacacaggccacagcaatcctgacctgaaaggaagttcagatttgctactttggctatgagaccaggggaggcgggcatattctgcggtcactgaagctgctcctcgtttgtaacacagttgcgcgcgtgtgagtttggttgccatcccatcgatgctccaaccgaattaaataaagaactttggagttagttgctcctggtgtactgtcattgatgtgtccaatgtgtgaatgttcaactgcatccaacactagtgtatacctttttaaagggcccaccctttgttagcaaagtgtattcgtgtggtgctgatagagatgtccccactgctggccaggtcctctgtgttcccccactttcctaggagtatgtgtccttgaggattccactagcatcaggtttgtctccagggtaactaagccgtagggagaagatctgtccttgta

SEQ ID NO: 17960 - DNA, 2086 bp, Mus musculus
cttcatgcctgagagctgctctggcctgtgctcagccagttcctggagcagtgtctgctctgcagcagacaggaagagctcttcctgtgcctttccagggaccctgctgaggtcctgtgaagtgccgaggctgcagacactttgtttgggaggggtctctgtcctgagaaaactgcttcctagtggaagtgcacttacggtggtcacagtgctgagagcccacagtctggatttgggattgaccttgtggggcggttggatcatcttgacccacagtgcagcaccaacagagagccattcgagcaaaagggtaagggtggcttgtagtacttgaggaaatcaaatttcctcagctgactggactgccttttattcttcagtcatgtcattcctgacaacagaaggcttgctggaaagggatggtatggggctatggctttgcatgtaaaacacttttgattgggatccacagcagtgttcttttcacctctgcctgctgctgtcctggcacagtctgattgtagtggatgctacatattaatgaggaagttttagatcctaagtagcattcctggtggtgaaaggcattgtggctttcccatggcctggggtctaagtgtaagctggaggaccactgtgcgcgacctgaggagtctagacatgcttttgaagcgcctctaccaccccagatccatgaggtcaccacagaaagtgtggcctttttggtaagacttgcttgtccttcactcaggccttgggaaccagtggcacctaggatgctggtgatgatgtcaccagtggtggtctgctggtacctgtgtctccttggtgcctgcacaccgggcacttggagactaatcctgccctgcagggatcagatgactttccatccgcacagagattcctggaagtgcctcttgacttgggagcttctttctttcccttgctcattttcacctcgttgctctccttcccagagttccttggtgtgcaataaagtagtaggtataactggttagggactcttagtcatctcaggaaagtcccacagatgggtacatgcaagctttgaagtgggcagtgatctgtggaatttactatacactccagcctgacataggacaatggagtgaggagaatgcggggaactgccgtagccttaacagacacccaatacccagtgtcaatgatgcatggggatccaaccagatcctgtgcatgtaagacaagcactcgaccactgagctgtatcttctgcctctttatgtcttaggtaaatgaagcaatggaagggtttttgtaaatctcacttgagattgccatttatgaacctaattgtcttggacatgcaatgtcagtgccctgttctctcctgcagtgtctgcatggcgtccactacttctgttggtgttgggcgtgtgtagtgtcccgtgcactggggcctgtgtgcttgtgctgaagtcgtgctcactgcagccctctagttcctgtttgaggatgaatgagtgcttgtttgcagtgccctggactgacttgcttttgcccttgtgcctagttaagagatttcaaaaggtcaatgactttttttatacattgttataataaatgctttattgccctctgatttccttcccacatgccttaattttgtggcccgtgtctcactgaatagaagcttcctctgtgtacagtctcttatttacattagttcatcattcattcattcattcattcattcattcattcatgtgtgatgtgtgtgtcatcttgtatctgcgctcacatataagctatggtgtggatgtggagatcaaaggacagtgtttgggagttggttctcccaagagccgagcctcttatagcctccccgtgcagctgtgtgcacagttcaagtgggaggggctggctcctggatagcttcctatggctggagagaaggttctaaagcaggagtctgtagctgttcagtggatcttggggttgcagggagaaatctagtcttttgcccaggattaaactatttagtgttgcttggttcactttgtggctctggttccagaactgaagagagttccttctcacagcc

SEQ ID NO: 17961 - DNA, 1179 bp, Mus musculus
ccccgacccctcccccgacttcagtatttcaggggtttgctaggagaggacaagggaccacgggctcagacttgtcagaactctaccccaccatttcctctgaccttcagaggtggcctcactgcccagggttgctttgtatcttcactctcaaattcaccccaattttgcctgcacgtgtcaaaaacacaggatgcatcacccacttgtgtatgtgcaggagtcatcttcaggtgtctccctgggggcggagggggtgtcactggaagctaggctggctggccagtgaacacgggatctctgcttctctctgcctccggttctaaggttacaaatgcctttgcattatctctaagatggaactcccatgcattcttcatgcttgtaaggcaagcactttaccagttaaaccatctaccaagccctttatgtattttttaaggcctgccctgggtacctgagctgctctggagtccacagggccaagccttggctcagactccaaggatgagacacccacccacccccgcccccatgaggacctggaggggctaacaggtcccagggccacatccactgctctggagtttcactctgaggacaatcttgtgagattcttacaggaggaggagtctgtgggacagcatgccttctgacctcagatctgagccacaggccagtggtgagaccctccctctgtctaaaggtccccatgcccgcatgcaatgtgggctgtggcaactcgctcagcaatgcagatgcagccagatgtttgggatgtgatggaatgttagtgtaggcaggggcggggcgggggagggttctaggacttccagccagatttctgacatccttgtgaaaagcagctatggagatgtaggccaaatctcctccttggagaccagggatgggggatttgtgagggagggcaccagagaccagatgtgatggagcaaatgcagacaatgcactggactcttggtgcagaggaaggccgaggggagtcagcctgctaacctaggatgctcactgtgcagagaagaaggggtgtctgtggggaggaagtgggtgtaaagaaatgtaacatgacttttaaaaaatctgtcagtttgggagcatacagcagctgcatgccaaggatggaggacaagcagggctggtctctccttcgtcctcctg

SEQ ID NO: 17962 - DNA, 1196 bp, Mus musculus
tgaaagacgtgtgttagctctgaggtgctgagggctggggtctggattgaagcccaagggtttttgagctccagattggccagcttccagattgccagcatgttcacccctgggcaacttccctaccagtttgtactttaattttaattattttctaacagaacctctgccctcgccaagactccatgcacatatgtacctgatgagtttttatagcaaaagatataaacttgctgttgatttttgtatgaatttttcacaaaaaagatcctgaagaaaacattattttgtgtattttacatttttcccttaccattcagcagttttctgaaggtggtaatgtctgaaactttttctttctaaattcttacttgtacattttttttagctctgaaggttatttttatggtttgattttgtttctttttgtacagcaagcagggttctgctttgagcaagagcgctgctatcatgcttggtttttttagagcaaacctctcgagattgggcagcaggtctgcgtggcaccctggtcttgtccagctcacccgggagcagcacagccaggggcttctgccctgcaacaccgctagtattacagggcgggcaggcctcgtgagccgtgagggtggttggcattagtgaatgtggacttgtaaccactccatcaggatagaaccccagctcgagtttcccaaagacctttgaggctctggccctgcacctgttcaggaatttccattgcggcctcataacctggactctggctagagccatagccctgggtttgtagcctgtggccgctgaaccaaggcctttgtccttgtcctgcaggaatacacagggtcctgagggacagccagtctttgtctttgctctttttttttttttttcttatgacaactaactttttaactgctaacttcttttctagcacttaaagccgccagtttctttccaaagtatgtggagttcagactggtgagaggaagttgagatactcagaagggacatcaagctaagcttctgaatttggtggcatttacagggtagatgggaactgggtcaagcttttgacagacaggctgagcacacattcttggacttttgatggctgggctgctgtgagtgctgagctaagacagagggtggagaggtcttaggacgtcactgactttgccctccctgtggctgct

SEQ ID NO: 17963 - DNA, 1188 bp, Mus musculus
taaattattcagaagtctccagtgacgtgcatgagccacccacacaagtgtcacaagcgagagtaagacagcaactacatacagtcttgcagggctggcaggctagtgtctctggtcaggagtagagtaactgagtctttgccaggcaggtagggcctgtgttgctattgccacattgagacactagacctgcagctttcctactggaaaaaggcagtttgtaaggtaaaatggaaaagcccaagttaaaatgaggtgcttcaacttgattggacgtgttaattggggtggtcaaaagggggcttttaattgctggacttgaacactttggtagctgggccttggtagtcggcctctggaggaggaattgaccaagtaaccttggaggctagctttagggatgtaatctaagggtgttttagcacagcagaggaaaggggagagaagggagcaattcagaggagcaggtctggagaccatcagagaactagacagagcttctgggcctggaagagggccaggcaaagactcggtggaagagatcctctgccagaggagggagctaaagcctcggtgtggaggtgtggaagatgaaagtgcaggcaggtggccggatagtgatgagagggagagctcaggaggcagcttgggttcctgggcatggatttagacaccagttgccaagaagatctgtcttccttggaagtaagagaaaggcaggttctgagttggagggggtgggaatatgagaaaatttccagacctaaaccagctagccctgtggccataaccttgccaagcgcccattggcctgaacatgtgctactatacatgtggattgacagcctgggccaaccagagaaaggtctggaggacagaaggatctagtgacccctcattgctagaatctgtttaagatggaagttttgacctccttcctgggcccaaatgccccagcaaagtgggtgacattctgaaaacacaggctcaactccctgaagctgagtcagagcaagagccctagattgttacggcctctgaagtgagtccatactgctaaaccactgacactgtgactctgtgacaaagagagtgggaaatccctgctatgattctaattccaccacctgacaaagagtttgctcatatacctgacagaggcctctgctaattacaagcgtggcagca

SEQ ID NO: 17964 - DNA, 1103 bp, Mus musculus
gaggactcatagtagcaggaaatatgcaggcatgtccttgttcctgcactgtccataatggcttagtgcatttagctgcaggccaggagtgggcgagtttactcagatccatgctaggaactccagccagatatgtaaacacaaccagcctcccctaacccctagatctgccagccctcaacagaagaggttctgttctgtaataggaacactgtcaggtacaaacaagctcccctacccacaagatgtatgggcagcatggtgtctggactgtgcaaggctgtgccaactcctcaggggcccactcccacctcctgtggctgcctacccataaaacgctgcttcctttcagactctggcagagccactctccttgcccttgctgcctggtggtagagtcttgcagcagagcctgtgggactctaagaaccagtcttgtcctagggtccacagcatgcttttcagactgggcactcacagagccagtgctaccctgatcttctgaccctgtccttctccccacaggctcgctgacctcagtgttcgtcaggcttccttgtggtggtgttggggtaagcatttctttaatgtgtaaataatgtcctgtttgttctcagggcctcagtggtcacagaaatcattgccttgctctctcgagtgggtaatggctgccaggtgttttccataaacagtactatggggtgggcggggccatctggggcttcaaagggactgagagcgtttttggttttttttggtttttttgttttttttgttttttttgtttttttttcacggaactcaggcacctttctttggggaaggttgtctaacaatgcatcttactaggccacagctcttacgcacctcatgtgtacactgtgcctcatggcgtacgttcacagcagtgctacatgcttgtccatacaggccacagaggcctcttagggaattgtggacttttcttgccacgctctagtttgtactccagatagttttctgtgcagtgaccagagcatccatgggtcagatgacatttgtaagacattctctggtttatggtggccttgcatttctataaccaggtgatacgagtagctagt

SEQ ID NO: 17965 - DNA, 1218 bp, Mus musculus
taagaacacaatagataaaagcagggtagccacatctcctcagtccttactgcctgtgtggaggcacaagagcacagtagccagctcctagtgcagcacagagcacagtgtgtcaccatgttcaaagtgtcccacaaagggctagtgttgaggggatagtagagcagtggcttgaggcccctcgagaaggagctcaggcagttccctcactttagatacttcctgctatttttaagcccagaccttggttttagaaaacaaagtaataatttattgaaaattattgtgtgacagtaaagggggtcatgttaaaaagcagaattctctttttaaatgtttttcaaagctatgattaaaatataagccatctacaatattttgaaatgtgatgttatgtgctgttttgttttccacttttcagaaagtcagtaatgatgtgcctatccccatattcaggttgcatccctctggggcagtggccttgtcatggtagatagagctgacacagaaacatgttctccccttgtgtcccacagtgcatccgtggacgcaaggccacattggaggagctgcagacagtgcactcggaggcccacacactcctctacggcacaaatcctctcaacagacagaaactggacagtaagaaacttctaggtactcgagacctccttacatccctaccaggtttgatctgcaagtgatgtttccagcccttggctcctgctggccaggacaggaaggttggctcccactaaggccacggcgcagagaagcctagagcacagtcagctctggaagctgttcaggaatgcttacggccaggggtacccagcccttgccctatttgcagttcctttctaagactgctgaggggaaggctcagagcaggcctggagagtccctggcctggccacactgaagccattggttagactcgggagctgagtcttgcccctgtcagtcagcactcctatgggcaggttcttgctagcagagactcatcctgcatcagcagaaggggctttatcaaataaaagtaggctttgacaaactgtggggccctatgtaatcccagagtgcactctacatcaccaacctggcttaccccacagactccaactgctcagagacagtgatttttgcagtgatccagaactacaggcagtagaaacagagacagagctagagtttcttctggtctcttccttgagactc

SEQ ID NO: 17966 - DNA, 1192 bp, Mus musculus
gcttccagagaggcagcttctgagaacttcttctggaccctcccaagtctgtactgggttcttgccacagggtacctcacatctgcttctgttgctcttctccagccacagtatgtcctgctaggtggcatctaaggaggatgttactcacaacatctgtggcctctctcgagcttacctttactcacctctgcacagtgagctgacacttgcaaccttagtttttcctacctggcacacagaaacactgcatgagcactgagtacctagtatctgtctgcgtctgtctgcaggccacattaccttagtcctgagcatcatttcctgtgtgtctcagataatgctagggcccatgctgtctgggtaaatagtacttgctggccctggatcatacaaatgcagaggattcttcaagtcccatgactatcctgacttcctttgtctcctccgcattgcagataatctccaaacctagtgagccacctcggcagcctgagagccacccagaggagacagaggaggagctccgtgagcaccaggccttgctggatgagccctacctagatcggctacctgggcagaaggagccctccctggctggtgtgcaggtgaagcaggagcccattgagagtgaggaggaagaagcggaggccactcgagagacagagcccggccagcgcccagccactgagcaggagctgctcttcagacaggtgtgggatggacagtagcccctcagcttctcctggcctctgagtcacacactcactgttctgaccctagccatcttactgccttcatgagaggtgggctgggtttgttgtacactctcaggtacacgaggatttgacacctgccctcggaaggtgtgcatggacttctcagtcatccagcctgcactttcctctggtatgggaggctgtagcttgtaaccccaaaacaagtgttggtgagattcagcataaccactagaactagagcagagcaggggagttggggtgttaatcagaaaggagcggggtgtgatggtgcgtgactttaattccaggactagagacgaagtcaagcagatctctgtgagttcaaggctagcctggtctacagtgggttccaggcccaccaaggctacatagtgagaccatgtctcaaaaacaaacaacaaaaaaaggagtcgaggtctgatgagactggg

SEQ ID NO: 17967 - DNA, 1184 bp, Mus musculus
ccagcagcccagtcggtgctgatctccaggttgaggtttttcctttggggttagctgggttttggttttggtttgtctctttattgtatttatttgaacctctgttgctgttttgatattaaatcttgctggcctcaaactcggactctcctgcctcagtcttctaagtgctgggatgtcagggctgtgtttgtgactctcccccagcactctatccagtcttcccagcaccccttctgatgcagctctcgctgggaaaggagcctcctgaacaggatttcctctgctcagccacagtggtccagagaggcccacgttccccattgtctagagtaatactgtgtgtagagcccagacctgtgaacattcaagccaaagtagtagggtagcatcccactacttaacgtggcatggctgtcatctcagcacgatctaaacacaacaccactgacaaatgggtcagctcttagcagagaccccagccttgcaccacagccctcttcccgggcagactgaccaagggaagtgtgtgaagcacacattcttctctgagtccttccacttctctgaactctgtctgtctgtcctgcagccactgctgccctgcaccatctgcatgctgtgctgtcactgccccggcctgctctctctgaagcccggctgtcatgcctctagggaagatctgattccttccctgtgcagcccttctttcctctcccagtgccactctgtatttgatacaaaatctcctgtggtagaatccactgaaggtcaaggtcttgacagtgcctgggtgtcagtttgcccctgagtttcggcatgtcagccgcaaactgttcttctttctggtatttggggatgtgcatgagctagaagagccatcctctggaaacgtctattggatgtgtggcaagctgatgctaggctgttgccatactttctggagtgctccttggtgagctcctggagaaactgcatcaatgggatctccaggtaactttactttctctgccctgctaaagcccaagctccaggcttacagcctctagctggaatcgagcctgtttgcagacatgtgtcataggtgcctgggctggcaggcatgttattttctccactggttactcaacagcatctctcccctctcttcttccttttcccctctgctgttttttttttcctcc

SEQ ID NO: 17968 - DNA, 1180 bp, Mus musculus
gcctgggccccagaatgtggcatgctcacacattaccacatgtctcttgtggttcggcttgtctcttaccttttaatttgtgacttttctttattttctgaatccttgctatctgaaatttgtctgcttctagtcatttcaaagaatccattgtttttgttttataacttgatctgtgagcatgcaatgagtgtctctctcttcattcatgcatttattttgttttgcatttgttctgatataaacataacttttattcttctgtaataactgtcatttcagaggctttcctaggcctagtcctgggagcgtctagcttctgtctagtcttagctaggcctagaatgcttcagcctctgagactcactgcttaataagcgcacccttgctttatagtccttgctttatagctctttgtgagctcctggtcagtgcagctgttctggctcagagctcctctccactcagactcaagctgcttctcttggtctttcctaaattgctctgcttagtctaatactaactttggcagtctgttctaatcttctggcttctcattctttagctcattccgtcttctgtgtctagcttgttctctctctgtagcccatctctgtacaattgtccctgtaaaactgcctcctctttctgcactgcccctcaagtagcttccctttcctctctcttctcgtgaaagttggcacagcctatcctgtcaaatctttctctgattcatcactttgtctgttactaaattagacatcaatttcaacatgtatgctttcttctacaaactaactgtaccttcattgtttgggatttaagggtgtattaaggtgtgtctgcattctagagggattaaaggtgtgagctaaggctaagccacacaacaactagaaacaggtttttccagtaaacaacagattctagaggttcacagtatgatcaaatatcctgcaacattccaaaattgtttaatttcttaatatagatctaacttaggcatctgtattcttactgtcagataaaaagttcctactttgctcagtgtcttccaagaatgaatttatttgtgtgtgtgtgtgtgtgtgtgtgtgtgtgtactcgcatgtgtatgcacctgtgtatatgagtgtgtatctatgtgtgtctgtgtctctgtttatttatgtgtgtgcat

SEQ ID NO: 17969 - DNA, 1902 bp, Mus musculus
cctatactacttcctcccaaaagctgatgatggggaagtttctggaagggtggttgatatctctaagtcagacttttaactgaggttgattttggctccccacaccctgagacatttctggctatcatgatggggggtgctactagcatcttattgggcagaggtcagggatactgctggcttatcttgtcatgagtgcactgcctttatagcccagccactaggtaactagtctatgatgtcagcagtgcagcggtgaagagagttaaccagctttgttttgttttttcctcacatgacatgcaacaaaccacagtggttcatgttgatcaaaatggcttagtatgaattgctttttccagtccctgggtttgtaaagaaagagaagagtgaaaaccagagcctatttccttagttaggtagtggtgttcacatcccaactgagggctcctttcttctctgaccatgcaggttcatctctgcaaggccaggtgacaacgtttgctcttctcgtggattacttggtttacaagacgctgccagtgagacttcaagtttacgcagctgggacccgggcctcctcaattttgttcctgcatgtgctggtggaaatttggagtgtgttggagccactgtttacctggacatcttgagccattttgaacttaaggcactgacgctgctagcaatgagctcccaaagccatccaggtaaggcctgcaacttctgtcactagcattcttttttacagatgtgtgctactgtccctccagcctgcttgttccctttcagattttgctttcctgtggcagttgctgtgggtttgcagcatcagcaggtgctcagaaactggattcttgtcttctggttcaaaggactgatatagacctcccaggggttcagaggatgccctggctttgtctgcccactccagtggcagggagtttccttgatgccaggaaaaagaattttgagtaggtgatgggtaaataccacaggtaacttgcagagtgaggttcctgtcagggtaagtgaggaacagagctgctgtgctgaccctggctgggatgaaaccttggttctgcacagcctttccagtgtccttcgtttgctttctttggagccatattaagcatttcacaagtctttctgcttctcaacagcccatttggaactgctgggacaaaagattcatccaaggtcacagagccagaacaggattagaaactgcatgcttgggcctttaaaagggaaatacatatgggacttggccttagaaagtagcaaagcatgaaccaggttaaatatagagggccctgtctggcccaccttaaggtgtgggtctcctggagaaggtttggctgtttttggctacttctggtgcatttttagtctctaggacttgaggtgtaggaactgtcctgagtacacacaggaggctggatagatgcttggatggatgcttgaggctttgtcagctgcctctgagcctgttctactggatagaggcagaggcttagggtctaggccgttcactccaggactgcctgaaacatagtggtagcacatacttttctgggcatcattgctttatctgagagcttcagagggcagagatctaggttttatttaggtaggaaggttttattgattcagttgttcatgtattgattgttgtaaagaaatggtttttggttgattgcaggaaaaatttaagctgtatagactgaaatgtaaagtagatactcatatgaaggtatgcctcctgctctgcagtgagatggaggtgtgtattccctgtgtgaacatgcagagagatacatgtgcccacatccaaggtgacattacacaattactgtgaatatattatgaactgtactacaagtatccccacttctgcta

SEQ ID NO: 17970 - DNA, 2252 bp, Mus musculus
agtataggaaattcatgagtaagtcaataacttttttctttttttaacttttttactgattcttgtgagtttcgaatcatgtaccccagtcccactcatctcctccccaatacccacccttcacccttgcagcctcccccaaaaatatagcacacacacaaacaacaacaacaagcataggaaacctctgatggaagctggagtgtgtcacagtgtgtcccacagtatgtctctctgtccacacatctccacttgtaatgtccattgcagtgagtcagtggtctcaggagagctggtcttgccactcatctgccatgagatgatgtgggggtgggcgtgatacctggtccctttagccccacaccatctgcagcagtggggagagctgaccctggggtcgtgagagtaggagagctagccctgctccctcactggccttatcactgggggaggagggaattaagctgaaacttccttggactatacagtggagatggccctgatgacaaaggcaccggtgagccagctcctcacaggctgcagcacaagagtcgagccttgactgggcagctcagtaagacctcaagggcatgagaactggagagctcgcttgggtggtgcggataaaggagagtaagtgggctgaccagctcagctgctacccaagcccagattgaggctctgaattcgcccaccccaaaatctatatcacttgcaattggttggggtacatgaaaaggctagccctactgttctgaagctacaaggtctccatgacgcagggcaacagcaggataaccaggaggagtcctgatgagtcagtactgatggtgtcacagaagccagacagctcggactgtggcctcttagtaataagtccatcactggttcccaaggctaagctactgtctccattcacactagtcaagcaggcagtcggggctgagaacaaggcattttctaagcccagcctcctctgccagctatcactgagtgccactggtttcttgtccttcctgctcatcatacaaaatagaaaaaccagctagggctctgtctccatctggatctctgtcctggacaggacttctgtgggcaaggctgcttcattacaatggatctctgttctccggtatccctggtactggatgggcagtagctgaccaactctaaaggttggaaaagtggtctttactctaaacagtgtttaattccttcccccaacagctgccaggccgcaagtatgcccctgggtacaatgccgaggtgggtgacaagtggatctggctgaagtgaagggtcccctccgcccagccgtgtcatagccatggagatgcctgctctgcccaactctgtgaactccagagctttccaagacaacaggaaaaaaagcaaatgatcaagaaattgccagaaaaaaaaaaaaatctaacaaaaagagtctgacccacgcctgggcagagatgaaagaatcagcgtccactgaaaaggttctggaaccttctagtgatgttttggaatcatctggaggagaaacaaagcagagctggtctgctgaaagcccagctcccactggaagccccgtgccccagtgctgttcccttgaacccttccaacttgaagaaataaagccggctctgtagcccctcctcctgtgtctgcgtggcacacttgtgcctggtgcctaaggatgctcagccctgcgccccccacccacccacccctgcactttgggtctctcacacactgttgaagcgtcttttctgaagcatttgttcttttctgaagcacattagagcaaaagggtgaagaatggccacagactagcagaaccgagtcttagagcaggctcgctttctcttatctctgaagagcaagctgagcatagggtgtggggtagtacagatgatgctatccaaaatgagggtgccagtcccaggtgaaagagcagtggcatcttattgttctcctgcatgggaacctggggggagagtccttaggagcgggtgtcaatctgaattgctgtcctaagctgtgagtttgtactgagacccctgctgtggctgctccaagcacatgtaacttgcatttaacttaattaaaacttaatgaaatttagcactcagttccctggtagcactgggctccattcaggcacacacagaacactgttggagagcaggtcaatattaggcagtacagaagagaacactttgatcttccagaaaagctggccttactgctggggccac

SEQ ID NO: 17971 - DNA, 1161 bp, Mus musculus
ctcaaagtggccctgcccagtagatggaaacgtggaagatgtgtgaccagaagagcgggtggccatggctgtgggcaccagtggcatgtttgcatgctgactgtaaatacactctgactggagcaggctgtagctgtgtatctggagcctggcttgcccaggctcgctaaggtagtcatcttgggctcagtccggccactgttccccacacttccaccctcctggtgcaggcgtggcactgctggctgtcctcacactcagtatggccgccaggctgcaaggtgcttgtccgtgtgtccacagcacccccatgctttataaagatcgcctctgaactagactacactggggcagtgctgtccatcccccagagttctgtccgctccctccagctggctaaagctaaacctcctggggagccctttgccaggctacaccgtttaccactctgcctttccagctttctcacttgcttgtcctgtacccaacagcgcttcattgtgatttgtttccatagattttgaagacctttttgatgatgatgatgtccagtgaggccgcccggtcctatgtgctccatgtctgtgatgtgtctggagtctctcgggacacgaccagctgattgtagacaccgtgttgatatcactagaaatgaagaccttgtcaaccaatagaggaactgtctgaaccaactgggtactgatgtctctgggaatgccagcccgtgtccttgtttaagttaataaagaacactgtaacacgcagggtgattttaattcctgtgcttttagatgcaggttgtgactccatcccccatgtgtgaacacagaataacacatgtcactgcagcaagcacaccatgctgctttcagtgtgcagtgactggggatgcactgtccgggtcagcagtggttgtgcaggtgtgcacatgcctgccagagcactttgaggacctgactaaaggtaccttcgccctgtgaacggaaagtcactgcacaccacggtaggtgacaggtttccccctagcctctttatcagagctgctgctagtacaagaccccaggtcagaggactccgggtgccccgggtggagactctgaaggaggtgcttttcccatgagaaacgcatggtctgcttcgtctcaaaggagggtacggagt

SEQ ID NO: 17972 - DNA, 1160 bp, Mus musculus
cttaaagcctgtctgtctgctgcccagtcctgggtccttatccagatgcggctgtgggcagggtgaagagggccattggtctgctgggctcaggaaacaggaaacgagaaaatgatatagttggcccttgagcaaacaggcctcacagggaagcacggtagctcagtgaatgggagagcacaatgcagatccacctggggaagggtatgcagagagtatcagctttaaactgcactgcctccatctctagctaggtgcggtaagtcacctcccaacccatgggcctcggttatctgcagcaaagcctcgtggcagcagtagtcctgggactgtgacaccgaaatgtgtacctgagatgacctggcctagagcagagcctagatgttctggcttgtatcccaagcccttcacattggggttccctcggggctagctggtgaccgggtgcacaaggactgcagtgggggctcaggctgcctttgttctccaggtacctctggccccagaatgttctcgggccatcatgaagttggtctactgtgctcattgccggggagtcccgggcgcccggccctgccccgactattgccgaaatgtgctcaaaggctgccttgccaaccaggccgacctggatgccgagtggaggaacctcctgggtgagccccacctcccaggccgtctggcttgtccttgggagcaccatgcagacagaggtcctgggaggcagtagtccctggtgtgggccacatgaaggtttgaaggcctgatatgagtggggctttggggatcaagggaaagattttattgttccaaggcatatggtagaatagctgcttcagcatgcatatacaccaacacagaggtgatatgtgacaaacccatacatgtatgaacatatacttaaacatacacaatctggcattgtgtatgtttaagtatgatacacacaatgggccagtctgtggtgtgcacagagactccctgcccatcacaggtgtacttacatgtgcatgtactggcataaggggagttgacatacacatatgccaacacatatgaatcacggtatccctctgttgatacggggcaaattagcatgcatacatgtcggcactggtacgaagctggcatgagctggttagtatgctgatctgacaggt

SEQ ID NO: 17973 - DNA, 2623 bp, Mus musculus
ggaagggtacaaggcctctccagagtcctctgccaggggccttctaagggccctgtgtccttgtagcacagttgaggcccagccaggatgtccatctggctatcatgtgacaggtgggcacagcaggaggcagacctaggaactgtgtcttcaggcgggcacaatgggcctcagactcccagtgtcacctaagcactcaggagcccaggtaggaagagcctgctggagcctcctgtcttccccaggtgatgacggcagtggctccggcagcggtggcggatgcccagatgacacctgtggccggagggtcagcaagaagagttccagctcccggacccccttgacccatgccctccccggcctgtcagaacaggagggacagaagacctcagctgccacctgcccagagccccacagcttcttcctgctcttcctcgtcaccttggtccttgcggcagccaggcccaggtggcggtaactgccccctatccccaaggactgtcttggccaaaacatgcaacagaccatatttaattcccttggccttttgaggtccagggcaggataaggagacagtagctctgagtgctggggcagggtgcatgggggggtcctggcctcctgggtctggccacgcctgtcaccctagcttttaattttgtatcaggtcagctgcgagccagtgtccccaaaagccatgtatttcagggacctcaggggcacctctggctgcacactcctcccctaccctcctgcaccacccccagaagctcatgaggccaaccagaagggcggctgttagctacaacccaacggagacctcaagtgagcctgtgccttcctctcctgcctcttcccgctggggactccctaccagaccccatgggccacagatgtcagaaattgaggcccatcctgcagctccccaggaagcctgcaagggatgccagtatgttgctgtccaggctctggcagggccttcaagtttatgcatgataccttctactcagaagaagctctgcagccaggatccccacacacagcagaccaggaccctgtaccactgtggagctcagtgaatctggttctcaaaaaaagacccactgtgggattctctagtatgacgtaggtgaggtgggaggtggcagctggcacagccatactacgctcaactctgccacactgtttgagggtatgttccgtcccctcagatgggctcacaaagactggccttggtggtccacatgaggagcctcacttcaggggaacagccagctacatctagcccctaccccacttagaaaggtcacctggccatggggatgctgggtggctggtgaaactttagctcagggtcaatgagacctggcactgcaggtcaagaggatgcctgggccccttcctgacccaggcagctctgcaggagctggggcagcattgacagtcaagggcttttacagacatgcacattcagaccctcagtgtccttgtccactgagcgctacatctccatcttccttgacagcactggagaggctcagggcaccacttggaatctggtttcctcctatggcctcgagacctgggggcacctggcttaccaaggctgtcaaggctccatcttcccttccagggcctaggggatgctgagttgctatatccaggaaggcagtggtcctgacatgcagaaggcctggaaaaaaggctgcttaccgcttttttttttttttaattttaattttttttttttaactttcttttagtcactgggttagagaggctattgccagcacagcaccaaggcctgcccagtagtcaggtcccctggtccaggatgggtattctccataattggtctgtgggtttgttgggcccatgccctgagcacactcaacccagccacagccctgctagtgccactcaagcaggggcactgggagctagacctgggctctgagatgagtgcctaggtgtcaggacagcagcacccatgctgtacagggcagccgggacagtggccagggtactgggtcctttctctgtcactcggtgtcagtggataatgtgtgttctttgagtccttgtatgaattaaaggctggggacctacagtggacatgacctcatttaaactggtaagactcggtgtgtacatgtgagcctgacatgcctagcccatggcagagcacagactggagcttgttagaaggaggttgaagaggggttgtgcctgtaggaaagtcctggggtttccatgtggtggcaaccattgaacatctatctccaagtcctgcctgggaagatacctgtctgtgccaactgaacatcccaaagtttatgggaggagggagccaggataccagagccagccagcctacgtgggttccaccagccttccacctctttaacacacctcaatctacatgccattgtcttagccatagaaaagttctcattcctgccagggtgccccagaggtacccaagagagcagtgtagggacaaggaatagcctgacacaccagtctatcccaagttatcctacatctgcagaaatgttctaagtaacttaagatactcagagctagttcaccctcacctccaggagctgacctgtccctatgt

SEQ ID NO: 17974 - DNA, 1171 bp, Mus musculus
gtccgggccgccatgactgcgccttggctctggccacgagctctgcccgggaccataacccctcccattggctccaggccaggggcatagggaaaaggaactgtattcattgatgctcgtggaccagggcccaccctgtccctgctctcttgcactgcaggccccagggatggcctatacacactatgcctcctgtttcaacactgacagccatgcctcaccctggaagccagcatctgctgacactgccctggggacagtgaccccagcggtcccacagcaacaaccacaatgtgccttaacgtgtgccagagacccagaatgcacggtcctggaaatgtgctttcctgcagagccctgtgtctggcccctgggctggatggaaagccttgctttagggacagaagacagaggggcaaggacacaggcattccatcagtgtgggggcaggagacagaggaagagactagacctctcaagcaggcctgtctctgtactagtccaagcccccagaggtacagggaagaatggcctatccttgtggcgacctgtgtaccattggtgctctctgtgcctgtctgctaggagagaccccaggctgtgacttcagcctggaactgcaacaggaaccatggtgactgtcccattaaatctccactctgcagatctgacctcccttcctgtctgtcactaccctgtcttttgcacctacccagctgccaggggtagggctggaagagatgagaacgggtcacagaatcatggtcatagcctgtcccaatagacagacctaaatagaggtgggaaccgaaccctgaaggctcagatggggacgggtcagcagggggaggcagggagaaggtggatccttgttcttctcagctcctcaatcagaccttcaggaccctaaaaaaggatgtttgtcaccctcacctggactttagtctctgtgactctgaccacacctctgtctcttatcactggggcacccaggcctctaacactagagttcaatagaggtgtgcattacagggattcatgggaaatgctgagcctggactccagcacagcaagctgtgaggtcagatgtctcggctaacaaaagggaagttctctgtgtcacgtggagccattccttgtggttgctcaaagacaagctggtgacagagcc

SEQ ID NO: 17975 - DNA, 1182 bp, Mus musculus
cctcggctttagcctgtcatgttagggggaagcatatggaacctcttcggccaacattctgtcttcaaatagaactttgttccttcaaatacagagccaggccctcacaatggcatccagctatttccccatgccgcttcatgttgttgccatagtttcccgtatgtcataagcccaaataatacactgttaatattttgctgtaaacagccgattgtcatttagagaggttttagattagatggtcttttctgtttacccaggtctgccatttgcagacctcattccgtagcagcagtggctccctgtctcacacttttccagtactgggacattccttgtaggcctcacttgctgagcacccgcactctagtctgagaaccgtattgatttcccttcctttcaaaagctgtgtctgcagtgtgcaggtggaattctgtgttggacattccattcttaaagaaggtgtcccactggctgtgcatgtacacagtttctcgcagggactctcctgcctgtcacctgtctcatggtgccaccggctctgacatgtcttcttccctctggctccttccataacttcccttttgtccctatttttccagtggttcaattctcaggtgggttgttgtggcatttttaaagtatttcttctgtccaaggttcataaagactgacagcctgtggttagataattctcatgaaatttgagaaacttcttagctatcctcaagtaatgttctgttcgttgctgccctcatttgaagactcattgtgtgcacgtcatactgtgtgcagatgccccagagctcgctggaatgttctgctgctgctgctgctgctgctactgctgctgctgctgctgctgctgctgctgggacctttatttgcagtattttttttttaaattacatcttatggtctcgaggagaaaggcacgtaccatagcacagacatgaaggccaaaggacgattttgaaggagttggttctctccttccactgtggagtccggggatggaattcaggttatcaggttgggggtaagcagtcttacctgctgagccggctcatcggcctgatttggaaagtttctttttcttgttttcacttttctgttttattttttttgttcttactttgattgaaggcagagtcttttctcacatagtaattaatatat

SEQ ID NO: 17976 - DNA, 1109 bp, Mus musculus
accatttccatggtactctgtgggcaaaggtcagaagcaacaaaagccaggtcctgtttcggcaactcatcaaactttaaaactaattttagggctgggtgtagcacatgcctttaatctttaatctcagcactcagtggggggggggggagggagggagaggaggaggagggacaagcggaggaggaagagaaggagggaggaggaggaggaagagaaggagggaggaggaagaggagggagaggaggaggaggagggagggaggaggatctccctaagttcaagaccagcctagtctacaaaaagagttacaggccagccatggctacatagtgaaatcctgtctcaaaaaataaattttaaaaataattttaaagagagaaagaaatgacagacacagcattggtgtagaatggggggagggggcggcacgaaaggtgatgggtaaatatcgctctggcttcttgtcccaatgtggccagtcgatttaattcttttttaaaagtaattgtatgtgtatgagtgttttgcttatggatgtatactacatgggggcctgaggagacaagaagagggcggttggagcctctgaaactggcattacagagccaccacgtgagtgctgggactccaacctgagtcctctgcgagagtcataaatgaccttaaccactgaggcgcctccagcccccaccattcatttacttaagtgtgaaattagacttttctcaaagtgaacattcaaattcaggagcacaacttccaggaaaagcagtatacggtgagcctacagacagtcccccaaacatgctggttacgtgtgtgtgctatatacagaaacagcaggatccttcaaaaccttacaggctgaaggatggagtctttgagaggtttgggagcaacctagtcatttcacaggcacgagccaggctcgagatctctgaggataaccctggtttggcttctttacgtatcaaggcgtattgtaaactttcccagagctacttcctatccattttcatctagagtaataatggccatcttgttttgttcttggggggtctgtccttagaagtagatgagtgccggtctcagccatgcctgcacg

SEQ ID NO: 17977 - DNA, 1145 bp, Mus musculus
gggatctcactggggccctgtggttatgaggccttgagactgacagaaattacagacacactcacgaggttttgagcagaaacactgaaatccggtccagctggggaaacctcagggagtgagtaggtagcatcaacctgagaatcatcaaagccaacccaaggcacagagggtggctcgcctgcagctcagctcagctccacactcttgcatgtgctttcatgctgctatggaactttaataatataggaaatatcttcttatttcagaacaaactcaccatgttggatattgcatcaaatagaataaaaaagattgagaatatcagccatctgacagaactgcaagaattctgggtaagttttaatcttagtaggattggtatccatctcttaggctcagtgagtccattgagcaaagcatgtgaatgaatgcaagcctgcccgtcccgtcccagaagccttgatctcagtgaaccgtgcatgtgttctggggatcagactcgagttgtcagcaagtgttgtatccattgaactatctttactatccgcaacttcattttttttttgagttcagtattttaggtacatttattttttcttttgaataagatcttcctatgtagccctgaccattctggaactctctgtgtagaccaggctgacatcacaaagatccatctgtcttcacctcacaaatgctgggattaaagacatgtgtcaccatgtacagctgagcttttgaaatctgtaaattttacagtttttatgaaatttaaaaaaaaattttttttcctctaaaatgtttctagtccctcctaactcttagttccttgtaaaatggtaagcatgcatgtgctagtcctttggtaagtagataatagtgcacctgttactcatctcccctcctgtcctcaggttctgctccggctgagcctccggttatgtgatttctattgctctgtcttcaagatcttgtttttccttctgtaatactcagtctgctgttaagctcattaattaactacttacatgttaaaagacttatgtgtttacgtttttatagtacatatgcttttgtatggagaccatgcttttgtgtggcacagaagcaagaagagggtatctgtaccctcctctgtcatt

SEQ ID NO: 17978 - DNA, 2883 bp, Mus musculus
tctacctattgctcctgatgtcgtcactataccaacagtcacaacccaatggcaataataaggcactggtggcacctggcctgtgatgctacacaccatttggagatgccaacactattaaatcttgccacgcggtcttcctggtgaattgatgaaagttattgtagccatggagagaatgcaggccttgttgcagtcatttgctcttccaatccgtctatgtccttaccttggtgggcattctgggctgccccagcagaccttcaagttggtttaagtagtcatgactcacaagagcacactggatagtctttcagaccaattttggaaagaaaaaaattttccttgcaaattttaaaaaagaaaagattatatttaatttttttttgagtaaaagatggcccaatgtctgaagctgtaatcctcagtgcccttccaacatgagcgacggctgagcacagcacactgggcactctgtgcccttattcccacttggtaaaagctggaatatggagagcttcgctccctatcacccagctatgttaaacctaagtgattatcagaaacgtccacccctgaactcttggccactgggcactggtcatggctcctgttctcacccacgtcctctggccttatttagatgaagtttctatgagcaaactcccagggtgtaagtctaatgctgcaagagcactgtcctccccacgcctccgacttcctctttcacacagtgagaactaactgtggtcaccaaaggcccctgagcttccagggttctagttctacgctgtcccagatggggccactaactgccacatgtagcaattgctattcatatctaatccattggatttattcatctcttcatctgtgctcacactttatctgctcagaggccacatatcatggaaggtatccattcctatcatcccagaaggttctggaaaatgctgctctagactgtttagtattagtgaaatagcttgctctgaactgagaagcatgtgcccaggtgtccaagctaaccagtaggccaactgcccaggagttcgcaatgtcagaatggctacatgaggtttaacaagaaactgtgtgatctcaatctgtgcaccatctccctgacaagaaataagctcttagcaaggaacactgggtgcagcaaggtgcagcccagagaacactgtgctgtaaccctggaatcgttccaagcaccattcacgtcagaataagagaaaaacatcttagacccacaggactgaaatgtaggtgtgcctgctgcagtcactcacaggagccctacacacgtgcacgtggcttctacagagtgtagagagagaagtaatggagtgggagaacaggcatcaaaaccccagtgccatctcaaggaggtccctgcagcattcagttgggggaaatgtctccaaatgaattggaattctggagttaggaaaaaatgccaaaaaattattccttaaaacaggtctaggtcccaggaagaatttccagaatctagcactggctgagtcccagttgtgataatagaaaatgcccctaaaagtcgtctgcttggttggttggtttggtttggtttttttccatacagggtttctctgtgtagccctggctgtcctggaactcactctgtagaccaggctggcctcgaactcagaaatccgcctgcctctgcctcccaagtgctgggattaaaggcatgcgctaccaccacctggcacccctaaaaatcttaacaaatacagtacagaagtaaaaacactgcttttacataagaacataaatgcaaaggtctgaaatcaaagatcagcaaatcaaagactactgattcttcaccaagaaggttttatctcaggaataaatgcagggatggtttaagagcagacaggactggccggggtgcaggcctgtaataccagccactcaggaggctgagggaagaggatgaaaagttaaagcatgccttagcaacagggtgaaattgaggccagcctgggcaacgtaatgaaaccctttcaaagagtaacaatggggctgcgaggatagctgaagaatagaatacctgcctagcttgtagaggaccctgggttcaattcctaataaggggaagaaaagtaagcagaaccagaatttacataaatcaccacttagtgcagtaaaagaaaaaaataccaattaatgttataaagattcaattgtatatattcctggatttcttttcaaggaaaaagcattattgtcattagcactatgcatgatgtctgaatgtggttgtgggcacacgtgtgctgtggcacagcatgtgaacctcaaagggcagatttgtagagttggttctccttcatgtgagttctgggaattgaacttaggttgtcaggcttatgcagcaagcaatttccctgttaaaccatcccatcagttctgtattcctggatttttatttctttataaataaaaagatgtcttaaaggttgtagaatctgatagacttgagctgtggagaaaagccagtgggtaagaactcctgctctgcaaacctgagaacctgaattcaaatccccatctcccacgtaaaaactgagcttggcttttgagtaaggttgcagtactatgcatcattctagaagaagaacccagttcagtggtaaagtgtgtgcttagcatatgaaggccctgatacccttgccaggggctagggggttagtgatggtgaaggcagtctctccattgggttacacgctgttgttattttttattgtcactgtgatagaataccttgaggaaccaagaagaaggatttagtctggctcatggctcagtggatgtagtgccagcgggagtagcttcccactgcaacagtgggaacta

SEQ ID NO: 17979 - DNA, 1185 bp, Mus musculus
cttttctctcccagttcctcttctgcatcactctccaaccaaagcgtagaaggtcttagctccttttcctgtgagaatccatgttcgccctgtctgcaccctcctattcagagcccgtaggacctgctccctgcgtctgcttttctgtcctggtcatctcaaacccacctgctagctctttctagccctgtccagttcagctctgccaactgggatcaggaacacaggcagaacaaggcagtatttgataatatcccaaacccactgcagctttaccatctctgccatagtggggcctaggaagggcacccagggacatgttctcaggaccttgctttctgccaggtgatgatcgcatactcacgtgtgtgggcattcagagtacagaagagctgaacagaaggttaggggtgatctgtggcttctttcctgtttccctctccctgcccctgggcaccaagcctggagagggcgttttagtagggcacccgaggcaggtgccagaccaattgtgtaggtgcaacaggctgggtctggcccagcaggttacaacacttgtggatagagactaggctcctgacctttgtgggatgtgacctgagagacattaaaacaatctggggccaaaaggctggagaggtataggcagctagacttaggaaaaatatccagggttaggtgtgggaacctgtgacttaatttgctaggacgcagccccaactcacagctagaaaggaaacataccagggcccagggccctctggccaacctacctagatatcacaaccacctctttcctccatggatacctagccttttgagcaggttcggtcaggactcactctcttgctgtggaatggatttactttttttattgtaattttatgtatatgagtggttttcctccatactactttgccattcgaggccagaaaagggcattggatcctctggtactgagtgatagatggttgcaagccatcctgtgggtgcttggaactgaacactggttctctgcaagagcagcagatgcttctaactctctagcccctataatggacttatattacataagccaatagaagaagttacagccaaataaagcaaatgtcaaagatcaggggcttgagtctcccgagcacctgagatctaacaagacacctgtattcacgtggtccttccctt

SEQ ID NO: 17980 - DNA, 1990 bp, Mus musculus
cctagccctcctccctttgttttacccatgtgctctcctgttttctttcttcctttctttctctttctttctttctctttctttctttctttctttctttctttctttctttctttctttctttttttctttttgtttttgtttttgtttttcgagacagggtttctctgtgtagccctggctgtcctggaactcactctgtagaccaggctggcctcaaactcagaaatccacctgcctctgcctcccgagtgctgggattaaaggcttgtaccaccaccaccacccgactgctctcctgttttctatgaggcttgatggcagtcatgtccagagtccatctctgggtctgggtagtctggtctccctggagtatccagggcctgttgcccaccagcatctgttgcccaccaggggttgacctgctgttcatctcacaagacccagaatggagggtgcctgggaggtgccaaggcctaaagctgctgagagggcttggagacctgagcctgaggttctcggagatatcttagaagggagcagaggggaaagaaggagacaggggagtggctcactgactggccagaaccaaggagcggaagagctaggccctgagaaggtgcacatgcctgttgaggttaggcctgtaccttgccctaagtgcctccatattgtgtaaaacagtgaccacccctgagacattgcatttacaagcagctttgtactctcttgaggatggaaggtacaccacctgttccacaccgtccacgtggcaagactactgaatggtcatcctgggaatagggagggtactactctgtaatttatcatagtgggttgggactgtgggggatatgagcatattaatatcatatcaggaaagtcaagcctaagaacttcctgggcacagcaggccaaggaaactatggagctcctacatgtgaggagtccatagaggagtagacattagcagttggctggtgagagtccccactgacctgtctcctcactgccctgcatgcatcaaggactgactaacaggcaaagaagtgactcttccagaggcttccggtcgtctgggtgcactgctgacacagctgtcaccgttgcagatgccatctgccctcctcccatctccgttgtcactcagccccttcctttgtctggaccccgacttgcccttttgcctcctcaaacagccggactcagctctaccgcctcactctcaaacctgcagtcaggggtcctgactcagccacagtttccccaagtgctccggtcctgtttacctcattgtcagagactcgtggccctgagtttcccagctttggcttctcaggcctgttggaaactctgaaactccttgcatctttaaccccttacaaccattctataatctacacatatacatatatagagaaatttactgtgtgatatgtagtgtatcatgagagtaattaagattagaatacagtaacctgtgtttgcctcagcaaggactgcaggagtatctggcaaattgctgccattgaaaatgctgtacctcgtgaatttgtcaataaaatgtgatactgtgagaaaacacaactgttcgtctgtgtttctgacagtgtgttcccaagaacgtccaagctcacactaccagaaatggtaaagccctctcccccatgaagcttcacccccacataaacagggccacctgacaggggatacctatggctggccctataaccaccatctccctggacttcccttatggaagcccggcctgctgccacggaatctctaaacaaatagggtacctgaggcacctcgaatttgcatgtagggtgtgtgaaggaaaagtgggctggctgtttgctggctcagagtcccacaccctcttttcaaacaggcagatcctgtccagagacacaatcagagacctcaccctggtggctgactgcacttagtacctctcttgtctgcttccagcccccttaccctgtgc

SEQ ID NO: 17981 - DNA, 3457 bp, Mus musculus
tctgagaggatgaaagtctcccctaagaagaggcctgacacgctcagccatctagccatcatccacacagttgcactgtcatctccttagaccagcctgctaggtcagcacatggctgctcttgggatgtcccagaggagtcaccctcttctctaactacattctcctctttagccccaggaccaaatcaccatcacagggtatgagaagaacactgaagctgcccgtgatgctatcctgaaaattgtgggtgagcttgagcagatggtttctgaggatgttccactggatcaccgtgtgcacgctcgaatcattggtgcccggggcaaagccatccggaaaataatggatgaattcaaggtgagtccccaaagccaactgaaacagaaggatgagaactcccatctcctacctgtgctgctgaccacatgaagctgggagggtgagtacttggctctaaggtctagagtctgccctttaatgcccttgacactgctgcttccaggtggacattcgcttcccacagagtggagcgccagaccccaattgcgtcactgtgacaggactcccagagaatgtggaggaagctatcgaccatatcctcaacctagaagaggaatatgtgagttctaagcaggcatggtctttggggctgaggcccagccataatcctgtgatgacagccaagtaacctgtctgcatccaaatgtgggactgagcaggggggtccggggggtggccccttggtagccaggagaaggctccactgcctggctgtaggctgagcaacaccacctcccctatgatgtttagctggcagatgtggtggacagtgaggcactgcaagtttacatgaagcccccagcacatgaagagtccagggcaccatccaaaggctttgtggtgcgagatgctccctggacctccaacagcagtgagaaggtcagatgtcctggttattctgtgtgggttaagcttgtgggctagtggagtatgggatggagttactttggaccaccctgtggtaatgctgtgttctccctctccacaggctcctgatatgagcagctctgaagaatttcccagctttggggctcaagtggcccccaagaccctcccttggggccccaaacgataatgatcaaaaagaaacctttccagcctgctgcccaaacccaaccacacaatggtttgtctcaatctgacccagcagctggaccctcgtaaattgttgatgctctttcccctccccgaggtctcgcagcaaagcctggtgggctggccttgtgtggctgcttctccaggcctggtcagcacccagcaggctcagggtctgctcctgatgctgtgctctgggacaggcacgccactgtgtgaaacactaagcaaggtaatcgagcatttcgtgatcacagactccagcttcctggtccacccagcatgtagtcagcactctgaccttcacaccagagctccacagcggctaggagttgacttcctgtgtcatgacctcaggaaataaatttccttgactttataaaagccaaaacgtttgccctcttcctttcccacctccctcctgcccaccacctgtcgcccagaccttcctctgttgaaagcagtcagcttcctttagctgtcaaaatctgcttagcacaggcttcaggataggaggaaggcatggtatcggacagcaagaggtcagatgtcctggtgatagagtgggctgagaagtagagggtggcctgggtcctcagatagtgctgaccgtgcccactttgggttccgaaagcatcaggggcttctattgcagctttagcctcatgatcctatgtatcttagaggcacagctgtgtgtattccacttgggttccctgtgactatcacagtggactagggtggcttgagactttgggggaaaggggaggtagagactggcttttcttttggtgatggggagggggctcaaccctaagtgacagctcagctttcccacgacctttagcctctgcctgccttgttcagttgccttctttctacctcagccagtgtggtagtactctcatgtgggttagtgccacccaaggctcttcttgtgatgtagacatttctggtgattctgggcttgccattgagttgagggtggaggccagtgctttccctcagtccacatgattcagggactgggccagagctgggtgttccttcccagccagcctgaccatgcaggctctggcaagcataacctggatgctttatgcagtcctaaggaacaggcttaaggggcaggtctcgtcgatagaggtggtcatttagggtggattcacagggaaggcagaatgaaaacaacccaaagcagggagcacagctatctgaaggagatcttttcctcaggtacaagaggtaatttttggaccactggcctccagctagcttggctgtaggccaaccctcaccaagaaaagtggtcccgagcagacaaacccctgtcaggctgtggaaactgaggacagaccttttatctccaggtcatctgatcaactagcaacatgtcccctcccagatacttgggttactagaaaagccaacttgtggcgatctcatggccttccctgggaactgtcacttctactatgatacctttccccctcaagtctttgactcccccatttaataactcaggcttggctacctgtagactctaatcctaagtggatccagaattgctttcccaagtctaacttcagttccctttggatggaaccagtcccacatgtacccacttagaagaacgatactgagatgggaaaagaacatctactttgttcagtaggctggcagcttaagccaggtgggtgagacggggagagcgcttccctgcctttccctggagccgtctcttctcccatctgcatgagactggggacaccttgcttccctccttcccttccagccccctcttcatcttcattgtcatcctacaacatccagtctcccctcactgaaggtaaagtttaaattatcaccaggattttgcacatctccttttattgctaagtgctgtagatgtaagccctatcctaagctgttcagggtctcactccttttctctgattgttaataaggactatgaaattgactgtacccaggtcacctctctgcagcctccaagatgttgaggagcctagggcaggggtgggagtgtcttttcctccttgttgaatgtcttccatgtcctatgtttccatagctacatccatcccttggccttaactttggaatttggagattatatgcaaacatgtgtaaaggctcatgaatatggatgacactggaattttataaattctaaaataaaacccaaaaccagatgcagtgtgatgggactcattttattctgtgtatgctctctcctgtgcctgagtggtgacagtgtccctgtagagctccctaatcc

SEQ ID NO: 17982 - DNA, 1188 bp, Mus musculus
ggagtccggcctctgcctgcatgacctcagactgggctccctgtcctgtcctgtttgtgatgtattgagatccgtgtagtctgtcacctggtcacattggtagcaggttctaaaatgtacactgttgtcttcagggctgttggccttgagctcatggggctagttagtctgcccagctcaaagccttatctctaccattgtccttgtaggcactggttccagtcaccatcgaggtagaggtaccctttgatcttcaccgctacatcattgggcaaaaaggaagtggaatccgcaagatgatggatgagtttgaggtagaccatgttccctggagaccatactctggggactgttatcagagagcagcccgtagtggtctgagtctgtgtccttcttcagcccacattggttctgcctccttttgttttgttcagtcaaccgctgactttcctcccaggtctcactcaaatcccccatggcaagtgagcttcactcctctccatctgttatgacaggtgaacatccatgtaccagcccccgagctgcagtcagacaccatcgccatcactggccttgcagcaaatttggacagggctaaggcggggctactggatcgagtaaaggagctgcaggctgagcaggaagatcgggtgagcaagaacgaacaggacaacctgcctgggtttggaaacagtctgtgttcagagcatatttccaacaccagggcaggcaggagacaaaaccaggtggtattcccgtgcagtcagagtgtggtggacctgctgtggagaagctcaaggcaaagctcagtctcccttactacccagatcaagagaaatattttgatatctcagcttctacagaaaagataaaagatagtacctcatctcaagacaagcaggtcactcctgtgcctgtgatggagtgctgtctgcagaattctgagagatgctgctcaggaattgggggaaatctgggaactagatggtcactccaggcaactggcctttccacaggagtttttagttttgttattttttggttttattgattttgggtttttttgtttgttgttgttgtcattgttggttcggtttgggtggaacacagtttggagtccagtgatagggcagagattgggcacgttttgactgtgacctggtgcagcttagccataggctgtggggg

SEQ ID NO: 17983 - DNA, 1099 bp, Mus musculus
ttgtcgaaccccaaattctttagccagccacttccatagaactttctataggggttttctataagtcgttatgccaagttaattagatgatgtaactcgtttcatttttcctcataataagtaggcggggagtaaagtaggctaagtctgtctgttggtggtatgcacgtaagttcatatagctttggtgggtaaaggagacacttgaccctctgacctgaatcctcttgtctttaaggtggaaaatagctattcaatttctgtaccaatcttcaaacagtttcacaagaatatcatcgggaaaggaggcgcaaacattaaaaaggtgattgggtcattgccccagccctaaagcctttgtggattacatagaggcctgccttcccagccctgtgctcaagtgtgtctactgtagggaaactctttatcttcttaatgtgcctctcctttagatccgtgaagagagcaacaccaagattgaccttcctgcagagaacagcaactctgagaccattattatcactggcaagcgagccaactgtgaagctgcccgcagccggattctgtctatccagaaagatctggtaatgggggatatttcttgatgggctccttatccaactcttgtttgtaaagtttctatcagagtcttccaggctcattttttaaaaaagacatgagctttaagcctggggagtggtgtcaagtgttcgttaattttatactctggggctggagagagatggctcagtagataaagtgcttgctaagcaaacttaaggacatgatttcagaacctcagaaatcacatgaagccagcttcctcacatctgtaattcagtatgtgtgcatacatcgagatgggaactggagacaagagagtccccagggtctgaagaacagctcccctagcatatgcagtggataaaaaagaggccctgtctcaaacaaggtggcagatgagaatgaacaccccagactgtcctctgccttccacgtgtgtctacactcacgtcatacacaaaaggatttgtaaaaggaaagcaaactatagttcaagacctaccggattttgtttaactttctaaaaattaacaca

SEQ ID NO: 17984 - DNA, 1225 bp, Mus musculus
gatatagtagttagagaatattccagaagaatgtgctttatcagaaccataaataggaggttttttgttggtggtctctcctgttacaggcctcagcaactgttcccattcctaaagagcaccatcgctttgttattggcaaaaacggagagaaactgcaagacttagaactaaaaactgcaaccaaaatccagatcccacgcccagatgaccccagtaatcagatcaagatcactggcaccaaagaaggcatcgagaaagctcgccatgaagtcctcctaatctctgctgagcaggtgagacctctgagtggcctgtggccctgccacctgccccacactgaagcagcgtgtgttggggagaccttgactgccaatgaatgacttgggcaaggcttctctgctccaggtgttctcatcaggtcactgtccttccaggacaagcgtgctgtagagaggctagaagtggagaaggctttccaccccttcatcgctgggccgtacaacagacttgtgggtgaaatcatgcaggagacagggacgcgaatcaacatccctccacccagtgttaaccgtacagaaatcgtcttcactggagagaaggagcagctggctcaggctgtggctcgcattaagaagatttatgaggaaaaggtacagtgtggaggtggcagagcccatgagcaaaacggttaatgggatttgagtgtgggaatttggctaattccacagttcaccctgcacccttttgtccttggagacaaagtttggtatgtgtctaccttaagtgtcaatgtttagtggttggtggccacatttcccttctggtctactgggtacactatagagtgctgtcctggttttttatgtgtgtatcctttctcaggtctatgactatactggtaggttgctaccacagaatcagcacagactttttgaagtgttttttttttagcttattctgactttgagatgtaaaacctgttccttatttggaagaagtaaggttggcaaatagctctgtagcagagcacttgtctaacaagcataaccctatgtcagcccccaacactgtatgaaaaatgtaagggaacaaatggaaaacagtctggttactcaaaaagtgaccagactctgggccagtccagtagagagaagtagaatttctggggaggccaatcctaacttcacttactgagaaccgcttctcagtccccttcacactt

SEQ ID NO: 17985 - DNA, 2511 bp, Mus musculus
cagtatctgtcagtttccacaaacctcataaaggcatcttgatttagttcagtttatgccctttgttctgcagagggaggattgccagtgctgtaagaaacaaatgcatcacttccatttaaattgttttgtttttactttccaggaaacactttggataagaaagacttcctgataagtgctacagcatcaaggttcttagccctgtggaaggaagggcacccatccacaatgaagcacctgtgtctgaggatttcagttggttgttttttgttttttgtttggttggggtttttttttttttttttttttcttttttaacatttggtggtttttgtttttactctttttttcttttccttctttttctgccctcaaccccccaactcctttggtatgaagtacttttaacatttatatttcattgttacactttaaattttgtaaggaaaactctgatattttattcctcctgaaccactaatgttagaatttatttctaagaatcagtcaacatgtatactcttaatagtgaatttctatgatatagctggcctgactaatcactgacaagtactctttgatttctatctagacatttttatgctcagaatgttcctgtgtggtggacattgatgtacctgtgacagaagtggttgtgcatacttggtggcaaattatttgcttactagaattgaagtcacattgttaactttatatttgtacagaacacctaaaaccaattttgctgctgtagttcattcggcttattcatctgcacaattatctgttaaccaggtagaacagaagagagttatctaatgagatacatgtttatacttaaatagcttttaaaaagcaggatttcagggttgaattttaagagctctggattctagtgccagatcattttcaaacctctgtagagaaagctcactacaaggactttttatactgtggatgctgattatgctatgctgtggagagaaccaaagcagctatgagctccagcttcatattgtaacaagactctttataaggaagagtcagtaaactttttactcaactaaaaaggcaatacttttttaaagaaaccaaaatgtttatattttatactgcactttaatgtactttctataactaggtgcaaaaggtcatagcagtggaaatcatagtccttggctggcatggatccaaccccaggcttgtgattgggtggtgctcttgaacaaaaggccacttgaagcccagatgcctgccaggttttcgtctaactcttccccttttcagtgatccttctattgaaaggaaaatagcagtgctgggttttttatgtgcagactgtctcatctgtttccaggcactgtcattttcttcagtgtgtgtagtataaatgtcttcacaccatgaacgaaaggcttttcagatctgtgccccaagcaggcaagcagagtcctgcctggtttatattctggcacttccctcttctaccctgtcttctaatgtcaggcagtgaccttagaagggaaggggcaggtgaaggaggcagtggtgtggagaagcaaagcaggtgctaactgtgtgctttcatttgctgcaggaggaaggacttgattgatgatgaggcagggatttacgtttaattcagtccaaaactcagtagtactaataagatgaagcttaagcatggttgtttataaatttaatgaggaaaaatacatttgctcgctttgcctcttcacattgcatcactgtgagtgatcagggaagttcattgtgtgaagttcctatcaagaaaagcgtcaatgactttagagtacccatgcagtcctttgtttggcttattttgacattaagtttgttggagaaaaatttaaaaacaaaaaaatgaaagaattcccaagtattcggtgtgagtcccatgtttttgagttaaggtgctacttcgggtcagctgacatctaatattggcagtgtggattgtgaggtcttgcagccacaattctaacccccttcagttttactgcttttgctaacagatacttgctctttcactaagaagtaacttgtacttgtagaaatgtattttgaaaacatttcacacttcaactttgtatccatttaaattaacctttttcaataaagcactattgtttagatattaaatgagtagtcctctttttgagtaaagtatgcgggccattgtgaagattcaagacccctattacaactgtatatcagagcaagatgttacttgtattaatagcaggcgtgctgcgtatattttcatcagagataacccagatactccaaaagaaatcctatagctgtacaggttatcagattgtctgcagactacttgataaaatggacagtaagacttcataggtaaatttactaattagaaaatgaagcaacaactgttaaacatagtgggaagtaaaagtgatccaaatatatttctaattctccatatttgtaagaagagagatgaattaggaaaacagtctt

SEQ ID NO: 17986 - DNA, 1119 bp, Mus musculus
gaaagggtctgctatttactatttccatagttctctactcctatggatgagaatatgcaaattaaaggcttccttttttctctgtaaaaggtatttcttggaaggtagaagagaaacgctgcagtttacaaaagcaactattggaatggcatgtattcaagtagcatttaaatccccaagcacctgaaactttaagactaagtagaagattctgaaaagtgatttggtaatatatacccaaaggttcaaaatgcatgtgatcttagagcccagaacttcatttttaggacagcagtggctttctcatgttgtttgtgagcctgaacactgtaatttgtagttctctaaggcatgtgacaccatgcctgtatctacgttttgattttgaaactggctgttgtatgacctgcttctgggcttgctttctcttctccagtacagtattattggacttgcttcctgaaactttgtattttgttctaggggccctaccaggacacgttagagttcttgttgggtagcagagatgaatgtaagaacttctggaagatatgtgtggagtaccataccttttttagactctctgaccagcctaagccaaaggcaaaggctgtcttcttcagccgaggctcctccttcagatacaggtaagactggcctcagctgcagaaacagctgaccactggggagaggaaagaggtggagacagggaggaggtgccataggctaggtaggtaattgtatttaggagtagttcttgtgaaggacaatatatagggggaaaaaatcaaatattcaaactatgagaaaataggcttaacaaaaactacccagaaaatccaagttatttacattgggccatcttacttctgttcttaactctaaaaggaaatgctctgagttactgctttgttttaactgagcctttatttgtagtggaagaactcagaaacaactagtagattatgtcaaagacggtggaatgaagagaattccatacgaaaggtaaatgctgtagcattgatataagatgtgaacctttaaattttcagttttttttaaattttatgtgtacatgtattctgcctgcgttcatttctgtataccacatgtgcgctg

SEQ ID NO: 17987 - DNA, 1131 bp, Mus musculus
cagacaggataaagctactgacatgagacccagccccgcatctcacaaatgctgggccagccctgacactagccctggccaatttggctatatttgtctggtccataggttgggtgactgtgggtcttgtttggttggtttggtggtggtccctctctgctctaatctagcagtacaatagacattgaaagtttcgtttttctcaaaatatcctgtggaaataactttttctggtgtgaattcaggtccttgaacatgctaggcaaatgctttgcccctgaggtacatcagcctcctctgggatggtaagcactcatttgtgttcatttgtgaggcttctggctctgtgctgggatcgagtaactctgctggtctctgatgcactgtgggcacctgtctcttcttcattgtattagttagattctggaaaggaagctctgggtaaatgtatcctgcttttatttcttttggtttttgtggctaggtcttactgtgtagcccaggctggcctggaacgcatacacctcaagctagccttgaactcatggcaatgtgtcagtctcaaccccccaaacactggactatgtatgcccagtagtgttttcatttccatagcttccttagacttgtagactacagcctctctcttctgttagtccatcagtgcctgctgcctgccacacatataaggccacactgcttagagcagagatgcttaagagagttggttttcttcagtgtatcattcccaaaggaaaccttgcattcctgttatggagagctaatatgcatcacctctaaaatgttgttcttgaactttagtatccatgaccactaccctgctccatcattgtcacctaaccagtgacactgctgggaagcaacagagttgtcattcttgacttttgggtggttggttggtttggtttttgagaattatcatcccaggctgtctagccaacaatgtcttgatctacctcctcctctagaatgccaggagtacaggcacgcatgttaccccacatccagtttatgaggtgctagccattgaacccagggctcatttgctgtttaagcaaacccacccgagtatctgggcagcagatcagggatggtaggggttgagccttt

SEQ ID NO: 17988 - DNA, 1162 bp, Mus musculus
tggagttccttgctgaagtctcttaatctccacccccatctctgtgaacctttgacttgcagacttgggcatgcaggatgtgatattcatcatagtctctctctctctctttttttttttaagatttatttattattatatgtaagtacactgtagctgcaccagaagagggagtcagatctcattacagatggtagtgagccaccatgtggttgctgggatttgaactcaggacctttggaagagcagtcggtgctcttaaccactgagccatctcttcagccccatagtctctcttaaaagccctgctcataggcctgctgctctgcattctggatggctctgtattacaggagaccaaaggcctgctcaaggcatgtcagtggttcgatgctgaacatttattctccaggcttttctggcttgtagggaagacaatggttggtcaggctctcttctttttggatcagtggccaaggttttcagaagacctcccctactcaacagtgagccttattagatttttaatggtttcctgtagaaatataagcaaatccatgtctctaacacaaaacatttgctgacttccattctgatgtgaactcatccttatagtatatagactgatttaattccatagttttttctttaacccagtgtctctcagctgctgttgttcctttctcattaatgttcagaaagtttaaagagtactaatcagtctatccctagggggtctttattcttccttttataatttttcttttataagtctttaagattttaagtttctttaagtttctatgtaagtctttaagtttttactttgtttctgtgctaagaagttccattctaaaatactatcttccctttgcataataagcccagcaggagaatgaactaaaggcaaaataaccaaaataaaatccatttttgggatctatgagattcacatatgcatcttgcagtctcttttctactaaagttaactctttctctgcttcctttgtcagctgtcttgacctaagtctgaatcacctgtaacaaaacaaactacctaactcttgagtagttaatccagtggtgggctgtagccaagtaacatctcccattaatatttgaaattgttaagagtttgcaactgatctcttctgatctattt

SEQ ID NO: 17989 - DNA, 1124 bp, Mus musculus
gaaaagccctggctgagctattaacagtgtgcctttctgaactttacattgttccccaagatgattttctatgtcgaagccactaacaaaacatcttaaccttactaatagtctccatctccaaattctttctaagggcggtggagattactatcaatctacacctctaaatcctctctgaaggtggtgggtgacacaacctactccagcagcaatgcttgagaaagatcactcagtactattgtaagtgccaatgactgcccagggagagtctggaggcccctgtaaagttttcatacaacccatagattgggagggacatggcagccaccaaggcagctagcagaggcatgttccacaacagcatgacatcctgaggacatgtagtcctagggcctctgcctctctgaggcacagccatcttaattgtgctaaccagtgggctgaattccctgagttctaaagctgttttgctgtatcttttgcatggcccccaattatgtaataattataagtaggtactgtgaaagcaaatttttcgttatcctgctcttgcaaggggatagtaaaaaagcagtcttttaaaacaattgctgtcataggccatgccttaggtaataaaggaactccatgctgtaatggacccatcgtttggattactctattcatagatctcaaatctgttaacattgttcgtttccccatttactgtttttataacaaatacaggggaattctatgggctggtagactcttctgtatgctgagcctcctctgttctggtaccgactgttcaaatgcctttaatttttcctaaaagtcactgctctacccacaaaggcttcttagtcacccattttaagggtagggtcattagtataatttcagcagcacccccacccccttataaatttggaaactcaatccctgttgtatccagttttcggacaacctatacggtctgtagttgttctggatgacatttttcaataccttcccccaaagcatcttccatttcaccccttattttaggaattgtctctgctatgaagggaatattaatctgagtcccccactgctctaagaaatcttatctccattaattcacagtcatgccagccaca

SEQ ID NO: 17990 - DNA, 1343 bp, Mus musculus
cctgagggcaaaggaccataactccaagtctagagccacactgcctgcagtagcatgcatgagaactgcacttcttagttgaggtatttctgtctgttatttactaactgacaagaggcaaacagctcatactttctgctgcaaggcctcaagctaggcactcccccacccatttcctcttccaatggcaagaaactggatggagagccctccaggacctacactctacggtccagtggtaacccttgccacattgcctgcacaccccatcactagaagcctagacctttctggattaattttaaaaagcccttgcctttagagagccttgttcacaatttggttgcaaattaccatatttctcacaattaaagctctgggcattttgaggtctgagacctttagtggcttggtcacagtctgtttacaaatgatcattgtatcctccaaggttaatgcactgtgcattttaagatctaaaacttctagctatggcttgcccagttatcatggaattatacacagtagaaccatgatcagttgtcttcttagcccacacctctgtaggtcctgcctttgctttaatgacttagtaaccttcgtgcattccatatttgcattttcaagtgccaaggtcttagcacctgcctcatttcagggtctgttatagctctattcacagctgcaactaatctttctgaaaaagtcagtgaaggcttccccgaagcattgtatagtttttgtaaatgatgtggacttctttcttggatcctcaactttgtcccaagctcttaaagctttaaaggacattgttctccgattgtgtcttcaaattgaacttattcctgtatgccagcataacgaccttcacctagcacctggcccatccctacattaattcctctcattctgctgtgctcttccaaaaccctggcttcttgaccatcctccttttccatttctttgacttgactgccctttaacaccattccttacactctttctacctggaaaaaaaactcctctctggttcagtcattggaaatgtccctatctgttctccttgttcttgtttgatatttttcaagtttgtctgcctttgctctcagtttctctagctgcatagccaactctgctatttttgtagaaagaagagagaaatgaccttgtttttcccagttcttccatttttttggattcccaagcttcatttctgtatttttctttagttgctcagcctgccttttgacctgttttataaacaaaatatcttgaaatgaagaaagggagaaaaaaaactgttgctgaatactatgcagagcatgttccaacaacacaacaaa

SEQ ID NO: 17991 - DNA, 1100 bp, Mus musculus
tcttaactccctgccagccctccttccagtttccaggtcagccccttcaaatgtttcccccaatccttagttcctccctcagttccccagcagtctgcttaaacagttccttcttccagttttcccaatactccaaaccataaaaactgttgcagcctatctgctcagctcagctcctcctggctcaactgtctcctaacaatgtcttctgcaccaactgccttcttctctcactctgctactcccttcccttcagcctcagctgtcctgttcccagaaatccaagaggcaaccagcactgaaggtcataggatcaagcaattctataacagttaagactttttaaagggccagttgactagcaactaaagatcctttaaagggccaggcgcacaagacaaatcacactaaaagacccaggtagagaactgtcacagccagtgtgtccatgcagaaaagtagcagtgtcaggtctgtccacatagtcattatgttggcattaataggaacaagaccctgagctgtcccctgtagtccaagggcatcaccaagcagtatctgtcctaaccactaagtccacctctaacaaggtactcctctttagatacatttttattatcaagtctatttttatatgtaagttcccaaagtctcagtattttatataagccactatgaatatttgaagactaatagcattgttacacagtagcaagattgtctatacagagatgtgcagtgttccgaatgcactgcataatcctttgatctatcaggtaatggtatgtgccttttatatggcagaggcattgtctagttggctttagagtagattgccctgttctcattagcatttgtatttaatttagggcaaatgaccagggcatgggcactagcacatccaggaatgtagtgtgaaaacttcttgatgtgttggctacatcattctcatcactattgacacgcccagtgaccccatccttcctgagggctttggtgcacaggtgtattttcatctctcatacagtctccactgttctacctgagtgatagttatattgtatcacccacactgtggttatgataccacaacagtgtgt

SEQ ID NO: 17992 - DNA, 1141 bp, Mus musculus
gagaggcccaccaaagtttggtctagttgacactgattttgaaacactaaggacatcttccatcctgtgatatgctgttggtaaaaatgctgtgaactgccgggcagtggtggcgcacgcctttaatcccagcacttgggaggcagaggcaggcagatttctgagttcgaggccagcctggtctacacagtgagttccaggacagccagggctacacagagaaaccctgtctcaaagaaacaaaaacaaaacaacaaaaaaagattgctgtggactgtacatctaagaggcttgcgaggtgttgctgacgtgcatgtccagggacggtaatggtacctttcacttgacaggttctcacacagcaggaaccacctgacatctacccgctgaacaaccaactgaatgcactactcttcacagagagggagaagaatgctgtttgttttgagctgtaaaaggactgacttggaagccctcttgtgttgtgttacaactgtaaagactgaccagcctgtaggcttcacaagccaggttaccttctttctgccctacacagcagccccttgacacctgtgttcactccttggttgtctgaagctatgctaggcacctgggagcccttgcagaactgggcagcaacttgggaggctggtatgaccttctatatagactcctcagtccctgcagcaggtagaccaaggagcatagtaactattgggcagctttggctcttcgtctacaccagggacattgtcttgagggctcataggggcccaagatggtcatcatttgccttgtggtgtcagttcaggtactgtgtgttttcatgagtactcgaatcgtccagaatattttgggtttttttttttttttttttaggaaaattgaacttcctgagtattctgacattaagtgttagttttaatagagcattgaaaaccctaccatttcaataaagacctggattggaaatgttctgatgtacagagcctggccagacaggatttctatagcttctgagctattgtcatataacctaacactttctggtggccttctgaagaacaaagtagggcaaaggggatgctggtgggtgggggagatgttcttttattttaagtcacatgggcatgtgcgatgg

SEQ ID NO: 17993 - DNA, 1195 bp, Mus musculus
ccagctctcatgtatgtcacacaggcaaaagctccagccatgtgagtcttttttgttagcacagattatgtgctttttagttttgggctgtgtacatagaatttttctctacttcctcttttgattgattattgataattagtttcttgatagtgttcatttgaaaccaggtctcactgtgtttctcgggttggtctaacatctctgcatgtacataatccttcctcctgtgctgagactgattttacctccatgccagctagacttggggcttgagtatgtttatggtagactggaacacttctgtattttccgacagctagggtctttggcatgagactgaatcccatcagtagttttgtagcttctggaaagaacctgtatttgcccctcgttaggctagcactgcatcaaaccagtgtctccaacacatgggccatgcttgctcttgggatctaactcctacttgtcgtgttatagttaatcattttcctgtgtcattatttggttttgtgtcagcattatttccttacagattgaagtaagagcttttctgttcttttctaaagggtgaggctcctggggattatctatagacctctgaccaagtgtcggggatgcaggctatggaaacaggcccaggcaccaatgagatcttcctccatgaccacttgtctacccttgtcttctacccactccagctacagattcatgtttccatagtgttggctttatctggcttttcagaatgctctgccatcctgtcacctcaactctaatgctgtgtgcgtgtgcgtgtatgtgcaagagagagagagagagagagagagtgagttaccttcttttcttgatcatgcttgtcaaaggatctcgtccgcagaggttttatttttttggctggagaactagcttttgggttttactgattaaataggaatgcctctccttcagaggtgcaggaggcagagatgatggcattggtcgtctgggatgtgtgctaaaagtgctttgtgctctattactactcccccacccccactgtctcagtatcgtctggcaatgacccaatgaaccagagctggaagcatcgactggggtttgagctttcatcttgagctaacaggcaaaacctcaaacataaggaagcatagaactagaagccaagcagtgatggcaaggagagggtcaggcccat

SEQ ID NO: 17994 - DNA, 1153 bp, Mus musculus
gtgcatcttgctttagcctcccaagtagctgggattacaggtctgaagcactatgcctgtgctttatattgatataaatgtttattcttttgaaaattagctttctgttttcagcctagatttgttttgattagagagtatgtatacatttgaaatcctggcagatttgacttctaacttaaaaagggttcaaaattaaagtcttgtacgtcatctgaatattgaacactgtgcaagtggaaggtttgttagttatgtagtggtcaaactaaccttctgtgttctgttctcaatagattggaggtggactcagcggaagaggcagcctgacagctactttaatgtcctcaatgctttcctcgacaggaaggacagctactattccatccatcagataggtggggattaagtttgtccttgggttggctctgtacaaagggcagacttcttgggcttcccttaggagctttctaaatctcgcagagttggagaatggggttctaggccactctctggtctctagtctctgtgagctgctctgggtgttccagcactagctcaaacccaagcctgtccttcccctgtacagcctgcagtgagtgactctgtgcagcctgggggagttaggctcctcttggaaggtttgctttgcttttctcaggagggttggagtcctgcccagacctttctatgaagcgtttactaatgtaccaaaagtgaggcgcacacacatacacacactctctcttttgggatggatgtgtttgctaacatgggtctgtttcctgcagcgcaaatgggagttggcgaaggcaagtctataggccagtggtacgggccgaacactgttgcccaggtcctcaagtacgtaatgagcccagcccttctgcttcttggggtcagcatgagttctccttggcatttaccctccttgagtacttattggcacaggaactaaggtattccgattctttgcttatagacccaggggagatccctgggtgactatgccaattgttctgtgattgggattcatgtttaggtcagagccctagtgtggccctgtcctctgtcttgatatacaaatccatctgtaatgagggtgtcttagatctgggaccatggcagttatggtactgtatctgcaggtgct

SEQ ID NO: 17995 - DNA, 1150 bp, Mus musculus
ttctttctcttctcagaaacccatctgggtcacaggaaattgtagatggtttggggccaaaaaggtaaaagtactacagctttttggtgcacaatagacatttagacagcaggtagctccaggcactcacaagtgaagagttcagacctccttggcactcatttccatacctgccacctaaccctggctttctgggccttcaagcttttgatgctctaggtctgctgtcttagaaaaacacctttcctccccctagatatgagcagagtatggcagtgtggggaggaccgttcaagagcctttgctaaaagcccttcccaagaactcgcagatgggtgaggccagagctactccagatgcagcagctctaagtagcccacaaggtagcaagagatccctgcctatcaagtgttgaagacatatttatttcatcttactctttctctcccatatcttgtcccttgacttcagatggggtgggacgggggggggggaaaggccaggacagtttccattcccccggagcttgtttcctgaggccaggagctattgtgctgctgtcgcccagggtctcgctgtaactcctgttgttggtagtaaggggtggacatatggaacactacaacctgagggaactctcagggcttgagaaaggcttcctgaggttgttcattcttagtgtagtttgcaattcttaatgataaataagtttcagtagaaaacaaagtcttgtgtgtgtgtgttgattttttttcccctccagttatgattagctttgattttagtgttaacaagtaaagacttcctgaagttggacaagcagatcctgccctgttcctggccttgctgtgtagccaatgtctgttttccctcatattaaactcatggtcctaaaaaagaaaaagtgaaaggagatataaaaatgagccagcgatgccgggcagtggtggcgcacacctttaatcccagcacttgggaggcagaggcagtcggatttctgagttcaaggccggcctggtttagagtgagttccaggacggccagggctacacagagaagaaaccctgtctcgagaaaaccaaaagccaaaaacaaaaaaaaaaaccaaagagtcagtaatgctggcatacaaagtcaatggcagctactc

SEQ ID NO: 17996 - DNA, 1242 bp, Mus musculus
gcagaggcaggtgaatttctgagttcgaagccagcctggtctacagagtgagttccaggacagccaaggctacacagagaaaacctgtctcggaaaaaaaaaaaaaaaaaaaagaaagaaaggtgcgactgtgtctgtgtagtcctggttgtcctggaactcactatgtagtccaggatggccctgaactcatagagatcttcctgcctctgctttccaaatgctagagctaaagggtgggtgactgttcttgtcaactggaagactgcttagagcaagatgggtagctagtacatctgacttcacctgtatttgggatacagcaggtatgcaggctgctttctacaaatacctggctgaaagaaagaaagcagcacatgaaggacccctgcaggaattcaggttggcttttgcagagccctggctcacctgatgtcaccacatgcactgggaatagaaggacgtggtacagtgatcctttttctgctgtctcccctgtggtgataggtggttgatgcttccaaaagcattgaggaagtccataaagaaatccgtgcacactctgaggacgccatccgaaacgctgcacagaggccactgggggagctatggaaataaatcagcttccattgccaatacaattttctggttctgcaagagactggtagaaggctcacatctctacactattcagcaggagctagttctcagcagaagagatctacaagacccctctcataacctgagatttaagttgtgcagtatctctctttacctactgcttggctgtaaaggtgtagcagtttccttgagatcaattggtgagaaatcacattttttttacagaataaaaatttacccaaaaatatatctcacgagctttggttctgcccctatttatggtccttccaccatggatttgatcagttattaggtcccatgttccaagcctgtgttcttgggtgttatctagtggcacagtgctcataattctaagcccagtgataatgaccttgttggctgttagtgctacaggggccttttacactatcccctctgccacacccactccaaggaagtctgtggggcaagcccaaaagcttggatgcagtcctgaggcaaaaagtttcacagacttagtctcctggactcttggcatcccatactatgaatgctccaaacttgtccctacatcagtccgtgaatggatctgtgtggtttccttcaatattgttttgaaag

SEQ ID NO: 17997 - DNA, 2120 bp, Mus musculus
tttagaagaacaataagtgctcttaacagctgagccatctctccatgaaggagaataactgatagagcatgtgtttgcccatctcccacaaatcttctttctttctcttttctgtttttgagacagggtttctgtgtagctgcggctgtcctatctttagaccaggcgggtatagaactcagactcgtctgcctttgcctcttgattttggggattaaaggcatgtgccgctactgccccgttttgttcttttgagagagtgtctttggctgaccttgaacaatgataaataacgctgagctgcctgtacctccaagtgctggagttgcgtgtgttttgattttgagacaaggtctcctgtggctcagcttaatctggaactatgtagccaaggaactgtcttcttacccttgcaagtgctgttaccacacggaccttaatgtttttaacttttacttttcctcagcaagaatcagatggtgtctgataatatctttatgcaacccttggggatgacagattgccaagtgataatcgtttaaattgtttcttccacatatgttaagagtgattcccgaatggagtattttgtctgtatagggaagccagggcagatagtcggtatgctgtggccatgtagggagggcctctggggttggggtgtcctctttggccctacttttcttctgaaaataaggacatttttagcaagttgatgaagtgggaagatgtatgtaaaaaatgagtaggcaggcatggagtgggtttccaggattgctagtttcctccagtgcttattgaaatacaagattatggcaaaaactcttcctgtctctggaacaaactgcttctaattgtagacactgaggttgaatgggccactgggatatctacatatgccatgccttattttctgagacaaggtccattgtagacagactacagaggatagagctgtggtgccatcctgtttactcttatttctagcaccaccaccaccacccctacttttttctttaaagatttattttgctgggcagtggtggcgcacgcctttaatcccagcacttgggaggcagaggcaggtggatttctgagttggaggccagcctggtctacagagtgagttccaggatagccagagctacacagagaaacccctgtctcgaaaaaacaaaaaacaaacaaacaaacaaaaagatttatttttattttatgtatgtaagtagtgtagctgtctttagacacaacagaagacagcatcagatcccattacagatgactgtgagccaccatatggttgctgggaattgaactcaggacctctggaagagcagtcagtgctctcaggccccaagccatctccccagccccccacccctactttgaagcaaaagactatatcccactcagtttgctttctctgttggcagaatttttccctggattggtgtaaacaaccggacgtgggccttcccaaacctgacctgatcctgttccttcagttacaattgctggacgctgctgcacggggagagtttggccttgagcgatatgagaccgggactttccaaaagcaggttctgttgtgtttccagcagctcatggaagagaaaaacctcaactggaaggtgagtcatggcaatacgctgccattgagcagttctgtggtagtctaccctctgctgacttcagcacagctggtccagtttcccgtggaacctcagggaagctactctggttctctgccatcagactttctggtggtggtggtgattagactccaatgaactccagcaaacttctgcatcttatcctgaacaagcctttagtcatgtgatgtcaccattcagaacatggtcttgcaaactacatcacactttatcataggagtgactcttcagtgcactgtgtatatagttggagtatacttagcaagtatttcagaaggtggggtttgccggtttcacatttagatagattttacttttacctcatactgtgacttattcctgttggccctcagtcataccataggtaccttcttcatcactaccacctgcgattttaccctactgatttttttggaaccctgtgggtcttacatggctgtttccagg

SEQ ID NO: 17998 - DNA, 1431 bp, Mus musculus
ttcattggtcattgatttgggagggcccggctggtggagatggcttagttaataaaatacaggctgaaatgagagcctgggtttagtttcccaggttaaaaaaaaaaaaaacctagtacggttgcttatccaaccgctggagaggtgagacggactcgttcctgggacttgtgagccagccagttcagccaaaactgagcttcaggtagaagctcctctctgaaaacacaaggtggaaaagtactgaaaagggaacataaggttgacttttggccttgcgccctgtacactggacaccaacccctgatcctacaaattaagtaggttgggaattggaacaaccactttgcaggatattttaattttcaaaccaaccagtcaaaagtcttacaagtacttttgaaatcaagacttgcacgtacattacttccttttctcggggagacttctttggcttcagagatggtccaaagctgtctggaggttgaaagttaggtgtaggtgcaaggagagaacttaagtgcaaacccctgtagacttcaggtgaagagtctgacttcagtcgagtgtatctttgtctttctagaaagatcaacggaaatcggcaagcttctgaattcctacttggaaaagaaaacggaactagaggatcactccgtgcacctgctcttctctgcaaaccgctgggaacaagtgtaaagacctgcgtcgttgctccccggttgtaacatgcacacttttgtgtgtggcaagggtgcgagcacctgtgtgtggcatgtgtgcaaacacccgcacgtcgagaccagaggccagcttgggaggtttcctctaccctaccattcgacgccgtatttgagataaaaaaatcgacgtatttgagataaaaaatcgtcgtatttgagataaaaaatcgccgtatttgagataaaacatcgtcgtatttgaccatcgtatttaaccacatccggcttgttttgttttattaaaaggttttttttttgatttggtttttggttttgtttttttgatactaggtttccctacataacagtcctgactatcctggaacttgccttatagaccaggctggcctcataaaaaatatgtattcgtttttgtgtaatataaatggctacctgtatgtgcacctcatgcatacctgctgcccaaggaagacaactcctgtaactagagttactgagagttgtaagctgtcatgtgagttctgggaaccaaacctgggtccttggcaagagcagtaagtgcttttaactgctgaggcaaggtttgttttgttttgtttgtttttgttttttcgagacagggtttctctgtatagccctggctgtcctagaactcactttgtagaccaggctgactttgaactcagaaatctgcctgcctctgcctgggattaaaggcgtgcaccac

SEQ ID NO: 17999 - DNA, 4128 bp, Mus musculus
ctgttgtgccagactgaagagcaagctaatatatttcctcactcatgttgcaatatgatctttcattttaaaactaccttattttgactgatatttaataattcagtggccagttgtaattttggatatttcctaaaacaagaagccgctgcaccatttgcacagaacaatctcacagggacttgccacagtgactttaggagcaggctcccccatcccacaacctcccagcactgggaatggccacaccatcagtgatgtgtgtcagtttgagctgtaggcaaagtgcatggtgcagggtgaacgcattttaacctgttacactgccactgctttgtgactagagggtcagccttgcgtgtccacggtttccaggactgtctgtggcagcatggaagcacagctggtgctctgtgagtaaagtattgtcaggcactgccccatgctgtgctctgacccttactggagaccaggcactcttggccaagatccctctgacgtgtctggaagggaccgggggctcttcccaggtggaagtaccctctgtcgttttgtgcaccaccttttcctgtgaacttacggccctccctggagattgagcttccgttagccttggactgtcagttaccacagccagcactgcccagcagcggacagccagacagccaggctgagcttccagctctctggggattcccgcctatatttttttactgtgaagatgaaattattgtactagcatgaaggtcatgggtctgtgtgtctatgaagtgagtctgtctactgtgagctgatcgtaagaactctgctgtgctgcatcccactaggccagcagcttatgttcaaggggacgatgattatgtgacatgatttgtgactctgtgcccaatagcagttctggaatgaaggtaggaaactggagtgtactctttgtttgaccactgtccacaaaaccagtgttgaactgtcttgaaatattggggggatgtctacccggggcctgttgagatgcatctgtggtgttccttaagagcgacaggctcctgaaagccacggttgacttagaactcctctggcatgttcttcagtaactcaggctctctgagaagaattaaaagagtccaaccggtacctggcctcacctcagaaaaagacctgcaagacagagctgggttatgcaatttctgatgtaagaagaggccggctctttatataatgacaggcacattgttttcttctgatggtcacaaacaaagcagaagggtgttgtctctgccccatacctgtgtcaccatggtcatgttcttactggacaatgtcttgcacagcctatcctagtgaaagaggaagacaggagtggcttgtgtttgtgctactgaatatgttggtctgcgttgacctttcctgggctgtaggtaccaggcaggttagctgtcgttgataggcaagtgcacaagattgtctctaggctaggaagagctttgggaatggggctggcattcttcttggggacccctctcagggtcagattagatagacataacttagcctttaaaaattgtgagggacccccctcccccaaagaccagatctcatgtatcctaggcaggctttgaactcacaatgtagctgagaataacgttcatcttttggtctttcttcacctcccaaatgctgaggttataggtgtgcaccaataggtctgtctggttttgcaatggtagggaccaaacccagaacttttttttttttttttttggtttttcaagacaagatttctctgtgtagctctggctgtcctggaacccactgtgtatatgactaggctgaactccaactcagagattctcctgcctctgccttccaagtgctaggactagagaagcatgccccaccaccgccagctccaacccagaactcttgagtgttaggtaagccttctgcagattgagtcacaccccagccttctctttattcttctaccatttgttctctttcttcagtgcttggggtcaggcctcatgcttccttttaatcttaaattttagattatttatttatttattgggaggcagggctttattatgtaaaagactagctttgaacttgcagtcatcttgctggagctaggcaatgctgggaccacagatggccgccactgtgtctggactgctttttacagtttctgtaactacaggacgtttttaatcagatcttgcttggtaatgccttagaagctgggttactatgtgagattcagcctgaggcagctgagtcctttgatgatcaggaagaagtggcgtttactggtggcggtgttagaggctggatgagttccatcttctggcttcctgaggtcatgctggctctttccctgaggtcttctacctggggccaccctacatactggcttctgatttttatttattttgtgagttcctatgattatctcctttttgacagttataatgtcatgaaaataagatgcatatagcttggcaaaaaaaaaaaaacagaattcgtgagtttggggatttacctccatggtggaaaaccatgcctaacaagtgtgaagtgtaatgtggtattggctgtatgtaggtgaacaaagctgccttccaaaagtgatggtctaggttagatccctggcaacaaaatggggggaaaacagaaaggaaaatctgtgggttgtggctggtattctgatggaaggcttgttcccactgcttctgtgtgtaagcaaagagggaacttcaggagacgcgttccggcaccagctccgcctcagatgtggagaagccacgagcacacccctcagccctgctccagaagcctgagtgtctccatcgctggatcagacactctcatgcctgctggtcgagacctggctcttaagctgtccttgcttcatcaacagactggcagctgctttgcctgagccaaggctgggtcttccctgtgtaattccccttgtaagtacaggagtgttttgctgagaggaggggtcatctttcttgttttctgtgcacattatcaatagtttattatagaagaagcatgatgaattagtaaaaaattgagcccctagatctgtgaacatgttagtggtgtaatgggtccaagcagcactgaccattcgcctatccagcaggtgggatcagtaggaggcaggctgccagccgtgtcttccactctacagtgaagagccctgtagtgtgaggttttgtggatggctggggaagtgggcacctgcttgctcctgtgtatacagcatcttgccttctatccctcatttgaccccagaaggccttggcggggatgcttcatccagagagcaacttctccatgtgatcacggtgccagggttggccctgttagagggctgggaggttaggtaagtcttaagggtttgaaatcaaacagcgaggaacctttgtttcaggctttgaaactctgttttctatgaacagagattgattggtcttcactgcctatgcccaaaggagctttaaagcaggggaggtctaagaagtgtcttttccctcagaatgtgctgtggtcgttgctcttcgccacactccatccatcaggatgatccagctttaacatgaatgtcacattttattttcaaggaattattacctatgtcccctttgtaaaggagagatactatggtaaatctttttattaaataatgtaaagatgtatatctgtatttttggatcatggattatggatatattgtttaataaagtatttttgggaagaaacatttgaaagtagatcattttgaaaacaggtatgttgatccctgtgctatgtcaaaggtgagcatatgtcatgttcagttactcaaagtcaaggatgccaagggggaccctatagacctaggaccctgagtttggttttggttgggtatttagggaggtcagcggccagtgctgtatttccagactcccagggaagatgtgtgcatgaatgggagtaccaggggctgctttataaagtagtattgaggggctgggatgtgtctcagtggtagaacacttgcctggcatgtgcaaggccctagattcatcctcagcaatgtgaaggaaagtactgggtcccctggtgtggggacctaga

SEQ ID NO: 18000 - DNA, 1221 bp, Mus musculus
tctatcttttaaaaaaatattatttatttaatatatacaagtacactgtagctgtcttcagacactccagaagagggcatcagatcccattagagagggttgtgagccaccatgtggttgctgggatttgaactcagaacttcttgaagagcagtcggtgcttttcaccgctgagccatctccccagcccctcctcttccaccttatagaaactcttgtcagtgtatttaagggtccacttagttcaggatgatcttaatatgagattttttttttttttaatttaagggatgtatatgtctacctgtgagagtggatttgtgcacttggatgcagtacatgtggaagccagaaggtggcagtggcgtcggatcccctggagcttccaagtgtggattctgggaccaaattctaggccccctgaactgctcttacctaatcagccatgttcagctcttattctgtcaagagcctatgtctgtattggacatggagcgggaggggctcctgtccctgtgggtagcctttctctggcttggctggggccttttcagctagactttcctcttggtttggcatttctctggactgtcttggtggttttgagccccttgttccttgttttttttgttgagcccattagccatagctcctcattttatcagtgtctacttagaaaggtctacgtgtaccacaggagtggactctttctgttgttacactgcctactatgagctgggcacctggttgtctgttgggaaacccagtgcagacttaatttcgcacctacctttgacagcagtattcacagcactgagctcgttcatgcaggatggctgaacaccctgaacacagccaacagaaatttccctggtgaccagggtctctgagttaggacagccagcctactcagaaaaggggttcttctgataagaagcagtatgcctttcagaatcgccaggacaggagatgtgtagagcttgagtcttagggtgacatggtaagagaacagagctgtaccatattgtctctgcagccaccactgccttagggctccaggggatgctgggaagtagaaagaagcttgatcctcctgggtggctgtggttaccaatgctgccccaagcttagaggggctcccactgggcatcagacagactagggcagtaaacagtgaagaaggcatgaaaggcctagaaaggagattcagtttgggggaaa

SEQ ID NO: 18001 - DNA, 1405 bp, Mus musculus
caccaccaatgaagacttcagggcagctgacaaatcaggctctgctctcgagccttcagtagaaagtgtgaagactggtatcaggactggctttttgaaaattgatgaatatatgcgcaacttctcagacctgaggaacgggatggacaggagcggctcgactgcagtgggcgtgatggtctcccctacacacatgtacttcatcaactgtggtgactcttgagctgttctgtgtaggaacggacaggtctgcttttctacccaggatcacaaaccttgtaatccagtggagaaggagcgcatccaaaacgcaggagacagtgtgatgatccagcgtgtgaacggctcactagcagtgtctcgggctctgggggactatgactacaagtgtgtggatggcaagggccctacagggcagcttgtttctccagagcctgaggtttatgagattgtgagagcagaagaggatgagtttgtcgtcttggcctgtgatgggatctgggatgtgatgagcaatgaggagctctgtgagtttgttaagtctaggcttgaggtgtcggacgacctggagaatgtgtgcaattgggtagtggacacttgtttacataagggaagtcgagataacatgagtgttgtattagtttgcttttcaaatgcccccaaggtctcagaggaagccgtgaagagagattcagagttgtataagcacttggaatcacgggttgaagaaatcatgcagaagtctggggaggaaggaatgcctgatcttgcccatgtgatgcgcattttgtctgcagaaaatatcccaaatttacctcccgggggaggtctcgctggcaagcgccatgttattgaagctgtttatagtagacttaatccacacaaagacaatgatgggggcgctggcgatctagaagactcattggtagccttataaccttctaaaatgcttttgattctgaaaattgggggaaacttttaatcacattttcttcaatacaaggggaaatattcttgtgaattcacactgttttgtgatatgagcagaaaccattagcatttcccaccattgcctcccatttgtgttccccgtacttaccactcttagcattgcctggactctacagtattttttgccaacctcaggcatctggttacaactgtattgaatttttggccctagaaaaacaaaatggcctacaaatgaacaaatgtgcctggggtgcgtgggaatagctagctatcctctgaaggtgcgttatgggtttgtttggggttttttaagcaacacaaaacacagcacagacgcacgtaagagtaaggactgagaaaggtccgagcttcccagctcactaaggcaggaggaagccttgttagttctgtggcctggagtttcatgtgagca

SEQ ID NO: 18002 - DNA, 1282 bp, Mus musculus
cactgaaataatttgttaatgttctgtgaaaatttttattgtgaatatgaatgagattttattactcataatatgtataaaattattttgaataattaaaattacagtttaaaggataatatccaaagtaattaatagtgacattatcatatgatcagagtggcttacaataaagattttttcttagttttatgttattctcttcaaaacttctgaatctttaaatgtgtttataaaccagtgttattcatgtttctatttattcattttacagatgagtatgtgcctttcatgagaagatttccatatttctactgaagaacagagtttctatgtctaaggaataagaagccactctatcaaggggaggggaatttaagttacatacattatgtcaacctttaatttgttgatactcaatccatagtgcatcatttggttacaactttgtatatttggaactgctgtatttattagtgtgctctgtgttattagggacaaactgtactatgctggattttctgtttgaaaattattttaaaactgttttctgcagagcttttgtccctgtcttttaccatattattgtaacttggctttctttattaatccattgttgttgctttcgttttgtcagtgtcataatgtaaagaactataagccacagctaactgctatgaataaatacaattctactaaactttttcccgtttttatggagaaagagccaaatctactgttatttttgagtttgtaagtagtaataattgtctgtgctaaagtatgaaaaagaataaatatgatttaaaattatttaagtggtacagatagaatgtgtttataaaataaatactgcataattatatattaacatgtgttttatatttatatactgagtccaaaacatatgtttccttgactatagtgtctcagtggatctctgagtttgaggtcaaggaagaatcagacaaagaaggttgactatcttgctagagattagatatttttggaaatctatgaatttcaaatacatttgtagtataatgagagagagttaatatagattgcatggttataagtctgagtcttgtcagagatcaagagattgaaaattttcatctgtagacttcgaagtcaggattttatctagagactagcattatcttgcaacaaatccattcccacccaggtctgatttttacatattttaaaatttagaagaaaacttagagaaaactccattgcttgttagcatcagtgaggtcattgaaatgtgtgacaa

SEQ ID NO: 18003 - DNA, 1632 bp, Mus musculus
attcttgtctataaaatttagattacatagattaatatagagccaaattccatcaaaaagtagtatttccatagttaaatggaaatatagctctgaattttcccactctaatgaaaacatactatatttaggcatgggtaagtcacatattaaccaatgaggccaaagattggcataaagacttgatctgccaaatgaaggggttatgtaccaaaatatctgatacagccagaaatttttaaaaaggagagagagaaaatcttttatatgactgatgatggtatttagaaatatcttgggattacgattagaaattggttctgtgtgacacacaagtatgagagtctgatttgcaataccagattgttgaggccagccagcggctcacatgtctgggttcgagcctgggaggcatcttggaatctggaagaaaagagggaacctagggggtgcaagaaaggatggaaccgccttttgtgactggcggtgaacgagtgcgcagtgccatgaaggcctcgggcacgcttcgggagtacaaggtggtggggcgctgcttgccaaccccaaaatgccacacaccaccactgtaccgtatgcgaatctttgcacccaaccatgtggtggccaagtcccgcttctggtactttgtgtcacagctgaagaagatgaagaagtcatccggggaaattgtgtactgcagacaggtgtttgagaagtcacccctgcgtgtgaagaactttggcatctggctgcgctatgactcccgcagtggcacacacaacatgtatcgggagtacagggacctgaccactgctggtgcagtcacacagtgctaccgagacatgggtgcccgacaccgtgcccgtgcccactccatccagatcatgaaggtggaagagattgcagctggcaagtgccgccggccagctgtcaagcagttccacgactccaagatcaaattcccactgccccaccgtgtgttgcggagccagcacaagccacgcttcaccaccaagaggcccaacaccttcttctagacacagagacccactgaataaaaacttgagactgtcaaaaaaaaaaaaaaaaaaaaaagaaaggatggaaccaagacattagtctgattaaggttcaattttaatattcagaacacagggttataaagaagggggaggggcccattcccaccaaatcatccttggagtccagttgcaggtgaccacgtgaatactccagaacagctaggcggcaggtagcagcagcaggagtgtcagaacgatagagtggcgggctccacacccaatgatctcctggtgataacagtcaagcctgatcagcctgagttcaggctggggcaggggggtgatgtggggggggggagggaggttacatctcctccctgttgttaatataaaaaagaaagtctgagctgaggcataaaatttatttatgctctatagttctgcctgaattcttagggtctaatgaagaaacctgtctcagtgggattccctaacttttctcatagtaaacccttattgggttaagactgtcctttctgtccaaataaacattttgcagagtagcactgaactgttggctccatcttttgtaatgctaaattagttactg

SEQ ID NO: 18004 - DNA, 1103 bp, Mus musculus
agaaagccaacattcacgtggaaactgaacaacactctaatcaatgataccttggtcaaggaagaaataaagaaagaaattgaagacattttagagtttaatgaagatgaagccacaacatatccaaacttatggaatacaatgaaagcagtcctaagaggaaaactcatagctttgagtgcctccaaaaagaaactacagagagcatacactagcagtctgacagcacacctagaagctctagaacgaaaggaagcaaattcatccaagaggagtagatggcaggaaataattaaacttagggatgaaatcaacaattggaaacaaaaacgactattcaatgaatcaaccaaaccaggagctggttctttgagaaaatcaacaagatagataaatgcttaggcagactaactagagggacagtatcctaactaacaaaatcagaaatgaaaaaggagacataacaacagagcctgaggaaatccaaaacatcatcagatcctactacaaaaggctactcaacaaaactggaaaacctggacgaaatggacaacttcctagatagataccaagtaggatcagattaacgatctttacagccctattttccctaaagaaatagaagcagtcattaatagtctcccaaccaaaaaaaagcccaggaccagatggggttagtacagagttctatcagaccttcaaagaagacctaattacaactctcctcaaactattctacaaaatagaaacagaaggtaccctacccaattcatcctatgaagccacaattactctgatacctaaaccacacatagatgcaacaaagaaagagaactacagaccaattccccttatgaatatcgatgcaaaaatactcaataaaatcctcacaaaccgaatccaagaacacatcaaaatgatcatccaacatgaccaagtaggcttcatcccagtgatgcagggatgggttaatatacagaaatccatcaacataaagcactgtataaacaaactcaaagacaaaaatcacatgatcatcttgttagatgctgtgaatgcatttgaaaaaatcccacaccccttcatgataaaagtcatgaaac

SEQ ID NO: 18005 - DNA, 1210 bp, Mus musculus
catgttatttatattctcttaggtaagtctacatgtgtatgaaatacagttaattttcatagtctcaattctgtctgaacacaaattatttaataactaaaaacttgagctattccaatcacacgtttcacagtaaagtatattagaaaaaagtttatgacataaataaatggtttttagaatatgattgtgttctttaaaaggaaatgacatctatcattccaagaaatactgtgttatgttgctacctaaatataataaccataataatcaatatattattttgatgatttaatagtttaagataaacaattgcaaataaaataaaaacaaccataaaaagcatacaataagaactagattgatgtgctcgcttcggcagcacatatactaaaattggaacgatacagagaagattagcatggcccctgcgcaaggatgacacgcaaattcgtgaagcgttccatatttttcagtttcactcaaccaataaagtttttaaaattgtaacaaagctcttaggatttacacatttatatttaaacattgatacatgaatattgactgactgttgataaagtcagagacaacttttcctgagatctcaccatggaaatctgtacacccccttgtctttcctaaaagctgaaagtggctgactaaaatgcaaagcagctgttgatgttttgaagatagtgataaacactgttctttgttagttttgggcacagcatgctaaactataacttgtattgttccaatatgtaacacagagggccaggtcatgaataatgacattacaatgggctgttgcactgttaatatttttcctttggaatgtgaaggtctgaatgagggttttgattttgaatgtttcagtgtttttgagaagccttgcttacattttatggtgtagtcattggaaatggaaaaatggcattatatatatattatatatatataaatatatatattatacgtactctccttactttatttcagttaccatccccatagaatttgacaagaattgctatgactgaaagggttttgagtcctaattcaaactttctttatgacagtattcacgattagcctgaagtgcattctgtaggtgatctctcccgtgtttctggaatgctttcttagactcttggatgtgcagcagcttatgtgtctgaaatgacttgaaggcatcacctttaagaag

SEQ ID NO: 18006 - DNA, 1274 bp, Mus musculus
aactgagtgcaaattctaaatttcagtcctgaaaagatctattcaaaactaaggaggtgattatattcgtgttgtttttacaaattaaatcttctacattaattagtttccctagccaaccaccccacaccccgtaccatccatgttagctctttatgagtttcatgaatcaggttctccatcagggcagcacaagtccagaaaaaagacctggaaaactccagaattcacagaagactctagaattcacagaatttacattgctgtgtctggtggcaatctaggtgtggctcatgatttcagcacctgggagctcttataagctgaaattcaagaaggaggagggatgagctaggagttagattcacaagctccttcaatattcaaagattagaggggtcagtctcaggaaactgagggctagacctacttgtctcaggaacttacttaccaaaaatcattttgaaaaaatatagccaaaattcaggtatttgggaagccaacacttccatcaagcaagggaacagcacaagaaagacagggaaagccacaggatacctccgatgagaatattcttccccactttctgggcacatcttaaatactgcctccattgtgatcaagggtaataggagtcagattttctacaatcccatgtgtagaagtatggcaccctgtggaataggataagctaatgcaatcctaagaagcttagcgatagaaccgtgaaataagaacaagaaaggaaataagaagtctgcacaggtagaagagtatatggtcccttagggagaagaaacaaaaaaattccaaacatattgtctgataaataggacagtagagaattggtctccataatgattagtgttcatcaaaaggacattttctccagtttactcagtttagatatattcctttcacactttttaaacaaacttgcaagagaaaattgctaaagggaaccaataattttggcactcggatatacatatttagaaagaatacctccatttggaataaagtgaacacactactgtaatcttccatttgtaaattcattcatattataagtgttggtttacagcttttagaatatattttcatgatatgtgcttgccacagcttataattatttcaaaatcactttcaggtgtacctgctgtaattttgtacataattaaatctatcttaaaatttcttatattttaattttcttaactgcagaaaataaaaatataaaactctttcttaaccatggaaaaattgtgtacatt

SEQ ID NO: 18007 - DNA, 1175 bp, Mus musculus
tagatcaaaagttcagaaaattgtatttaaaatattatggttaaaagaagcattttgttaaagttgtgcacataaggtaattttaccgtggcacttatcaaaattatagtgtttgttctttcaaactagctcacataatgatattgtcagcatgaatgcctctatgccccctgtaatgagaaagaagagttagaaggaagacattatctgggtaattatggtctactgaaagtaatatatgcagaacaagaggaagtgtttaaccattatatccttgtcaagttgttttatgtcatgagccaataataggctacgagctgaagttagcagccacaaagtcaaatacaggtacttcatatatgtggcttgttacaatgtgcttcctttcttacaaggtctaatgactctcagcactattggctccctatagactagacagtggcaaggtgatacaaagacatgtttgaattgtacaacaactttgacatttttgtatttaaatttcaggtatattataattgttcctgtatagaaaggaaaatcacttctactgcagaaagtactgattttgaagctaaagctggaaaatgtagaactcggtgttcaaacttgcccatatttcttggcattttcttcattacagttatctttacctttatggcaggcactcctataactgtgtctatattaaggtaagcactgcacttgagaacttgcatttccaagaaaagaatgttgtaaacttagaggttcaagtaggcttttattgatttgaacaatacctgtctggggcatcttggactctcagactccatagaagaccaggtgcctgaggtttaaagaagctaatgcaggaaacatcttctgttgcccaggtcgcaaatgttgggcattagtcccttggtgggtttcacacatgaccagtgtgagctgcaaatttgataagttgtgtggaagtcttctggcataatcacagtctgttttctaaattgaagagtgggtgctggcaaatgaactcgctacaaaatgctaagaagctagctgccatctccgaaatagatggaggtctttattgttgttttttttccatttaatgctgttctacaagagtctttaccttccatctggaggtttaccgcctgttttcaaacaaacactaggctttctctttcttt

SEQ ID NO: 18008 - DNA, 1176 bp, Mus musculus
aaggttaagtaattttctttctttctgttttttgtgttttgttttttttttttttttcttcctcaacattggtaaaaatgcggtttgtggtgaggaaaaaaaaagaggaaattctatcttcatagacatgttccttaaaagtgcacacactggtcagtgttagccttaatgagctcttttgtattatttttaatcgtcttgcccattagatgcaattgcacgcatcggagtcaagcagaatttctgttttagcactgtgcgacagctctgtgatcccatctagataccgtcaactagaaattgccatggtaacttcttagttaaggctgtgcctggtgtaaagttcagcagtcccctgaacagtagtgtagaaatatgatgaagtctgtggtgattgaaatggctgtctgctttctgtttgtcactagagatggtagttacaacactacagaagtaaaaactttcccatagattgtatttgcatttcgttagaagcaccttggtcttgatgtcttgccaaaatgtggccaaatattttgaaacttccacatttaagacttaaggaaagaattactagtgtagctcagctaattggatcctcctatcacacaattaaatgtggccgttttagtagacacctttgcctaattttgaataacttcattctctgattttcagcgtagtaatggggcgttctaagactttcaggaaaagatagactagtaagaatagaatggagaaggaaaatcatcttaggatagcctcacctaggccattcactattaatttaacatcatccaatcttttaaaatgtatatgtgtgtgcaaataatcccagtgtggcattgaccttgcttctactcacgcactcacacccagtcttcactcacactcatcactcatccatcagtctaccacatgcaaatgcatagctgcacatacatatttaaaatgcagcttagtgaaacaactggctgagcctatgcatataaatatgtctagttataacatatgttgggtatctctgctattaatagagatggagctgtagaatctatgtcttgtattacttaattttatagataatgtatttaattaagcctcctttgttatgttcttattaatatattttatgattctggttcaaaaggttctagttattgtttgtttatggct

SEQ ID NO: 18009 - DNA, 1161 bp, Mus musculus
cagcctcctgtgaccaagggtatactcttggagactgccttcagacttcaatggaacaccagatttctgggtctctaccagctacccagtaaaagtttgggacttgttaatctctatagtgaaggaggtcatttcttagaccatattttacttacatactccacctccccagaccactttggttcccgcttttgatatactaatatatcatattaattcatcaatgagtatgttttattctgattccaaaatatatccaacagtcatctattttgttctgtttctactgccattaaattctaaaagtcacaaatctctaaatgatggtaatagcctctgctacaacgaaatatgaaaggtttgacaaagctatcagtgttaaaaatttggtttccagattgttgctagtgggatatgatgaaagacttgggagccagtagacatgacacatggttaggaggaggctggtgtttctcctcactgtgaagcaaggactgattttgcactctttcctatgagcaccggtctcagcacaaggttataggcaatgaggccatccatggacagaaatctcagaaactgtgaaacaaaataaacattgtttatcataacataatcatctctattatttcatcaaagtgacatgtaattgactaacacagatttctttggggttcccacacttccactaatgatccacaatttatttttgagataacattcaaaattactctttaaaaattgtttgtattgtatttgttaagaaactgtttacatggggggtgggatgggtggagaggtggctcagcagttaagagcaccggctgcttgtccagaggtcttcagttcacttcccagcaaccacatggtgttgggatccgatgcattcctctggtgtgtctgaagagagtgacagtgtactcacatatataaaataagtaaatcttattttaaaaaaagaaaaaagaaagaaaccgtgtgtatgtgtgtgtgtgtgtttgtgtgtgtgtatgtgtgtgcaatatgccacggtatgtaggtggaagtcaaggatttagggtgtcaattctttccttccattatggattccaggatggagctgaagtaccaggcttctgtgaaaaggactttgccccctaggccatcttggtgtaccaaaat

SEQ ID NO: 18010 - DNA, 1138 bp, Mus musculus
ccagtagacagtgcctggcccctttcaagggaacatgttagggtgatcactgacatcttgacactggcaattttcacagtgggtcattgggtatcattaactgttcagaagacagcagatgttaaaaaattctatatatgcaagagaaattcttaaagataatgtgaaatgatgtctattagatgtgcttccctggcttattatcatcactagaggaaattctaagagaagttgagtcccattggaaggcctgcatgaaggaatgaaatgatgagtagaaaatgggtaaataggactgaatgcctaatagacaaagtacgaacatattgtagaatcaaatccctgctaggatacttaatagtatacactgaatgactaaattcaaaaaagccacctgcagtccttactatttgttatgagggtgaaatctatagagacatcagagctgtttgttgtattgtaaatatgctttctgtggattcttccaacatgtgccgtattttacaacagagaaaaataaaactttattcaaccaactgatttcatccaccataaacttcagtttcagtccacagaacccttggtgctcctaaaagattctcctggtctccatcgtcgtggtctgcagtctctccaggacaaaagtagatatctctactcttccactcttccctctgctttctttctacttcctgctttttccatacaattcctcaacttcctaccacagaaaccaaagtttcctcaacatcagaatttacctttcctgtttctctcctgttgtaatgataaagcagtgcctgcatcaatctaagataaaccattctattccttccgagggattttattctctctcctccttatgcaacatctgtcttattagtgaacccctgggtttagttggcatttaaacccagacacatttaaacacactctctcttttttaacccacatgccaaagtcataaaattatttttctaataatatcaatccaatatgtttttcatgactaaatctcttgaagacatttccccaagtctctatctttactttctcactccctgattaatctgttagaatttcaaatatttttatctcagtttcccttagatcaaagactgaggaaaattattgatgt

SEQ ID NO: 18011 - DNA, 2064 bp, Mus musculus
ggtgaggaactcctgaagttagcccagaagtgcacaggaggggaagacagcaagggagaagccatgcccgccttgcgcgctaaacagctggacacgggactcgcgcgttcctctcgtctgtataaaactagaagtaggtactatcagccatatgagatcccagcggttaatggcaggaggcgaaggcggatgcccagctcaggagacaagtgcaccaaacccttaccttatgaaccttataaggccctccatgggcccttgcctctatgtcttcttaaaggtaagagggctcactccaaatctctggactacctcaatctagataaaatgaacatcaaggagccagctgacacggaagtgctacagtaccagcttcagcacctgaccctccgaggggaccgagtgtttgctagaaacaatacatgagtggcgtgggcagagtttaaaccactttaggtcagcctatgctcggctagagaaaaatctactgtcgtactctgtacatgacccttcacgttagagatggttatatcagctaagtgttcctggaacataaaaattgtttggatcaagttttggatacaggaatgaaatcacaggtacttggggcggggcggggggatatcattctagagcacgcaattgcaaagaaaaccgaatgttgactgttagtttgcatagctttttagctaggaaaaggctttggtgcagtaatttcacctttatgagtctgacacccaaattgggaatgttacctgcttggttgttgctaacttggtatgattcattagaaatttataccgaagtacccagtgcttcttggatctctgtattttactataaaatgtatgtaatgatttgtcttatgaaatttaaagcttgaacacggctgaactggaccactttttatttttaaatattgagtttaaatattttataactggttttgcactgaaaacaattaacatttcagataattaagagaataatctttcttcacttgcctcaataatgatattgagcaatggatttttttttttaatttccgcatggaaagttactgatctttatggctgtaaaatattcctttctagcattattaaagtgtgtcttaataaaattaaatttgggatacaaagtatttattttacgatgggtagcgggtggggcgcttttcagaatgtttccaatatgaagttttcgtcagttggaaacatttccttagtgcttattatcaatttaaattccacatggaacttgaagacagggaggattctcagcactgggttgtcagtatagtgctgcttgcatctttacttcttgtaagtgactgcagctctagcagaggagctcctgattttgactatcaaaggcttaaactgagtatgaagtgataccgctcagcccagggttgggtctttccaggctcagttctctgcagcgaggcactcatcaaaactttagttcgggattagcgtaggagcccaacatactcctacagttttaatgggctaatcctggattacctaagagtttacgtccatcacactggtttgatttgttgctaaagaaataattccttgcctttagtaacagaagcagctcaactattcttgaccataaatgtatgtaactttccttttgtaaacatttctatttcttttactcagtcttaaaggtgcaatttattactgatttggcatttctggctatatagaactacgtagtttatgttttctttgggggcactgtgagtttctaaggggttagcagtcttgcttttaaaaataagaacactttttaattggcggatgggccattcctggaacaatcgtgatttttccctctgtccagaatgaatggcaagctttattagagcagaataagtcttagaaacctcagaaactcttcatagagagacaaccgtgttggcaacatgtaggaaagagctttggagatgctggcttccatcttactgaatcgattagagttttcaatggctggaaagtttctgctgttgtctattttaaagtaaactgcacctttgtaacatattgatgaatg

SEQ ID NO: 18012 - DNA, 1723 bp, Mus musculus
ttacttttctgtatttgtgttgacttgtaaaacattagtgtcatattgaaagcctgcaatgttttatcataactgtagcgcatacagccacatcgcccaccagcgttctcttaaccctgttgattggtgcaaatcccaacggcactggttctttcttctgtttgtatagcagccggcggaccatctcaggcaatggctccccatacctcatctcggaagaagagcataaatagcaaaaccgaggggcatgaacccaagaaaagcactgggaagaaaagatgagcacacaccagaaccgaaagtttccatgcttataaagggacttgttgcttagcaaaaagaatgtctaagaaaccttgactgaagctggtcagagccagtgattcatgtgttatcatgctttactttatacatctgtgtatttctttaaacacctcgaaagctagaggacctcctgtttttattcaaacaaggagctctggcaggatctagaaatgttcaaaagaatgtctgtccgctttgtgtaaggaaattcatgacaactgctattgctgtcactgtgatgattcccatgtgcctgtggcagagacaaaggacacaggaacccggctgactggtaccaaagtgcactctcttcaggtgcctctacacacatgcatttctacagaattacacttagcgagtgggattggacaggcaaagatcatgtgttgatgactttttttaaaaagtacatttccaaagagatctcgttgaccatttacattacaatgtttttgtcattgctacagtaacatatgctgcaatatttattgactggattatatagaccatgaattattttttcaatttgtgctttgaattttttattgtgaattatttaaaatattacaaatgcaggtgggagaactatacctttatacacataaatttacaagttaatctgtagaaaatattttctttatacatatctttaccatcaagaaaaatttcttggttcaccaagaaaaggtttttttttttttttgtattagcaagagaggcaattttttagagtttctttttatgaactgtaactgctaaatttgtaaatcttacacgtgattttctgagtttttcttgagacctatggactcaggtctatgatgcgagttctgctgttcataagtgtcatccagggtatagttcttgtgtttccattcttatgtccagtgtatttgatgatttcaccaagaaaactcaaaagattgaacatttgtagtaagtaaatggtgtttacaaatgatgagatttggaagaaagatggagatgactattgtaatttcgtctaatatttaaataaaaggacatcattctccttggtgctctttctccctgatgcacaagtaattgtttgaaatattttaaattactcacaaactaaacaacctgctaaataaaaatctcaaacattggctataatgcaacttaaggtagtaagctgtagcttcaagcttatgtttagaagtactggacccttattgtatagttagtgtaattcttcaaaagagacttctaaccttaaataatcttacatgaactgacttctagagaataggcgtattatattatcttggttgtttaaaaagggatgagatacagaagctccaaatatatacaaataaataagtacatatatacttcacttgaatgtaaatggattatatggtggtaaatcttgtaa

SEQ ID NO: 18013 - DNA, 1188 bp, Mus musculus
aggatggccgcttccagtctgagtgggtcgggccttgtgtcatcgactacattacagaaagtggatgtgctgtcctcagagataacacgggaaccagactcaaacgacctatcaaaatgtcccaccttaggccctatgtgagagagtccagtgagcagggtaagtatctgctacctctctagggtgttagtttccacaagaaagattagactttcaacctaccttccttccttccttccttccttccttccttcggttaaaatcctctccatctaagttttataaaacttgatggtcttacttctctccaggagtctgattagaatgtactttcataaactcatttttctttttagttttttgttgaaaatagatttttatacaatatattctgattatctttttttcatccaatatattctgattacctttttcccttctctaactacctcagatcctccccacccccccccccaccctcatccactctttttctttctctttcattaggaaacaagcatgtaagattgattaatgagtgattgattgattgatgttgttatataatataaagcaaacaatgcaggatttttgtcttgaattctactgtgcttttcataactgctatgaaaaatgctgaacctgtttcacataaggaacgattccatcttgagttttgcatactatcctcttacctgctgcctcatttttatgtgaaaaagtagcagctcagatcattatcgccaaagagaagcatgttgtccagaatctagctgtgaaataactaagggaactttgaaactgtgtttccttttaatgttgcttcataaagtcataaattaaggtggaggatggagaatactcagaaagctatagaattataccattgcattccatttatagtcccccaagctatgccaaagagcaccctggctatgccagagagcaccctgactatgccagagagcaccctgactatgccagagagcaccttgactatgccagagagcaccctatgccagagagcaccctgactatgccagagagcaccctgactatgccagagagcaccttgactatgccagagagcaccctgactaagccagagagcaccctgactatgccagagagcaccctgactatgccagagagcaccctgactataccagagagcaccctgactatgcc

SEQ ID NO: 18014 - DNA, 1150 bp, Mus musculus
ctgattgggtctcaaaactaaagcagataaatatggtaaatatggaaaggggactttagggtaggagagagggttaaagggggtgggaggaacatgagcagagctttggggcaagaggagcctgaatgtgtaggatccctgtatgaatatgtctgaggagacattcaatagtcagttttttaaaacaggagaaatatgaaagaaaaagtaaacacaaataagtcacaaagtaccaaatccaactgccctgaaaaaaaaaacaacttatgaatttccagtttttaaaagaatctcaagtcagtggttataggtccccattgctttgctcagtgtctagaactgtgccccacagagtcaggatgcaatgaacagctgccgttggctggagttgctttggtgggaattaaggtcactttcgtttgagtcacatgctatgtctaatttttctgtcattctgtaatagatgtaagtacagcctcatcccaataacaaatgcctttgcatttggcagcactttgacatgcctcatgatattgtggcttctgaagatgggactgtgtacattggcgacgcacacacaaacaccgtgtggaagttcaccctcactgaaagcaggctgggtttgtttttcatttgttcatttttatagtacttctgactgtaatttccatctgttttattgtttaaaatgggaaacaaaaacatttgcttttgaataggaaacagggatataaggggtttgggtttggggttcagcacgtgtctggcatcttcagctttctattccttgtactacaaaggacgagaaatgaagagcgatgagaggaggaggaggaggaagggatggggtccttatttggtatccaattcagggattcaataaggtttgaaatgtggagagagaggggttttgttttttggtttgttttttttttttttgttttggtttggttttttcttttttcattttcctggcagtcattgccttgtttccagagacactccacaggaaatttttgatgtgtgaagtaatgtctgttacattaaaagccagtgttaattccagcttggttacagaaggaagagacagctttgacaaagcagaggttggcttgttgccacgagctatcaccccatgtggctctctgta

SEQ ID NO: 18015 - DNA, 1562 bp, Mus musculus
cctctccccctgcccacttacttgaactatgtgcttttcaaatcttccagctaaaggtgaactattgatttgctatgctgtgcttacatgtgctctattttagggaaaagacatatagtcttttctccatgcagaaattattctttatctcaaaaatggggcataagtaagaacatgtgtaggactatgatgtttcatgtcaaaaccgacactggatctgttatagaagttctcccccaaaataactgagtaagatacttgcctcctgcccacttcatttttctcttcctttctctccttctctcctccatacttttatttcctttcctgtctttacattctttgcatcctgggaaataaacagtggaaataacatttcaattgttaaagaaattataatcttaagaatgtaaattcatggctagctgccatcttgcgtccccgcgtgtgtgcgccttctctcagctggtctgcccgagaccccctgagcgtgaaccttagttccccgcgcggcgccatttccactccgacaagatgaaagaaacgatcatgaaccaggagaaactcgccaaactgcaggcacaagtgcgcattggtgggaaaggaactgctcgtaggaagaagaaggtggttcacagaacggccacagcagacgataagaaactgcagttctccttaaagaagttaggggtgaacaacatctctggtattgaagaggtgaacatgtttacaaaccaaggaacagtgatccattttaacaaccctaaagttcaggcatccctggcagcaaacaccttcaccattacgggccacgctgagacaaagcagctgacagaaatgcttcccagcatcctcaaccagctcggtgcagacagcctgactagtttaaggagactggctgaagctctgcccaaacaatctgtggatggaaaagcaccccttgctactggagaggatgatgatgatgaagttccagatcttgtggagaattttgatgaggcttctaagaatgaggcaaactgaattgaagcaacttctgaagaaggtgatacttgcagaaattacaggagctgctattttatatcatgactgctttttaaaatttttttgtttattatggatctgataaaatctagatctctaatatttttaagcccaagcccccggacactgcagctcttttcagttttcgctatacctaattcattctttgcggcaaataaagctgaagaagcctgggaataaagtttggaaagggttaataaaaaaaaaaaaaaaaagaatgtaaattcatgagacaaagatgttcccgtttttctgatttttaagttgagtagctgataagagcaatgaacacagcacggatcagatattaagagcagttttctatattttatgcattggcgtacataatcaccatgtattttgtttttgctttagctttatatcaagagaatcgggctgcccaatttgatatatccatttaactcaataacatcgttattccagaaggacttgaactggattataaccaaagagtaaaaccaacatgtttttttttc

SEQ ID NO: 18016 - DNA, 1099 bp, Mus musculus
ttacaatgttgatcctgccaatccatgagcatgggagatctttccatcttctgagatcttctttaatttctttcttcagagacttgaagtttttatcatacagatctttcacttccttagttagagtcactctgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcctttccaatttgtatcctcttgatctccttttgttgccgaattgctctggctaatacttcaagtactatgttgaaaaggtagggagaaagtgggcagccttgtctagtccctgattttagtgggattgcttccagcttctctccatttactttgatgttggctcctggtttgctgtagactgcttttatcatgtttaggtatgggccttgaattcctgatctttccagaacttttatcatgaatgggtgttggatcttgtcaaatgctttttctgcatctaacgagatgatcatgtggtttttgtctttgagtttgtttatatagtggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtagtagtggcttcataaaatgagttgggtagagtactttctacttctatcttgtgaaaaagtttgtgcagaactggaattagatcttctttgaaggtctgatagaactctgcactaaacccgtctggtcctgggctttttttggctgggagactatttataactgcttctatttctttaggggatatgggactgtttagaag

SEQ ID NO: 18017 - DNA, 1230 bp, Mus musculus
tggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaaaaaaaaaaaaaaaaaaagaaaagcaccggtatgtgttttagattcatttccctgttttagggaaatgacaggcagtagtttcagttctgatggcaaaacaaataaaaacatgtttctaaaagttgtatcttgaaacactggtgttcaacagctagcagctaaagtaattcaacccatgcattgctagtgtcacagcctttggttatgtctagtagctgtttctgaagtattttcatttatcttttgtcaaatttaaccctgattgaattctctcctttcctcaaggagacacttatgttcaaagtgttgattctttgccttaggtgcatagagagtagacagtttggagatggaaaggttagcagtgacttagccatatgttctgtgttggaatttgtgctagcagtttgagcactagctctgcgtgcctatgaactgaatgctgcttgtcccattccattttatgtcatggagaaataattccacttggtaacacaaaggctaagttatgttattttctgtacagaaattaaattttacttttagccttttgtaaactttttttttttccaagccggtatcagctactcaaaacaacaattctcagatattcatcattagacaactggagtttttgctggttttgtagcctactaaaactgctgaggctgttgaacattccacattcaaaagttttgtagggtggtggataatggggaagcttcaatgtttattttaaaataaataaaataagttcttgactttaaaaaaaaaaagaaaaataaaagtttccaggagatgttaattggctaagacctcaccttaccttatgctcaccacaggaggacttaagcctttgttagatgctatcaagtgagattcaaattaactggtgagaagcaaaaggatttgcagaaagtagagaaagcttctgtaatcaactgttatcaattgtaatcaatga

SEQ ID NO: 18018 - DNA, 1169 bp, Mus musculus
atgtagttgaggtcaatgaaggggtcgttgatggcaacaatctccactttgccactgcagatggcagccctggtgaccaggcgcccaatacggccaaatctgttcacaccgaccttcaccattttgtctacgggttgaggctggcactgcacaagaagatgcggctgtctctggaacagggaggagcagagagcctgcatcatcatcatccctgcatccactggtgctaccaaggctgtgggcaaggtcatcccagagctgaacgggaagctcactggtatgccttccgtgttcctacccccaatgtgtccgtagtggatctgacatgccacctggagaaacctgccaagtatgatgacatcaagaaggtggtgaagcaggcatctgagggcccactgaagggcatcttgggctacactgaggaccaggttgtctcctgcgacttcaacagcaactcccactcttccaccttcgatgccgggactggcattgctctcaatgacaactttgtcaagttcatttcctggtatgacattgaatatggctacagcaacagggtggtggacctcatggcccacatggcctccaaggagtaagaaaccctggaccacccaccccagcaaggacactgagcaagagagaggccctatcccaactcggcccccaacactgagcatctccctcacaatttccatcccagacccccataataacaggaggggcctagggagccctccctactctattgaataccatcaataaagttcgctgcacccaaaaaaaaaaaaaaaagaaaagtgtatttattacctagaacagtcagactcatttgctgaagtagtactacaaaacagaaagtggttaggaatgttcttggaacacagagggctctgcctagcctttggagaacaacgttgtttctgcacaatcatctcaggcattatcagaaatagcctggccatggtacagcagagactagagaaaagaggtaaacttagacaacaaaatcaaaactgctaggaatcattcttttcctggtccccctggataactatgctaaatatcatcatagaaaggaccagtcttgctcctgctaactgaactcatttgtggaccctatgtaattaatgcacgtttactaaggagtgaatttccactggccaactgat

SEQ ID NO: 18019 - DNA, 1116 bp, Mus musculus
aatggaggaactagagaaagtaaccaaggagctaaagggatctgcaaccctataggtggaacaatattatgaactaaccagtaccccggagctctggactctagatgcatatgtatcaaaagatggccatcactggaaagagaggcccattggacacacaaactttatatgccccagtacaggggaacgccacggccaaaaaaaatgggaatgggtgggtagggaagtggggggagggtatgggggacttttgggatagcattggaaatgtaattgagaaaaatacgtagtaaaatatattaaaattttaaaaaaaggattgcaaaatttaaaaagcatttttcataatctgtaaggtttgaatgtaaataatacagaatatttaaatagaccaattagttattaattattaaatatcaacaattggtgaaagatttacatgatctgaagagaaaccagagtatttttttaccctactaatgatgtgttgttgccatggtaatcctgctcagtatgagaggaaccgcaggttcagacatttgctgtatgtgcttggctgaggagccaatggggcgaagctaccatctgtgggattatgactaagcgcctctaagtcagaatcctgcccaggcagaacaatatggcaccacagaaggagccttggttggcccctgatagcagggtccctgtctgtccctgctctgcggggtccccgcattgtcctcgtgctcggcattgggactggggtccgtgcagagagccattcgtcttggggaaaaaaaaaaaacaaaaacaaaaaacaaaaccacaattggatgggctaggtaataacttggtcgtcaaaatgcagtttccttgcaagcatttcacacatatacatgtattttgcgtttctgtgtagatctgtggatgtacatgcatgctttaggcaagggcaaggataatttcattttaggaaagatttctgcaattaatatgcttcacctgttatcatatatgtataacaatcaataagtattagcccaagcttttgagaagatctctgcaaaacaattaagatcttctttcttcttttgatcctatatagacaagtagatgacttcttaatttttattt

SEQ ID NO: 18020 - DNA, 1181 bp, Mus musculus
atatgagttcctcagttttagtgtctccagttttagaaataatgaatactcactttgtcccaccacacaagtgtgtttgtgtgtgtgtgtgtgtgtgtgtgtgtgtgtgtgtgtgtgtggtatttaatgtctttctcaattgctttttatgttatttttgagacagaatctattcataaacctaaatttcagaacttggctaatccatttggccagaaagccttatggatcttcttgcctatatttccacagaattgagcttagaaacattacccatcattggtagattttgtttcagtgtgcaggtttcaaactcagaactcgaataagttgttttcagagtccctgactttcttcattagtaatgttatatcagtagtaatttaaaattaagtatgagtaagagccatggtaatcttgggttatgttagactgtgtcctaggcagagatcagcccagatacccttacccttacctgcaaaggagatacatcactgctaaggctcatcacaatacaagaagcatcacagaaagaggtagaagtggggttctcattattatatctctgtctctgtctgtgtctgtgtctgtgtctgtctctctctctctctctctctctctctctctctctctctctcttctctctttctctctctccaggtttgttagtcacatgcaggctatagcaaacatgttagggtctcatggcaaatctgggtgtctgttcactccttcagtcttgtttagcaccatctcttctcttttccactgagtattccaggcctgaaagatttttagataattttctgtcttgacctctcacctcaacctgagtgtgatgaggggattatacacacacacgcacacacacacagaccaatatcccggctttaccttccatgttattgaatctgaccaatactatctatacctcattttcttttgcaaaaacaagagctttagtaataattattttaactatgctgcagtcagttccattattttaagggaattatggatcataattgtgtatcagagaccttttattaagttttgcaaaagtatgattaatataaaaaattagattattctgccttatttaacagcatcactacattttgtgtattagcactattcttattgaaaaccatcattagttcaagtttgatgccaaatcataa

SEQ ID NO: 18021 - DNA, 2070 bp, Mus musculus
ctcatggaatactgttgaacctacagcactgtcttgattcttttgtgtgtgttctttgctttgtaattttctgttatcactatatctacttgtaaatctttttttttttaattctgctacatttaatgtcgaagagctatatcctgaagtcattttactgtttagaacatttcctagccatgcagtcctaggactggtttttacagagtatctgttgagtactttttacccctgtgctttaaagcacttccagtgcttcagtggcttttagtgatccaccaattgctgaagaggctatgctaccaagagctaagtggacaacacactccttctctgtccgactgctttggtcatttacagcatctcacaattgtagatttcagacatttggattggggcttttggggtccatgttgggaggcaaagtttcctggaaattccatggcagcagcttctctagggtcttgattttaaatccaaagacttgaaccacatcccctgctgcacatgaatgtttgcttattttcattttctcattgtctcctcccatctggttctgttgtaaccatggatgtctgtaggaagaacagcctagagaaagcactgggaaaccagggttgtcagtcccatgggtctgtttccctcagtggaaggaagtgaaggatgcctgatgactagtatgctggagtgctgtgctcagacagcctgatgagcctctgctcactgtgaaggaccagcctccacctcaatctctctcacccaccccatgttctgagcaatgtttagaccctaatactggcctttgtctctcagtgagtagaacttatgccgattcatatccttcctctctgggccctcgtcctaagttctgtttttcagtcaatagagttcatgtttattgtaaaggtcacaggtgctttactaccttgcaagggactttagatgtagccggccctgaagctttgttataagagttgtcacacagagacttttccccagagttctactatgtttaaatgtgtggaaaaattaaaacataggatcagagtccagaagtcttgatccagtctgaccaagtctggctataccaagttttcattcttatctatcctgggtccacttttcctgccagtggcaatacctgcagaaacgcctcaacaaatgttggcatttttagaagagttttgcccattagtattgctctttcatagttgagaactgctgacatactatcaatgtagtagaatataaaacttgaaaacacagacattgaaggaatcataggtatttttgctttatgctctctggcaggattgttctgtaagcagacgaataaatagctgtgtccctcacaaagctggaatgaaccaaagtgaaaaggacggttcccaggcagcatctgtcagtatgtcagagtgctagtgcttccttctaaacaggatgaccaagtcattccagttcatcttttccatcatcctacctgcctagaactcatgtgtaactgtgatatagctactttcccaggtatattggcaggtgtgtgtgtgtgtgtgtgtgatctcagaacacacaggtaatgtgatgtgacctatgacaactggtaatggtggattcatttacattgtttacacttctatgaccaggccttaggggaaggtcagttttttaaaaaccaagtagtgtcttcctacctgtccccaagtacaaggtaaaacagaaggctgttggcttcagctttcttttcttttttgctcagtaatactgtcaagcaggagtttgtttgcaaatgaaagctgtgtaagcatttttgtttatttcaaataaaatatatttgtattatttgtcattcatactatctatccatgccacactgtcttctgtaccaggtagcccaatagaaatacacctgttttgttctaaaaaaaaaaaaaaaaactacttttaaagttaaatacattttgatcatattcttcccctccccaagtttttccagatcctctcccctccctatgcacccaactttaagaccttactcaaaaaacaaacaaaagcccaataaaacaacaaaaa

SEQ ID NO: 18022 - DNA, 1567 bp, Mus musculus
actccctgcagcactgacactcacattcactgggggagggagcactcttccctctggcacagtgtttctcatatcttgaaatgtatatttttgtactgaatagcagaagtaaatgagatttaggcaacatttttatttctctttaaggtattttcttccttttgttaatattatactaggtttcaaaacaaaaacttacaaaatgtgccagtcagcactgtttaaattagtaagtgctttagaaagtagggataaactggtatgatggcagatatctgtaatcccagcactagggaggtgtaggcaggagatcatgagttgaaggtcatagaaaattagacaccagcctgtgcttctaaagccctatgttttctaaaaagaattaaagtaggtatctcaaggtgaaattaattaaaatagtgaatgacagctgaatcatgaatgaatctttgtttactgactatataatggtcataatttgataagttctttgtattttattatttagtgtataaagtcttagaacacaaaatgctttcttacattttagaaaaaaatgtattacaagctgatgtggtgacacaggcctgactataatcccaaagtttacaaggctgaggaggaggatcacatgttcagggtcagcataaacaccacatgttacgtgagaccctgtattaggaaacaatgaggtaggggactgttgtattataagatggctgtatgtgaagaatgatgtaacctaattatcagggaactgaacttgaaagtgactcataagttagtgtggcttctcatgaaaacctcattccagatttcatgctacttacacatcagtcctcctccctgctaccgcctgcacctttacatactgttagcaatcgagggttcctttgttcttccttttgaaactagattctaatgctagtagttcagggggtagtgaagtgctacacagtcatgcctttagagacaggcagcagctaagtgttcccctctccttgtgggagccaagcgagttcattttcccattagatgccatctcatcaggaagctagaatgacactgaaacaactcagtaatggagagtttccatgtcccactagtactcaggagcctttaagagaccaaaggtagcctgatcaggggctctcctttcctcaatagtgcttaagattattgtgctgtgtgctttctgtccctggtaatgtcttggcagcatttcccatttcctccctggtatagtttgtaaaaatagatttctcaatgtaattctgttaagaaataaaaatgtttgacttgtatatgtcactaattttctctagtacactaaaatagattgttaatggactcaccattggaattgtaatatttatgtgcagttttgaaaattgtttcaaagcatcacttgttgatgaataaatatataataaaagggttctctgatgaagtgtttaggaaacatctaggttagaaggtttaaaggtgcatttatttctggtagttatatgaatttattcaggatgcccacaacttccatatgtctggcagcagagtgtttcctccc

SEQ ID NO: 18023 - DNA, 1322 bp, Mus musculus
attcaagaaaatggatattggaccagcaaaatggctcagtgggtaaaagttcttgttgcacaagctgacaacctgagtttgatccctggaacccacactggaaggagaaaatagacttccaaaggttgtcctttagcccccaagtacatgctgtgacacacacacacacacattgcacttgcacatatgtcatgcatgtatacatcacatgcatacatgatgacactgcagttttaagagatgatggataataatgcacagtacattctcatctagagaatgttgcatctggcattctggatttaaaggtgttctgaaataatagtttttcttttgtctgacagcttttcccagtaatgtttgagagcacctgcagccctttgctcctcactgtcaacttcatgtacctgtgggggtggtactgacactctacaaagtcattcccaagtggtgactgaatggaaccacaggttacaacataaacccagcattgacttgcttttgtggtagctctgacttctagaagggctgcaatctgggatttactgagcctctgagcaaagctgtctgccaggctttgccatttctgctcctgcagtacgttggcttgtgcctctctgtgccacttccgggattctcatagtcagccaattagcaaagctttcacctttacattttgtcaacttctggatcatcttcaaattttgggagactctgtggctttgttgattattgtttcagtgtcagtccccaaatcagtggctgtagtttcctaacagtatcataaagaatcaaataaacttgctactcttttgtcttgatattctagctagaccaaaggccagccatcttaatagagtgagcttttcctttatatattctaatatatgaggtaatttgagagtaatttttatttgcgttttccataaagtgacctatacagtgtagagttacctgtacaatactgttaagtgcttggctgatattttgctggtatatatcccattttaaaaaacagttgcttttttgattcaagttatattactagtctacaatgatgaccaaaaagctctttacaagtttttaaacttttcaaattggcaggtaaggaaatatgtatctagaagagtaagctcagctgagcaaaatatactttattttctactgatatgtcaggagacccattatagtgaattaagcgagaagtactaatcctagcacgggcatcactgtgggacagtccaggtggcagctatgctgacacaggcagaacagggcccagctagtttcctagaccctcaggtgacttctgaccccattat

SEQ ID NO: 18024 - DNA, 1117 bp, Mus musculus
gccctagcaggcgttgacttgagttcatgctctagctcatgcagcacttaacctggtaatcctcctgcctaaccttcacatcagctgcgatacaggccagagcccctagggtgtgctctcactaataacaccatcttctatttgaataggctttaaactacaaccatgtgacaaaacatgcttttgtagaccttggctacattgtggagactagcctagagtttgctatcctttgacttcacctcctgtgttctgtatatgggaatgtcctaccattcctgtttatatttgtaattttagttttcatgctattaaattgtttagaatttctgtcacaactatagatgctaagaaagtgtaattctgaaggtacttttttgtgggatctgagctgtgatgtaataaacgtacatttcatccatatgctctgccagtgttttatcattaatatgcttatgtgtaataaatatatatacacatagtgatttttcgatgcagcacctgaacatgtggcttagattttaatgttctcatttttcatccacagtgcaaacccggcctatcatgagctgctgctaactgttctgtggtatggtgttgttcatacttctgcacttgtcaggtgtactgctgctaggatgtttgaggtaggttacattatcttgtcttgtttctatttgtgatttcctttggaaaagaaaaagggttaagctttaataccatgttatatgtgtgtgagtatttatttattgatatgtgacattaagtagtatctagttgtgtactgtgtgatggggcagaactttagctttggcaaattaaagaatgttttctagccttattggttcttttaaatgttgttcttgatttcatttctcctttaaatcttctttgaatggcatcctattaaatgtttttgattgtcctttcctatttactgaggtaaataactactcaagctaaaacaacatagagtattgcttaagttgtagtattcttattggtattaaatacagttacttgccattatagtatttcttcacatatcatatctgaaataggatccctgacactgactgcttataaggcatatacctaaatcttattaacttgttat

SEQ ID NO: 18025 - DNA, 1682 bp, Mus musculus
aatatctgtattatactctaagctattacaatggtacttaaaataatgtaaatttgaagtcattgttataaagtaataaaagtggaaattacttaagtatttaaattatgaaagaataatgcagactttttattatttcttaactgactagaaagagccaccagcattactctgtgccttttggacttgagtttgtatgttctgtaggaactacatgcattcctttcacacagtatttcaggctgctgtggtgaatttgaatggcagatcctacagtcaatagataatgatgagacttacaacatttcacatctctcttgagaatcctttaagtgctgtttagcctcccaacacatagatgcataggatggagttccctgaggaaaacagcacttgagcatggtgaggagtagccagggtgaatttcacaacatttgtactagatttagatgctcaagaataaatgtactgagaagagttaataattgtttattcccaaattgaaatacacaagaaaatataatttaagtctgaaatttaacgcctacttcctataacacattttaggatgctttctgatgatttaaactttgcagtttactttttcatcctgtatgagaagtactaagtaagtttaggacatttggggttcctttttcccttctaaagtgaaagtgatgttagttaagttattattggtttgttgccacctggtaccttaaactcggtggctattcccattgctgtgttttatttgtatagtcttacgttgatagacagccccactggaattgaccaattgtctacacagcgacacagagtgttgtgtatgaaacggagtaactggcttaaggggttaatgtgaggccttacacagttgacgcatatacatgattctcatatttattgtgtaaattggctttaatacacttggatcacattcacttcctgtggaaaagctagctttcccatgcagtcaaagcttataaagttatttgccttaggcaaagccattcatttcttttacctatagtgaaattattgaatagtagtttttctgaactgttggattctaggcattcctgagaaattgaaagtggctacctttcatgtcaaaatgttgatctgttataaataaatgttttgcatacttgtttttgctgtgtattttgttttcactttgaatcactttatccgtacaaaaataaattatttattcatgaaaatacattttagaaatctaatctctataaatttcctattctaatttacatttatttaaaaggattgtggcaatataaaactaatgtatttcaaacatagtttctaaagaaaatgtttataatctactctgagctacagtggaatacatgtatattagctaccagatgaatagataaagagccttctggtatctggagattgttgcaagaatcagagcagatgacaaaaatctacagatgcctatgtggcaaagcgtttatagctattgttatccttccatattttttgagtcatctttccattgctgaaagtgtctagaacaatgcaaatgctctgttaattataatagtatttgggtagaggaaataatttcttttttaagattttattctttgagaaattcacacaagtgttatgatcttatgtactcccaaaggcctcccagatccatgcccctt

SEQ ID NO: 18026 - DNA, 1221 bp, Mus musculus
gtgttttctgatactctctctctctgtctctgtctctctctctctctctctctctctctctctctctctctctctctatatatatatatatatatatatatatatatatatatatctcaggttttttttccaaagagtgaaagggatgcacggccactaccactaaggctttgagtttgtgtggatccttgagagctaagttcaggtgaccttgtcccctgcctggttttggttttgtttcattttttgttttttagtcttttttttttcctacagtggcaggtacttggccactaaatctcaaaaaaaaaaaatcataccttttgtggttttggcatccttattttttttaaactattggctgtctagaaaagatggagggagtaaataggacgtcaggccaaaggacaaaatgaaggtgccagggaaattcaagaaagaatgaatagagttgacatgtcaatttgctttttctcttcctccattagaatgtcagaaacacacttaggcagtaggccctctttccttccaaagtgtttgtgcatgagtaatttagcctatggaagtaaaaacattcttctgtgtgtgtctgtgtgtgtgtgtctgtgtgtgtgtgtctgtgttcatgtgtgtgtgtgtctgtatgtgtgtgtctgtgtgtgtgtggatgtgtgtgtctgtgtgtgtgtgtgtctgtgtgtgtgtatgtgtgtgtctgtgtgtgtgtggatgtgtgtgtctgtgtgtgtgtggatgtgtgtgtctgtgtgtgtatggatgtgtgtgtctgtgtgtgtgtgttgctcccacatttaaatgacaaaccaggagatctaaagagatgcctcacagttaagaagaagagtttgggttcagtacccagtaccccactgttcagtccacaactccatgtaactccagctccatgggattccatggccacacacacacacacacacacacacacacacacacaattacaaatcaaatctcatgaggtaaatgtaaggaaatcaattgtcctatgggtgattttcttttggtgggtccttatacaagaaagcagtttaaaactgaaagaggccacaggcatagttatcacgagcactggttcttggataatggagataaagctaaccacttaagtgaactacaagcagttttgtaattgttggggtccaggagtcacctcacaaaccattcaaacacccacctcagaca

SEQ ID NO: 18027 - DNA, 1222 bp, Mus musculus
cgtgcggacgcggaaaggcggaaggaggacgcgctcgtcgacttgctcctcccgcaccggactccccagcgggcacagagcccaggggaggagccgtcgcggtcacgccccgcctcccgccgggacgaagctgccggccggccaccgccccccgtccccggtcggcgagacccgcccccggcccgccccggcggcatggaggggcaacgttcttgacggccgtgccgccgcccgggcgctcggctcctcccgccgcccccgctccctcgctcgcatgtccgcaccgccttagctgaggatgctgaggatgaagctgccaccgaagtcgacgcaccccagcgagccgccgcccgacgcggaggagcccgaggcggacgcgcggccgggcgcaaaggctccgctgcgccgccgccgcgactgccgcccgccgccgccgcccacgggcctgccgcggggacccccgccgccgccgtcgccgccccgggggctcgagccgcctgttgctagcgggccgacggcgggcgcgggcatgccgggcggcggcgggcacgcggcggcgctgcgcgaacaggagcgggtgtatgagtggttcgggctggtgctgggctcggcgcagcgccttgagttcatgtgcgggctgctggacctgtgcaacccgctggagctgcgctttctcggctcgtgcctggaggacttggcgcgcaaggactaccactacctgcgcgactcggaggcgaaggccaacggcctctcggacccagggtcgctggccgatttccgagagcccgccgtgcgctcgcgcctcatcgtatacctagcgctgctgggctcggagaacagagaggccgctggccgcctgcaccgcctcctgccccaggtggacgcggtgctcagaagcctgcgcgcgactcgagccgagggctcgcggggcagcgtggaggacgagccgagtggcgatggcgagcaggacgcggagaaggacggccccggcccggaaggcagtggctgcgccaagctcgggactggaggcgggctcggcttcagggcccaagaggaactgctgctgctgttcaccatggcttcgctgcacccggctttctccttccaccagcgggtcaccctgagggagcacctggagaggctccgcagcgcactccgggtggagccggaggacgcggaggtggagcccagcaactttgcgggctccagggcccaggtaagg

SEQ ID NO: 18028 - DNA, 1105 bp, Mus musculus
tcagtaagtgccctctgttgctctgtggagatcttgcaagtgtttttgtttgttttggtttgtgttttgttttttatggggtttgtttttcatgtgtcatcctggtgttcaaatgtaaaacattttaattaaaagttaaggaatagagacatgcaattaagaaatatgtgtcttttttacactgcaccttaaaagataatgatacagaaaagataatagaaccaggtagactggttcccaggagaaagtgtgccctccagttccttggcagagcagatgtagagatctgagaggttggccatgctggggcaggatgtgcattgtcccctcctcctataggaccctctagtgctgacttccccattccttatccatgtgcatctcattgtctgcacggcagcatatctaaagaccagcctacgccaggcaaggatactctccttgtcccgcccatcctttctgtcgattttttcagataggctttgttttattcaaggactacaaaagtctgctgtttacgtagactctaccttatcccaggactgttctgtggataaacgtcattgttaatcttctgatgaaaacttgaaaagtttggtaagcaacctgggtgtttatattaaagtcctgagcttcccttgggccccttagtctgtagctacttgaaagttcagctcttcctggagccctgtagctcactgttgtgtctctgtgtccattgctgtcactgccccttcagatcacactggtcaataccagactgaatgtgatgtcctcaggacattgtctgagtcttgtttctgtgtactgtttgctttcctggtttcagtgttcatccctcctgtctcgtgttcagcattgcacctctctcttcagcctggcttttatttggccaataacgctgatatgttgcataggtgatttctactcactttaagccaatattttgaggaacattttttttctttaaatctttccttctgatttcagttgtcatttttctatacctaaaggaaaaagaaaatacatgcctcctcagtttgaggtcagagaaaaagaggtgaaaacgaaaatggactattgaggtgctttgaaagtgtaactg

SEQ ID NO: 18029 - DNA, 1212 bp, Mus musculus
tgttcttctctgtgtgcttgtatctgtgatgacagtcaacatccagggcttcctgtcgtctgccaccttgacctacccagacactgctgagtgaagatgtcctcttccctacctggctgttgcagtgtcacactgttacaatgtgtgtggtttattgcatcagaacagaagctagtgggttttctcaaaagtcaggtacctgcttcctaagccgagtctcctcagccaagtcacttttataaccctttaccactatgcttgatacaatgtgaaagactgcgtggagtgtgttgagatggtgtttgttaatcatgtcagtgtcgtgtcactaagtttaatgctgctggctttttaaagttttgttttgttttaagccaatctatatactaaatcgcttccaggtaattttttgatttcctgaagtgcactgaggttatctgggaggttggatgtatcttcagtgactgctgcattcaacagcaaggaacaagtaccaccatccattgtaagctctcggggtagcagggcttcccattccttggtacagagtagaagtgattgacttttgttgtggggagtagagttggtgtgcagcagaggcactggaatgttgggtctgggttctgaaacctgacattgtgagacaaagaaaaaacttgaagcaagaagaagctagttgaacacttcaacggtagtgtttgtatttatcgcgccagtgtacgttctgaacctttcaggggtaggagctactgggagagacgggggagtgagatggggtagacgaaagctttaatttaggaagaaaaagttcaagtaaaggaaattattttgatgaaatatattttatttgatctgggtatttttggaccacattattaaattgttgagctgcagctgagttgctgaggggagagctttgctaagccttgcacaggtgcgtgtgactcatcgccaggtgtactttatggagcttattttatgatttcaaatactgtactgtacataggaggtatgttaccttctccttatttgtatgtttaccatatactttgatatttgaaatgttatgtactggaaaggccacttatatttctagaacagattggattttatgcaatctttttccttgaattaacagcaataaaaaaatgaaaaacagcctaagaattatgccttattgcaagttttataaaagtgggttttcatggtcgt

SEQ ID NO: 18030 - DNA, 1143 bp, Mus musculus
gtgactttcctcccgccttttctttctatttctgcttacagatgggttcatcccacttgacttgttcttgtaacagctgatcaaatattgccatgacaaccaaaatacattgttctttttttcttcttctgtcctttatgaccatcaggactccacagctcagcaggcctatggtctaccccaggggtaatcacagaaaactgtgttatctaggatttcctacctcataaaaaggtttgtatcttttaggcctttggtgtcaacacctgcgaactctcatcactgcctaagggccacagactcctctagggtaacaacagaagaccaatcacatcagtcaattcccactgggggagggtggggggatagaaagagcaccaaattggaagccaggatatggcctgactgtgtgctgaccagttcctccttagggctcctcaaagtgcatattgcttcctgcacataaataggtcatcttgcctactaatgagccctgtctgggcagctccacaggctctcttctgtagacatctaacataagtcctaagattgatccaagatggatctggtgtttctgccctgccccaactcatatagaacggccctagcagggatgccttagctcttttctactctccatgggaaccaacatccccaaatacaagtgcttgcttaggcctgttaacagagaagaaaggaagtagtctaagtgaaccagagctccaaggacaattatctgtcactatggcaacaggcagttgtcatcagtgactccatcttactttcctcttgttctttctcattctcaaggttttcagcctcctctgtagattctggagcaactaacaagaatagttatcatttagaacctctgctctgtgtcaaaaccccagaccgcacaacctgaactcctgggaaactcagatctcttcatgtcaccctaatacctaccctttcaaacaacttaaaaaaaacagagacctgaggcccctggaggcctcccttccagactagcatctgctgtaaactctatgaccgtcctctaaagcactctggtcctgggcttgctgcacagaggggttgcccacagggatcgtgagcagttctagaaggttgcagggatctctgcaaagtctggtagca

SEQ ID NO: 18031 - DNA, 1146 bp, Mus musculus
ttgataaatacagtggaaaaggaaagtaccatttgtcttaaaaaatatggcagttttgccatttttgcagtgtttaagcaagttttcttcatttcagtgtgtctctagatttctgttagattcttaccatttgcctttattacctatttttcttgtgtttctagctagttgcataacttaattggaaagatgctatcctatagttctaatttagagatattttaataagctcctagcttctccactttttttttttttgtaattcattagtacatttgatttttgctacacgaaaaaaaagctgctttcctttaagttttagatataaaatcaatccttttctaggggaaggccttagtgggagaacaaaaagaaagaaaatgaattagagtacagaggcacaggcaagtgacactgtgacttcatctgtgggcttgttcactttcttattcttattaactgtagcattgcattttatgagcacatgttatgtagactgatgtgttgaggtcagaggacagcttgcaggagttggttctgttcttccattgtagctccatacagacagtggagtcaccttgctggtcctcaccatcagtaccatttctcagatacccagagagacaggtaacacaaaacaaagcgaaaaagcaagtgaaaaactgggtcacctatcatttgtgttttgagtactgaccccgatgtcagtgacccggagtgaattgtgggcagctgctcatctgaaaagttggtggacttttgtataagccttgcaggcagaattgcttggagaatatattgttattaataataattattactattttgtaaagtgtgaggcgtgtggaatgtttgtgggaatagaataatctttgccctgtcagaacatggtctctaaaacaaattgtgtgagaacttttaaagaaataaagcccaaatgtgtaaagaatgatttatacttcttcaggagggcagattaaattattataactggtaatgtcttcccaaagtgtttgtctaagagtagaacaacatcagctcacggggagaagggcaagcatggagaggagacatggccttgttagctcagttcagccccttggaaaaggctttcatttgtatgcagtctaattatactgcaaaata

SEQ ID NO: 18032 - DNA, 2236 bp, Mus musculus
cttgtggcatattggacagctgctgaggtgggacagcagggaccacttcccaattcagagggaacaactggacagtttccaattttattttcttttaagtgtccccagacagctggcactttctactcttacctgttaagatctaatcccagatgacatctgacagtacaattaacttttctcattatactattttcaaacattcctcggccagaggatggctgtctagataatgcctgacatacagtgaaaagccttgtttcatggtgggcgatgctggctctaacccactttaaactcaggtttgcagagaccgtgatgccatggcattagaggcctcaacaccctgattcacaaaagtttggagtaagctttccttttcttctgaagtagataccatagtcccagatgaacttgatgtgagaatactgtttttattcatgtcacatcagcacagcgtgcctgtgtgttaactttaccagactccctgcaagcatcttgcctctcagtatgtgttccacattacctttgacagaggaactcttgagactcctgcttggaatgcagcattgaagcaatacccctgaaagtcaccgttcatcccagttgaggtagaaaactacagttggggccgggggaggcggtgtggacagccccattgttagggaaattatcagctttcccccccagagagctaaacactttccatcctttgccacgtgctaaggctgagttggatgctgaggcttgcagttcctctgtgccattccctctgtgtgaccaagggcttctggggtttcagtgctgagtgcctgctctgatagtcagatcgtattactttattttaatatatccctgtgttcatttgaaaattaatattctgctatataaagttaaggacgcttcataactgagaaagaataggaggcaatcatttatttatttaaagaagaaaaagataatgtcacgggctggggaagtgtttcattggagaatgcttgcctagcatgcttgggaccctgggtttgattccttaccccaatccaaaaacattctttattaaaattgtcctatcatttcagactttagtaatttatacagtttagactgttgttgtggtctctctctgtataatgtagtggtgtgtatttatctagatctgttaaatcatataattgattcctgaaagcagaatctttaagatgactttctgttagatgatgagaacatttctataccatttgctctactcaaagaatcctatgcatttgtccttgtagaaggctgtacaatgaattatgttgtggtacataagtttattatattgtattctaattgaaatgtgtcttgctgaagaccacagttaatattcatacttttgctagaagatgctttgtgtctttcttatcacccttagtccttaggaccccagctcagaaggcccctgctgactgttaccctctagttccggactgggtcttgctgttctgatctttctgggttaatggaggcctatgggtttgattttcgaaaatgagagagttgccattatattttatacttatttgtggtgtgaactcttaaggcgttttgacacatgttaggacagggtttctaccttagaagcttttgtggcggtactgtatggtagcactgctgtaatgtgattttcatatcttgtatttctgaattacacatacagactagggaacaagctttactgatctgaaaatttatttttctagatatttgtcattttaaagatacttaatcaagctacaaaagtcttttatagcattgtctctatttggcttcctagacatttcataaggcctgatttttattatttttaggaagtaatatttttacaatatatacttaggaatctgaacattcatttcaagtatgctctgtctgtatgagtaaaagaagcctaagaaatatagaatataataaagctttttgaacagttacatttcatatgcaaatagattttctgacccttattcctgcttattttgtgagctgtgtctacattttgataacaagaagtaggtgagagaacaccttggtttcttgtaagcagaaatgtttgctcatcctgaggagatgtttcttaaaacacatttttcaccataggtcttcctttgctgcttgtctgcactcttaggggaaatgctcggacatctcactacaacatagacggctacttgtaaggttttcatagagctcattt

SEQ ID NO: 18033 - DNA, 1373 bp, Mus musculus
caataaataaacagatcagttcaggtaagcgaggaatgtatatttctcacgtcacgatcctgagcacccagcaaaagggcttaatactcagaacaaaaattgtagccaaggacaccttgattgtagcataagtatctggaatgcggaattgtaccgtgcctaggagttataaccccgtcttctaagaatgcctagtttgttctttttatggttggaatttgttaattcagacaaatattgttgtctgtgtggccgtgctatccactgtacaaagcagacgtattctgttcttgagaattactggcatttacaaagttttcattatacctgtgcttggagcagatcagatgtgtcctggaaactgtttagaagagacttaactactataaaatgggctgttgtcctgtcctgttggatgagctaacaggtctccctttctcttgcaggtggtcaccatgggccttttccgaacaattgccttgttttaccttggaagtttcgataatatagttcgccgctgcatggtgcagaaagcaaaacctgaagttgtagacaaaactgcctaaaccttgccccttggatgaaagactgaatccagtgatttgaacagtgtgctgctaatggaacacaagttttggcctccagacttttgtatcttgtttttgaatgtgtgagattggaccccgtgctcttcagaaatctggctgtaagcagagggacatgaggccatctctacaactgttaaacactatgcaaatatgggccaggacacctttgattttctgggctgtaggggtgatagtgtgagaactaataacaggaaagcagggtaaagaatagcattccagaacagtaaattcagcttttcggtcattctcccatcctacccatagagatcaagaaatgtcctctgtggcgtttctgaggttttgttttgtttgttttttgtttttgttttgttttgctttttttttttttttttttgattttgggttttaactttttatgaaagatggtccggatttttattagtctttttttcttttttgtaatttttttagtgtatgttattcaaggtgtgtcttccgagtagcccatgagtctgactctcagcatgccttgctgcgcctgggactcgcttctgctagtgaagctggtttctctctctttgatcccataaaattcgagggggatgagagagcagcacagagggcaaggggtgagtcctttgtgacggcaagcggggctttcttgtcttcttagactgatgcttacaacgttttcatttttattcaaggggaaaggcagcctctttacgtgtttcgtgaagagaaataaaatctcctagcagcttaagttacagtttcttcagg

SEQ ID NO: 18034 - DNA, 1191 bp, Mus musculus
aagacttggttttactattttttttttaaataccgttacaaatagttttggtagaccaacattttggcatgtgcttataatctaagtaatctcagtatttggaaggctgaaaccggaggagagctgtgagcccaagttattctagacagaagtccaagaccgtgtgtgtaggttaaaatagcccgaagatgtcattctgtccttccaccatgtgagtcccaggtgatgagcacccttacccgctgagctgtctctcaggtcctgatcccatttctcctgttttcttcctttgagcaggtggtgctgtgtatctcagttgatgtgtctcaagactataaccaagtggagaatgtcataaagcaggtaagaggagaggtgctttcagtttcactgcctgactctgctcagctctcgccaggagttgacagctcttctctataggcttagtggttccatggacttgattgaccttatctttctgaatgatgaatcttccattctctgatgtagtgtttggaatgatatgtaatgttatggaatattcctccaggcacaagagaagctgggtcctgtggacatgctggtcaactgtgcaggcacctctatgtcaggaaagtttgaagagcttgaagttagtagttttgaggtgagtcacagtggtatcaagatgatgtcttctattttaaaacagccctgccaagccaagaactcagctactaatgtacttcaacactgaggaaatgggcattaggtgtgaactcttaagtgcaaggccttttgaccttggcaatacgtcattcttgtctttagtgtcctctttcaccagagtgatagggactctgaagttaaactgctctgctatctatcttataggaggtgtgactgctggaccagtgtcagaactatcttctcacaggctgtagtcaaccccatatactcagagatacacacaaggcctacaggaggatcagagggtggtaaaaggtagaatggtaggacctgagtgtctgagtttgtctgagacgccctgtcactgtgcacatcacgctggcccagccttctacctcagcttcctgagcactgggatcacacatctctgtcactgtgcctagtgtcaccgtgcctagtgtcaccgtgcctagtgtcaccgtgcctagtgtcactgtgcctagtgtcactacacctggcaca

SEQ ID NO: 18035 - DNA, 1176 bp, Mus musculus
ctcaatccttccccagactcctgcccctgccagtacctctgagacagcctgtaagtgcaggaatacagcagctagggcgggagagggatgactccaacccgcagataatcaatattgttttgagatgagacctatgtccccattgctgtctgcaaagttccttctgtctactgctcttgaagccacttagcttaatcttttcagtgacagctgaggctaagatgggaaatttgtattttatagacagttatgctttgtttatatgaggcaagtgaacataacagccttcagatggcgaaaggaaaacacacagaaaacccccacatgttgtgacagtatatcaagaaaatgtcaagaggaaagtcttgggccaaaatttaatggcatttatctcggagtaataaaatgacttgttttttcttttctataatttatgtagtttattttggtgaaaacagtatgtagtggaatttgccattgcaatcacttttacatatgtaattcagtgtccttaagtacattcagtattgttcagccatcagcatgcatcatatttaggactttctcttcatcccatgtgtagtaactctccattctgctactgctctcagcccctggtaacctttattccactgtttcttaagagtttgtctgcatcatgctaaacgaaataaatcagaccacttgtatatttggtctttggttatcaacagtgattcacaggtatctgagtccctgtgttcagttgttctccatccatacccagcagtagatcttgtgggtcatatgtgcttcatatgttgatccctttggtgacccactaagctggggcacagtcgctgaggcacttcacattttaaccagcagtgcgcaagaggtcaagtctccatttcttgtcagcatttattgtccatattgttttattatagacatggtgataagtacaaagcaagttgttcttaacatgagaaaaggctaatagtttacagcaaccaagaacaaggttgttggcaataggaatgcaatccaatagaagctgctataaggcagtttttgctgaagattagtctgttgtaaggcaatttttactatagcttaactatagatttgttttccatgagttttatattaacttagatttttaaaaaccactcccttaaaaatactttaattttt

SEQ ID NO: 18036 - DNA, 1219 bp, Mus musculus
ttcacaaacattgtcgaattgtaaggaaagcaacaatggtatgaggaacagcagagtggggacatcgaggagcctcgcccggcttcatggacagcagctaggattctcatgagtacttgttcaaagagcaaggccttttttcttttcctaaaaatgaaattgaaacggggctaaagctaatggtatataaatgtcttgaaaaatctttaagcattttatcaatgtaaacttactgctttattaaaaattaatggtagaatctttactctcagggatgggcagcaaaacgcagagcactgatgaatttggggtttgtggcacagccagtgctcctgttgagtttctagtgggctggtttctcctgtatagattaaagtgattcctttaaagcagtgggcttttataactccatgactccttccactgtgcactcgagactttctaaatcagtagtcatctttgccttgtctacgcagtgtcttttatagccaagattgaccaaaagaggtagcaaacaagtatgcatttttcgagaattgtcatgaaatactgtaatgggaaactttaataagaaaatgactttcttctggactttgggatgtttcctgtggatgatgtgggtatgtgtgtacatatatatacataatttttaaaatattagcgagagtcatgtctttcacttttaagttcagggagcagtttgttctaaccacacaaacattctcagtgtggtatttcatggagctttagagacaaactaatgtctcattacataatgaaatatgaacataccatcgtgttatttcaatgtcttcaaatacatgatctgagggtgtatgtcacatacttgtgtaccaactcttagttgtgccttggacatttgcattgcctacctgcaaacaattactaggttaactagaattgctatgcagttctaccttgcgagtgctacacggtaattgcattttaaagtatatttgcacattttacatgctatgctatatgattgcctttgggttttgtgtacagactatttttgttgatattcaatgaaaattataggcttgaaataatactgttcctatgtgaagtaaattgctataacctacttttggcttttatatgttttttttttttttattttggaaccttctacataggagaaaatgtcttaagttggttagataaaaagaaataatttatatttattaatgagcat

SEQ ID NO: 18037 - DNA, 1143 bp, Mus musculus
ccgaagactatcccctttttgggtttcctatctgcatggaatgggtctctagttgcaggtggacaaggagtcagtgaatgaatgacaaacagaagcgacacacgagattctgtagaatctgaatgcaatttgacaaatcaagcatcagactttttatacagaaaatagggaagttaggtgacatatcggccaggtacaaatgagattaccggattcttatacaaaacagaggaatgcaaacatggaaggactggcaagaaccaactgggataaaattcagtgtttaacaactgggatcaaaaacagttccacctaaggtccacttaatcttagaagccagggtcaagggtcgtttccatgaacttttcgccttggaacggtgcccaggttttgggggcctgtcgcgcttgtcactgctggagtggatgtagcaatatttttaacttttctgatagtgaccggaatcttaattcttatttcatttactcagatgaaatcaagtcactatcattacaggttcgaggaccctcaagagctgatcctaactgcattgtaaatgacctgctgacaccctgctctccgggagaccctggggctattgaaatgacatggatggatgttcctggagataaactcttggagccagttgtttccatggtgggacattttaaaattttatacacttatatgtcatttcgtttctatagcactagagaatgttatgatcaagctcatgtatttaatacttgaagagaattgtaagtattaattttgtttacatgtaaaaatagttatctaaaggtgtgagacttgtgttaatgaaaaggttgtattttgaaagcacaatttgctctgacttaagtcatccacaaaattctcacatatattgcacaaaatattgttagggcttaattaaaatatgagttttgtcctgaatcgcacatgtttaaaaataaccagaaacatcaactcttgtgtgatagtattgataaatagtattgttttgttttactttcttaggctgcatagaaagtttaaatcatggagttctttaaatttttaattgaaaacattaacctttttctcaaatactgtataagactttgggaacatttttttttattgtgtgtacatttacattgt

SEQ ID NO: 18038 - DNA, 1148 bp, Mus musculus
ttccctattggagtgtttatgctccttccttattttcatatgtctgcatgtattttaaattaaaatttattgtaaaattacaatttattgtattttatgtgtatgggtattttgcctgctttatgcctgtgttccatgtgtgttcttgatgcccatggaggccagaagaggacattgcatctcctggaaaagaagttatagatgattgtgagctaccctgcaggtgttgggaactgaatgcaggacctctggaaggccagtgttcttaatccctggaacatctctccagcctctaaattacaatgcttcgtcaaagttttattttgaaggccaggtaggcaggcagatctctgtgagttccaggacagtcaggactacacagagaaagcctgtaaaaagttttatcttgagatcacatgcaattttcagaaatgatgagaggtatccagtagaccctttccccagttgcatgttgtaaaactggcacaataacacatcaggatattgatgttgacaccctctgcaggtcttactcatcccccagtttgacctgtgcttctgtgtgtgtgtgtgtgtgtgtgtgtgtgtgtattagtttgggaacagtttgctcgtcaaaccactgaaggctatctggaacattcatttatgtacaagctttgtgggattgtctaggagtgcagttctttgtttatattattagttaacatattttgttcagtaaatacaagccagttctccagaactgcaaaaccattatacgctctcggcattcttaacagcatcgaagttgtcattggctttaattttagccattgtgataggtatctgtttttttttttttcattgtggttttaatatgaccaataatagtatgccatctatatggtctcattgatgaaatatattagttaattgggatttttaaatgtgtgtgtgcagccgtgtcaggacagcctgcaagagttggttctcttctactgtgtgggtttattgaatcaattaggttgggtagcaaaaccctttatccgctgagccatcttctggcccattcataaattctctttaaactgttaggtcttcaggatccctttatgtgttctagtagatgtttctttttgatctgatgtttcacagtgttctcccag

SEQ ID NO: 18039 - DNA, 1743 bp, Mus musculus
aacaacactcttctcaatgataccttggtcaaggaaggaataaagaaagaaattaaagactttttagagtttaatgaaaatgaagccacaacgtacccaaacctttgggacacaatgaaagcatttctttttttttttttttggaaaaaaggaaatcaactttattttctctacatttaaaaaaaatagaaccagctattaatttttgctgagaaaatgcttcttttggtgtttacaacattgtttgcattaccgaataggaagggttaactgatcttttctgtggtttttttgtccttttctttgaagtcactacacaacaatgaacacaggatatcactcaaaagttgccattacaaaaagtgtattcggctctggttcaaaaggatgaatggtaatggcctttgatgggaattttgccctccaagtgctctgggccttatagctatcagcaggcaagagagaggcagatgagactgtgtagcaggtgtgctagttcccggcatgagggtagagactaatgtgtttgggaccaaaagcacctaagttgggaatttctggatcacataagagcctggggtgctctgaagcagccactggctggtgctggttgatgtcatgttgcaccagctctcagtaatctcaaagtgggctctgagactactctgcgagttcccagctgttgggggagaagggctatggtcaaatgaaagatgcactgtggagttttctgcagaaattccatctgagaatttttacatttaaaatttttttttaaacaatctaaagagcaaaaaaaaatgtacgtgtattctagttgcaaagtatgcaaatgcttcagatggctttgtttttattgtgtaaaactgttgaacacaactgtggtgcacaaattctttccatgtaaggagtctatgcattttacaggaacatatcttatgattgggtaatgagacagttatacattcaactgccattatttttattaagtgctttcactttctttacagttattacaaagttatatttattttctacagatgggtttctgttttcatgatgctgtaatgtttacttcagcttgttgagctttctttgtgatctgcatgtcacaatgtgtgctctaaggtgactgtcaatgctgtgacaactgtaacttgctttgtaaagggctggtcacctgtggatctggtttatgaatgcatcgggatgattttaccagatcaccttttcagaaatgaaagcatttctaagagggaaactcatagctctgagtgcctccaagaagaaacgggagagagcacatactagcagcttgacaacacatctaaaagctctagaaaaaaaggaagcaaattcacccaagaggagtagaaggcaggaaataatcaaactcaggggtgaaatcaaccaagtggaaacaagaagaactattcaaagaattaaccaaacgaggagttggttctttgagaaaatcaacaagatagataaacccttagctagacttactaaagggcacagggacaaaatcctaattaacaaaatcagaaatgaaaagggagacataacaacagatcctgaagaaatccaaaacaccatcagatccttctacaaaaggttatactcaacaaaactggaaaacctggacgaaatggacaaatttctggacagataccaggtaccaaagttgagtcaggatcaagttgaccatctaaacagtcccatatcacctaaagaagcagt

SEQ ID NO: 18040 - DNA, 1200 bp, Mus musculus
ggaaaagaaacttgaagagactcccctatcctagatagagcttcatttggaaggaaaggtttaccaacccagtgttaaaatttctgacccagaattgctcttgactaaaagaaatgcagggtcaaaaccagagcagagattgaaagaaaggctgtctagtgactggcctaacttgggatgcatcttgtggctgagccccaaagcctgacactattgctgatgctatgttgtgcttacagacaggagcctttcttctgagaggcccaaccagcaactgactgagacagatacagatagagtccactattagcctgaggtcagggactactatggaagagatagaggaaggattgagggagataaaaaagggatggcaaacacataggaagacccctaggagctcccaaacagtaagttgccaaccaaagagcatacatgggctggtctgaggtccctagtatatatgtagtagaagattgctttgtttgtcctcagttagagaggaggtttagagacatgaggacccagggaaccaaggttcctggggtggggagagatggggagtaccatgtcagagacaaagcagaggtggaatgggatgaactctggggaaggaactcaaatgaggacaatgtctggaatgtaaataaataaaataactaattaaagaaacaaaaataaaaaatatttaaaaacataaagaagaaattatctttttttcttagaaaacataatatttcacaaaatactaaaagtcctttaagaatcaacaaagtggtagaacataaagttacagaggtcaggtgcatttctatattactagaaaaaagtctacaaatcagtcttatttactgtagctacaatcaaagtgcacagagatctaaatctcccagacactgagctatcaatcaggcagcatacattagttggttccaggctcccaacacatatactgcagaggactgcctggttcagactcagtgagagatgatgagcctaacccttgagagccttgaaagtccagggagttttgaggaaactataatgttatatgaaagcttgttagtgatctctggaggttcagaaaaatgggcacaatatcttcaacttcagcattcattctttgggaacccactggccactatattcagggtaacttacctgagggtcctcatctttctctcccttctcctttaaatc

SEQ ID NO: 18041 - DNA, 1182 bp, Mus musculus
ggaagaaccagatgtgtagtggggcccagagaatcatgagtggcgtctcagaagtcaagcactgaacattttacagttacatttgttcctgcttttatttgactgtgactatgccctgaatcttccgtcctatattaaaaaaattaaaactatgcaacatttttttaaaggtgcatgcagtagggacagtggatattttagaaaaattttaaacttttaagtgtctttaattactttagagaagttagaagcttggatatttggataattttaaaccactgacatttgacagtgtttgggttattaaaggtaatattaattttaaaagatgggatgttttatattgtgatatcaaaataaatatgccatttcggagataattggagaattaaaaattgtagttggatagttatatatttgtatgttaattgacaaggtgtcggtgttttgttttgctttatttctgaacttgaaacatctgggaaaaggaaactcaattgagaaaataactttgtcagactgcatgtaagtaagtcttcctaattaaagattgacgtgggatgcctcagctcactggaagtggaattgctactgtgcctattgtcctggatgatataagacaacaaattgagtaattcatgaagactaagccagtgagccacattcctctactcctatggcttcagttgctacctgtagattcctgtcttggtttttctcacttatggactgttacttgagacgtgtataatgaaacaaccttttcctttccaaattgcttttcatcttaatattttattacagcagtaggaatttggataggttattgatttttacaatattgttcagaattctagcatgctggggtctcctattaccaagataagaagataagcaagtgagctcccaggctctatttaaagcacactggaattccagagcagatgggctttatcttactccatctctaggggcatcccattatgagagtatgagggggctagaaactgttactggggaggcctggagacttgcttgcccattgtccttgcttcaggccagatgagcggttgaaggctggagcctggttttttgtttgtttggttgttgttgttgtttgtttgttgtttctactaataattgacttacctgggcttctctggatttgccaatttcaaatct

SEQ ID NO: 18042 - DNA, 1605 bp, Mus musculus
caagtgtatagagcatttgtttctttctttttcgtttactttagaatttacttgtaatatccattcttgctttgtgctcatgaatacatctcatattgctcaaaagcttttctcctacccatccactttttcattattccatatttcaggttgaaagatacatactattatgtgctttgggtcactaacgttggattcattttgtgtgaataagttacaaactttatttttaatttttgtggtatttggagggcaaataaatataggagatagcttgacaatgttaataagatgaccatccattaccagtttatatcatttcttttttctatttttgaaagatattaaactagctcattgaatgcagaggcagctgtcggacattcgtgtagtctcgtcatcagcgtagctgggcctacacgcaagcaaccatgtctaagggaccagcagttggcattgatcttggcaccacctattcctgtgtgggtgtctcccagcatggaaaggtggaaattattgtcaatgactagggtaactgcaccatgccgagctacattgctttcacggacacagagcaattaattggggatgcggccaagaatcaggttgcaatgaaccccaccaacacagtttttgatgccataggatgatgctgttgttcagtctgatatgaagcactggctcttcatggtgatggatgatgtaggcaggccctaggtccaagtggaatacaaaggggacacaaaaagtttctacccagaggaagtgtcctccatgattctgacaaagatgaaggaaactgcagaagcatacctcggaaagattgttaccaatgctgtggtcacagtgccagcttacttcaatgactctcagcgacaggcaaaaaaaaaaaaaaaaaaaaaaactattgctggcctcaatgtacttagaatcatcaatgaaccaactgctgctgctattgcttatggcttagataagaaggtcagagctgaaaggaatgtgctcatttttgacttgggaggtggcacttttgatgtgtcaatcctcactattgaggatggaattttttaagtcaaatcaacagctggagatacccacttgggtggagaagattttgacaaccgaatagtcaatcatttcattgctgagtttaagcgaaagcacaagaaagacatcagcgagaacaagagagctgtctgtctcctcaccacctgcgaacgggccaagcacaccctctcctcacccaggccagtattgagattgattctctctgagggaattgacttctatccctccgttacccgggttcgatttgaggaattcaatgctgacctgttccgtggcacactgggccctgtagagaaagccctttgagatgctaaactggacaagtcacagatccataatattgtcttggtgggtggttctaccagaatccccaagattcagaaacttctgcaagtcatcttcagtggaaaagaactgaacaagagcattaaccccgatgaagctgttgcctatggtgcagctgtccaggcagacgttctatctggagacaagtctgagaatgtccaggatttgctgctcttggatggcattcctctt

SEQ ID NO: 18043 - DNA, 1234 bp, Mus musculus
cataactttctgaattcaagtacagtgtatatttacaaaattattgattgttttgtttatattgtgtcagggatattatgaaatattcttagtaattagataatcctaggttcttttgaaacaagaatcgtttgcatactatacttaatgagaattacattttgttgagttttacaacacttgaatactcttcatttctttttaattaatttattttttacgtattcactttacatcattctaccagtctgttgccgtaccaactcccccattcccgtctcctctgagcaggtcgggggcagggcctgggtatgtacctgacctcagcacttcaagtctctcccactgaggccagacaaggaagccgaggtagttgagcatatctcaggaacaggcaacagcttttgggatagccctgttccagttgttcaggacccgcatgaaggcccaattgcacatcagctacatatgagcagggtggccattgacttttgggtgcttcctatatcctagatgtgccgtatcctagatatgccccccatctcctcacccctgtcatttgtatatttccattcatcttcatggccatctagccatctctcctgtccttccccacacctgattctgaatccaccattcccctctccatcccctccaccccagtttcccctctccatctgcctcttatgactattctattcctgcttctaagtgagactcaagcttccttacctggatcttccttcttgtttagcttatttggatctgtggattagatatgggtatcctgtacattatggctaatatccacttattagtgagtatataccatgcatgtccttttgggactgggttaccttactcaggatgacattttcaagttctatcatttgcctgcaaaattcatgataccttggtttttaatagctgaatgtcattgtgcagatataccacattttctgaatccattcttcagttgatggacatctaggttgtttccagtttctggttattactaataaggctgctaggaacatagttgagcaagtgtgttggtgagattttggagcatattttgggtatatgcccagaagtggtgtagctggttcttgaatactctttatgacttcttgtaaaacactaagtggattttgtgacaatagataataaaagacttcttgcatttcacaattgattatagtgcagtttcagagtactccacagctgttcttta

SEQ ID NO: 18044 - DNA, 1177 bp, Mus musculus
ttcacatgttaattagatttacacacagggagtaaatgttggatttgttgtattttctgactagaccactgttttctgtgcattggagacattggaggcattaatattccttgaaattttattttattggaagcaaacctgtgccagggacacagacatgctatataatttcctaacttttcttgctttgaataagctgaatgtcacctggatttcacagcctatgaggtatagtctgttttttgtttttgtttttttgctacatctttaatatataatttacaataaccagataggaaacactgtgcttaacacatatgcctaaggaaaagatcttccccatggatcatggcgtttatgtttacagaacatttactatttttaacattgatgatgtgtagtttttctacttgtgaagaatctgtgagcaattattctgaatgggcagttttcacagacgatatacaatggcttaagtcacagaaaatacaagatttcaaactcaaccgaagacttcatccaaatttatattttgatgctggagatatacaaacattgaaacaaaagtctcgtacaagccatttgcatatttttagagctatcaaaagtgcagtgacaattatgctgtccaatccatcatactacctacctccacccaagcatgctgagtttgctgccaagtggaatgaaatttatggtaataatcttcctcctttagcattgtattgtttattatgcccagaagacaaggttgcctttgaatttgttatggaatacatggatcggatggttagctacaaagactggctagttgagaatgcaccaggggatgaggttccagttggccattctttaacaggttttgccactgcctttgactttttatataatctattaggtaatcagcgtaaacaaaaatacctagaaaaaatttggattgttactgaggaaatgtatgaatattccaagattcgatcatggggcaaacaacttcttcataaccatcaagctacaaatatgatagctttactcataggggccttggttactggagtagataaaggatctaaagcaaacatatggaaacaagttgttgttgatgtgatggaaaagactatgtttctcttgaagcatattgtagatggctcattggatgaaggtgtggcctatggaagct

SEQ ID NO: 18045 - DNA, 1604 bp, Mus musculus
agcaaaatcaaaaggggtctcataaaggtagaaagtagggctgtcaagagtacaagataagggcctttccaccggagtcttaggttttccgtgtggagatgtctaatgtagcaggtcttcttctcttgagtaggccttctggagctgctttttcgctcactgtctcactcactggaacaccttgagcctagagaacaaaggctgggaaagcagcatgtcagcaccatgtacaaaggctatttttaccagtggaggggggggggcttgtagagtaatttatagggggggtcagcctaaactgtccaggggtgtttctatctctgaagagcataaagggtaggagagctatctaatcatagcgccagtctccgctgtcaatttggtaagggtcccttaatggttctattcattttctctacctgtcctgagctttggggcctgcatgcacaatgtaactcgtcactgcgctgacattctggcaggagagctggtacactgatggcagtagcctcgtggttaaaggtaaacagaaggcggggacagcagtaccgtggtggacagaaagcaagtgatctaggccagcagccttcctgagggacatcggcccagaaagctgaacttgtgactttaagacaagctctataaatggcaaaagaaaagtctacactgacaacaggtatgcttttgccactgtacgagacaatatacaaagagggctgttgacatctacagaaaaagacctaagatgctgtggctaaaaaaatcagatggcagatctaaccgccaaacaagaggctcaaggagcaatgatcctggcagtcaaggagcctaaagattattatgacaccagagagaccagctttagatataccactgagcactatcaagctatagacagtatttgacttggcctgggggccaagaaattcaaaggtgtggttaggtcctatgactactatgttacaggactctctgacttgacagaagaaatagtcaaaagcttcaaggcccgtgctatgatgaggtagaatttctaaaagaaatcttcccaaggtaatagacctgcctttgttgcccaggtaaatcagagactggccaagatattaggaattggttaaaaataactacattttataaagacctcaagaagttggactctaacaaaccaaataatcctattaaaaagtggggtacagagcttaacaaagaatactcaactgaggaataccaaatggctgagaagcaactgaaaaaatgttcaatgtccttaatcagcagggaaacacaaataaaaacaaccctgtgattctaccttacaccagtggttaagatcaaaatctcaggtaacagaagatgctggcaaggatatggagaaagaggaatactcttccattgctggtggaactgcaagctggtacaactactctggatggtggttcttcagaaaattggacatagttctactggaagatccagcaatatgactcctgggcatatacccagaagatactccaacttgtaataaggacacatgctccactatgaccatagtagccttatttataatagccagaagtggaaagaacccagatgtccttcaacag

SEQ ID NO: 18046 - DNA, 1333 bp, Mus musculus
gaaacacccctggacagtttaggctgaccccccctataaattactctacaagcccccccccctccactggtaaaaatagcctttgtacatggtgctgacatgctgctttcccagcctttgttctctaggctcaaggtgttccagtgagtgagacagtgagcgaaaaagcagctccagaaggcctactcaagagaagaagacctgctacattagacatctccacacggaaaacctaagactccggtggaaaggcccttatcttgtactcttgacagccctactttctacctttatgagaccccttttgattttgcttctgtttttaattataggtccatgtgtgttaaataggcaagtcacctttattaaaacagaaattagtgcagtgtggcttttagttttaagacaacagtaccatgccctaaagtaaaggatcaagtatgtcaggaaaaaaatagtgtctagttctaagattagaactcctaacaagtagaaggggggaatgaaagtataacaaggtaaaaacagaattctaggcctttaggcccaggcttgggaatgtggcctttgtaaaggtatgctaatcataaaagagatagcgacattcctctacccacccgcttcctggattcaaagagtgctcattcatagaaagtcaccctggccattaccagaacctgaaatgcaaatgtgctattgttagaggctcttagaagctgtcttgagagttaacaattaccaggtattccttgtgactcttataactttacacttccttgtgactcttaactggtatctttggtatcttccaacaacgccctccccacttccttgagttttggtttcttcctttaaatacccacttacccagctactggggcgccacggtcctctacccctgcgtggtgtatgaccatgggcccgagagagagcgctcttgaataaaaatcctcttgcaatttgcaaaaaaaaaaaaaataataataataataataaaataaaataaaataaaatgtagttattttagtacattatctgtaggcacacaaatacataatgtgaattttgttagcattatgtgaatatagatgtttgtttccttgatgaattattaacaaatacgcacttcacgtgtacttcacctttttaaaatctcagctaattttgagaagcagaatcatgaagaacacaattccaaggtcagcctgtacaatttaacaatgccctgtatcaaatgagaaaaagaaagaaacagaaaagtagatgatacagagaaaatgtgaatagaaaaaatagatttgttagcataatacaagctttgtatcagtaattt

SEQ ID NO: 18047 - DNA, 1193 bp, Mus musculus
gagcccagcagataatttgttctctgatttagtcttattaagaacattttaatgaaaaagatcaaagtgagaaaggaaaaatataaaatggttggttgaagtaataaaggtacactggcaagtggagtgcagctgaatcctatattcaaggattaaatagataaagtgggatttccagggatataaattcttgtctccctctggagctcatgagcctatggtttggttgtagatagtggataggttgttgttgatgcctctttctgcttccctactatgtacaaagagttcacatcatggcttctgtaggcacctctcattgcatacattcaaggatcctctaggcaaggttgaatggttgccacttgatggaggattcctgcccaccactgacatagtgagttatgcctcttccttaagaacctaggtagaaagtacacatgcttggctacttgccttccagtggctgtagtttttccagaacttgtgtctgttactagctcccactttactctgctctggctgggtagttgaatcttttaatattgcttatggcttttcagcaagtttgggagtggatttctgtggaaggtattgaattgtttcttaatctatatggatgtgtgctgtgcatagttgtgtatgtatgttttgcataagtgtgtgtgtttgtacatgtattcatagatgcctgggtagatattgtgtgcattcctggattgttctgcaccttattcattgaggcaaggcctttcaatcaaactcagagctactggagaaccagtctatcaagcaagccggcttactcctggtgtttcatgttgtctgagtgacaggtaggctggcatgccctctcagtctttctctaggtgcaagagggctgacctccaatcttcaagcttgtattgcaaatgccatatttactgaaccatctatcagttcaggagagaggttttgtggggagggagaagtccagggaggggatgataccctctgtgtgttgacagattgaatgatagctgaggtgaccagggctatgtctttgggtacatagtgactgtggcatccaaatggaaacatacccctcacaagggatgctcatttggagctgaacattgagagcacgaagagaacacatattctgaagactgagtgaaaatgtgcctgtgaccttaaaattcactcaatgatcc

SEQ ID NO: 18048 - DNA, 1184 bp, Mus musculus
cctctcatcccaattagtgtaatcaagattatccttcataggtatacttagatccccaggctcccaggtgattataaattttgccaaaatgacagttaatattaaccataaaagtaatgacatataggacatctttgaactttgaaataaaactaccaattatacgcaatttcataaagtttggtgatgtcagagtgtggcatcagaaatttccacagagccttaaggtgacctcaagaccttggcctccatagagagaaatttagagagctgctctttgagttctttgaccatcatgaagccatctgaaatgaacatgttccccttgctgaaaatcaaggagctgatgttcaacttctttcccttaatttcctgtgaaacatgggactgatcctatgatgccacctcaaaatgatagggacttgatcatcaacacccacaaaaacgccagggttggtggtatgagcctataatgccagtgctggggaggcagagacaggaccatcttagggcctattggcccgtatatagctaacatagctgaaattgtgaactcctgaatcagggaaggatcttctttctgagagatggttagtgattaagactacttgctcctaggagtttgattcctagtggtcttcggtgactctcgggtaagatgtttattgaatatgctttcttttcttcaatgttttgggtatctttgtcaaatattaagtgctacatccactcaagtagtgacaagcacaacaggcccctaaaacctgggcgctgtcctgaggagaaaagtttacagaaacttagtctcctgggttcatggcatcctgtataaagaatgctccagtgtccttgctttagttggtaaacagatctgtgtgctttcccttaatattgctttattataagtgctcctaaggattgattttttgacatatagctaagttagattctaggcagtccttgatctgaccctgggcatggatagctaagtcactggcctgcacagaaatttaccattatctaggaagaaggaagtttgtaacctaagaaggaaccagagtaaataattagaactatagatagctgagttacacccatatacaagtatttacaatggcctagggggaaggtggactatacagtagactagaataggaactatggcaagggcaggaagcccttga

SEQ ID NO: 18049 - DNA, 1149 bp, Mus musculus
ggctatcatgcaaacactgagctggctgaagcgctagagaaacagacttggagaatgggcaggaacaaggaaaggggacagcagaagttgcagccaactttacccttccaggaacctgggttggaagcaaatttggatacttcgaagccaagaggacagcccctgtcatatctgatgttcaaagtcagctcctctgtagcccagttttccttttcttttttttaaattaaactatttacatcttaaatgttgcccccttgtcccccctcccagagttcttcaccccttcccatttgtatctgagaggtgtcctcctccaagtatccctcttccctgagacatcaggtctctacaggatcaggcacttcctctctcatatgagggcagacaaagcagtcctctgctacatatgtgccagaggccttggaccagtccatgtatgatctttggttggaggcttagtttctgggagttcacaggggtccaggttagttgatactgttgttctttttatggggttgtcatccccttcagttccttcaatcctagctcttccatagatgtccgagacctcagtgtattggttggctgtaagtatctgcatctatctcagtcagcttctggtacagtctcccagaggatggctcctgtctgcaagcacatcatagtattaataatagtgtcagggtttggtgcctgcccatggaatggatcccaggttgggtcagtcattggttggcctttccttcagtctctgctccatttttgtccctgcatttcttttaggtgggttgctatcccacccctccactgagggccctgcaattttcctttactcctttgtttttttttaaagatttatttatttttttattatatgtaagtacactgtagctgtcttcagacactccagaagagggagtcagatctcattacggatggttgtgagccaccatgtggttgctgggatttgaacttcggaccttcggaagagcagtcgggtgctcttaccactgagccatttcaccagcccctcctttactccttttatagaatgtgcttcagtttattaatttacttaaagttattttagtcctcccccccttttttagacagggtattgctgtgtagctgctggctggcctggaa

SEQ ID NO: 18050 - DNA, 2915 bp, Mus musculus
cacatagtgatgtatccgatttctttctccctgtgcagtcgaggctgtctgtcaacagtgtcactgctggagactactctcggccccttcacatttctactttcatcaatgagctggattctggttttcgtcttctcaatctgaaaaatgactccctgaggaagcgctacgacggcttgaagtacgatgtgaagaaagtagaggaggtggtctatgacctttccatccgaggcttcaataaggagacagcagcggcttgtggtgaaaaataggagcttttccctggggctggccttgctggcgccgcagttgccagggagggctagctcagtgcctcttcctgtagttagcacaccagttgctaaacactgcgctttattttcgtaaccagctgtgtgctgtgagtgtcagaattgaaatactttttggatctaaacaaaaaaaaaaaaaagaaaaagaaacctttccacggatggggtttttttgttgattttcagtgcacttgccgtgccgtgttgtcgtcgtattaccattttgtcaacagtgtgaatgttggtcccttggtaaaagtcctttcttgcttacctgactgttgatgtactgactgacaggtttgttgtcttgtttgtaatttctcccacaagtaaacaatgatgttttctaggtccagattagtcctccatttccagctatagcctggatgcagtgtgagaataaaatggttgacaagcaagggaactttattttgcccatcttaagtcttgtaagtgagttgaattttttgcctaggaaatttgaggccccgactctgtccctgctactaaaacagagcagatgaaactgtacagttcaacccagcaaggtcaaggtagaaagagcctctggaaaagcgttgtgatgtcttgtgttgggttagagcatctgttttctgacatcaccttacaccccggctgccgtagcagttagtctttacacctgcctagagctaacacctgtgtgctgtatttgtaaacatggagaccttttctcagcagccagctagaactggtctgggagtagaaagccatcctcatgtattcactccttatctgtactgaggagtggcttcttagagacatcagtgctgtttggagtagaagaaagtaaaatttggctttaaaaaattcatgtgattggcagtattttttggaataagaaattgaaggttgtgattctgtcagtacatttaaaatgtatagtttagggtagtcatgtaaactttgggctcctctatgccctctccttttcagatcgcataagaattcatatgtggccattcttggggtagaactgaaattattaaagtcaaggctggtgatgtagcttttagtgatagacttgcttggcaatgtgaggcaatggtccatcctaggacttcaaaaaactgaaagaaaaaaagaaaaaaaaaacccaacaaaaatagtgtaggttttttttttttttgcaccctctgacaggaagctgctgccattactagtgtaataggaagtactcaggggtgtcaccctttctttcttggtagcattttgggcttcatgtttgtgcagtgggatctttgacactggcttttatcaggccatggttagagactaactggaaagtggggcctgaaagtgcaggcttgtgctcccaggtacacaggaggctgaggcaggagattggcaaattcaaggcttcaggggtagcctgtctaactgagtgagatcctgtgacaaaaaaaaaaaaaaaaaaaaaaaaaaaagaccacccacccccacacacacacacaagcaaaaaacaaaaaacaccaaccaaaaaggctgggggtatgtttcagtgactttccctcgcatgtttgaggccttgggttcaacccttcgttgtgcagcgagcggggtggcaggaggctgactctaatttcccatcctgaggaatgagctgtgattgctgtatattgttggacatgtagactagctttcttcatggttctttttgcagggttagagtaaggtattaggcaatttttgttagtttaccatttgagacagggttttgctggtagtccaggctggcctggaactcgcacctctgtttccgtttcctgagtacaggattagactcttgaaagtgtctgggaaggtagaaggcttttcagttgcatggtagtttcacaggctcttgcctgttcttgtgggttctgctagacatcattaaagctcttgtcaaaagtttcatattttcctctttagagacagaggttgtaatgtcctgcctgtagtgttgtctaggctggtctcaacctcctgggctgaagctctcctcttgcctcagcctgtgagcagctgggactctaggtcattgccaccatacataactcttgaaattcagtttcagatgcaatgaacaaattgcacttaaaagtgaaggagtatgttctagtgttgtgattctacttgagagtttagaagtgtcatgttgataattagttgtgttcgttactggcttgtaaagcaataaaactgtttttggtctctttgtaaagtagtgtgctgctgtttgaactcttcttctctatggagaatcaaattgttcatgttctgctggccagtagtggcccacacctttaattccagcacttggtagaggcaggtggatttctgagttcgaggtcagcctggtctacagagtaagttccaggacagccagggctacacagagaaaccctgtctcaaaaaaaaaaatttcatgttccttgctggctgaagaagcctggagtggtaagcctgagctgttgtgtaagggtgacaccaaccaagacactagtcactcccagggctttgatgtaaatgcagatactgtctgcatgatcgacctccatgaagaaattaaaggtgttt

SEQ ID NO: 18051 - DNA, 1242 bp, Mus musculus
aggatgtccatgcccaagagaaccacctgcaacgcaaagaagcacagcgtcagcggtgcagtgggatggcgctgacatagctggtccccgcgggcgcccagcgactgggaagactgagctggctggtcaggaaagggtactcggcacggaaaaacccgctaccgtttggaagaaaaactcgccgaagcggaactccactgaagcagcacgacctagaggagcctactgcggccccgccctctccttgagttgcgtatgcaaatttaccaggtcgcaccctccccccaaattgctaactctaagcctccctccggccccgcccagaaaggcgtgtatgcaaattttcagacttgtgacgcgcggccttctgggtaaagacaagcaggcttcagaaagccccttgggagtttcagaaaaacagaaagggtattcgacgtgggaagcagcagtcgaagaaaatactgtacaccgggcaggttggggtaggcctcctgcggtggtcaccgcaaccaaacccggacttagagctttctggctgccgggcgcgcgtggttgcaagcaaccatccttttcttggggttgcgctactgtccaatgaacgcgtagtgagggcagtactgctaacgcctgacaacacacctgcatcggttagagctctgctttaccttggtgcaatttttggaaaaaaccacaaaacctctcttccttacctaaacatttaaagattaaagtagccgcgtgtgtactgttgccctcctcgcagttcctttattgtatgctagagggcagccggacagtaattactggagaccagctttctcaccgctgccctaagactgtgatacactaagaagcgctccctttggaaaatgttgtaatacagataaagggttccgtatttgggttttcatccagcttacaagtaaatctatatactaattcaaacaccaagccagcactgggaggaattagatacttgaaagtgtataattcttttgaggcgcagagtctatgtagcccttagcatgtagcccctgctggcctcaaacttgtagctcccgactgctaaaattaaaggcatgtaccacttcccggggcccttttttctcccaacttttaaaatagttctatttatgagcattttctttaaaacaaagcaaaaaaaaaaaaaaaaaaaaaaccaaaaaaacaaaaacaaacaaaggtcttacttttgagccacaggatttaagtttccttagt

SEQ ID NO: 18052 - DNA, 1199 bp, Mus musculus
agctgtggcctgctcccagctttcctcaatgatgtgccaccctaacatctgctctgggctcccctgcactagggccagttgtttaaactgtcaggatggctagacagaaatctggctctgtggcttctcctctttccctgcctctgtgcggccatgagtccttttgctccttgcctcacataatatagagcggcgggcagcagtttgttagctatcagaagctggaaaagggtgtgtttccagatagggtgtagctaggtggtgacacgcattttatttcatgtgtcaaccatagctttagacctataattttccattattagaacaatggagcagtagatacactcaggcaaagtcactggttttctgtgtattgcatgatcccatctctggggcagtgagcgcttcctccctcctgtggataccaacatgtttagttctaagaaaagcagagaagcagtatgtaacagtatggccagtccttcctgacttctcttgcttctccattaaaggctctacagttagtaccaaatctgtgtcgacgacaggatctctccagcgatctcgaagtgatattgatgtgaacgcagcagccagtgccaaatccaaagtctcctcatcctcaggatcccccgccttcagctctgcagcagcactgcccccaggatcctatgcgtccctaggtaaccaggctccctcccatcctgctgccccatgaccctggcctcggagcagagcttacacagcgcttccctctatagctgagagcagcttcactcttgagggatctaaagcataagtaactactctcaaagacagttcctagcgacttgttgtccagtgtcatgtcaatgtcccttttctctggagtatcagcctgacctgtaaagacatgtgcttgcaggctgtgtggtcctcatgtcctttttcctatagcaagtcctgcccatacctaagccgctggccatattgccagcactggctttccccctcccctgctggtgggaactgagcaagatggctcagtgtgcctttagggtttttgtcgttgaatgtctcttagaatgagggtgacaggaagattctaaatgaatgtaatgaacctttaaccacctttagcacaactgtgcaggtgttctatactacatactgcccacacactgctccccaaaattgtttctaattactttccaaatttt

SEQ ID NO: 18053 - DNA, 1774 bp, Mus musculus
gattcaaaataatttgaatagtttgaaaattaaaactatttgtgtggcttgagccagtaactgcatttaggaaacatatgtgccaaccttaccatactaggtatgggtttaacacactgtcttgtattcagagtgtgagaggagaatgaagggggctattgtagtctactttaaaagaaacctattgccaggcgtggtggcacacgcctttaatcccagcactcgggaggcagaggcagttggatttctgagtttgaggccagcctggtctacaaagtgagttccaggacagccagggctataaagagaaaccctgtccaaaaaaaaaaaaaaaaaaaaaaaagaaacctattgatgttaaaaaccaaatgatgctgttaactaaaatggctcatacagtctgcggcccttttgcatagaatatctccactactaacaaacatttcaactgcagacttcttaagcaagcatgattgttcaagcaagcacacccacagaccatgcttaagggctgcacatgtgagcacagctgcagtgaattgttgctttgtccttcagagtttcattaaacccttacactagtctgctgaggcaggtgtactggttaccttccttgagaggagtcaccaaggcagaaactgacacagttgttcagcagtaatactaggattggcaccaaaatccattgggctgaaaaatcccctttccaccacccccatacatacacactttctacaagacaacaaatccttcttcacaaaaatgtgcagcatgtcacttatgtcacctaccttgacacttctgtttttaattccctaatttgtaagcacagaaaatgtgtgtgtgtgtgtgtgtgtatgtttctttttatatttaactctgcactgtagtttttaacggatgagtcatgaccggttcaccttcccacttcttccttcccctgctcctcgtgggacattttagaagaagcctgtgagaaggagatacgagccctatggaatgtactctgatgatgatgccaacagtgatgcctccagcgtgtgctctgagcgctcatatggctccaggaatggtggcattccccattatctgcggcagactgaagatgtagcagaggttctcaaccattgtgccagttccaactggtcagaacggaaagaggggctcctgggcctgcagaacttactgaagagccaaagaacactgaggtgaggacacacatctcagtccctgttagactcgtcataggctttgaggtgcctctgccattatagatagagtccttgcaaagttctagtcactgagtcacccatgtcacccatgaggagacatagtacctgccacccagatgtctgaaaacatctagcaaatccatggtcatctgttaggttgcttggacatttggttcctgacaggtgcacatctgacaggagcatcctttagatgatgctccctggggagtcaggttcagaaaacaattgtacctgtaggcgcacttctccccaaggctccaggataaactgcagcaagtacaagtctgtaagctcatgtatacattcatgcgtacaattcaggcataccgagcaagtcctcagtgagatagagcatttcccaaagcagcagcacgctagctttgtaatgattatttctggtacctctctttggtattttataaaatatttaaatagccaagcattgcacagattaaataaagggatgcatttataccaaatttcctcatatctctgttgctattgccatgctattttgtacc

SEQ ID NO: 18054 - DNA, 2600 bp, Mus musculus
cggattgttggcctctcttctccttcttgctgacttccccctgttcactcatctctgtcttcttctctctgcagatgaagctgctgaacttatatataaagagggcccagactaccaacagcaacagcagctcttcctctgatgtgtccacacacagctagtggccgtgccagtctgtgcagaacacacattggtggtgcctctgagaagctccatcagttgcccagtccattcaaggaggccgcacataatttattacaatcagtattttggtcccttccagcttttgtgtagaattttgctggtattgaatgtaacggaagcaaggcctggggactgagaaatgaagagccatacttgcacgtgtctgcaccacctgctgacatcaccaaaccatggagggcacagctcttagaatccagagctctctagccagtgcttggtacacagtagcatatttttcagtccatacagacttgggggtggtttggggtattgctgtgtgttctttatgcttatgttcttagagtatggtcagatgggacaagaccccctcctgtcttctacatgacatggagaaaggttgtgtgttctttagggtgtatcttagagttctcaaagtggaactgcagtctgggcaagaaaaagacgacaacctggagctggcctcacaaaaaacacgaggggttggtttctcttgcagagggagccaacttccctgccttgggaatagaatcagtaatgccaccaaagttctcatggttgcattaaagaaaaggtgactgtaaaacgccaagattggaaccagacttatatcatgtgtcccgggaagtgctggccaaacctcttgaaacaactaaggtagaatctggctaaatagattttaaataaaattcttaagccaaatgacaattcttaatgcaatcatgcaaactttcctaggctggccttggatgtggtgtcctcctgcctcagcctcccacgtgctggggttactgataggggccacgtgcccagcaaaagcttgtttgcggtgttagttttcgaaaagcatgtgctcttctagtgcagagcccactgtaactaccagggttgagagcagaggctgggctggcgagttctctagcactctgcttctctgaccctccaaatggtaagtcaggcatggtgactcatgcctttaatcccagcactcaacagacagaggcaggcggatctctgcaagtttgaggacagccagggctacctagtgagaccctgtctagaaaaacaatcaaaaagagatagtgaggttggagaaaacccgtgggaaatagacactgaaaatgaaggttccgtgtgtgtgtgtgtgtgtgtgtgtgtgtgtgtgtgtgtgagagagagagagagagagagagagagagagagagagagagagagagagagagagatgagtggctcacacatctaactgtcccactgctactgttcagagaactcaggggtgcattttaagggatttgctattattgatggacttgggctcagaacatagcaggaccagaccttactttcagttaaaacacaaaaactcctgtctgttaagagttcatcagtgagaatccttctcaccctgcactaggctccctctgtgttgtagccttgtagccatgtgcagcctggccaggttacttaggggaactcccaagcctaatacagttagaaaggccctgctctggcattctttgccccactgtaaccgaacagttccagagcattacctgacatcctcacagtacacacaaagggctagccccgaatgtcacatgaatgtcagtctgagtagaaagagtacaatcatttctgtctcttgggctccacctcaagactgctgcccgaaatgctgaggagactcgcatgccaccaccacctcatggagggcgacagagcccactgccgctctctgaaccctgacagctacagctgccttgccttgcctccacctccccaaaggacaatattcaaagcacctagaccctgaaggactcttcacagcacccagaactgtgtttgcctccccatctatctgactatccaaggccttgaaaccccctaccctgggggaccgctcatctgacttcctgcttcctggcgagctgcccctccctctgctggaccggcgctctccaggtgcacccccgtgctgtgcggacctggtgcccacagatggcctgggctcgccttacctatggctcactactagctttcaacatgtgtgcaggtaatgcaacaggtttgtctcctacgtcttctgttcctttctctgccacctttatggaatctcacactttaaaagacagcaaactagaactttatagacaggacactgctaacaacgttcagaagagagaaatgctctcaaacaatcggccaccaagatagttcacacgcatggtccttgcgcccccagattgggtgttgtttgttttgggtttttttgaggctttttcatgttacatccatatctgtatttatatcttatttgtttcacttcccaagtgtatcatggcaaatgtacagattttttgttgttgttgttaataatgtgctaggatttgcta

SEQ ID NO: 18055 - DNA, 1209 bp, Mus musculus
cctccttgctgcgcaggtcctgagccttaacctcggccatttctgtgttgttcatcgctgaggccgtctggttctagagaaatacttgagttttaatttttaagaattatgtgtctgtgtgttctggttgcctgtatgtctgtacatcacatgtgtgcctcgtgccttcagaggccaggaagagctaggaattgaactggggtcctattgaagattactcagttgctcctaactgttaagccatctctctggccctgagaaattaaattttttttccattttttattaggtatttagctcatttacatttcgagaaattaatttttaaaccaatttttaaaaaccatttttactctgtgtaaaatgcttactgtgcaagcatttagaccagaattctgaaccccagagcccatgaataaactgggtgtggctaggaggcataaaccggagggtcaggggttcaaggtccaccttagctacatgagatactgtctcagaataaaattacagaaagaaatggaaaaggtattaccttcttccctcaggtcagtcgtatgaaatccggctgctggagaatcggaagctaggggacttccaagatctgaacacgaaatatgtgaaggtgagtaagctcagggctggctcctcacatgctagaggggcctgtggggtctgaatgcctggggctgggggtggtgggaaggaatccctgagctagtcccatcccagtttctggagttcattgtcccagtgaagattagatgggtaggcagtggagcagggtggggtggcttacattggtgaagtatgctctgggttagatagatagaagctgtggcctaattttgccctcaattgagcctttcttacttgcacataacagcatagtaatcagacatgtatgtgaagctgttcggaatactggaaaccatggaagcatccaccttcttaccattgtccgtgttcttgggattctgatgatagacaggaagtcctaggaaaagggaccagagaggggcagaaggttttccctggctggggacaggtatacatgctcgtcttgtggccctgcagtccctacacacagctgtctccaacatttgccttccacagagcatcatccgtgtcgttttccatgaccgccggctgcagtacacagagtaccaacagttggagggttggcggtggagtcggcctggggaccgcatc

SEQ ID NO: 18056 - DNA, 1145 bp, Mus musculus
aggaaagctacagacaaccatggacacaaagtctggtgtacagaagaaagccagcggttcccttctcctttcctcttggcttttaggtttttaagtttcttgttctgtttcctgggcagatagtggggatgtgcatctcttaaactctgagccctgcagttggagggtcctttgatgtattggtccttcctgtctcctctcttatgtcaccctgattcctgcttctttttcttgagtcactggcttcatggctagctctgccaatctcacaagggctccacacacagttctcctcctaatactgacttcctttctcaggaccctggtagccatgtctctcctgttcttggatgacttgataagactggagctatttatttgtgccttccatttctttctcagtcgccttgtctctaaggatctgctacattcaagcccagagtctctgcattgacatggtagatggcacagtgtacctatgtgacctctcattgtgtattagttccttttctgttgctgtgataagatactctgacaaaggcaacttgataaagaaagggcttgttttggcttagagttttgtagggattatggtggatattatggtgaggaaggtgccaaacagaaagctagctgatctcattttcatacacgtaggaagcagcacagagagaaagagcaagagcaggaaatggtacaagccttcaaggaccaccaaccccagtgacttacttcctccagcaagactgcatcctctaaaagccccataacctcagcagactacatcaccaactgggaccacgtgttcaaatacataagcccatgggatacatttctcattcaagccacacattttgcccatgtgacctcccacattttctagttagagatgctatggactaggagatgacatgtgacttcctcaccagggaagagaggtgaggacagaatgattcctcatggaccactactgtgtattctcatttctgttgagcaaagagtactaagaggtgaagattctgttatccagtggccttgaccatccattctagacatttgggttggggtatgtctcagtagatccctccctggcaagtatgaggccctgggcaccatcccagcgctacagcaggaggtacttactg

SEQ ID NO: 18057 - DNA, 6940 bp, Mus musculus
ccaagtggcccaggggtagtatggtgtttttttcattgctcatttaagattctatcataggtatatagataggtgctttgtctttgttggcatggttgaattgttcactttttttgtttgttttgtttttttcaagacagggtttctttgttagccctggctatcctggaactcactctgtagaccaagctggcctcgaaatccgcctgcctcggcctcccaagtgctgggattaaaggaatgtgccaccactgcctggcttgttcacctttcttaactctgggggaatttgaggatcagtagctatggtagacttaattcatctttattatgcccacccagtgcttcaactctttcctaatcctcaagccatagtgagttacttctaagctcaaagatttgccaaaggttttggcaaatattattttacaggcagaaaaactactctcacaggaaagatgagctctcagttccttgtcttttgagacatgtgggtggggttgacagctttattgagatgttggtgtcgtgaatatattggcacaggctttctgtggacagggtttcattttgggaatgtgcctggtagaatggacagctcataaggtaacttttcaccggtttgagaaactgcccagtgtttcccacgcagctacacgtgtttgtattaccaccagcaatggaggatggttctagtttctccacctcctcatcaacatttgctgtgatttctcattcttgcccgcctgtcctctctccctcccccttcttcttccgtatagtccagcctggcctcgaagtcactaagtagaagaggaaaattgaacttctgatcttcctgactctgcttcttaaatgctaacaacatagaaaagtacctccacacctaatgtatgcggtgctgggacaaaatccagggctttgtgcttgctaggcaagagctctctctaccagctgagccacctccctagtggtgacctgtcttttattacaatatcctgctggtgtcatgcatgtctctggctaatgatgttcaatgtctcttcacattgattggccatttgtatatctttgggaaaatgtctggttatgtcttgcctgtttttaaattgggctctcttcattgaattgtacaagttgttgatgaaaatccttcatcagtttttctccattctgctccattctgtaggctgtcttcaccctcttaatggttgatgctccttggggtgtacatgtttctaaattggttgtgcttagtagtatgaaccagcactcccagtactcagctgaggctcccgaggccagcccaacctacatagtaagacccagtctcagaaacaattgtcatcattattttaatgtgtgtgatgcctgagttaccttctgctgattgtagttttgatgtggatactaagaaaccatgacctaatgcaaactcaggaaaatctgtgttttctccttagaattaaaaacgctgtttatttttattttatgtgcattggtattttgcacattggtatagtatgtgtggttgtgtgtgtgtgtgtatatatatatatatatatatatatgtatatgcacacatacacacagatccttgtaagggtgttagatcttctggaactggagttgcaagcaggtgtgagctgccatgtgggtgctgggaattgaagcttggtcctttggaagagaagccaatgctcctaacccctgaaccatctctcctggtccctcttaggaacatgattaaagtttagttgttacaatgagttctgctccagtctgagttagttttacatatatgatatgtagtgggagagtctagtttcatccttttacatgtgagcgtctacttattttacccctaattactgaaaggactggagcttctgtagtctggagacctccgattcctggatctttgtgagcacggcgggaccattgctgatctcttgttccttttaccttcttggtctgcatttgggtctactgctcttacggccacttccctcctctcctcctgtcagcaggactggatgatgcccctctgttctgtcgtttttcctggcactaacacttcctagttctagaggaaggtaatgaccaaacgtttcccaaacgtttccatgcttggatagagaggcaaccgagtctcttagaataatatgctcaaggcgagccactgggagaaacaggactcattgggcctctgactttcagcccatcaggctatctgtggcccctgttcccaagtgatagctctacatgggctaaaggaagagagactaaactgataccttttttttttctcataccaaagtcggtctaaactggagagccaaagatggcacactgtaaaaagagcagatggcatggaatgttccaagtcttgtcttggggtctgaattagttatttttctcattgttgtgaaaaacatctgacaaaaacaaaacaaaacaaacaaacaagcaaaacaaaacaaaacaaaacaaaacttacaggagtgagggtttctttctggctcacagtttaaaggtccagtttgtcgtggctgagaagtcttggcagccagagcatgggacagctggaagcagaggcagatggatacaatgtttatcttaccatctctgtttttttagtcagggtttctattcctttacaaaacatcatgaccaagaagcaacttggggaggaaagtgtgtatttagcttacacttgcacattgctgttcatcaccaaaggaagtcaggacaggaactcaaacaggtcaggaagcaggagctgatgcagaggccgtggagggatgttctttactggcttgtttccttatagaacacaggactaccagcccagagatggtcccacccacaatgggccctcccgcctttgatcactaattgagaaaattctggatctcatggaggcatttcctcaggggaggctcctttccctgtgataactacagcttgtgtcaaactgacacacaaaactgctactatacctttttactctgcaaaacttcagccatgaaatgctagggtaggttttcccacctcagataactaatctagaagactcctcacacacttgcttggcaggggagagtccatgatcaaggagctggtctttcctgggtaatgcttattctttgcagtctggatgtgcttgactgagtaatttttggtagtgggggaatgtattcttgctcccgatgagtgaattaaaggaatagaaaagaaactcactggcagacatagtcagaggtttatttccatggtgatactaagtcccatcaagttgacaatcaagattagccattgtgggggtctagaaaacagtcagacattgccctagtgacctcttacccagtctgcctggagccccttgagagctattaaccaggaaaaggctagaacccataagcacgtcaccagttcctaagtccagtgttgcttcaggggctggcccaagtagctggagttctgaaaattattaacacatcagtggaagaaatagaaagactctttagctgttgtcagtggaaagttgaggttgttgggggcaaggggaattgaatatggtcactgccttaggtacactggagggacaggaccaaaagtcaagggtcccaggctccctttaatacaaggtgaacagtagaccattagtagagtgtccctgtgtttgaatggcagaactgcccccctaaaacaagaagcattgatctggagacctgagaacctggaaactagtcagtaggtgaatctgagcttcgggaaaactttaccattgtttcccattcatcaaagtcatgtggtggacaggtgacctttgcttgtcctcggtattcagtgccaccagtgctgctgcagctgcaggtaaacccgagtggatggatgcctgctcaccaagtcccaggctttccctgactgcagctgggtgagtgcaggtgtgtaggtgtgggcctcagtgatgtgctgctatctgctgtcatccgagccagtctacttggccagtatagagtgttcttttctctttcctcttccaatctctttgtcctttgaagataggactactgggcccaaagagcagtgagactctaggaagtacccagactcctttcccaaggccagctctccttagctgcttctccgcctcagtaggagtctctgagcccctgcaggcactgctgtaaagggtctctaacctgggccttcaggctgttctaaggactggagtgaagaggtctgtgttcccttccttccaaagagtgccctccctttatatttgcagacaggaactaaactcagtgctgtccactggtttcgccatcatttagttactagagagcattatcttcaaacctagttcagggaatgatagccttgccatcaaaaattacactaaattactgtattggattgcttgtgttaaattatgcaggactgtggtggggctcgatggccgagcacttcccaactgcgagcaaggttctgagttctatccctagtaccataaaaccaataacattgtggagagctgggtatggtggtgcaaacctgtaatcccagtactcagggcaatgctgtggccggggagtaaacgaagggtgactgagtctcaggccagtctggactattaaaagttgttttctcttgtgccaacatacttaattttacctctttgcccttaaatactgaaatatttactccccaactcctttttttttaacattttaatgtattttattgtcttatttgtcagtggtagggaacagacccagaattcagggcctcacacatgtgaggcaggtgttctaccactgagctagcccctaacctcagcagccttctctctccttaggattacttagggcactctcaagcattaagggctatctttttttttttttttaattaggtattttcctcatttacatttccaagggctatcttaacaatgcattttgcataaacttaggagaagtagaaggtgcaatcagaagtctggagagttccttgccttctgtgtatctcacttctggaaagttctgatcctcacttggctcccagggactatgcccagcctttccatgagagagagtacagaggtctcttcctcaaacgctcctgttacctggaaccctgctcggcctttgtcctggtcctctggtcagggtttgatagaagaaaggacttttgtgctgtatttatggattgccgagctgtagggggtagcagtggcctgaggcgcctactagaacctgcctggaaaggacagactgatttcagcaggtgtcttgaagactaaacccctgttagcttagcatccctggagcctacagacccctccccatatatgctagacccttcctgtgtggttgtgatttctgggcagcttcctgccttccctggacccagatttctacagtacttgtggggcagagtgtggtgttccccagggatgttcatctttcatagcttgtctatctgtagacgccccctcccctgtcttctgcatccccttgcatcctgcagccactccaaacctgtctatcctgtattcctcattgacctgcttctcatggagtttttatctcaagccctctgcccaggtttctagctggggaaaccattgaaaaatgagagacagactgggtccttaaactacaggaagttacacatcctgttttccaaatccagaattctatacctgactgcatggaacgggtcacattcaaaacatggatatgctacaaacaaaattacccttgggtcatgtgtgcagcatatgcagaaacacaagtggatcttgtgtgtgtgtgtggatgtaaaccccatccccaagataactgtattacatttgtatgtattggtagttcaagatctcaacccgcccaggtagaggcttgtttatctaggatattcaaccttccgtggactgagccaggtcctacgaaggccacatctgtgaagtacgtggacaagcttcttcccacgtggctgccctgaggctttgttaatgggctgacggaactacgggagagagctttgtggggctagtattagagacaagcaaagggggaccatttcaagcactgacctatctcttcctgctgggtaaagtcttgcttacttaccatgttcttccatgctttgatgtgactctttcttgaggtgttctcacctaccttcttcctctaggtggggtgattcttttctaaaggtggtagggttttttaggtggtagtccagactggtcaaatatgtgtggcaggtcacgggaaagggagtcatggaaacccacgttgtcataatgccatgttgtttttgtacctgaaataaagcatattttgcacttgtaaatgaaaaatctgtatgtgggctctgtgctgggtcagaatgcaaataaaaccatttgtactaaacccatgtggctggaacctcaacttgctttgtttattgaactgtagcaaatgaatctactactgtagagtattgggagacacagctcagtggcattaggaacacgcacacgctgcccctatgctccgtctgtggtgttctttccatcttgcagaactgaaaccctgctgccttattaaacatggctctgcagtcccttcccccagccctttgcagctaccacctactttgtgtcaatttgaaaatgaggggcttcacttaagtgaaattcagtatatgtctgttgtaggagattaagttacagtatgtgttaggatctcctctgttttaaagcttagggatactcagctgggtggctgggccatgtatgtgtctgttcactctcattgatcacagactccccccatctgtgaccatcaactctgcagattccaaaggccctagttttgattcctataatttcagcagtgaggagcagaggcaggagggtgagaagttcaaagtcatccctggc

SEQ ID NO: 18058 - DNA, 1715 bp, Mus musculus
agattcccgggttctggctcctttgcctctatcattcagctaatgagagagaactttggccaggggctttccaagtacacgcccaaagaggggaggggagccactctgggtttgaatctgagaccatgctggatattctctgctctgagaagatgagtttgccattctgccacctgggaggaaaagggattactgtttcccctggattcttccatgaagctcgtcaaggttgctcaccacggaggagaaaggcgcatcccccgggatattgtagtctcctcagttacttgctaacatctccatttccttaggtagagtgggaccagcagatttcctaaatggagaagaattaataaaacacgtattttactattggggggggtacagggtctctcctggcctgtttacagtgttctgaggtatacagtgaagccctccctgggaagaagacttgcgtctacatgccttgggttgctgtggactaggaataggcagggcctcgaggtggaagaggccttccccaggaaaaggaagtcatatgtttacccgctcctatttctccagtgcactatctgaccactctctcatgggagatcccagggctcctccacaccggctggtggccagcagacaaccctgagcgaccacctgcagcctccacactttctggtcccctgacctctaccctcctctccaggttatttggcatggaccagtgatgacatgcatggtttgtggttgagcggaaggttgaaggcattgattcttggactttgaggaactcttaactgaatttgcttgttcagtatggcctggccccagataagaaatggcatgtggaaactgactccaaaaagagtcagtcagagcgcactgcagggtgaacccatgcctccaccaccacagacatgtgcgtatcccaaacctgttcctttgagttaacagaaacttttgccaaccaaacctcaccaatcagagcttccttctggccatgaccttggctgtggtgaggagcttcttaacagagtctggaccctctgtgtcccagggcagcaaacttctctgtttacaacccagagacaggaccaactccaaatgacagctctgggccatgcccctgggtctctggctcttgtggtgtggactcattgcctgacatagaccctagcttcccattctgtctgtatctattttgtgtagacatcgtcttgcctgaatagactgtgggtgaatccaaatttggtccagccaaatttatattgccaaacatttttagctttttctacatgctataaattgagatgacatgctcaacttgtaaataagtcttttttgtacattaaaagtaattttttcataatttatcttgttgatctgcttttcccttgacagtagttaatgagaatccaggcagtaaatttggtgcatttgaacaaaaattaggctgtatttttttcataacagtgtcaaaactgactaccccaccttaacccagacaggcttaattcaaaatcatttactggctgtttgctttctgtcactttggggtgggggcagacagtttgccaagactgggatacgagtgagcttagcacatctgagtcaagtagctgaagtcccagtatgccagatctcaatacagacccaggcacagtctgtggtttctgtggtgatacccatttggagttgggggtgttttgtttacttcctcatgc

SEQ ID NO: 18059 - DNA, 1196 bp, Mus musculus
aactggagagatggctcagcatttcagagtgctcgctgttcttcccaaggatccaggttcaattcctggcaccaacatggtggcttccaaccagctgtaacttcagctctttggaccaggcacacatgtaatgtgcagacatacatacaaacaaagctcctgtacacatacaataataagataataagactatggagtaatccaaactttcatatgcaggtttataaaacaggtttataaaatagtgaaggactggacatcttataaatgtgtgcttttgttcatgtaaatatcacaaatacatacgtgcatgcacgctcctgtatttcacagtaaagctctcccaccaaggtctttgatgcgtccaagttacttttatactgcaaccctttcagtattttctagaaaagagggtaactgtcattactaaaacacatgctttggggtgcacaagtgggagtgtgtgccatgggggtgggagtgggagcagggtaggagatgcaggggagcccctgagtctgtctagctgcctgccatgcatctggagtgtcctatctgaccagtccacttctttccagttcgaaggctgttccaaggcctactctcgcctggagaacctgaagacacacctgcgttcacacacaggagagaagccatatgtgtgtgaacacgaaggctgtaacaaagccttctccaatgcctcagaccgcgccaagcaccagaaccgcactcactccaatgaggtacgcatggctgcgatatgcagaaatgcatgcagaggccctggcatgtataaatgcatcacccttgactagtggataaccatgttctagtttcatttctattgctgtggtgaaataccctgacaaaaagcaacttggagagaaagagactcacttcaacttagacttccaggttaaggtctattgtggggaagtcaggtcaggaacttcagttaatcatattcttcaagagcacaatgaatgcatgcatgcttacttgcttgatttcttgtactagattccatttcttttttcatacagttcacaacctcctgcctagggaatggtctgcccacagtgggctgggtcttccaatatcaattagcttaattaagacaatacccaataaacttgtccacaggccagtccaaaacaatctctcactgagactctctgcccacatgattctaataa

SEQ ID NO: 18060 - DNA, 1226 bp, Mus musculus
ctgggacttctcacccaaatcaaagtctgtgtgataatttatgcaaatgagggagggctggtggtggccagagtcacagacatccatcaccccatgtcccagcacagtcatccttcatcaggcccttaaaagatagtacagtttttgtttaaggcaattacttaatcttgacaaactcctgtgttaagcagggctattaatggggcccaccattaatcagtgcgaacccaggtgggtgctttctctgaacctccatcactcttggggacccaaggtgggccctttgccatcctcaatgccctaattacacaaacagcatgctaaccacaagcatcccacgtggacggcaggggcacccagccatggacaggaaagaggcccatttttaatgccaggcagaaggttttctgagccaagcaggatgatccatggaggttattagtagggaccaggagcacagctggggagaacagataactcctctcctgagaaactctcctgctcttagcacccactttgtcgcctacctggcggtctgcagaaggattgcacaagtaccttacgttggccagttacgtttacgtttggatgactaggaaggagtttggaagtaccaagccttgccctgtgtctgtttggcatcatcatctctgacaccccataaaggagctgggtatcagagtgctcctcttcatccaactaccacatgtggccctgtcacactgacacctgcccaatggtgtcagaggggagctggccccacaggagaacccgtagtgagtggaatagagacagagcccagaacctggatctccctcaaggagttcatttctgtttggatcagagcagaacaaaacatagaactacttaggaaagacgggggttcatttcagcttgccaattacaagttacagtctatcgttgtagggaagtggaggcaggaactgcaaatagctggtcacacccacagttaagagcagaaataaatatgtacttgcttgcttgtgtgctggtagatttcttcactcttataccattcaaagccatctgcctaaggaatgatgctgcccacaggccaacccaatgttggcatctctcattgagactcttcccaggtggttttaggttgtaccaagatgacaaagctaaccatcacaacggtcaccgaagaaatgtcactatcttatcccaccagtgaggatggaccagaatcagtgtgggtgggt

SEQ ID NO: 18061 - DNA, 1210 bp, Mus musculus
atcctggagacatgagcatggaaaatgaatgctttctggctgcagtgactaagacctgggaaagacagagaagaagaggtgagatctcagaaggacaactccatgtctccatcccgctctggctcttggtgtgtattggtttcactctgctcttgactgtggatgggctatgaccagctcccttgatttcctgcagtgatggactggaacctggaattgtaagctaagttaaaccctgagttgcatgtggaggccaaactgggtgtcttccttggttacttttcaccttgattttcaagctagtatctttcactggacccagagctcctttattatgctagtgtggatggttagcaagccacaggtatctgtctccactagggattaaaaatgtgcaccaccatgtctgatttttttgcatgggttctggggatcaaaagacaaagcctcatgctttagggtgtgctgtttagttttaactggagggtttcagttgagcaattctctagaacatgttagcctatgggcatgtctgtgggggattatcttgcttgctaattgatgtaagaagacccagccaattgtgggcggtaccattccctgtttaggggcctcgtactgtgtaagagcagagagggctgactgagtagtaagcaggcagcatgcgtgtattggtttcgctctgctcttcactgtggatgggctatgactcgctcccttgatttcctgcagtgacagactggaacctggaattgtaagcttagttgcttttggtcaggatgttttatcacaggagcatgaaggaagctagtacacatggcaagtgctttcccgatccagctttcatcccaacccaaggcttagtgaacacaaggcttgtgctgcatcctgactcaggaccaggaccaggaccaggcaagtttgtgttttctgccaactttagatgctgctgatactgcttgacattgttggtccttgaccagttgagaaaagcctgagattcagtggggagagtgtgggccaggcagggctagcttggggccagattgtttcataagctgggtggagcaatgctgctcactcacacagaacaagatccccatgaggccatctggggaagacctacagtccctcaaatatcatctgagaggccatccatgccagaatctttggtaacccagccgacgagcagagacacacaacctacaag

SEQ ID NO: 18062 - DNA, 1229 bp, Mus musculus
ctggctcctcactggtgcctgtttggactatttaccctggctggcctactttctttttcaaacctagggaggaggaggttggaactgtctcggcacgcgctccagtgtgcgtgtgcgtgcgcgtgcgcgtgcgtgtgcgtgtgcgtgtgcatgtgtgtgtgtgtgtgtgtgtatgtgcatgtactcattcatgtatgtgtatatgtgtcattggtgtttatgtttgtgtaactgggaaagaaagcagcttgctcatccttctgcatcgcagacatcactcatggtgaaggaatgtgagtttcctgcaggttggttcttggtaaacatccctcatctctgtttccagaaggcatggatccttcagctcttacttaacaggtctttctggaaaggaaagcataacgtgagtacacagaaacacacgcgcgcgcacagaaacacacgcgcgcgaacgcgcgcgcgcgcgcgcgcgcacacacacacacacacacacacacacacacacacactttgtattttgatgctagaaagtgactctgagtacgtatggaggccaggaaggtatgtgatggctgatcctagcgtgggatggctcctctctttcttcctggggagtacacagctacctcccagaggaagtgctagcctagcactggctaagaagcaggaaagagagagggaaagatggacagtaatgagaaagagacagagacaggaagagacgaagaggaagggaaacaccagcagcagtctgtttgggggacccctccctactcacccataaaaacttgcatgcctttaaaaacaagcaaacaaacaaaatccccagtagttcagagacttaaatctattatcagtgccccttgctaagtggcaagaccaggtccaggcctctcggcctggccctgggtaagctgtccttcactgtcccaggagttggacgcccttcccctggtccaggcttctattatcttaccctgtccgtgagccatttcgctccatcacatctactaccttctcagggtttagaaactgcagtcaggagtctacttggccagctagaggaaaatcaaggtcttgcacaggtctgtaaactcctaaagagcagccgtacaacagtgcaagttcacattgtgtaaactacatgttgagtgcattatttctggtttgatattcttctacggtccctaggaccttcagccagagtgtaggcatgtacatgtacgaca

SEQ ID NO: 18063 - DNA, 2397 bp, Mus musculus
tggaaataggaggcagacactcacaggccatatcccttcaaatgtttgaatttcgcacaccatttcaaaaaccatgcttgccaaagcacatttcacccttagtatataattaagaagagatccggcgacggtgacaggctcttcctgtccatgacagctgtgtggaaaggcagggctcttctgctgggagagaggaggctctcattaaagcggattcttactgctgtctgtcgacgccttgctgtttattcgtgatgctttgtttgtaacgaaacaggctcataagcataagcttgggggctggagatggacttattgatagaactcttgcctgggaccatcatcagtgtcacgtgacctagccctgggatgcgtaggaaagccaggatgcatggccatgcacagccagttgaggccagcttgggctacaggagagcctgtctgaatgaataaacgaatgaaagaacgaacatttggaccctgtacataagagttgagtgcaccccacctccttattcttttctctcttcctctcacttctaggtattctttgatctgatgagagaaatccgggcaaaaaagatgtcagaaaacaaggacaagaacggcaggaaaagcagcaagagcaagaaaagtttcaaagagcgatgctgcttgctgtgagcgggctgcagactgacgcagcagagtgggccacactgcagcgcagcgagccggaggtggcctcccagctggctccccattcgctctccacaactgcattcactatcacttcttgagatgggacagatatccgtgcgtcagtggctggcagaagaaagacgcctttgtctgtgtaatgcctctgttaactttgccaggagctttgagagtctgccctctcccacccttcctgaaccatgaccaccaccagctctagggtcgtaatgttggagatcaggaatattggttgtgatgacaagaaagagcccacttactcctcctcgttctaggacacggtcatctttccttaggaaattaaaatgcttcatattatctgggcatggtggtgcacccctgtagtctcagaactctagaaggtaaggcagggagggtagcctgagcccaaggccagcctgggctacctaacaagaccctgtctctaaaagaaaaaagaattaacatcttattttcttagattttaagagagagtctctggcaagacccccctcatcagttctaatcattttagaagtagacagaaaaaaatatctaagctcaggtaatactgaaaaagccaaaatgttttgtttcgtttcttttttttttttttttttaaagataaacttgtgtagtttggaagcagatttagaaagatgaacttcacttgggccagataggctgaaccaagcttcctggcgtttgtagagaaagtgggacgctgttctcttcatatttaaatgccagccaggtgctggctgtgggctttccctcctcaacacccttatttagaaaggaaactgtgtggggggagatgcaggcctgagccccatagcgagcttgccttttctgactgggtcttctggtcccccctacaccagccataggcctgttctttttcttccttctgaaaactgtgaccagttcaaattatgactcagaacgtagggccagcaccagctacctctgcagactcccagtgactctctcttcacaagcagatgaagggaaggctcagaagggcatctcctgtagctcctggcagctggttctggtggcactgagatgagtgccaccagaggctcacactcactctctgttgagcttcttcccagggaaggggattctgggacagggggctgccactaagcacacacactcctcctattttccagaagtgaacatttcatgtttaggtgccgaatgtgaatctgggtggggagagcgggagcccttcgaatggattttttttttctttttttacagaggttatgggaactaaggtctgatccctggaaactgatcttgtgtcacttccaaagaatcatgggctttttcgaataaaaaaatttacacttttcaggatttcgccctttttcctgcatgccatcgaatggaacgctcagggaaaggaattagcagttgctcgatgttcttaacagacgtgctgcggtatccaacaagcgttgcttcgctgaatcccctgggttgggaaacacaactataaatacaagcgataactgtagcttcatctctcctgtgggagacattgccatcctccttcgcagataaagccctgaagacaattacacccgagcactaacagacagccctgtccattaaagacttcgctgacataaaaatgtccccgtgagagagatgactcggtaagaacaggtactacaaaagtgtgagagc

SEQ ID NO: 18064 - DNA, 1410 bp, Mus musculus
tgtggagcccaggatggtcataactcccagcagtcttcctgccgcagctttccaggggctggattttcagtcatgaaccattgagtctggcatagacttgttctgacaggttttctgtttggttggctttggttttgagttgctaggggtcataaccagaaccttggactgggaatggtggcatgtctttaatcccatcactctctgagctgcaggcaaactaaggctacatggtgaggcccgtgtctcactcagccactgagctatgtccccaagacccactaagtttgttctatagagaccccgagataacagatacttcaccaatcagttctgctggtgctgcgcagcatcatcagaggcagcactcagcatcgttgcattcactgcagctgattcacagtgctgcttcccagctctgagcacaggagagtgctgcctgcagtccatggtctgcagcactagcagccactcaggcagccagcacttgaggacattgtgtcaagttgtccacagggctgcaaggagattgtgggtctcagctgtgaaagacttggacctattatttgatccatctcttgaccatccagttgactggaaatttgcatacatgtatgtaataaagaatgtgggtttatagatcactgatgctttttttttttttttttttctggaaaaaaatgaaacttgggtttggatggtcaggatgaactggaaacattcctattccaggatagggaacttggtttgcactgtggagacttggcctgagctgtgttctgctgtgtgcacttctggtgggactgcttatcttcttctttatggcgttgttgggggtgatagccactaattctcaggattccttcttatctctctctgtgtgtgtgtgtgtgtgtgtgtgtgtgtgtggtttcatggaactctgtgctctttctgtgctcacatctggatacaatagacgattatgaggattcaccagctcttttgtgtttaccttttctacatgttaagctctgcagtagctttgaaactgtaatttatttttgtatcacatgcactatattcagtgacttcctgttgtatgtattagaagcactgcagtgaactgtgagttgtctgtacactgaacaagaactctaggtatgacccattgcaataaaacttccatgagagttcatgttttatgagctgtttcttgagcatgaatggccctggctaaattgttaagtccgagccactgtttattgtaaccaaatggactaaattgcagccctgatacagtgttggggatttgtgtcagtgtgggtgtgggagattaggagtggaaatgtttccaaaggccagaaccctccttggtggctggggagataattcagtgagtaagcacttgccgcacaagttcacatcccc

SEQ ID NO: 18065 - DNA, 1099 bp, Mus musculus
ctttagcctgtacccaaaaaaaaaaaaagataatgttaaagtagtacccacccatcatagaaaagtgtatggatatgaacctatcatcccaaaacagaaatgacactgaatagctttacctgcttaggctgaaggatcaggcctcagttgctgtggagacaagggtgatgtgcagacggtggtggtgccagtagtgttgcactgatgctaagctgctaagctgtgtcccctggagtttgttctgcccaccatgtgatgtgtactcattcttgcttctcagttaagaagacacccagctcgtggtctaaggagctgtgatttgaactaccctggcttccttgtgcatagtttgtgctcaggcaaacactaatgtcttgattgggaagcccagggggttcagtttcacagtgtccagaggagctggacagtttagaaacactttctaaacagtctgctaaggagttgctcttcttgctggctgtctccccttagccagtagtgtatcttgtgtgatcgtccgcagtgttttttccagtcctgagtgataagacatttcttacaggatgacacttagaattggggcttgacccaggcacactgcactgggtttcagatttctggtgtctggaagtcctggatggcctgcaaggctagctgttctgctaacacacacccaagacacggcggcttagagggcctaaatgtcctgttctgcttagaagcaagcactgtcccttcaagattgagtccatatgagtatcccataacatttttgtctccaggtaactgaattcttactagtcagaatatttgctagtgacttggttaggattcacttgaatcccagtaaaaagaaatcctatgtcctactgtcaagtcctaagcttagaagtacatattgagtgacatattttccctgacagattagacactgttacatgtttcctgtgctgttacagtagcagtactctgctcctttgagaatggtagtgtctaatgagacaggcctgagggcgcctgtggaagcagtagaggcagggcaagtccatgagacagtgagaatgctgacagagtgaggctgggtaagaaggcaacaggc

SEQ ID NO: 18066 - DNA, 1224 bp, Mus musculus
tgtgtttcgtgatccactgagctttctcggtcatatagtttatcacagactagagggaagaagaagctaacaaagccaggctttgtggcacccacatctttcttcccagcacttgggaggcagtggtgaatggatctctgtaagttcaaggccacctggtctacatagttccaggacagccagagcaaatagtgagatcctgtcacaaaaaaagagaaaagagatcctcctcacttcccatcttctgtataatccctctgggtttgaagctctaaccatacttttctaaagtagatcactcttgaatttcctgaaggctttaaactctactggcaacccttagtttttaggtcctatgtttcctggcccccttaaagacaagtcttttctatcatcttagtgtgactgtaggaaggaagctattggactcagtatctaaagagtctgtgttggatatcaaaactgagtgttcctccccagctgccctttcttcctctccatggcccccgtattctcctggaggaattagtgccacctttatccaggcctgcttttatttccttccagtactgcattcaatgaaaatgatgtgcccgtctgtaaagattccctcactccggtgcatggcacagctgcagacagtgcctctgtactaaaggtaagaagattgctttccatttttcaaaagacaatattgagtttaacctgtactataatgagggacagctggtgacttgtagttggcactgggaattgaggcaagaggcacagctgagcttcatctcctggaaagacaagaatcttcttcccagtctctatgctgcttgtgtctgcttcagctgggggcagtctgcttgctggctgtgcctctacctgaagaaacagcactttggtacacatcaatttgtttagtagttgccgcaaaatgatatcaacaatacatgttttcctagagctctctattgtcaacagtcctgcatttccaacagtaacttcttttcttacgtgatcacattgtattgctgaattgcattgactttctgccctaacgcaatgcatggcctgcatctcactgccacctgggtgccctttcccttctcaggaggattcagctggggcaccaggactctcctatccaaacctgccaggctggccacaagccagtcactgtctgaactaccaggctttatctgtgtagatgcaagagctgcatgaatattcaca

SEQ ID NO: 18067 - DNA, 1185 bp, Mus musculus
gcatagcactgtgtcctcgggaagggttttcaatgttagcatttaacacatcactcaaaacatctctcaggggattcatgtttatgacaaactgtcagttgtcatccacatgccatctaagtaagactgagttttaaaggttaagacataaaatgtacacccaaaaggaaccatattcagtcatggtgcctcagccttttgtggtgctatagtaatactcttctcatatgctactctctaaagtggcccatgccttcatttcagctaagagcctgcggtttaataaaaattattataatatttttttcttaacaaacattttattaccacagctgtagaaaatgcaataacagcatggttcatgtagagagatatgtctgaaaggtttctttgggtggttaacttagagttaacgtgaatggttaccttactagcaggtggttataccaaatgcaaggtggaaagctttccttgttactcttttctcaatgaagtccttgacagatcatccgagtttgtatcaccctcataatctgacccatacaacctttaaaataaaattctgaagtcaaagtcttaccatttttgagatggattacctgtataattcaggctctttggtttaattcacaaattagctggaaaagtacatgatgattgacacactaggaagagagaaacaaaaacagtatttcctcttttacaattatttttaattttagaaaaatttctgaactttaagctgtataaggagaaatgagaagggttatattcagaactgttaatgcttggaaataataaagctttgttatatttaacctgtcctgcttaactcagaggttggcttcatcctataggttctctcttcagagggctttgacagaagtctgctgttgtagatacagtagggcttgtcactagaagacaggtggctaaccaaaaatatttagagcatgaaattcataggcaaatcttgatctgatttttttattatataagagaatcattgcttaaatatactgtagatgtaagatggatattcaaaattttagtatatcctacagaaaagcagatgcatatcttaaatatctccaagactcaccatctagtatgctctaaagacaatactaatgtacaacgctctgagggttttttgttttgtttgtagctcagattataactaag

SEQ ID NO: 18068 - DNA, 2802 bp, Mus musculus
atatacagaaaatatttttctatgaacagaaggttaaaactttaatttcattgcttaaaagggataaaacaatatttgtatgtctttcatgctgtaaagaaaatgaatgtatctttcaaatgttcgagttgttacttgattctaagtatatgtgttttagaaaagcaaactgcaaaaggttgaagagtcttacaagtcattatgtaaaatgcaatgttggaagaaatggaatttcattataaatgagtagtcactatcaaagcatatttcagatatagtgtacattcattttcacattgatttgttttatttctagaaatgtttcttaaaaattgtatatactgttttgagtgtaacgtaattgatttctaacttgtgttaggcttagtgtgctgctgcatgtgtctaccatggaggaaagttcccaagctttgtcagtgtcacagccaccagtaggggcatcattgtgagaatgtgaaacccatgcctaagagccactgcagtaaatatgtgcagaggcctctgactgtgctaatgtgtttccctttttatcttcaatgacatatatagtaagactactggaccgaactctcctgacttgtaacagtggtggcttgtatgcttacaactttattcagctgagtgaagactctttaaaccagtgcccataggtgtgagtgatttgttcaatagcttccttaaatctagtatttaccagttattaaacttgatgaaaattgggaattcattgttttgacacttttctagccattcatacttatttcaactcatgatgtaccctgaacaaccaaaaagtgatccatggttagtgtcatatttcctctaccccagcagttacaaagtttagcactgctaaataactgatgacttagaagttgcattgttaaatacagtcactgccaaggatcatcaaggagatagctttctttaacctttggcccagatagttgctgcttcctggtttccctagatgtgctagctatatatctggtatatgtcttcatatccactatagtaacaattgggcctagtttaccctttaaaagttttttgttttccactcatatactattccagttatcttccttcccaagattgtctggattcattttcccagtgtttgaatgagttaacaagatccctcactcctgaatcctgtagagtcctttttcagtgctaaaattgttttccaatagcactttatttcatgcctactactgatttaatttatacattaaaaatatctatcctagagtttgtaaatacagaaaagcaattgattagtagtagagtttattagattggccccaagtttaaatgctttataatgatctcttgatagcttctttgatacttaagaggtaacttatgtgactttagctctgccgttttcctgtaatttgtataatacagtagaggctgcccagccaactatattgctggacttatttctctcagctagcttcagccgagcttggttactaaaactgtttttgtgctctgagttttggacatcacatgaatatttggaaatctgtttgttttcagtatagtacctaaagatttagtagatactgcaccacaagttcatagtttatatgaaagacaaagggcagaatttataatattgtaacagtttatattaagctgtttttataatctgccagtacaatacatctgctgtaaaaatataaaagttgtctaccccagtggtctccagcacagaacacaccaattctaaactatgctgtggacttttaaataagaaaggctagttattgtcttctacagggtaggttaactttaggcctgatagcttatacttatcagtactgttttaaacaggagtttaaaaattatttttttgtagagggtattttaatttgggaactttctttttttgtaataggtgctatatgtaaatatggagtgagaagttgcttgattaaaggtctagtttatttccttattaaaatacttttcatttctgtttccatttcatggtttctgctgaacttaatagcaaaatagaattagtcccttaaagttgtagactaccttttctcacagttgtacaaactaatttccatatggtttggtctcagattaagaggcaaagaagctaagagtgaaaacaaaatacataagcttgaatttggtcaacactggactattagaaattatcactgtgcacttgtcactgcagtttactttgtgtctgaaaggcattgtgtgtgtgtcataatttcagtgaaaattagaattcctgccattcatgtttaaacaatccacacatagcaacagtgaacaggataaaaatgctggtttgcattgaaactgttttagtcctaacctcaatttatattatgcaaaatacatttacagatattttgttggttatatttcattttgatttagtacttgttcaggtacaaatgtgaaacgaaaaaaaaaacccacctagctgttaatgttcaattgaaaaataaagatgcgctttagtaatctaatgacttcgtttcaaggttcttttatggagacttattgttagaccaatgaccgtgatttattcattaatgggtgatcagttagaagggatggctgaatgctaaacctgatgtttatttctacaatcagtagtgcacatggtgtctcttctctgaaggggggagtagagattctaaaaagaatttagaaacttgaagactatttgtgcgtgtgctatgtgtgtggtgtatgcatgtgtatgtgctggtacagccaccaatgctcatagaggcc

SEQ ID NO: 18069 - DNA, 1988 bp, Mus musculus
atgtgagaacttgctcactttttcacatgttattttatatggatatggttaaaatagacacatttgctagtggtttcagattacttatgcagtcttgataaaacataggttccaatggtagatgttttggaatgctatttagttgggagaatgatatacatttaaaaatctttagtaaaatataaatcattgtttcatatattcagaatccataatagtaaaattcagtatttaaatattaattgccagggtaccaaataaattgtcacttataaatatttcttgtcttatttttaaagaaagaaataaacatatctttacatcaaacagaagtccccctattctgatttcacatgcaagacaatattagtcagtgaactataattttgctcagacattccattctctacccagaggcaaatgtaatttaggctggtaggatatcattgcaagttaaaaagggatattgggttggagatctacacattataaagctattttatttcattggtcgattttagcctaaattttaaatcttgccatgtgggtagaaggtgacaaccatagaccgaaagagaaaagctagtagaagggcagtgtcgtgattcatttgctctttaatgtaaagctttgggtacatttctgtagataacactgctgttggcagtgagctttgctgccttttaagtcggcagtgcttgtttttaagtgacaaggggagaaataaatttaaatttctcatagaaattcttgtctaagaactatactccattagtattttacgtgtgaaaacagcccttttagagtatttattaggatcctaagctaatcgtagccttcacaaattgttactatggatatgctaattaaattttgctagttacctaacatataacagtcctttacatctaagcatctaatcagttaattaatctaaatagatttctagaaataatgctagttttcatacgccaggtagtgctacactccatacatattgatgtaatattgtgtgacaatacccaaatttcttgaatcgaactacttttccatttcactcgccacttgtaagtccacaccccgacaaactcaagaaataatgtgtttctcccaacaagtgaaaagtcagtattggtgagtcaggtcttttgtacatgctaaaagtaaatgtgaaaaacttccttccctaaattcacatgacttttctgcttcttttattgggcatttggttatgtcagcactgccgagatgctctgtagtaatcttttgaagtagattttgcattcacaaaaagaataggttgtatttgctaaactaatccattcattcaaaagtgagacagaataaatagctcaagaaaagcttgtgtgtagtttgctgggccaagtaattgggaaagggtaatgactgatcattttgacttaagaataaaggtaacagtgtatgaaagttgacttcacatgcacttatgctgagccattaggacggttgcttgaaagttttgggtactactactgtacgtgccttcatagagaaagatgagtgcattgatttgcatgtgtacttcataaagacatgtccacagacttttaaccatggggttgtttatatctcttggcaggtctgaccaagtctaatgagttacttgagcaaaaaatctcttgtctcactagaagtagtacttgagagctaaaaatttgaaagattttgttcagtttttatgtccttgttattataagaaggaccacaggtccagcaattaatttagcagaatctagtcatcttcagattttctaattctcaatttagtgttgctgtattagactataacttcagtaaattgtgactatgatcagtacttgtaaagtttacctatttctacttgggaggcatgctcagttgtcacttggaacctgtgacaccttagaagtttgaaaggagccttcagaagtgatgccaattaggaactggactcagtttgctagagc

SEQ ID NO: 18070 - DNA, 1145 bp, Mus musculus
ttcagggttttttttttctaatttatcttttgaattgagttttctggaagtaagaatgtttgttccaaaggtaaaataatattattttattagatattttcaaatttctctttatagtttcagtattttaacattcctatcagcagtgtcttgggttttgccaagaaaatatcatgtgagagtttctggtttttttgagttttcttaactttttacccattggtaaaacttctaactccgttctgtttcatgttttaagttttttaataagcttgatgagtgagatgttagtttttggttttttggactttgttgcagtgattctggttttttctccttgtgtttttcagagtcaatacagatttgtatgtgaagctattctgaaagtttatgaagaaggatttgttaaaccattaacaacatcatcaaataaataaaacaaaaaggttggaacaagtactgggaaactgattttgttatgttcactgtgccataatactgcttgcaagaaatggcctctcacacaaaaagtgaagaactcaaaaagacgtcaagaacttcagcactactgcactttatgttttaaaaagtcactcaaaacctattactcacatggttgaccattttgtgctttgctctgaacgacgagtgaaaactgaatatgttcagggtagtttatggaattttgaggtgttgccatgcagtcccctcgggtagaattgccacagataaggctcagaattctcatctcttacacacccgtaccttgaaagcaaaaaggagtaaacatcaggagtctgctctggtctttcccagtggttcatgtactcgctctactgagtaccagattttatttttcaaatgttagcaataccattctcaacattagccagtacactgcctgtggatgcagcacatcttccctgccatcccaatagggacctgctgttgagaagaacattggaacgtgctgttcccaggaaatgctgcacagtgtccatttaccagcatctcagagaactaactatgaatctatggattttcttggatttaatgatgtaacttatatttatcataaggttggcttattccaaatcatgtgatttcacattcttgatgtaaaggaatgcatgcatcgtgtctta

SEQ ID NO: 18071 - DNA, 1138 bp, Mus musculus
ggatgaaccatttatttgtgtgttaatagagctcatgttaaacaaagttaaggagctggatatggctcagcagttacaagcacttgatgtatttacaaaggaccagagtttgacttccaatatccacatggtaattcacaatggtctgtaactctagttccaggttatctaataccgccttctggcattcataggcaccagacatgtacttgttttacatacacacattcaagcaaaacgtccatacatgtaaaactaattttctttaaaatggagctaagagggaaaataaataaggataagttgtaggcctggcatttataggcccaacatctaagatctgagctctcttatactaacttgaacatgaaagatgcttagtgactagttgggtgagagaatatggggctgatttattcagctttgtgttcatttatcatatgatcaaagctagcatatctttagacataatggtgtatagacttctatctatgccattgatccatttcctagaaattaagggcatgtctattcagatctccagctcaaaatgcctcattttctctatttttgtaagtatttattaactctgtgtgtgtgtgtgtgtctgtctgtctgtctgtctgtctgtctgtctgtctgtctgtgtctgtgtctgcatgctcatgatcacacatttgaacactcctgtgtgtgttgatgcttgtggcatgagcccaggatcccaagaatgtcagaaaagggcatctatccattggaactggaattacaggaggttgtgaattgccaggtggatgttggtaactggacctaggtcctcttcaagagcagaaagtgctcttaactgctttagtcttgcctcattttcttaatgtgtcttcagatattaaatatgtagatggataaagaacccttcttttttccaaaggaatagcaacccccatagcctttcaaccccacagtcattcttgtttcctacacaaaggcaccaatcagatataatgcaattattagttattgaatctatagaatacatctgtcaatttcttactgaattctattaagattcttactgtgctttttgttgtattttagctgtatatgatgtagtggaagaaaaactagaaagtgaaccaga

SEQ ID NO: 18072 - DNA, 1149 bp, Mus musculus
taccacaagatacaagatacggaatgttttttacagaaagaaagggaaaaaatttcactgactatacttcatgtaaaagaaaaaataaataaattcagcatacttttttaaaaattatcttttttggacctctcctccttgaagcagaggctcagaaaatcatcgaggagatgaagtggtgggaattgttcagtgcactttgtggtaaactgtgttctgagtacagtagctacaagcaaagatttataacatttgcaatttgagaaaatgtttgatagcaaactattgcttctctttatatctttttttctattattcctcattctcttatacttcctagactaatcccttttttgtcatataaatcaaataaagccttttttggaattattttataaatatatcagagtaagcaaactctttgactatgacttattaaaagaattttaagatttgactcatatcaaaacaaaaccttttatgtattattcacttattttctacagatctccaagtaagcctttggcacggaaattaatggattgggaagtagtcagcagaaattcattatctgatgacaggttagaaacacaaagcctcccatcccggtctccacctggaactcccaaccagtaagtggcaagcccgcgtcatgcttgcattttgtacttattggctacggactttattgcctaaagatcacaatttataaaaatttaagttctttgttcaaattttcaaaaaaaatttttattgtgttttactttttttaagcgtgagtcagtctctctctctctctctctttatatatgaggacatgtggccgtgtgtatgcaacagtggacatgtggaaggtagaaaacaacttgggggagtaagtttttccactctaggattcccaggattgcaaccaagtactcaggcttgagggcagatacttttacctgattggccacctcacctgtccctaacagggtttttgttgcctcaaacattgcctgtttgcttgctggtcattataaaagtgacctaaaatagccttagggaatgagcaagaagaaaattgaacagcctttactttcctcagcagttgattttcaccagaaggataattcaggatttagtcatgacttgaaattttcataaaac

SEQ ID NO: 18073 - DNA, 1722 bp, Mus musculus
aagggcctcttcctcctgccctgcctcaaccgcagactcaccaagatacgcaggggctgggagaaagatggggctgtcaagttcatgctgcccggcgaccacacacagggggagaaaacaagccacgtgtgaggccctggaagtggagatggcttgtgggggccctgagctgggttcgggtctcttttctggatgctgcacagcgaggtgatgatatatgcgtgggtggctgagatcctaattcctgggatgcaggtgtaaactgacatactcagaatgacaccccatacatgtgatatgtacttacatatatttcacatataataagatttgctattattcttacttagctaaaaaaaaaaagtgggtccctatatttcagcgtaagcatttcaaagcaaatgccacacattgaacagcagatcccacccttgtggtatctacagaggcagacagacactctggtataggagaaactgtctttcgttggattctctcctttaatctctatgctccttattagctgaatcctaaagttggtgcaaagctggggcaagaaatgcctctggtgccgcctacccccatcccagggctaagaaagaagcctcgagtgaacagggaaccaggtctggactctgctgcttccctgggcgtgcgtggggaggctcagcaagaccccctgggatctatgcaggagctttttcaggtccgtcctttcttcagggaagggtctgaagctgccccatctgatcctagctgagctgagaagattcttccccaccccctgaaagtccagagtcaccaccggagcctgcaaattgatccttctgcgaaggtgtgaagtcaccgcctctccagagccattaatgaacctggtcttcgggaggaggataattgtttcctctccattaagttgctggtgaccccccctttaaatcactgtgccttctcgccttttccatcattaatttggacatctccgtggagtggacacttgtctgggcagtccggggtgggggggagcattagagattgcagagaataaccatcgaatcctcttcttggggcaaccctccccttggatgtgccccaggcctgccttcattaaattggtccctgaggagaataatagggacccttttcatttaccctgtcgcctgtaggcagaaaacctaccttctgagcacccagaaaacacagtggccccatgctcttcttcagggggttccacagcccccttccccgtgtttttgcctccctccctccttcctcccctccctccctccctcactgttacgttcaaccacaaaagtcttcaaatattgtttttttgaattcttaaagagacctcattttattacaatagttaaaattgtcctttgtttattattcttattaagctttcctgggcctggtttattaattagacttaatcacaggcgtgtataggagaaatgtaacatatgcttgtgtgtgtgtgtgtgtgtgtgtgctcgcacacgtgcgcacactcccacatgtgttttgattatctacagtctcaggaatcctgagactgctttataattcaaaacaactgggagtggcttttctgccaaagctacaagtgtcaagctttactgccccaaacacagagggccagaccattgtcagggcatggcgcatctatcctcccagccctgtgacgtccatctatgaggaaagagttaggaaagagccagt

SEQ ID NO: 18074 - DNA, 1770 bp, Mus musculus
gacccagttttcccttgattgtgtatgtgtgtggtgtgtgtgtgtgtgtgacacacatgtttttgcagtctgtgattgcttctgtaaatcagttaccaacctttcggtatttgatttcaataaatgtaagatatctgtgcgctacatgaaagatatgtttatgagtacatgaaatttctaagttttttgaacacagcatacattgtatcacaatgtcaatgtgccaaacgtgttactgacacagagaataagaatgctttgaacaatttagaaatgtaatgaaagagaaaaagaaagctaaaaacaaagcaaatagaaagcaaattatagctggccgttccctctcaccggctggtgtgccttttcccgtttctaatcagctgtgttcgtcacagcacccacatgtgttgtctctgttgctatcgtttcagagtttgagtcttatatggtactcatgaacttccatagaatggttttaagtctgcattgttgtagggacccaaagaatactttcccgatttcttcagaaggctgtgtgatgggcagaggtggttatcaacatcaccccactttgagtctacatttggaaaaaacaaatgactaaaatcaggggctttgtttagatgaatgtgcttgggaatactgtgtagccctctctctgccacagaggccaaagtgatgctaattgtcactggctactgaagctcacagctccagtgcatggatgacaggaacacaggcagatcaaggtgacaggtcatacagaacctattggactctagaaagcaggccatgtgactgagcagctatagagggcctgagtgtgtggccttcatcagtgcagtcggaagatgctggaacctgactccctgtgtgctaatgtctattacaaggtctgtccttggagagcgtatggagagcacacttcacacatcccgttaacaacgcctgccatgtatttatgggttaagtcgatcagctgactctccgctcgctttgcatttctgaaattgttaattgactggcacacaagggtaaattcttctgactactgtggtgtgcgtgtgcttctgttttgagtgtgagagaaaatgtattcatgtgtctgtgtgtgcatgtgcccatgctttcctatagtgtcaggtagacattttaatttcttttaaagcagtgctgtcagactgaaatcttgtacactggagtgtaatgtgctttgtgttctcaggcgcagagtgtgaacatcccaagagtactccatactgaatatgtatacacaagcctaatggtagtagtggtgaccacactactctatttattattctgtctttcagatgttattcatttagaacaaataaggtatatttttagaatcaaatttgtaaacactataaaatctttaataagttataaggtctatgatatgtttactttgaaaattgctgttgaaagcaagatgtattaaatatgtaattatcaccatgtgttagtcctttttattcatgataaatattagaacattgtacttgtcctactttgggttttactgctgtgaacagacaccatgaccaaggcaactcgtataaaggacatttaattgggactgacttacaggttcagaggttcagtccattatcatcaaggcatggcacagatcaggaaggcatagtgcaagaggagcttagagttctacatcttgatttgaaggtttctaggagaagactgtcttccagacagctaggatgagggtctcaaagcccatggccacaatga

SEQ ID NO: 18075 - DNA, 1188 bp, Mus musculus
ctccacctcgttgcagtggtagaggcagctccagcatggctaaaccttgggctccagcttcctgtgtgttacactgacagaaacacaaatgaggagaatgggggtttatttggctaccatctattggtgaggggcactcagggcatgaactgggccagctgctacctcacagtaagcagagagagggagcgcacgcaagcaagcgtactgtatagtgcccagctggctctctcttctctcttatagtctgggcccacccccagggaatggtaccactgactctcagcctcagtgttctcacagtgattaaggcgatcaggacaatctcccacagacaagttcacaggccagcctcttcctaggtgatcctagcttgccttaagttgaaagttagcattatcacacctagactctgtcctgctgcccctgatgtgagctaaccgggtgggcgcccccatcctttagtaaaggtctactctgctggcatggctggaggcacccagccacaatccaggggagcctctcatgttgcctttctcatcccctcaggatgcttacaagccccggcgaaagtaccgacggcagcggggagcagaggagctgccagacgaagagtcccgagtccactccacacttctggaatatggcaggtacagagtgggtgctggtcatcgagtccaaacccagcaccacatgaaaaagtccagagtggcggcgcacacttgttatcccagtgaggaggtggagacagggagatagatgctggggctccgtggccagacagcctaaactaagcctgttgagtaagatccaagccactgggagaccctacctcgaaaaccaaggtggaccctgtcctgaaaaggaaggttgttctctggcttccactcccctgtatacacacacaaaagagtaggtattgatatatttagtggatggatagatagatagatagatttatagaatatacatctaaataaaggctttttgagttttcatgtcagcttactagccctctctcatcctcaagggtgcttttcccttcttaataaactgtcgaaagaaagaaagaaagaaagaaagaaagaaagaaagaaagaaagaaagaaagaaagaaagaagagagaaagaaatgaaaggaaggaaagaaagaaagaagcaagcaagccaacaattaattttttgtta

SEQ ID NO: 18076 - DNA, 1225 bp, Mus musculus
cggaaacctagcaactgggtcatgctaggtaaaccccagtgtgagatttgtgctcccttctgtataaacttagcatacacatgaacagcaggttgggaccattaagcagaagcaggtgggggcattgggcagtcacagaagaagtgcttctcaactttagtttcctaatgtatgattgagaggcatgaggcatgcatactgataggaaagaaggggtgctgggctcagtgggtagggtgcttgtctaggttccatccctagcatcacataaatagacatggtagcacacacttgtgatagaggcaggaggatcaggactttgagtgtatcctaggctagaatttcttttggtgtggttgtaggcatgatcaactacaggctgcctgtagccaaggatagctgtgaaggtggcccaacatgaaattgtaaagtaatttagaacacagattattttccatctcttctcttaaaactccattacactatgtactccataaactttgtaggtggcggggtcatgttgtaaaagcataacggtgatcactcctgatagagagagattgggttggtaactcttggtagagagaggttggtggctactttgtcccattccttaatccgcaaggcttaatagagatgatgagaggttcctgttcttctgtaccaggtacaaccgccctcctgaggagcaggcaagagatctaaacagaataaggtggttgacctatgcctctctgagtccagtgctctcgtcttgcctggcagatttgtattacaggctgcaagtccatagctgggtaaggctgttgctgacactgttaccccagcgtctgtgcagcaacatctgacacagggaaagctaagccatcagaggagaggcttcgagctcagatctaccttgatttctctctcctacattcaaagtacgtgttacctaaagcagtaatgtcttactatctggttctggtaagcaacaatgagcagcggccgacctgtattgtttagagctttgtgggtagactgtgttattctttcaattaaacctgaggaccctacatttgtatcagacatcctaaatcagatagacaacactttcgtgagtaattccagcatgaagtgggctgctcagtctgacttattgttggctgaggagattccctgagatccctggtcagttcagaatccacctggaggctggtggaaggggagggcctctcagggtagt

SEQ ID NO: 18077 - DNA, 2213 bp, Mus musculus
tctgtacccagacatagctgtacccagacatagtatagcattgtatttggagcctactggcttttaccagaattgtaagatggtggggaaacatctgtaggtgagtcttttttttttttggtgtgtttgtttgtttgtttgtttgtttgtttgtttcagtgtgtactttaagagaagccagattcagagcagagagcttgttcacggggctggctcccagtgccatgcattcttaggaccagcctctaggtcaggagctacctcccctcccatatgcttttcatgaagttcctgaggatgctctggttgagaccaagctcagagcagctgtgagcaggctgagactgaggtgatggtggaaggcctgggaggatgtagggacgttctctacttctccgtgttcagtggttagtcggccagcaccacaggggcagtggcgagtaccatagaatatctgtcaacctgcatccagaggtactgtaatgaagcagagtccacgctgggcataagctcctgttagtctgatcttctggatcagggtctggtttgtagcacttgattcaagaacagtggagacgcaggcttgtggtggaaccaagccagcattggtctccaggaaaggctttccttctccagactgtttctgggggacccctgaggaccttgaacaaagcacggggcaggccttccaacagctctcttactacctcccaaggtgccagtcctatccttggcactttggcagactcctgtcttttctatcttgaatattgtagtcactacctgaaggggtatctgagagacacccagcctgacctgcaacccctatagtgcatcccttctccatggttctgtcttgcctgctcccaaggtgatggatggctagtttaaaggagctgggcatcctagcaataacttcctacaggaactttggcttgtgaaggttcaggcagttgaactgaattatgctctgagaattaccataaggaagtgttttatgatgtgttcattgccagggttggccactaagacaaagaccttaatacagagcagtataatgaagagcccagtaacatgggtggtattgtctgttgcagctgagcgtggctagaggaagagtcaatgccttctgagatgcatcttagagttttccatgctcttccttctagcagcaggtggcactgggccaaaatagtatgtaaaacataatggagggccagggagatgtcccagtcggtaaagcacgagaacctgagttaggatccccagcatcaaggccacacatagcagtgtgctcttgtattcccagcccgtgagaggaagaccaaaaggacccctggggctcactgaccagccaggccagctgagttagtaagcttcaattcagtgagaaaacctgtctcataaaattaggtggagagcaatgtaggtggcatctgagttgacctctgaccttcatatgcacaggcacatacatatacatgcacacacatccccatacacataaaggaacattcatatacaaaaaatatgcatgtttttcttctcagaataactatgtataagatcatgagcagggctctagtgcctcattggcagtgtgtttgacaccatggggagtcgcagcttctgtatcatcatcggcctgtatcaatttcccagatggccacgctcacccttcattgatactctcttcatgtgtctgtcctctccacgattttggatgatgtcatcacaatgatctcctggtcatatcacagtccactcgtcacattcctgttgtctgtcttaatgacacatgtcactgcttaagtttcctgatccatcacaaggtctacatctcttttctttggaatgtgtaagggcagcggatgcagggaccctacccacctcactgtggctcatcagacagtcagaacattccagttggttaagttggctccccaaactgttatctttgcatcctatagtagcaaaatatagatctaacctaacctatgctcaggtttaaacaggctgccagttctagtcagcagcactagagaagccctcttaagtccattagtcactaaccttgaaggatggaatggaaaaggagtttcccagaagtttccagactttaactacaaggtcaccttttggagatgtgtagtattgcggcagggaaggcacattaatgtcgaatagggtcattagtgtgttcttccttcaga

SEQ ID NO: 18078 - DNA, 1178 bp, Mus musculus
cacacacacacacacacacacacacacacacacacagagagagagagagagagagagagagagagattttaaagtctactaacagacattatatgcgtgcagtctctgaggataaaatgaagtacatccaggtgtctatgctcagatactgtcttggttatttttctcttgctgtgataaacactatcaccaaaggaaactttgggagtaaagaggtttatttcatatcacaactctcaaatcgcactccagaactacgggtagtcaggacatgaaatcaaggtgggaccctggaggtaggaattgacatagaaggcatggagtatgttgctttctagcatgttcattctgctttattcaccattcttttcacaccccaatcctttcactctggggatagcgccacccacagtaggagggccctctcacatcaatcattaatcaagaaaatattttacagcaattgtatgaaggcattttgtcaattaagattgcatctcctcaggtatgtctaagattgtatcaggttgacaaaacaaaacaaaaatagtcggtagtggtggcgcacgcccgtaggatttgctgaaggaggcagaggcaggaggatcacgagttcgaggccagcctgggctacacaaaacaaaaataataaacaaaacaaaggaaaagaaaacaagactgacaacagacacaagagaaaagaaatatgtctcttacttgaaataacttgaaattccgttgttgggggcaattctgtctctctctctctctgtctctgtctctctgtctctgtctctgtctctgtctctgtctctctctctctctgtctctctctgtctctctctctgtctgtctctctgtctctctgtctctctgtctctgtctctctctgtctctctctgtctctctctgtctctctctgtctctctctgtctctctctctctctctctctctctgggaaatagtagtagctaatgtaaaacaaatagtaagacgaatacagccaaactcaaatatcacatgagcttataatatgcagagttatagtgaagatacgtttagtttcaagtgcagaaatcaagagaactcagtattagctgatgacagataacaggactaaagacaccttctatgtctagagctggaccagatcaggaatgccccaaattatccagtc

SEQ ID NO: 18079 - DNA, 1240 bp, Mus musculus
agctacacttgagggagtcccctgcttagtataagacttttcttgccttgcctgtcatatctctcatatctgttcattgtttgtttcctttgctcttgtcattatgggtcccctcccctctaccatcaaggaaccccagattagggcactcaaaacccttctagttacttgtggtctcaagataaaaacatgatatagaccaactttgagaggaagttgctattttggccccctggatgtcaccagagaatatgtaggaccctgacccctggatgtgtgttctcttcctcatctgcaagatcaaggtacagtctgggattacacctcccttgtgttttgtccctttcctccttacagttattgccagtcttaagaattcttccccagaggaagtggtggctgcccattacaaacagtgccaggatcaggctaatattcaactttctattatgaaccactcccaattttccaggaaagtaaaatgatctcaaggcgcggcgcggcgcgcgaaatgtggtgtacagaagacccactccccagcgccgcttgtgggctcaagtccttctgatggaggcccagccccaggcttgggtcttcccggagtcgggttgcttgggaatgcagcccaaagcgggtggtaaactccatctaaggctaaatacgggcatgagaccgatagtcaacaagtaccttaagggaaaaaaaatgatctcaagaatgagtatgagggtgcctctgctccggccatctggtagtcaggctccaggccatcctctacccctgctctcccaggtccctcgctcactagcccttctgcccctgccccattggaggttctcccagcttacccataaagtggtttagagggactttgccttccagcagttattcctgtggtggtcgctcctgcgatgcctgtccctcgagctggactgccattcccctggggggcctcattcttctaaggtatattgtgaggctttacctgtcaatcctggccttagtgcagcgactaggtccggaattcccactcagctggcaaacttggcactaatcagaaatgctgccaatgattctggcccagattccccttattttgagcaagtgctaaagcaatgggccatttaccatcagacctattatgattggtataatctccttaaggtggtgcttgaccttgccttgtttcttaattggtggtctgtatatcatgacttggctgagaatcaggctaggatta

SEQ ID NO: 18080 - DNA, 1186 bp, Mus musculus
catggtggagaagtataaaattctcaataagaaaaattatttacaaaatatcaccttcataagttaaatattgtcagcatattgacttaatgttgtaaatacacatctcctgcattccaggctggcttcaaacttgctagatagtttgaaacatctattctcctgtctctacctccaaacatatgtgcaatgccatacccaaatttattcattcaatttattcaaaagtccttaaaacccttgaccctaaagaatttcaagatcccaactatcgccatgcacacacccacatgtgagtgctttctctttatatgcatatatatggctataaatataaattttgtattactggtaccaaaaacactttttttggttttgttttttccagcaaggattctctgtgtagctctggctgtcctgaaactcactttgtagaccaggctggcctcgaactcagaaatctgcctgcctctgcctcccaagtgctaggattaaaggcatgggccaccatgcccagctcaaaaatacatttcttaaagttgaaatcatttgcttcttccataatgggacgttgaaacttctgcttgtggaacagcgtgtgttggaaagcttgtttgagaatggctactagagtttaagaggctatgtatggggtttgttggggatgtagtggtggtggtaaggatcagacctagggtccagtgtacacttaagcacatgcctagctcaagagtttagaatttagtgtagtttaaagttgagctgccttttttatgtagctgtttaaaatatttctgaagttcaggaatctggataataccttaattagtagacactgtcctatatacctattaaaaatgccaaacactgataacattaaacatgttcatcttgatagagataatattgtataggtctagtgtgcatgtatctgggatctccacctttgaggcagagacgggaagatcaggagttcaaggtcattagctgcatagtaagtttgaagtcagcctggatacttgagactctgtctcacaaaagcaaataaacaaaggattatacttttaaaaaaaagaaaaaagaaaagtatggaacgcacagatgtgacactgcagcgtttcatttcagaaactggtctttgtgcacttctctggaaggcttctgagaggacgcccagatttggctt

SEQ ID NO: 18081 - DNA, 1944 bp, Mus musculus
cagtcatgcaccaggtgaaaagggagggcacaggcatgctgatagtgtaggctcttgtccttcagattcctgtcccaatttaaatctagatttcccaagtggaaaagcccagcagaacagactacatgtcagaaccccgcagagacaggtgtcgagtgaacggtgggttgtgaattaatggccctggagttccggcagatttgtctatcctagattttaatcttggtttttagagttctgagctttgtccaaaagccatgaatcgactgataaatattgtttatttaacacgagtttaaaagtatttcttttatagactgttggaaaataggagaatttgacctctcaaatgcattgttctgttttttttttttcttccagcctgagttctaccaagtatgccacaccaaaaaggattatgaagaaattggacctagcatttgtcgtcacaatccagtgtttggagtcatgtcctaaagttgacttcttgttgattgggttagggagatggaaatgagataatctttctgatgacctgtttttgtctgaatggatggttctgaggtttttaaccaaacatgatcatacaggaatatttaatgagtgtgtcaacatgcagatgtagaagagagctaagacgattgttttcctttaggttgaatatttgaatcttatgtgtatcaaaaaagaaatgggttttagttctttctttgccctgatattttgtatattattgacttacccagtgtgctgggctcagtgggtgtgtagagagctctgtaatgcctgattgggcactgctgagtgggtagtgcctgagcttgtttatatttcatacttttttatactttgaggaaaaaaagtcaaagaaaaactgtagtattggagggaaacaatgtgaccaaggaaaagatgagttcaacaagcagcctcatgggacttggcgcacactctgggttccagttatctcgagctgctccacccctccccagcccaacggttctctctgcaaatgcttggatctaagaagctagtctcctgggttagccgatgcctgccctgctttctggttacttacattctgtttcttgctttaaaagaaggacaagactgttggaccagtattgcaattctgtagagtcgtttcttattaaaacaataatgtgattaccaaaattggcatatttaaggcctaatgccattctaataaaggcaaaaaatttctttttactacttgtttcaggctctttgatctctttataagttaactaatacgtctattttcttcagattctgcagtagctctttaaaagcacagcggttggatagcaagctgacttttttatgtgctctgtacaaataattgtgaacttttaatatgttgagtgctttcattttgataactggatctccatttgatatttcatttgtataactcatttgcagtctgaattttttttagtgccagtccctgacatatcatgaaaagttggttttctttgcattttcaaatatctggatcatgaagaaaaagtgatgacaataaattaaaattgaattacccttcctgatggtttttcttcgtgcagtggagttcaactggctgtctacatgcttgataggatttttgtttctggagaaatgatggcatgtgtttaagtctctggcatgtgtgtggtagagaatttcttgtgaacataagattttccagtttgtagaacagcaaatgggatatgttttataatctataacacttaaatcagcactgtcagtaataacaatgtaatgtacaaaacacagtagaattaggaatgcctccattacatgtccttaaagagcttttttggtctgttgcagtaaatctacacagacaaacttgggaactgaaccttagttcttatgtaaagtctatcaggatatttgtaattttattattttacctga

SEQ ID NO: 18082 - DNA, 1223 bp, Mus musculus
aaactatttccttattctttttgtatagcttttggaatttgttgtttatcaacaaagctgaaaattttctgtatttctcatgctttgaatatgtaaatctgcctttgcaaaaataagtctcatttatttgcatctcgttgtacgacctttgtggagatgtctttgttctttcaagcttagccatgaagatgtcttgactacttcctgtatagtaaagagactactaaatggtttctgaactttatgtcaagttgataacctaaaaactaaacatacgaagccaggctcacacctttaatcctagcacttaggaacagagacaggcagagctctaaatttgaggacagcttactttacatatcaagatctaggttagcaatgctatagagagatcctggatctcataaaaacaacaacaaaatccctccatactactaaatgcataaaaatttaatcaacactattattttttaatttctttggcaaatctatgacattaaaacaaagcaagcaagcaagcaaaaggatactgagaatttagatttattccaaggaagactgctcatgctgaaggtctttgaaaaaaacttctctaataaaatttccatctccaagatttggagatagatgtgtgtgatgggttgtatatgcttggcccaggcagtggcactattagaaggtgtggccttgttggagtaagtgagtcactgttactgtgggctttaagaccctcgccctagctgcctgtaagacagtcttctgctagcagccttcagatgaagatgtagaactctcaactcctcctgcaccatgcctgcctggatcctgccatgctcctgctttgataataatggactgaacctctgaacctgtaagccagccccaataaaatgttgtccttataagatttccttggtcatggtgtctgttcacagcagtaaagccctaactaagacagtatgtaagataatgagattgttctttttttcatacaagtcttcccttttgcagggggattgaaacagggtctcactatatagtgctggctggcctcccacttacagaagatcctcctccctctgcctccccagtgcgctagattaaaggtgtgaaaccccacaatgccacatcatgacagctttgtgtattttgttgttgttgttgttatctgtgataataattgtcgctgcttgaaaaatgtccttggtattcagaattacagg

SEQ ID NO: 18083 - DNA, 1207 bp, Mus musculus
ttttttaaaaaactgatactcagtttacaaaagttacccccatccccttccccaccctgggaagagttgttttgtatcagccatcatgagattcttggtaggaaagtggtattgtgtgctactggttttctagttaactcatggtgtctggaagtgtgtatggccttttcagttaaggtacttgtatactgcagcttgcacttaggaacttctgagttctgagtttttaagagtagtgcttgctagctcatggtgatgacaggatatactggtagtttgtggtagtctgatatttaagcttgggcaaggtcgtgctgtgcatgttacatacatgtttgtgtcactcttgcttgtggctctaggaagagagcgttccttttaaactctgaactttctaagtatcctgatgcagtaagaggcccatgaactgtagacagtatgtagtctcattacagcttacttctgtagactttcacccctagtaactctttaacaggttattttttgtctgtcttaaccttttaggctgttcttgccttagctgcatcctggacctcaagacaagtaggagagcggacgctgacgggtacagtaatagacagtggagacggagtcactcatgtcattcctgtggtaagtacagaaaattgctaaagaggatgtgaaatagtatacccagaggcaaatggtaggaaagatggacctttacaagactggaagctcttcctgggctaccaccatcactgactgcatgaggatctcgaagatcttaagagcatcaacagtgctaaaaggaggccaatgccaactccttaccatactattcccccaaatcatagctatgtttgtgaccggtaaaggtcacagagctgaaaagagtgttgtggacctcacacagtacataaggcatgatcagccccagatttgatttcacttaaagccctaggaaaggggcagaataatctgtggtgacaatctcacctggcatcatgggtcatgtaggaggaaaagaagggcacacaagaggaaaagttcttagtgagctcaagtagcaaatgacagcttccaaatatggtgtacataatatctgtcagccacaggctttctgtgtgaatagtttgcttgtccagtaacttcatagaagaggaattatatactctggtctttatgacaggctgtgttgtgttcacttatgtttttgaaattg

SEQ ID NO: 18084 - DNA, 1148 bp, Mus musculus
tcatatggcccatgctggccttgaactcagtatgtattctgactgactttgatcttctgattctctggtttcccctccccccacaccccacactttccaagtgctaggattatagacacgtgccactgtgcccagtttgggaagtgtttgggatgcaacccaagaactcatgcatgctaggcaagcattgcactactaagctacatgtccccagggtggcttctgttgcatacattttgatagtccttgaaggtgaagagtggaaaagatgtgattttacacttgaactttccctaagcgttatttctgtggtgctgttttaggtgggctgagttctttacctccatttggactgggctctgcccgctttgcaggcattgcatttgaggatctcagagaagcccttgcaacaaggtaaattctcatgttatcagtaaaaagcagagactactagcaaatgtctcttgtttccttgggctggatttctaatttttatgtggttcttctcaaagaggctctaatgagatctctgttttctaaactaacagactgcaaatggtttatgtgtttatcatgaaccgtgtgaattcccagagcagtggtttcagtcagcgcaggcgaatggccctggggatagtgattctcctgctggttgatgtgatatgggtggcatcctcagaactcacctcggtatgtatttctccaccaatgatgttgcactgtgatagaattaacatggacctagaggattttgctaatgatgtaggataacatatagtgtcaagctatagtattttcatgcttctaacatcagtattttaaatattgttgaattctttgtttttctttggtactgaattagtgtcatttaaagtaaaaattgacaggatgctctttgttgttttctgaaggtacaaaaactttgtgtgtatgtgtgtctatatatgcacatgtgtgcacacgtgcctgtggaggccagaagggggcatctgagtccttggaacttagataattgttagtcctgtaacgtgggtactggggactaaactctgaaggaatactaagctctttgaatcatggagccatttctacagtcctacctacagctttctcacatttgtaggaaacatatctcagaagattttttt

SEQ ID NO: 18085 - DNA, 1227 bp, Mus musculus
gttctctcagaaaacactttcattcgccccggatggttctgtgcatgctcattccttaagtgacgccattccaatacaggcttcgatggctgtgaagagagggatggttttaaaagaatcatacacaatctgcaatgtttatttgtttccctgagtcaacagccaggttttccaacgttgcagcttaggagctggtgagtggtagccaggaatgattttgtctgcactacccaccccttctcccccgcacccccccccccccccaccacacacacacacagggtctccatggtccaggacaatctggaattcactatgtagctgagaataatcttcaatttctgatcctcctgccttctcccaactgctgggattgcagtgtaccaccactccctataatgttggaaatgagacggagggcttcaggcatgataggcaggcaaagtaacaatctgagctacattagcagacccgtgttcatgttttaaagaacccctaggcagctcaagctgtaccacgtttctctgcaaggttctttccaaaggaattaagttctagatgcatggtcagagtttttgcaacactcctcaactctgccccaacttgtccctatcctgccctgtcatttggggactacaggatggccactagaaaggtttgtggacagcaggtgactgtagaaactcagttctaccccaacaaacagctcagaattcccttgtgttggtggcaggtcaccacccttaaccttctccacaggacaggacggtctttgtaagtccctgttgttagaatctaggtcctgttttgtacttaaacatcagccccttcactgcccagattctgacagacacaccttggtgtgggaaggagatgaactaccttttctatcaagggttaaaagaaacaaagaaagatacaaactccatctagcactaaccctgtctccactcagcagttttctaagataaaaccatgaactcaaggctgcatcctgctctcaaagtctttctttgtttactgttctgggttagccaagtacatcagtgcaaatgtgagctaggctcaggaccctagaaaaaatttttttttaaattggttttgtcatggaatatctttctctatctatggtgatttcaagtttttctgggtatagtagtctgggttgatgtctgtggtctcttagagtttgcaagacatcggcaagatctggttttttagagtctc

SEQ ID NO: 18086 - DNA, 2135 bp, Mus musculus
gtatatttcttctttgatcagtatgaagtgtccttccttatcctttttgataacttttggttgaaagtgccttttatttgatattggaatggctattcaagcttgtttcttgggaccatctgcatggaaaattgttttccagctctttactctgaggtggggttggtctttgtcactgtggtagatttcctgtatgcagtaaaatgctgggtcatgtttacatatctagtttgttagtctgtgtctttttattggggaattaagtccattgatgttaagagatattaaggaatagtgatcgctacttcctgttattttttaatgttatttttatatttctgtggctatcttcttttgggtttgttgaaagatgattactttcttgctttttctagggtgtactttccctccttgtgttggcatttttcatctattatcttttgtagggctggatttgtggaacgatattgtgtaaatttggttttgtcgtggaatatattgttttctccatctatggtaattgacggttttgctggatatagtagcctgggctggcatttgagttctcttagcatctgtatgacatctagccaggaccttctagcttttttagtctctggtgagaagtctggtgtaattctgatagatctaactttatattacttgatttttttcccttactgattttaatattcattctttgttttgtgcatttggtgttttgactattgtgtaacgggagaaatttcttttctggtccaatctatttggagttctgtaggcttcttgtatattcatgggcatctctttctttagattagggacattttcttctataattttgctgaagatatttactggctctttgagttaggaatcctcactctcttctatatctatcatccttaggtttggtcttctcattgtggtcttggatttcctggatgttttgggttagaagctttttgcattttgcattttctttgacagttgtgtcaatgttttctgtggtatcttctgcacctgagattctctcctctatctcttgtattctgttagtgatgcttgcatctatgacgcttaggaacctttttcctaggttttctatctccagggttctctccctttatgatttctttattgtttctacttccattttcagatcctggatggtgttgttcaattccttcacttgtttgtttgtgttttcctataattctataagggacttttgtgttttctctttaaggacttctacctgtttacctgtgttctcctgtatttcttcaggggagttatttatgtcctttttaaagtcctccatcatcatcatgagatgtgattttaaatcagagtcttgcttttatggtgtgttggggtatccaggactcactgtggtgggagaactgggttctgatgatgccaagtagccttggtttctgttgcttgtgtccttgctcttgcctctcaccatctggttatctttggtgttagctgtccttgactatgactatgactatgactgtggcttgtccctcctgcaagcctgtgtgtcagtactcctgagagaccagttctctccaggagcagtttgggttggagagctgtggcacagggtcagctctggggtgcagtaggaaactggaaggatcctgtccttggctgttccttggttcctgtgtcctgagggttctgtacaggtccctctgaacagaagtggtggtcttatctgtgctcacagatgtgtccacactcctgggagaccagctctctcccagtggtatttgggtctagagcactgtggcacaggatcagctccgggagcagatcagatcccgggaggatcctcgggagcatttcttaatttcttaatttcgggagattttcctctttcttagcttgtgtcatttgacaaaaaaactaatctgaacagcttgcttgtatgagattctgtctcgaaatgaggtcgtgggggttgaagagttacctcagtgcttatgagcacctgctgagcttcaagaagactagttcagttcctcccatcctagttaagcaactcacaactacctgtaactaccgctccaggggattggccatctttttctgacctgtacaggcagctaaaagaatgcaag

SEQ ID NO: 18087 - DNA, 1225 bp, Mus musculus
gacagcacaaagaccatcattcataggatgaatgtattgcagcagtagagtactgagggagcaagaacctgcatgctgtgttgcatgatgagcatcctagggtctcctagttgctctgtggttaaatgaaatcctgtgttatcattgcaggtctcagtacctggcccaggaagggtaactagatccttagaaagctttgcaacaattcccgagtgaggagaaccctcccagggggttggtgcacaggccagtggtttgaatgggaattgtctcccatactgtgtctcagtggataattgtgagattaaccagctggtggctctgtttgggatggttaggaaacctttaggaagtggagagctgctggcggaagcatgccattatggttgttaggggagggccttaaggctctacatccctagaccacttcctgttctttctctactccttgtctcctgctcccgacaccacgccttcctcaccaggctggactctatccctgtccacagttaagcgggataacttctgatccttttgcactcatctcccttacactgagactacaggtgtgtaaccgcaccctctttatgggaatgtgagggatgggacccagggctttgcacatgctaggcaaggtgagcttcaactcctgaacagttaatgttggatataaaattctgttcaactgtaaagatcttatatggtagttttcttttggagtacagtatccttaatgtgattttatctttaacacacaaaataaaatggtcaagagtttttgtttttgttttcttctcaatgcatattggttgcttccccaaactacattagcatccagcagctttccctttgcttgcagtggtaatccagacattgggttctgagcctggcattcacaagcctttagcctgcagtgcctgctctgctgtcctgccatagttcttcccatgctaccccgcatccgtcctaggctctaatcatctcccctctccaccctcttaggcctggagggttggctgcttgtctccattcatagggctgggattatcctcagtaaagctctctggttttggaacacacatcaaactaccttccccttctctggcctgtccctcttctgcagcatcccttgcctgatttccctgctgactagtgcttagaagcgtaattaggcagataatcctgcaggaagctaagaacagagtacatgacaaaaggaacaata

SEQ ID NO: 18088 - DNA, 1137 bp, Mus musculus
ctctcctaagccattgttactgcttgtataaccttgggcagggtcctcaagaatcttatgtttcaggagcttttttgggacttgtgagtctcatgtacttcctgaaccttgtaggttttctttcctgaatcttaaagagcccttctccagatcagactatttgactttggaggaactatcagcatagcactgttcagtcccccctccctaccctgaaggctaacgacagcaagattcagtgagatgactcaggtcagctatcgcatgtcttctccaccgtggagatggataacactgcttctgaactacacaggctgtgtttacacacccaccagcttcccagcatctaattttgaggggtccaagtaggacctatgaagagttgagacaggtttcaatcagcagcccattatccctaagagggtctggagctgtgtttgaacctatcaaagttgccaggtttagtactgtaaagttattgatgctttttttttttcttttcttctccatttgcctcattccaggataatgaagaaggttgttggaaaccggtctggctgtccaactgtaggagacagaatcgttgagctgatttatatcgatattgtgggacttgctcaatttaagaaaacactagggccatcctgggttcattaccagtaagtactacatgctaagacctttcttcccctaagaaacattgtgctggtaggttgtttctgtttctgtgtttttttgttttttaaggataatttagtattacgttataaactgtatggagtatacctctcattcctaatgaaattcaggctattccccctgactgtatgcttcctagggttgtttattatttatattgatattctgagaataatgtgtccagccaggcataatggcacacatctttaattccagaattcaggaggcagagtcaggcagacctttgtgagtccaaggacagcttggtctatacattgagttctaggacagccagagctacatagtctcaaaacaaaggcaaacaaacaacaacaaaaaaccctataactatgaggatctcatgcatttaatcaagtgatttttcgtgtgtgtgtgtgtgtgtgtgtgtgtgtgtgtgtgtgtgtttatgtgagtgta

SEQ ID NO: 18089 - DNA, 1475 bp, Mus musculus
gagggaaatggccttgaaaacacagccagtcactgtcacagcattgccagaactggtggatcccaggtgtgcttggcagatggcagctaaaaggcacataaccttggtggggaaataaatgcctgtggtgtcctgagggccccaccaagttccaaagacaggctgggctgcagatgagagaggctgctttcctgtgtgtgtgtgtcccttcctccccctccccctacatagcttggtcctaatttctggttagaatttacctttgttgaagaaacaccatgggattatgtaattcttgtttgctgctgtggtaaactcagccccaccccgtcaccgtcccccctcattccccataccccatcgtaggctccaggagctgtccttgaacttggagaaggatttgggtaagaatgccagtcctagagttagtagcacgaggctttgtgccttgcccccattgatgtctgatattgctgcaatccagggaactcactcttagaacttgatggtttctggggaggaaaggatagttgaggatgaatgctacaaagggtgggagcctggggctggcttttacgtgaagcactattgttctatggagtttgagcagcccctgtgagggcctgacagcaggttggcctaggcagtatgccggaatccccacctttcacaccctggaacccttctgtgagtccatccctgctgaagtaccgctcctgtgctctgtacacgtgtgagtttctggagacacctcccacagttctctccatgctggcgagtgaaccaatcctcttctacctcttgctgttagcattgtccacccagccccagctggtagagtagacttcctggccggcggctgctgcccagcgcctccctgtggccaggaggagcttctgcctagctgaacagcagcctgtgactggctgagccttccagaagcaacagaaaggaggatctgcttgtagtgactaaggggtggggagatggcgcatggaactttttggtctgggaaatcatctgttcttctcttgatctctacctgggtgcatacatcataccaatcacacctctagcgcctccccgaccacacccctgttggccctaagacagacacctcaggggcctgagattctagtcccagagaatgaagtggagtgaagaggtgatgtcagggcgggtactggccctaagcactgacaggggtccctcaaggcctgcctggaatcacctctgcccaggttcagctgccaggaaggcagaagttcaaaagcctagctatgaagcatctttattaagctttgcaaaggtttcctgctacaggaggggagaaagctgtgcagtctcttgggaaaggacttttcccttagagtgggcctcggggctgcactccagagttgtggcaatctgcctaagtttccaaacctgaaggctgtgggtgacagtgctgacattcaaccggcagggggcgccaa

SEQ ID NO: 18090 - DNA, 1591 bp, Mus musculus
agaaggtgaaagctttttcagagtaagaactcctgagagggaccatgccttgtgcatttctgtgtgtgttcttatacaaatggaagcactgtatagaggtttattttgtctctaagatgaatcgtttgttttaggtgagtgtttggaaatagctgtctgttctttggctgggacatgtctttttgtttctctttggggttggattttgaaggctgggtgctgtcgaaggctgatagcagattgttccagccttgaataactacatttgtccacagtgtgtgcacacacatgtcccagtgtatgcaggcacacaagactgtatatatagtgtgtatacgtgtgtacctgtgtgttttgtgtatgttccagtgtgtggtgtatacacatgcacccccagactagggccaagggtgccaagaatcctttagtaccctcaggaccagaccctatctctgaatctgatgatgaccaaggtagtgaggggtctcatgctccatcaccctagctctagctgacatgttgctgaggcagaaaaccagccctcagtctatctctgtagaagaaggagcccccaaatacttcagctagttagcatggtggaggcgagatgttgactttttctcgtccttagcgaatgaatgtaggcgtgaagttgcggtacctactagtgagttgggttgcactgaagctatgtgttgctcatggatgagtgtgtatcctttagatcagaccagggtggtttacctagattgtatgtaactaggcgccaccaccctctcccaaaatttttgactgaaaaggaaagaccaagtattttgttaacgacaggctatgctgtgtcacgacacgattccaagcctggactcttatatttatttaaaactcttttaatttctctttcttctcttcccctctgtctgtgtgtccgttagagtagacagatggcaggaataggtctgtagtccttcaggaagccagcagcctggagctggaaatgggctcctctcattcgagttgccttcaacagaaagtgagaagttttttcggcttgggtttttttttttctttacatatagcaaaagaccaaattagctgtatagtcttggatacagaatataagaattactctagctgtcctagcacttagggtcctgtggggattccgtgtttagcacagtgcctggctcatagggagcctagtgaatgttcaatattgatattagtagtatatcataaaacttgagaaataaagagctgcgctcaccccctatctgttgattcagacatgatggttacatagaaaccttgttgagtcgatcagatgctataggaattaactgtttcaattgtttaagctctgtgcctaccctgctcgctggaattctagtgtcttctcgaatgcactgagtaattgggaaatttgccagtcttcagcactctgtgaaacaaggctgaatttattacctgaaattgaaccaccaatatgttctggaacattccaggggtttctttgagggaccttttgagctcaaaattaaaagttctctcacaagtttcactccgtgaattagagtttaatttttactccgct

SEQ ID NO: 18091 - DNA, 1102 bp, Mus musculus
taaccacttagttacctatctcctcacagctccccgagatgtgttttataccaagttttcatggtggcttaggacatttgtcctagaattaagttattcttgttggggagggggtatgctagagattgaacccaggacctcatgaattctaaacaactattctgttgagcagcaacccagctgaaaactgattcttaactctgttttgtataaaatagctatctatagtagagtacttgagaccagatagtttataatgttcagaaataggctcacagatctgcaggctagatggcctaaaatgaagagcctaacttacagcaagggtcctagcgtcctgtgaagaaagagcacaagaacacaagagagggaaccttgtctccctctttacactgactttcaaggcagctttagaacaagagttagattgttaatggtttgtaggtaattaaaatagtttcctaagtgaaaatccagttagatcatcatcttctacatgtgtaccatgttttataggatggggaagacttggaactaacaactcaacatatggaggcaataatctgatttttacacttaaggttctgattgtaaagctggtatagtatggccatgtttagagagaaatttggagttttctctgaaggctgtcgcattattacttgttcgttgccaacattttaaatatgaagtcattgtacagagtgtatgctaatagtaaagatgtaaagctggtcactggtgcttagtagcagtgcatttttcctttacatgacagtcagtaccgatcagtgttttacaaattgagttcataccaacgtaacaagcaatgatggaatttgccactttcttcgtaaatactgaagacataaacaatgctgtcccttaagggacttgtatcctagtgggagagaagaaatttacctagagcttatctttgagtctgatgtgaaatagctaagagcaagtagtttgagctgtttcctactggtgaatgtttactgcatcttcctggatggaagctgggagggaggtcatgttaggcactaagcagaagtggtgaagcctagcgattacattaggaagctgatatgtaatgaat

SEQ ID NO: 18092 - DNA, 1264 bp, Mus musculus
cttcttctttttgttttttgttgtttgtttttttgttgtttttttttttttttttaatccaggagaatgctttatttcaacttttagctgactagatgcttaacttagtaacaagtttagcccttgtaactggctagctaaaagcaaatcggcttgtttctcagatctatgggggatagcaagaaacatttgagtgaatgttgttgaagattttcagtagtatagaaaatgatggcgctcttgtgatatttgtaagtagtaagtaaaatttactttttgtgtacaaatctttgatgttgtattgagagtttttgtgatgttgacatgttgaagctgatgatattgtcttcgttcttctttcttttcttacagcaagcaaggatttggcacagacatcctatttcatggctaccaacaggttgttatcctgaccctctttgttgcactgttgtagcacactatagcttcctttaatgcagggccccctcgacgtgtctcttgcccttgttgcaacaggagactggaccatctactgtggtggtaccttcctggttgctttgcggtgtattgtacaagggactttgggcacagaggggttaaatgcacactgtgaagtgtagtggtgctttctggtggcatattctcgatttgtgagtgcataagtctaaacttggtagcctgaatagcagctaaagattacacagagctaaacttaacctagaaacttggtaagtataaagctatttttagtttacaattatagttaaatgactttttttaattttcacattgatccaatcttttagaataattgctaaagtttaagtaaaatttatgtaattttggacttgttccagataatattcctaatagtaaattagaagtagtcaattattatcggtgcttaggtttgcagagatgcaatctttattttaaaagtcctgcttttccatttatataaagtaaaaatgtagtgtgtgtttgtggcttttcagtaattgtttcatctactctaaactagaatagtttgaaggagctataaagtaaatgtataattttgttctggcttgatattaaaggttgaacattttttaagtgggcactgtggaaatgagaactgaactagctttttgaattagcaaaactttggttagtcagctagacatggtggtatgcctgtcatcccagactggatggtggagacaggaagatcagaatttcaggattaccatttactacataccaagtttaaggccactttggg

SEQ ID NO: 18093 - DNA, 2654 bp, Mus musculus
ccacggtcctgaggccaatcacgagtacagtacaagcagccagcatatggactacaaagacacattcgacatgctggactcgctgctaagtgcccaaggaatgaatatgtaacctttgtttaggtcaacttttccttgcctttttaatttaaaaatggttggaatggaaaacgccctcctggtccggcggtggtgccactgcttccatatttgtaagtgctgctttgttcttcattctgaaagaagagatgatagtaaacaagcctatctccacatacgatagtgttaccaggactgtaaccgcatggaagatgcagctgagaacattaggatgaatggctggctgctgctaggagcctaagctgcttcaagcttctcttatttatgatttgaatattgtagctgttttttgttgttgcttggctttgaatgagtgtcagttgttttcttttgtgtatttatacttgtatgtatggtttgcatgtctcagtgataaagggataaaacagtatactgacagctgtttacaagaaagtggagaaaaatgtacatacatttttgtatgtttagatattaccataaatactcaggattggagctgcttgtaagaataacaatatacagaataactttattttctctcgtcagagtccatcactaatctaaaacacaagtggcactttttttatgttaaccttaattaaactctaggccttactggaagccgctgaggggacacttcactactagacgggaatgtggtgccatgggtggtccttaacactgggaagcactcagtttgccttcagaggtcctgaccagattggctgcagaatcagccgttgatttctgaaggcttgaagaggaaaacacaataaagtttacatactcttgatgtgaagtgcatttaaatgtttgttggcttgttgcagtgctgtagaaagcagctaataattggtgtgaggatgactgtgactttgctcacagcagctcccagtgaagatgagtccatttcttcaggaacgctgacactacagattctaagagtgaacaggggtcacttttcctttagcattgcagtgacaccatagtcttgaatatactcttcccatggagagagagagtgagtgtgtatgtgagagagagtgtgagtgtgtgggtatgggtgtgagggagagataccatatttctttttcaggtaaatgcagtcttccttataaaaatgaaattaaacctatgctctcttgattcttttatattctaacaataaataaaaaagaaaagattgctgactgtgcattgtacctgtatttatagcttatggtcattatcaggaaaatgtaaggaaaaaggccagcctcaggcaagccactgctggggttttacatgctggggttttacatgcgtttgcacgtcttagtaggttctcattgaggtaatgcttgcactgtcacctgacgccttgtcaggggatagactgacttgtctaaattttggtataagcaccaatagtatggctcttgtctcttgcctaaccttgaatttatttctgtggtaagtcttagctgttgagtctcttaagatgggtcgggttcaacttgtattgaatcacaagttttcctctgtatatgaaatgttttgttataaagccactgatctgtgcacaattgtaattttattcaagtatgttgtggttgtaaatattagagttgagccttgtactctacttttatttagcagttatcccatttgccagtagctatttgttttttaaagaaaattgttgattattttgtcaatgttatttgaacctgggatgtcaggagcttctttgtgggaactcagcctagcaggctagtcctcactctgttcttgtttcattggtaatctttgttactatgtgatttttgttgctgtggtatactgttgtatcataaacatgatgattttgatacagttacagttttaccgtggtacatttccaagaactagcataggatttaaacagagtacaaggcgagggagggaagggttttgttcttggtgatttagatgtgaaacctcaacagagcatcatgtgaattgacatgaggtggtcgtgctactgtatcattgggagtgacccaggaattttaatcagcctttgtaaagagtatccagagacgtagcaaacttattttcagtatgacatagaaaacaatgtgaatatttaaggtctgggactgtagttaaacttcactaaggattttcagaaatgtgttgttttttgtttgttgttttgttttttagatatgggaataaaggtaattttgttgaatcttcattggtgctaatgatggacagttaaacagatagtgtctacgctgtggataagtacacttagtgcttccagaactgactttgaaatgctgtgtattcacttctcactctgtaaatgtaattctttacaatgactatttattaaaaggcagtcagtgtgatttttacaggattgtgtgaactattcaaactcttcaacctcagaacaagatgctaaaaccacaatgggggaaaattcatgactccttgtttcctgtccactaaggaaaacccttataattcatatcaccatgaatttgcttaaatgatcttgtttgcataacatagttcatttg

SEQ ID NO: 18094 - DNA, 1652 bp, Mus musculus
taaccaaaatagtatcaaacttaggtgtgaaatttcacatgtgcatagtactgttaaggtgataacattttttgatgagttttttaatacttgaaaatgattaaaaagcattctctttacatcatcctataaaagagtgactcattcttaaggtgtttccctaggtttgccaccttgttgcaaaagcacattgtaatcagaggcttcctgtctacctctctcagctaagtttctaaaatcagtatgtgcttcctaaatctctgccttagctactaacacaagctgtcttcagaaccaaagcagaggagtgtttgttttgtgggagccttctggaggcctgcattacaaactcagtgccagtgcccactggtagataaggccccacatgtctcctatggagtagcagtgaaggctatagtgccagtcctgggtacgcttcagagcactaagtactcagctttaaagatgtctcgtgtggtactgggtggtttcgtgagcgcacactttgtgccaacagatagtaattatacagaactcccaaacatttggacctatctgttccctatgaagtaaaaacagaacaggttaggatttactttagagaaccagtttgaaatgtcattagtcaccaaataccttgccttaagatgtttcaagaaagtgtattttcttacgatttaaattctgattttatttgcattatataagccgctgcctatttagtgcatgggtgcaacatgatttgttggttggatgacttaaggctcctgcattatggagatggcttattttgataacttctcagaaaaagtctctggtttggaatctttgagatgagacatggtcttcctctataacaaggaaaagggctgactgtaattaattctcctgtctccaccggtgcctggatccgtgattcttaacttgttctcaatcttatataagcaacaagtacttaaaacttagatgtaatttgccagaagattctgaggatttttttgctgagaaaaatctagaagctcttagtaaccaaggacccttgacttcacttctctagactcagcagtttcccctgcaggagcgtttcccaggaggcagtagaacccactcaccacattttcacaggagaagaggcagccaagcccacactagaagaccgggagttgattgggtttaattccatgcctgttggtttgaggtaggcaggttgaaacatctgtactgaccagaggcagagtgcattcccgttttccctcagtacttgatgttgagacaagtgtgcaggcacagctgtaattaatgcaggccaaccgacacttggagggcagctttggcctagacagaagccaagtcaggtgctcgtgggaaacttcttagtcggtgatcttggtactacgagctctgagtgtgttccattatttcagtttttgaagtgtgctttgtgagtccccttttctggtttataaccatctctcctgcctggtatgtttctcgaggtgtgcttcatggcggagcagctctagttgtgtaaactgacatcatccttcactgcaattccgtaatctcaagtcaatctgggaactccgtagtttgttttgttttcaagtttggagaggaagcctcacttaaaatcctccagcccacaagttgac

SEQ ID NO: 18095 - DNA, 1149 bp, Mus musculus
ttattttctttttttttcttttttttggtttttcgagacagggtttcctctgtgtagccctggctgtcctggaactcactctgtagaccaggctggcctcaaactcagaaatccacctgcctctgcctcccaagtgctgggattaaaggtgtgcgccaccactgctcggcttggctcttttctttttaaatagcccatcaattccttttttttttttttttccccatatgctccttgatatggggccctccccagcaacatggtggacctaccaggacccacacccttaaaggaaactgagtctctcctccctggaaaccatcatctgtccatggctcctcagccacacatcagggctcatgaaccccttccattccgtgttagaatggggactagcttgatcctctgtgaatctgagtgcagtggccatgtcatgtccacaagatgctatgtaccctcctccacagtggaccctgaacttgtggaattattggttcttaaactgtatttccataggtagagatgaagtgcttggagtactccaagtacagaatggggagaacaaaaacgatcgtccttcagttaggactgtttttatttcttcaaacatgttttaaagccattttataccattagaacagcaactcagtctagggaagaacaattcatttttggtggttggttttgcctaagtgatatgtgaatacttatgtttaaaaaaaaaaaaaagcagcccggcgtcgtggcgcgtgcctttaatcccagcactcggaagatagaggcaggtggatttcggagtttgaggacagcctggtctacagagtgagttccaggacagccagggctacacagagaaaccctgtctcgaaaaaccagaaaaaaaaaaaaagcaggcttcttgctcactggttcagaccttctcaaaagtaactgttgttactagtttgagttatgtttcttacacttcttcctttccactgatgtgtgcatatggatatgatttggtttcatttctgaatgtgcactgatacgcagcttgtttatcctatcaatagggtcaccccatgccattaaatgtacatctgtgtcatttataattgttgcatattattctaacatgtggaagtcctacagcttatttaattattc

SEQ ID NO: 18096 - DNA, 1293 bp, Mus musculus
cgggtgccttttcctcagacacctcctttttctagggggaggaggaggagcggcagctcctgccgtgggcacctgagacgcccttgtggaaccagcagcaggagtcacaccagcatccagaagcatgtccagtaccaagcttgagccagatggatagatttgaggtgtcagagacttccacctggggggaggtggcctgtgttaggggaacctcacatcagcaggcctcttaccttgggggacagagtttgttcattctcctgtgacagtcatctgtgtagacacttagtagctatccttactagtattccatatgcaaggtagagtatccgttaactcacattctggacacttgctggtagagcctttagtcccaggatctgtgtttttaaactgccacgtagcattctgtttattcagtcaccagatggatggtcagctttattatgctgtttcatgagcatttgaatattctaggagaaagactagaatttcaattttttccatgccactaaccaaatgcatttcttctgataaatctgtacatgaaatgtagctgcagattagagctctctctgtgtgtctgtctgtgtgtctgtctgtctggtaggatctctcggtcctcttggttgcacccctgctttgcactttacttctctgcgttgctggttagggatggtatttaatgacatcatacgagcacatgttgaacacacatcctgggaacatagatcaccatgcagttagtgagctgtggtgtgtgtgccgaggctgtgagtgggctgaagcacccggtgcaggggtgatggctctgtcctctgcagctcagaatgcatcagtacgctgctgcgggacctctccttggtgattgtaaattattttgggacctaaaattcccacttgaatccaaagtaaaaaatggttatggtgaagtgtaaattccgcctgtgtgatttttaaaaattaatagacctacacaagccctgtgttatttttgtaaaagaaaaaaaagagtatatatatatatatttatctgtatggtgtgcacagacacgtgtctgtttgggtatatgagggccaggggccaacccctagacttcccagcgagcactctttcctctgaaatgctggactttgcttcttagaaacccatagatacgggctgaggcatgaggggccagaacaaatacaagacaggacagtgtttgctttcctgggtattgatgacagaactctacagtgtggggttggtctaaaatggcattgtttatctaataaaacggactgctgttt

SEQ ID NO: 18097 - DNA, 1224 bp, Mus musculus
tcagacatcacccggtttctggtgaagaagtaaggcgagatataaacagaagcagatggcctgcaggcagaagcagttgtcacaattcatcttcatgtatgtctagtattttaagaataggaagtttttaaatataagtcaataactgaaatttagatttttgctaagctctcttagtgttacatacttaacagaaactgagggatgatgggaagattctggggtcttcctgactcatgaagattgtcaattatgtttcagcaagattttgttccgctttttttccccttctacaccttaatcactgcattgggcatggatagtgtgggacaaatatattcacgcaaacctgacagctcttgatcaccattgcttctggactgtgtagtataaagggaacattccagaacaatcagggacattttggagacaagccatgattagtaaggaatgattacagctcaggcgcatgtttggggtgcagcctccttgcttgatttctgggccagtcctcttcattgaagagatgcttttgttaatgaactgattgtaagctcacatggtgtctgtgtacaactgctgtgctctgagtaaccatgagaacaagtgagagaccacagtgccgcacagcctcgcttctgttttcctgtttgctcccttgtttcctgtcatggtttgttttgtttttaatgtataaaatcaggctaattgtcaaaacagattttgtctcctggtcctcgtttcctggttttaaaatcctggtagtgatttgttttgttctgttctttcaataaaccttgtaattttttaaaaatatttttaaattatgggtacgtgtatccctgtggggccgggggagatgcgcagttgcccacagaggtggtgtagctcccaggcctgccacacagcagctctgacagatgctgcagactgagttgctaaccacgggaccatctctccttctccatatcctattttattaggtttatttctgttacctcttaaaaagaaggatggccaacaaatcgtggtggcgcacgcctttagttccagcattcaggaggcagaggcaggcggatctttatgagtctggggccagcctggtctacagagtgagttctaggtcaggcaaggccatgtggtaagaccccgtttccacaataaagtgacagtggggttgggaggtggctcagttgatgagctgctggccacacagcataatag

SEQ ID NO: 18098 - DNA, 1196 bp, Mus musculus
ccaccatatttacaaatctttaagttaagtatgaatatatgaacattaaaggaaacaaaatatttaaatggtgtgaaaacttatcaggctgggctgtggctcagtggtagaatgcctgcccagtgattctcctgccttagtcccttgagtagtggagttgcaaaattgcaattgtgaatccacattcactgctttgggtagctttatttttcctttacattttttttaaagtgggggtgttccttcaaaggccgtcagatcttctagaacgtgagttacaaatgtgaatgctagcatccaaacttgaggtccacagcaagagcagtgtgccctcttaaccactgaatcatctctctggaccccttggattggctttctgaaactaattttcactcagaaataacagtaaagggtgtcgttttgctcctgttattaacaggaaggacataccgcatacatggatttcctcctgtgacatttagctctagctttgccctttgtgttttttgtcttaacagatactttggcaaaaggcgtcagtgggactgtagaggggcatcaaaccttagtgagcttcaccagctcctaaatgacataatgatcagaagactaaagagtgaagttttaagccagctgcccccgaaagtcagacagcgcattccctttgaccttcccccagcagctgtcaaggtgagagcctgtctttaggtgaaaggcttacttcattatgaatcatgctgttaaagattgggcattagacttcacagaaaagcatactttcttaaaactggcttgattcgtagaaccactgttggttttacatcatctcaggaaaagcacaagatgattttaattatcaaatctgtgaacagatacagctcccagtgattcaaatgtttatgatgactataggaagatcacttggattttaacaaactatttagtatgaaggattcatggtacctataatgtaaatgcacaggggtgggtgtgtgtctgtttgtgtgagtctgtgtgtctgtgtgaagctggggctgggtcagtggcctcattgatgaaatacttgccatgcaagtgtgagggcttgacttgagcatgtcagaacccaagtaaaactggtctcatgacgtgtgcatctgtagtcccagtgctgctgaaatgagatgggagcagagactcgagcatcccctaaagct

SEQ ID NO: 18099 - DNA, 1227 bp, Mus musculus
tttcccatggaaagagcttagaactgggtggagattgtcagagggaagacaacacgaatctggaatcttcttcattttgcatcagttagctgtggtttagataactcaacctctctatcttattattttttttttttttggaaaatgtgtatggctcacagttactttttaagtaacgtgattttgtgacaggtaggtaaagcatttgtccttatggtctcaagaaggtaggtaaagaatttgtccttaaggtctcaagaaggaaaaactatagtatttccacctagggatcatctgtctttaattataattgacaaaaatttatttaaatagtatagactcttaacattcctaatgatcttgaatatttatcaaccataattggtataataaaattattaatgtaatactttttagtatttgatgatttctttcaggatatataggctttatttgtaacatactttttgcaaacattgtttagatgggtctaggaaagacaatccaggcgattgcaattgcttacttctacaaagaggagtggcccctgctgatagtcgtcccttcatctctaagatacccttggatagaagaactagaaaaatggatcccagagctagagccagaggaaatcaatgtcgtcatgaacaaaactgacattgggtaagaagaacttatttgtcttaatggaaaaaaaaaagtgtgctcatattttggtttgcttttgactttttggtactaatgacaaaactcagggcttgatgcattttatttgtactcggaatgaaatactagctgccatcattagaagagtgatgtggtttgacctctgttacctgcaggacacttttaaagttaatgtgaaatatacgtaaaggcatgaatcaggtggtatcatataagagcgtttgaatatatttcttttttttttttatttcttctttttggtttttcgagacagggtttctctgtgtagccctggctgtcctggaactcactttgtagaccaggctggcctcgaactcagaaatccacctgcctctgcctcccgagtgctgggattaaaggcgtgtgccaccacacccagcttgaatatatttcttaatgattcatttttaatattttatactcttttactatgcttagttcccaaagaatattttgtatgttttcaaacaatttagtattcaacattagatatatgttcctcagtattaaatatttatt

SEQ ID NO: 18100 - DNA, 1204 bp, Mus musculus
accagggctacatagagaaaccctgtctcaaaaaaaaaaaaagtagaaaatatttagcaaaataatagaaatcaacaatgaagtatagcacacagatgcagcacagaaaactaaataacagatttatgccaaaatgtgtttgctagtcagtataatggttaattctgtcaactaaccacacctagaatctcctgttgaaagtctcaatgagtcagagatccgattgccttgtggacctgactgtgtgggcgtttgttgattcgccttcattgatgtgaggtggcccaagctgaatgtgggcagcagcactgtttccagtttgtggccctgggctgcacagaggtagagggagctgcgtgagaagcacgcttggcttctctgctctcaacttggagatgtggctgttggagttctcttcaccttgacttctgtgacatatgatgggctatcctggaactaaaggccaagttaaatctttctccccgaagttacttttgccaggatactttatcattatcacagaaacagaaaaaaaaaaatgcagaccttcgttttcttgttctgtctgcctgtctacctacctacctacctacctacctatctgtctgttgaggcagggtctcactattgtagctcaggctggcctgcagctcactgtgtagactaggctggcttgaacttagaggtccatttgcctctgcctcccgagtcttagaattgaaggcatgtgttctttaatccagcgttcttctcatctgtaggaacagccaggcttacagttaaggacagaggtggaagccattctgcacagtctcatgccttcatgcttggtcctcaagggtctttgcagctccctccatggtgagcaagagcttgtctgaagcaccttcactcccacatagacgttggcagctgtagagttgtatgcagtcatcactatccagtgttttcattcacttacagcagcctctctggcttaatcctttagcgtttgtgaagtgttggtggtgagttacttaatcagaactctgaatatgctttgctttgatgattataaaattaatttgcttttgttttattttttccaggtgtatggtggctgatgaagtaagtaccttagagccttttctaaaaatacacatcagcgtttactgtcttctatccctacattgactatctgcctctgctttttcatgtgaccata

SEQ ID NO: 18101 - DNA, 1224 bp, Mus musculus
cttcattgccttggtgagtatgcttttttaaaaaatgaaataaaaattttaaatcttgaaacttgttcataagacagaaagcttaatttcatatttgaagtaatttgctgtgcttccattttttgtttttgttttttacttaaaaatcaaaagaataaagcaaactaacattgaaagtattttaggatatctttaaattaaaatatcagtacattaagtaatgtttttagaaaatcagatccccaatctgataaacagattaagctattttactgactgtatcatatattgttcatgcctcatattcagtctttttgataatttaattttaataacagcacacttctgcatggtagcattaaatagttctctgttgcccaaaaatgttggatatcacaacaggctttctctttatggagagctttctggtgttcgtttctttttggttggttgatttggttataggttgttgttcttctcaagcaacagtaaagtgaaaggttattacagaacggaagcacggtgagttacctcagaagcagaatgactgtaggcggaagtagagtcggccaagtagctacacaagcaaagatgtacatttcattttgtggagaagagtttgaatattcatatcctttcaggaaagattttgaatattgatggttttgttggtgagaaagagacttattgttcatgcttcctttacataggcctcaaaattaacatattacggagagggtttaatgaggcagtcagattcatagccatcttagcagtcactggtctgaatcagtttgcccttggcttcctgtttctctacccacttacccacgaagtagagttgcccacctgttgcctggagtgtgaagcctggtagttttgtttgttctcacattgtagctactgctgcagagccagcagctagggtcctacactgtatccccacaggatttctttcttcttaatcttaggggtacaggtccacttgtaggtctgttgaaagcttgcatgggactgttaaccgtactgctggaaaaacagagctccctgaatgcctgttccaagggcctagtgacagggcttagattttcatacttgtcattaacttgagatggaattgtttgtatcctagaggacacaaatttcaccaaaagtctaaaagactgctaacaatattattcccattagaagtcctgagaggcatagaaaccaagttactccatg

SEQ ID NO: 18102 - DNA, 1218 bp, Mus musculus
gactggaggaaccaggtgttcagcctggaacccgttaccgctaaggggcggagccacatccttaaagccttcctctcatcttcccacatgaacgacaaaattgtcctttcatccttaaaaagctctataatcattccctgaagaaagagagttgtctaccacatctccagtgattaaaatcgcccggaactcgcccacctcaggattctactcgtgggaaaggtggctctttcacaagtgggcaaaatggctgtcctcctagctttatcattggttgactcttacgtcgttcagggacgacaacttgcccgggattggttctttttcttttgtgggtggagatagacttagtcccgttctcccgctgtcccgcagtgataatgggggtggagcgaaagtggttttcaaacgctgattggataatttgtatgtcacttaatgttgacctagcgtatgaggtaggctgctttccgtcaacgcgacggagaggcggggccagtgcgtggtgggaaggggcgggattctgccgccgcggctgccgctggagccggtgtccgggctggtgatggggttaattcccttccgtgagactctaccttgcaaccagccggccccgccgtcgccccgctgtgccgcgctcccgccacctcctcctgctccttctcagtaacgcgggtaagagatgctgtcccctcccccgcggcgccccgggaataacgcgctcgctcccctcccccgcccgccaaccggtagcgctaacggagcgggagagtgaggcagccggggagctaagcgctgaggagacggcgtccctcccctctcctccggcccgccaggggccgtcgggttctgaggcgagccctctagtcgcctccaccgcgcggtgcccgccgcttcgctgggggccatgtgcagcgccaaccccttgaggcctagcgggggagctggggacaggttcccgagcgtccctgctgcagctgctgctcttgcgagccctggagatccggggaggacggaggggaaaagcaacatagtcaggccaggctggagcagggaccgttcgcggaactgttctccggggcctggaccagatgcccggggctgatacccccgctccggggaattgtcacacacaccaaaagggaaacagcacgtcgtgcccgtactgcccgtactgctagaaaaaacacagtggggaaattagcaagaaagttgaat

SEQ ID NO: 18103 - DNA, 1209 bp, Mus musculus
tctcatgtgaacaggaactctgcagtgagctagagccatattctcagtgtataagaaccaaaaggaatgatgcaattaacttgttacagcccaagtgacctggacaggacccgaggtagccaaaggagcacatgccaatatttatttgagttctgatttaatagatagtgaatgcctttgcttcattttcattttatgagaaaatttctcaatctaatagtagccacttaacagaataaggagtaactgcattcgattcccttaggaacattccttattactattaatagcatctcatgttctttagaacactgtttctgtggagctcaagataaaatacatgggctcttaggatgtacactgacctgtccacaactctactgtaaaaagttacactgaaaaaaaaatgatctttcattttcttacaacttttgttttctagaattcttataaaatactctaacatgttgcttatgatatttctgattctattgtttttagcgagggaactagctatgtaaattcattgcctgttgacccttcaatgctaagtttttcatgtaagagtcttcatactttctttcagggacagaatgatgctgctgaaattggaacaagaaattttagatttcattggtaataatgagtaagttctcagatttaacaagaaaagagattgtcattgtgattctccttgacttactaaattggcaattgttttcctttcaggtccccacgtaagaagtttcccccgatgacatcttaccacaggatgctgttacacagagtggctgcctactttggattagaccacaatgttgatcagagtgggaagtctgtcatagtgaacaaaactagcaacacaagaatgtaagtgtatagttatgttgtctgtggactaatacttgccttcctacagcaccttccatctacagtaattgcctgatcacttcatgcaatagagccaaaagtacatttatctcattaggagcaaaatgcacacctggattcaggcaaggcttgtttgaggaacagcaacaacattggaggacatgctatcagccatgtttgacaccctttcttaatgaatttttaaaattagtttaggtatctgtgaccacctctagggaatttgtttaaataatttttaaaaagaagcaataaacagattttaacactcacattctgtctactactttattatcattt

SEQ ID NO: 18104 - DNA, 1204 bp, Mus musculus
aaaaataaataaataaaataaaatagaaatatatatatataaagtgtagggcttgggtaatatagctcagttagtagagtgcttgcctcatatcaaattgtcttgggttccgtcctaagcactgcacaaattagacattgtgatttatagctgatctccagcattcaggaagtgggagacaggaggatcagaaattcatgaaattttcagctacgtaatgattttgaggctattctctgagagatgagatactcaaagggatgtggggtgtagggtgggggtgtattgtagcatttgcattggtaggtttggcccatgaatgaaaggctgactgatggccaactttttttcaacaggataaccttggcgctcagttcagccatatgagtcttgcccgccagccatcagctgatggttctgaccctcatgccaccatgttccagtccactgttgtactacagtctccacagcagtctggttacatcgtgacgacagcacctccacatccgccaccaccacctccaccacctccccctcctccttccctaccacctgggcagtcagtccccactgccagtttctctgcctctgggcatcctgtcagccagcctgtgctccagcagcaggggtttcttcctcagccctcaccacaggtgtgttgttttttcacgttctttctctctcaggaacctctaacttgggaacaatttgtgaggtagtgtaagtaaagcccatggttatctctggagattgtcaaatgcctagggagcagccatataacatttagttacaactcaacgtacgtcttctttgaatttccctctgactctgagaagtgggtttttttgtttgtttatcttaggaaaacataataagtgtgtgtgttagttagggttactattactgtgatgaaataccatgatgaaacaaaagcaagtggggaggaaactgtttatttcatttggtttacactttcacatcataatctatcattgaaggaagtcagcaaaggaattcaaaacaggacaagaacctggaggcaagagctgatgcagaggtcatggaggggcgctgttcagttaactggcttgtttatcctggcctgctcaggtttcattcttacagaacccaggactccttgcccaggaatagtaccacccacaatgagctgggtccttcctgccaatcacttattaagaacatg

SEQ ID NO: 18105 - DNA, 2243 bp, Mus musculus
aagatgacctggtctagcgaaagcccttgctttgtccccacagaaagactgagattagggctggagagaaggctcagcggctacgaacactgactgctcttccgaaggtcctaagttcagtttccagcaaccacatggtggctcacaaccatctgtaatgggatttgatgccctcttctggtgtgtctaaaaatagctacagtgtagtcatatacataaaaataaatacatcttaaagaaaaagaaaaaagactgagattagtagctcaacacttaatgctgaattggaatgattttaaggagtaattgtgctgtgagtttgtgtcagaatgctgtttcctgtgtcatctggggcagcagtagttggtccattaactctttcacctttttcatgctagttgtcggcaaggtcttggaaatcacagaactaccagacggaataactcgagtggaagccgagaagctttttggggaactctttaaaattggcgccaagatccgatggctccgggacccccagtctcagcctcagctgcgtcgtcacgctctctgctgtggtagtggggataacactgtcaaccctgagcactctaaacccagtgacctggcctctacgtacactgtcctagctacgttcccctccatttcagctgcacagagtgcactgaagaagcagatccattcagtgaacaagtttaagctgagaatgagcaagaagcactacgatttccacattttggaaagggcaagttctcagtaaaccagccgctacctttggacccctcactctataattccctgccctctcccatctgattggcttgttaagtggagcgtatgtaatatagagactcctgggatgtttggccatatgttaccgcttttggaagaaagtccagggacccagaaaagggagggggaagatacccatttcaccccagcgtctataggaatccacacgggaatggttcagagttagcagctgtttctaaggaaatgctgttcagatgcctcctaacttttatagttattttgttttatatttctgaattcttgtatcagatccaaagctctattgtacagcaaattattcttcaaagtgattataaccagttacaacctgtatttctttttgcagccagcacagtgtgaaccaactcagactttgagagaaaaagaatgcaggagtggaataaccaagtcaaaaaccatgtcaaaactatcctctggggggtgctgagggtgctatggagacccacaaataaacaattactcctccactgaattgctaaacacagaaaaatttccaggaaatccagaactccccaacagggtccttcttcttcatttaggtagtgtggccgttaagtgtaaggtaaattatgttctcgatgcctcctaatcaaaccacttaggttagaaagaaacaggaatcatcctaggcaggaaaattactccacttttttttaagtgtccttccaataactaatgccactcatcagcattgtcctctttggaaattttgtcctcctgaggaaatgcacttgacgagtgctgaaaacttcttaagtggtttaaattttgttttcattgtttgcagcggattactggacatcaaagattcattgcacttatgaacaaggaaccttattttcaatttctgtgtaattttgcaaggctgtacaatgtgctgatgcaagcctttttcagttcaagagaataaatgtttacaaatgtagacccactttgtcttttttctaattagaaacatccttagggactgcgaaggtgtcacattgggtgaaagcactggttgtacatcaatccctaaagcccactaaaagtagaagagatcctaccacatggacttctcctgtgagaaagcagtgtgctttcccatgatgccaaaagtagtaacatgaaataattagcatcatagctgacaacagaatagaatctgacctcttcttcaggctaaggaagggttcgtttgtttgtttgttttttcctgatcctaatatggaagaacttgtggcctatgactagagaaaatagacctcagattaaaacccattagtcctgtggtcttgatgtaactcaaggcagcacattctgcaaaacagctgagttgaattctccacatcagcaacagaaaaatgtcaaaatgagacctcagaaggggctcagcagaagctctttgtggaaatggtctgacccctgcatgccagcactcttcatggtct

SEQ ID NO: 18106 - DNA, 1181 bp, Mus musculus
aaatagtggatgaaagaatgacagactacataagactcctcactcttgacttcctccttaaagtgattgtgcagagtgctcttaaatagctatttctaggttgatagttgactctttttcttgggaatttattatttcttcctaccccattgtctctgcagacattcgttcagaatcgtctcacttccaaatggtacctttcccttgttctttagtgtatttccatgtcccatttccatgtacaaatttctcctgggacctcatctcattcagacatgcagtcaagtattgtaggcatatgtgtatgctcactatgctaaatatttaaatattccaataaacacagaatacaagctatatgtcttattactacaggttcgcttgtaggaatttcagtcttaagataacaaggaaaactgtctttgtccttatggaacatttttttttctagttgggagagaaagacaatagacaataaagataattaagatgtatagtatattaaaagtgggtgacctgtaatgggttttgttgtccaaggttcttataacaaagttaacttaaaaaaaaaaaaaaaagcaacttttttttttaaagtgttaagtggtgctggagagatggtttagtggttaagagcgctcgcttctcttataaggggccccaagtcctgataccaaattggctccatgataaccaattgctgtgtaagaatagatattctagtgagactggacaagctaagagaacttgctcctctttcatcaggacccaggttcagttcccagcaccacaaggcagcttacaactgtccttaaccccagtttcaggggatctaatggcctctttgggtaccaggcacatatatgcgcagacaaacacacataaaataaaaataagtaaattaaaaaaaaatagacttggaagggaagacccatttaagctactataaatatctgggtggcctctgccagctttgttcaaggtggtagtagtggaagctataagtagttattatttgtgtttgttttgatatagccaactgaaatataaagttttttgggtttgtttgtgaatttgctatgctggggctcaaaccaaggactttgtgaattctagacaagcactgtaccatgggactacattcatgacttcaggagatcagttttctgatttgatagtta

SEQ ID NO: 18107 - DNA, 1813 bp, Mus musculus
atgttttcagaccgtgtatagtctttatttctgctaagaggttttgagttaagttgtttaacctgaaaaagtcaaacatgaaatagctggatgctaggtccttgtgtagggtaaccagctgttgagcctagaagaatcccaaggccaccctgccaccaccgctcctactcagactccacagcccctagcccagtgtttcatttaggatactttttgctgcaagattctcaagccacacacagtaactggtatgtcactgagtagtctgagccccgagcacctcagcgagctaatcaggtgataactgatgtttagcgtttctctttgcactcatcagcctcaaaaacaaaacaaaaaaaaaaaatcttgtagtttttgatcttacttaaatatcaaataaaaaaagtttccaaaaaaccagaatgatcttatttttgctgtaagcatctttgttgtacagggctgtatcgaggtcacttttgtctgactttttcctcccagtgctgccctgaagatgtcagcaaaataactgagtacctttatttagaaaaataaaatgtagaaactctgtgtcctaggttactgatgcatctgttttataacctgttctcatcgatgccaggcagatgagaatggccagtctgcggcttagattgctcactaatattcctgctgaaatctcacatgcagcagtcacacttgccaggccaaagtccagtactgtaggactagggtagagaggagacacttcacccccattattcctgaaagttgtgatgtttgaaccgtggggtatgttttgctgtacttctggttttaaaatggaaagtcaacctgaccctgcctgtgtcagacaggaagaactcctctcccctgcggagtaacacgcgtgttgcgtgtgagctgtggtgctggcgggaagcagggggcagctaaagtgctggagtaacagaaccttcctgaaaacatgcctaggaactttaaatatttcatattttgacacaatagctttttctaagtaatgatcctcattgcagaagtttagctatgaatagtcctaatattagttaacttaaaaactgaaaacaacaaaatgccttctgtggatgtaattcctgttgagaaatggaacatactaatccagcacatgtttattgaatgtctgctatgttggtggaaagaaggcaggaagcatagctgtaggcacaggatgagttgagctttgtaaattgtgtgtgtagagggcagcgtgctaatgtatatgtaaagagaagaacacgctaatgatgtatgtccttggagttctcttgcagtcttctgcattgatcacatttgttaacactatttaaagaagttgtttgccaggcatggtggctcacacgtaaaatcccagcgcttaggaatcaggtgcaggagtttaagggccaggctggtctacatagcaagttcaggccagggctacaaggtcaacaacaacaacaaaaatgcaagcttttaaaactttgtaggaaccatctcatctaagatccagtcatctaaaaacacagcaagctgggcgtggcatcttgttcctgtacagtacttgggagatggggcagggctctcaaagctcaaggttatcctcaggtccaggctcaagtccagcctaggcagagtgagatctgtctctgcaataacgaggcaatatatgagttttaagaaatacttgttaatggtatgaatcctggaaaaacattaattacctcaagtcaatttgtcttgaagaaaatcaaatacaagtcttaaaatgtccatagttcatgtgtgagtaaca

SEQ ID NO: 18108 - DNA, 1488 bp, Mus musculus
gaggagggactcgtaaaaagggccaataggcagtgattaaaaatgaacagattttagatattagaaaattttttacacaatcttaaagttcaagcacagctgttttgaagttatactgacaagcatttgataaaatgtgtaggatacctggggctgatcttccagaggtcctgagttcagcagccacatgatggctcacaaccatcctgaatgggatccaatgccctcttttggatgtctcttcttcagacagtgtgctcatgtacatgaaataaaataagtcttttttaaaaaaaaaaatcacaatacctgctaggtttcttcgtttttcaaggcagttatacctgaagggtagcatcctagtaagaggggttgagcagagcactgataatggttgaaggtaaggttctgtccagggccttatcgagaggaaacaggaaagtgtaagtatcggacatttggaagcgtccgtggttctggactgaggacaaactgtgctccacaggatcacgttctgattgagctcacccaggctgggctgaaaggctccagtgaaggaagcgagagctatgaggaagacccctacctggtagtcaaccctaactacttgcttgaagattgaggtattgaaggtaacttgatggccagggacctgtgctgtcctacccttagcccggaccctgcacggcactgagagacagtgtctggagcaatgcttgaggaggatttcagaagtgatggctgagttcatggctctgtgaatttcatactgggacaggcttgggcactctgtcaataggcttcttgtactattgaagttggaaccaaatcatgttgtttctataagacatttcttcatgtataggaaaagcctgctgcatttgtcatacatgtgtctgtggaaattgctttcttctgttcccagccactgcttttacccatgaaaataaaacaacttgttctgtgattgtctgttggattcatttctactcttgattattgcctccatttccatgagtgactttttttctggcttattcgctagtagaaagaccatgtcaagcgagagttcttggtgactttctgaagtaaaatcccagtggttttgctggggtttgtttgggtttgggggtcagggtgtctggggttttttggggggagtggagcagctgggtttggggggaactttttttggtttttcgagacagggtttctctgtgtagccctggctgtcctggaactcactttgtaaaccaggctggcctcgaactcagaaatccgcctgcctctgcctcccaagtgctgggattaaaggcatgtgccaccacgcccggctggggggaacttatgtagcctagacttggatttttgatcctcctgtcttaattcccacacctggcttctagaataaggactgtttaccatctgctcagtattttatttctttcctaaagatagttccttgggattgttctcaattgtttttat

SEQ ID NO: 18109 - DNA, 1099 bp, Mus musculus
cacatgcgtccatatacataatagcaatttaaaagattcttaaacttctcgatcacattgaacaggtgaataatattatttttttccttataacactacaaattgactttgtcagatgccggggaaaggtctcactaggtagcctaagttgtcttaaatctctagcctctggttcagccttttaagtgcacaaattataggtgtgtgccactgtgccctgctgcaaatggtatcaataagatctctgtccccatctctgacactcttctcaagccagttgtcttcactagtaggattttaatttgtttcagatttatctataaaatggctgttttctgaagtttgtactaagcatagagagtgtgcatgggcactagatgggcatgttgaagtcaccaggaaggacttaggtggttatttccttccttaggtcatgccgacagccctgcccctgtgaataggttcaacggctccagtgaagatgccagccaggagactgtttccaagccctccctgaggctgggctttgctgaatactgccgaatctcgaacctcatcgtgctccacctcaggaaaatggaagaaggtgagtatgtttcccacgctgcttatctgctgtgggtcttacacgcgctctctgccacttgtgatgttaagccttgtgttaagcttcagaactcagaagagatgatggtttgtgttggctcactttaggagggagcctgggtagtatcagcacagcctccctacaagctcattgtcagtagagtacagatcattctacaatacaggacataaataaataccgatgttcctgtatttagcttatgattttgaagcagaatctttagatctgatgatataaacaacatttttgcaggtggaaatgactatagttgctttcttaccaacagatgtcttgcaggatatttgtgtttatctacaaaataccacagatgtaatacaatcctcctttgtacctggtcggtggggcacttgcccgctttttacccttgactgctttgccatggtttcatatcggtttcacagttagccatgggtaagaggagaagccatcatctgttagagctgaagttca

SEQ ID NO: 18110 - DNA, 1122 bp, Mus musculus
ctcaggatagacttagtgctaatgagctttgacatcttgaggtacatttcattttattctatttattgcttcatgtgttaaacatcatttagaaatggtcaattgcttatactggtccattgtcttcatattcatagaattaggacatgaatttataggcttctgagtgtcagtttttttaattaatttactgtctttgtgataaagtttcaacctctgccctctgtttcctggagtgcttccatccaggaccctctttacctgacatttaatgtagtcgatcaagtgtgtgtgtgtgtgtgtctgtctgtctgtctgtctgtctgtctgtctgtgttgtatgtatataaataaatatctccttgacttgactggtttttaaacagatttccaaagagtcagaagacttcattgtggagcagtacaaacgtctccgccagagggatggctctggggtcaccaagtcctcgtggagaatcaccgtgcgacagcttgagagcatgatccgactctcagaatcaatggcccgcatgcactgctgtgacgaggtaccagcccctctgataacacgggaacaggaatgcatgagttgacttttaggcgggtttttatctttgttatggaatatctcacagccagttgataactattctcccagtaaaaaggttgctatcataggtttatgaggtatgctgtctagactaatagtgatggataaaagtgtttattataatcagtaaattatggagtgcagatacaggtgagtacttacgcaagagaaacctatttaatctctacagtggccttggcctctggctgggaatacaaacgtgactgtgactcctgcctcagaggactcttcctccttagggttgtataatcagtgtgtggcgggtgtgggcattattttgggtttgcatatgctggggcaaaattcagggctttgtgtatgctaagcacactcatgactcttaccttagctccatagatttttaattgctcttggtgccctagactcaaagcaaatgtcggattatgggaaggggtgatattggaagccacatatctgcttcaaactaagaggcttttgtgtacttttatatacagagttcatttaggatt

SEQ ID NO: 18111 - DNA, 1099 bp, Mus musculus
aaaatatctgtagggctggtgagatggctcagtgggtaagagcacccgactgctcttccaaaggtccggagttcaaatcctagcaaccacatggtggctcaaaaccatccataacgagatctgactccctcttctggagtgtctgaggacagctacggtgtacttaaatataataaatgaataaattaaaaaaaaaatctgtaaaacctttgatcgtggggctagagagatggctcagcagaagttaattttgtcttgtttgaagatagggtctcctggagcatatactggccttgaactcttatatagttaaggcttaactccactgaggttcctgcctctacctcctaagtgctggaattgatcgcaggcctttactcctagtctgtcacttgtagctagacatcatcccttactgcggatagatagtacttgggagtcaatactactatgactgacagaagttctcttgttctggatcaggtgacagattatgctattgccaggcgcatagtagacttgcattcaagaattgaagaatcgatcgatcgagtttattcccttgatgatataagaaggtaccttctctttgcccgacagtttaaacccaaggtaatctgccctgccagacctggataagtcgtggtgtgtgtgggtgttagaactaggtgtgaataaatgggttctgtggaaattaaccgaactgagttttagctttggttttggtcttttgaggcagtcagggtatccattgcatagtctaggctagcctcaaactcaatcctgctttagatgcccacttctctatctataggaatgtgccaatatgcctatctgtattcattttttaaatatcctcaaatctttagcttattgtttgagaattttattcttgaataagatatgtttttataaatccacctctcgcttctaggctttttattccttccatatccacaccacttttccttcctaactttgtacactccttttaaaaccctctaagtccactataatctccttaaattttaagtttttatgttgttctgagtactggtttcttcaaagatggttaatttgttaagtactgaaaaaatat

SEQ ID NO: 18112 - DNA, 1243 bp, Mus musculus
tggagctgatgggtatgagacagaaggcattcgagggctccgggcccttggtgtcagagatctgtcatacaggctggtcttccttgcctgccatgttgcaccaaccaacccaagggtaggtcttattattacttatttgtttgtttattgtgctggggattgagcataggatctgtgcctggtaggtaggaattgggctccatcctcaaccttagtgtgagatttactaagatggtagagctggataaagaaagcgctttgctaaggctcattttcatcttcatatcagtgatgaacttactacaattcagagtaataaaacagcggtagcttttgttttcctctggacaaaagataggcttttatatatctttatgaatgaagcctagtttagggactatagtaaataaatcacaacgttgacctcccaagtgatcttactgtagcggaatttctttccctttatgttatcttggttctctataatgtctttcattttgtttttcttcttccacttcagtttggagggaaagaactcagagatgaggaacagaccgctgagagcattaagaaccaaatgacggtgaaggaatgggaaaaggtgtttgaaatgagtcaggacaaaaacctgtaccacaatctctgcacgagcctcttccctactatacatggtaagagctctgtctgttgataaaaacttgaaatcaggagtaagcatttcatggattcagtactggttcagggattttcatgaagagattgcttttagagctgaagaaatgactcagaagataaaattactggctactttttcagagaacctgagtttgattcaacagtattcacaaccatctatgaccccagttttagaggatccagtgtgttctggcttctgagggtactagacctgcatgtggaacataggcacacatgcagacaaaataccatgcacttaataaagatgatgcatcgctgagcagtggtggcgcatgcctttaatcgcagcacttgggaggcagaggcaggcggatttctgagttccaggacagccagggctacacagagaaaacctgtctcaaaaaaccataaataagaaaggaagaaaggatggatgcgtgcaccagcaaaagctgtagacaaccaaaaggtagatgtggctagagctcacgcaggggctcgcttggcttgacttagtgctggtgggtagttggattccttatgagtgagacatctagtgggcaga

SEQ ID NO: 18113 - DNA, 1446 bp, Mus musculus
cagcataaatgaactatgcagacaacatatgaataaataagccagttgcaaaagggcaagttgtgtacgatgctgctggtattttctggtattttagagggttaggttcagaaccagagagtagtttggtgaatgtctatgtctgagggatgaggaaaaagaatatttaataggtatagtttcagttttataaagtaaaacagtatgctccaccaaaaagctattggactggtaaatgagaggttttcaaagggggattaactgttattttcttgtccacagggctggaaagggtgacgatgctgtttttaggattgcataacgtacgccagacctcaatgttccctcgtgaccccaaacgactcacgccttaaagccacactttttattctctccaggaacctgctattgattaggttatacctgaggtacttaaaatatgcagtagaattaatgtcttactaaagtgccacaattattttttaagtagctcagtacaaattaatttaagtaaaaaacgttttagaatttcaaatatcctaaaataggaaatacttgaacgttttaatgagaaatttctatggttgaaattcatagcctttcactataggaaatgttaagaaaaatttaaacagtttaagattatataatttttttttcttttctatattgaggtggccaccatactaatattctaaattttcaatatttgaacttttaactcttgacattgaaaaaaaaggatttggagaaattaccaagattttaacatctataaaattggtatgtcttaaaagttatttcaaaaatcctgtgaagcatctgaaactggctagaaccagtaacactgagacattgttaccagtcctgaggctgagattcaataaaaacttacagctgatgatagtgttgtgtgactttatagaaatctgattttataactggttattgatgaatgtatattgggaaaatagaaagtaaactaaccttatattaatattagatgtgaaaagtgccgagggtacatgacagcatgtgcctgtgaccccagcactagggtgtgagcacaggagagctaacagttcaggacttctgctacgtgagatcctgcctcagaggaaaagtaagcacatgggaaagtctacaggaacatgcacgacgtgtaaatatcttagtgtatgtttggcgcccttgagagagatccctcccaagaagctccacacgttggtttatcatggccactgcacactgggcacagctgactcacaatagctaggtggtggggctgtgctgctgtttggggtgatgtgcttcagtagtgcagatcaaggcaggatggccaggagtggaagagacctcaggcagctgtgagtcttaagagaacagactcttggaagatagcttcagtgagacaagtcgtttaatggggatcggagggggttgcag

SEQ ID NO: 18114 - DNA, 1174 bp, Mus musculus
agcagatgcacgctgaacatgattcagcatagactcaaagtttctcaggcttttggtctgatgagcacaattcctctgagaacagtttttttcctctaggcaagtttccatacatagatactcaagcttcttagtggtgactttttatgtcttgagtacaaagatagttggtgtgcagtcagaagtagcaagtatggttcctttgtaagaattcttgtcatcattacaaataatcaaataattagagattacctttgaaactttttctttcttactgcttttttaaaagactgtattttcaaaaatggaaatttcgatgaactcttcttaccaaccttattgttcattgtggcagtccttgtacctcagcctaagagctggtattacagatgtacactgctatctataatcatcacaaaccctttaaagggtagaatctgcaggaaaataccctctagcatataggtgctaaatagaaagtggaacataactggaattatcatctaaacaactgtgttcagtttcttggtggttttttttttgttttggtttgttttggtttttggtttggtttggtttggtttggtttccttgcgttagagattaaactcggggtcttgggcaagaagtgtactgctgaactacattgcttccttctttttctaatttctttttccgtaatacaaattgagcacagaattttgaatatgttagcttgctagacaaatgatgcagtcttgagctatattcccagttccttctttttaataaaataggtaccttcttttctaggaagaacctaatggacagggaggtgtttattcttacataacacagtccattttccatgtacattgatacagttgggagaccaaaaataggggtttagtctgtgatagggtatatttattttttgttgttgttttttttttttggttttgttttaaaatttgctttctaaaaatactaagtttagttatccttgctaaaagaaagaaatagctatgaagtgtactagtggcccttacagagtatattacactaaagtgaattgtgtctccatacgtgtagcaatataatgacatacctctttgatctgtagattactaggttttgaaaacagaagtttacacagtttgtggtgattgggtgaactgatgtttaagtcacttaa

SEQ ID NO: 18115 - DNA, 2041 bp, Mus musculus
agtattcacctagcagaaagccctgggctccatccctcacaccatataccctaggtatgatggaacatgcctgcaattccagcactgaagaaatggaggctttttcgcaatgggtttgccgtcctaacgcaggtgttgtgaaagccactgctaattcaaagcaaaaatgggaaaggaaaagactcacatcaacattgtcataatcggacacgtagattcctgcaagtccaccacaaccggccacctgatctacaaatgtggtggaatcaacaagcgaaccatcaaaaagtttgagaaggaggctgctgagatggaaaagggctcctttaagtacgcctgggtcttagacaaactgaaagctgagcgtgagcatggtatcactattgacatctccctgtggaaattcgagaccagcaaatactatgtgaccatcattgatgcccaggacatagagacttcgtcaaaaacatgattacaggcacatcccaggctgactgtgctgtcctgattgttgctgctggtgttggtgaatttgaagctggtatctccaagaacgggcagacccatgagcatgctcttctggcttacaccctgggtgtgaaacagctgattgttggtgtcaacaaaatggattccaccgagccaccatacagtcagaagagatacgaggaaatcattaaggaagtcagcacctacattaagaaaattggctacaaccctgacacagtagcatttgtgccgattttaggttggaatggtgacaacatgctggagccaagtgctaatatgccttggttcaagggatggaaagtcacctgcaaagatggcagtgccagtggcaccacggtgctggaagctttggattgtatcctaccaccaacttgtccaacttgtccaactctgcgactgcccctttaggatgtctataaaattggaggcattggcactgtccctgtgggccgagtggagactggtgttctcaaacctgggatggtggttacctttgctccagtcaatgtaacaactgaagtcaagtctgttgaaatgcaccatgaagctttgagtgaagctcttcctggggacaatgtgggcttcaatgtaaagaatgtgtcggtcaaagatgttagataaggcaatgttgcttgtgacagcaaaaacaacccaccaatggaagcagctggcttcactgctcaggtgattatcctgaaccatccaggccaaatcagtgctggctatgctcctgttctggattgtcacacagcccacatagcatgcaagtttgctgagcttaaagaaaagatcggtcgtcgttctggtaagaagctggaagatggccccaaattcctgaagtctggtgatgctgccattgttgatatggtccctggcaagcccatgtgtgttgagagcttctctggctatcctccacttggtcgttttgctgttcgtgacatgaggcagagagttgctgtgggtgtcatcaaagctgtggacaagaaggctgctggagctggcaaagtcaccaagtctgcccagaaagctcagaaggctaaatgaatattacccctaacacctgccaccccagtcttaatcagtggtggaagaacggtctcagaactgtttgtctcaattggccatttacatttaatagtaaaagactggttaatgataacaatgcattgtaaaaccttcagaaggaaagaatgttttgcggaccatttgtgtgtgtgtgtgtgtgtgtgtgtgtgtgtgtgtgtgtgtgtgtgtgtgtgtgtgtgtgtggcagttttaagttattagttttcaaaatcagtactttttaatggaaaaaacttgaccaaaaatctgtcacagaattttgagaccattaaaacaagtttaatgaggggaaaaaaaaaggagatgggaagatgagaagttcaaagtcattcttgaggccatccagagacaacattgagagagagagggagagagagacagagacagagagaaagagagacatagagagatagagagatagagacagacagatacaaaaagagag

SEQ ID NO: 18116 - DNA, 1330 bp, Mus musculus
aaaatagtttaatgcaaatgtatttgtgaatgttctcaattgttttaatctattgaaactttacatgtagttgttcaggtgtctttcattggctcttattctcaaagtatcttcagtgtgctaagatacaaaaagctgcctttcgtacttgtttccataattactgaagtatattgaagtaagctgaaggctctttattatctttgacttacattaagacatttgacatttgttttgagctcctaattagccagttcttctagtgttttatcccactgaacccgaaaagttaatgtttatcatcagtaaataaaatcattttgatattaatttttttctttaactttcaggacatacatgtttaataaccttgacagttttgcatgtgatgctatcactcattggctacttgacatagccaacgaagagttacgaagaaagtatataaaactactgataatacttctagtttgttagactgtccaagaagaatggatacaataaatttaatagtgttgtttgttctgcatgctgtcattgtcttcaagatgtgttagaaatgttaagaaagcatgaagaaagtttgtttggtatggcatttgtgatgcatataagtctcttggaaatatttcaaaactagacaaattcacaacattgcatggtctcttttctaaaaagtgtgggaaagtgtagaaaatttccagactagtatggtaatgtggggagagggaaatcatgatttcttaggctagatctatcctgttagtctagcttatgattaaaataggaagctaaaacatactgattagattgcaaaagtaaaccaaagtccccaaacaaaacttctgttcttgtaagcagaatcgccacagaggtggcacattctaatttaacccttgacctgaagatgttttcacttttactttctatgaagatgagttggctaaatgttataaaggaagactatactaacaaacctgcagtggaagctcacttgatacagtgcttgtaccacaagcctaaatctctgagctccttcctcagcacacagttataataatcccagtatttgggagatgaaggcaagaagatcagaagttcaaggtcattctgcgttacctgatgaggttcaggccaacatgggatacctgagactctgtagtaacaaacaaacaaacaaacaaacaaacaaacaaacaaacatacatcatagatggatggatgcatgaacaggtatagatagatagatagacagacagacagacagacatacagacagaaagaaatgaagaatgttgaaccttttgaattagttgatggcaaattaaga

SEQ ID NO: 18117 - DNA, 1300 bp, Mus musculus
agacgtgtacctgtgttcaaggctgagattagataacctatctaaaggcttgttcctggagaagactaaatcttcctctctcaggagccattgagtacatgtggctcttcatctagagtgagtatgtatgtgtgtatatatatatatacacacatatacatatacacacatacacatacatacatatatatatatacacatacatacatacatatatatatatatatatatacacacatgtacaagccacaataactagaagggattatgatattgagggagtgggagaaaccttggaagagttggatggggagcaggaggcctagaatacagtgtgtgtgtgtgtgtgtgtgtgtgtgtgtgtgtgtgtgtgtgtgtgtgtgaaatattaaaaataaaaaagacaggagatgcaattgatagatgaatatttgaaaaacaaacatcctagaagagctaacattagagtagagtataacttgtcctctgactgtttccttgttctgtggctgtgagacccaagggggtggcatgtcctctcatcacagtgtgaggatgagatatggcctgcttggtgtgtctggcacttttttcatagttgcctcgtctactgcttagttattgcaactctggtccaaattggaattcagtctttcttctgctgcaaggcaagagtagtccagagctactgagtgggaagagaaagaacattgatctaagagctactaaggatctagcttgtaagaggagacttttctgaccacttggaattgagctagcctgttgaacgtgccatctttaggagtggactctcagtctactgcttgctcttctcattcccactgtgttagttcacttctataggaagtcttgttatccctgcataacaaggaacaaaagttggagctgaaaagcagcaggagtctcaacatccttttagaacaaggaccttccgagtagctgagcaggagcagtagggagacacgagtagaaagtacttattccagagtttagggaagtttaccaggctgtgcttgtgtctatcacaaaccccacaaagagaatataacctctagagtacctggagttgagactttcagtttcctcatggggaaaataggtgaagacttgtataaaacagggaagagaaaataatagtttgcttatttatttatatttatttattttttaacacacaactgaatggaaaataaaaccctgaaaaatggtgggaggggtcctggagatatagttcagtggttgagtacttgcctagcctataggaggccctgggtttcat

SEQ ID NO: 18118 - DNA, 2089 bp, Mus musculus
cagacagggctttactggagcagggcctacaggatggctggcccaggactctttccccttttgtgagcttgtcagagggctcctgggagaatagctacacagtggccagtgctggaggatgatgccgtctgtcggcagtgtggacccacaactgacatgcatcactgtaccctttttttgccttgtctgtctgtccctcactgcctgtgtctctcctctgccctctttccctgctcccaggaggagatgaccagtgccttggccacgatgcgtgttgactatgagcagatcaagataaagaagatagaagacgcatccaaccctctgcttctcaagaggcggaagaaagctcgtgctgtggaggatgcggctctcgcccactgagccgctctgtctcccacccactggaggacaagcaataactctacatgaatatattttttagacaaagagacacaagttgcccaatgctgcctcctgttctcttgggctgcgtggcgcccagaaatgcctccggctttattctgcccttggctctggctcccccgaggtgggggctggaggatgtgtgaggggcaaggtgctcctgagcccgttgctcctttgcattttatctgtaatttggcgtagagtttttatggaacctgtcttcttgtccttttccccactcctcactccttccccaggtcctttcccatctacaaaggctgaggcttatccacaggtgttgtggaagttgttatagggaaagtccctaggttgccctatctgtctcctctggcctcccactgtaacgtggggtcctcactggctctagaatctgggagttccagggagaaggcagcagagtggcagtaggtggcccttgcctcccgctgaagcccttagacatcaccagtgtgcacaacagagcagcacatgtgtgtgcatgtgtgtgtatgcctggatccatgccagcgactgggcattggagggtctagggaaggcggggctacagggactcctgcttgaactgagcctgcctaaatgcctaggtagcttgtctagatccagagccaggtaattgtggcctctgtgttagctgggcaggggaggcagtgaggggttggggggcactgacagccatcaggaggactgggtcccctcaggacccctttccctgctggtcccagatccctgaggcactgatctactgagtagcctctgcttgcccttcttgccacgattaacccactcttgtcgagttctctgaaatttttagccatttctcaatgggctgtccactcccacggtgagcctgggaaggttctatgcctggaaaggcagttgcatttcatgcatctcccctgatctctggggtacctgccaacctcccttcgacaagggcaggaccacgtgtggtcttcctggatttccaccatgtggtctggtggatgggacagtcttcgcaccaaagatgtcttgactctgtccctgcccactagccaccttaccctctaactactcaacctgggtgggggctccccaggattgaggaggagcaggcggggaagagtctttgtgccatggtcccccatgcccctcctgctggaggaggggtgtctccctcaggggttggtggaggaggggctcttgggcatccctgggcctggggcagggcccagatgtctgcagctcctcccatgtctttgatggtgtgttcaacactcagactgttgtaaactctcgttttgtatgagcaaaattgtctttactaaacaaatttaatagttgaaagtttttcattctttttcttcctgaggcttgggcccttgaccgtttacttgtgttctcccagcctgtgtgtggagagtgtttcctgtgacgggtggcagagccctgtgccccgagaagggagaagagagcctcctggctacatcagcatgggaatagcccctcgtagacgagggcttgtgtcaataagcacgtctcctttggagccaggaaaacagggtggcgtattatcttagagtccagaagggggcagtacaggccaggcagaaacaaaagtgctttgagtgagctagtctcctcagaaagcctgtgatag

SEQ ID NO: 18119 - DNA, 1161 bp, Mus musculus
gttcaggggaggcccaaggactgagtctttgcctcgttttgctcatctcaggagaccatagacctaggcatgctgggtctttatgtccctagatgtactagatctgacagggccccgccatgagtgggctgccagagttaagctgtgattgagtgctatgaaaatgctctgctgggctgagggcagcacttgggatctgtgtactcttcctaaggagagccagggtttctccgtggagtctgggattcagattttgctctaaagtcccagctgactccacgaatacactcccaggacatgttcctgaagctaagtgggtgccacatgtttgtaggttctcagcggctcagcagtgattgcaccctaagcttgtagctgcagagtcccttctgggagagggtcctcttctttccccggcccccactgttgcctctctttctttatgaagggatgaaggactctgaggcaggggaggtctcagcattcaaagagccaggacaacccacagtgatctttgctttgcagctccggaagtcctgggcccggagaagtatgacaagtcctgtgacatgtggtccttgggtgtcatcatgtatattttgtaagtgggctggtgtgtggtgtgggatggctgctaggctgcagtgcgtcagggagctggggacgctttaccactgcaggacaagaggaggctttagcatttccccttcggatgggggctccctgggaattctgagttcctgcttcacttgatgcttggtgggttctggttgctaagtggtggtagaaactagctaatgggctagccgtctaggtgacatccttggcacttagactcctgggtcctgcagtcccgatttctctgggactataacaagcagagtctgtttcttacctgattagtggtgcagggtttctaaataacacccgctttgcccttctcttccttaggctgtgtgggtatccccccttctattccaatcacggccttgccatctctccgggcatgaagactcgtattcgaatgggccagtatgaatttcctaacccggagtggtcagaagtatcagaagaaggtaggaaccggccttcggggacaggggaaagagtgagtgtgtgcgagcgtacgcacgtgtaggtatcagtctttttcacatgtgt

SEQ ID NO: 18120 - DNA, 1188 bp, Mus musculus
tgatggatatgtttttgttagacttttttttaacaaggcagaacatttttatatgactataaaagaacgcttcaagggctaatgtcaaaccagcttgtattggccatctggagtatacattaaatgactttttcataggtcagtgcattgttttcattctcatcagaggtactcgaactcacgtattaccctcggtttcaatctctctcaagatagaagatattcttttatgtttttacgggtttttttttcttttttaaattttatgtatactggtgatttgcatgtatgcctgttttagggtgtcagtcttgggagttacaaacaattgtgaacccccatgtggatgctgggaattgaacctgtgtcccctggaagggcattcagagctcttaaccactaagctatctatctctctccagctcctcgatagaagatattctaaaagcacaagctgactgcttgtctcccttagcatctattccggagggtactggggtgtgggaggcatggctgtaaggcaaagctagaagtcttaaccccagcaagcaattctgtgggctcattctagatggaaagagtacaggtagctgtttgtcacctgagccactgtcacagtggctcagtttttagttctctggttttcgtgttgagttcatagtattttatggctttgtcttttattatttcgcctctgatttatagcctgggtactcagtggtttacagatcttacactttaccaaataaccctgcacttaacgctctgctgtcataattcccccaaaggcccgtgtgttaaataaaggctcgctccccagcaccaggaggaagtgctgctcctaagccgtggccgcagtgttggatgttgggcagttcattgtgaatgtgcttttaatgaggaccgtggggccctgatctcattctcttcttttaactgctggccatcaagtgaatggctttgcttcactgaatactccatcgtgatatgatactgcaggcttaggacagcagtgctgttcagctaacagattgaacccttggaacacactaaagctttccctatatagatccatttccttgggtatttgttaacggtaataaagagctaacccatattggttttaaacccaactcatgcatcctttctcggccaactcaaaaggagctaacttaatgtcacaaatga

SEQ ID NO: 18121 - DNA, 1235 bp, Mus musculus
tggtgtaccaaaactaaaagtatagggggggggggggaaacgcctaaacgattattcctggccggagagactggtgtcggagaggtccgtgccctgaggtggcagagcctaagaaagctgtggtaaggagagatgttaactctcctttttaagtcagtgtcgtagacacggatagctccgcagggattttggagccagctttctttaggtatcattcttggtgccatagtagccttttaatgagaggttgacagattgccaaccagtctaagacaggagtggggacagcatgtgaggtcatctgtgtttccaatgactttctaaagactaactttggttgcttagtgaaaataggtgttccgatggaataatatgcccaggaggtcttgagaataatgaataagacagataataggatttggaaaagctgagaagggggcatcacgaaccaggcagtctttcttcagtctttatgatttgtatagtcattctgaatgtctgtatttattaatgtgcatcgtgctggtgtgctttctgcaggagaaagctccgggccgatgtgacagctgctttccctgccctgggaacagatcagatctctgaattgatacctggaaaggaagagctaaatgttgtgaagttgtatgttcacaaaggggattcggtgactgtgtacacgagtggtggtaaccccatcctatttgaactggagaaaaatttgtatccaacaggtatggtaaccagatgaaatgcccagactgcagccctggtgaaacacgttattctctgttgatttggtgtgatatttgtttttgttttcccccataaacataccttttcaaatgaaataaacacagaatttcccaatactattcctaaggatcttctgggacctagtgtttccagaattgaccttttcaccgtaagagggataagaaacaaacgaaacccccggccccccccccaaaaaaaacccaaaacacatggaaaaatggcagtgcaaagttctgagagaaaggagctgggggtattgggaagagtgctgaagtgttgccaaaggtggaattttagagcatgtaaagaaaatatggcgtaaaccatctgtaaaaggctttttcttaacacagtggagaaaatgtacgctcaggactaagctgtgtcagtcacacacttcccctgagctgcttcatagtgggttttcctagttagagtctctctctctctctttttttaag

SEQ ID NO: 18122 - DNA, 1296 bp, Mus musculus
agaaaagagtggggcactttgcttgaagctctctgctggcttgcccctggcaggaagtggacaatggtgctatagagccaaggacacagcctcagagcacagggtgattgatgatcagcctctttcccatcaagcttcccggtcaggctttgactttgaagatgcgaggttactagactgcattgacagcatcagattatgactccaactcttgagtagttcagacttaaaaccaatcagccagagtagccaggactgcaaagacactcaatacagatggagaaaaacttgtccctttaaaagagggccagtgtttcaattgagcctccagaggagaccactttcatgttgtgcttgcctttccataccctttcctcgggttgttttaagcccaagcttctccgtgtagcctaaaaagttccctaccagcccaggctgaagccacactgctcccgtcccagaagaacgccaaatccttgtcattcaaactgtgcatcgtttgcagagctgcaaaaagcaacatgagctagcgactctgaggttgtgcacgccatcagccccttggctgcctgaggtctcatgcccagccttacacctctctcccttaagaagcccccgtcctgctgtgtactacaggggcacgtggaaagtcattcccttcatcctgcatgtctgtagcgttaggagaaggcatggctcctgctgcaaacactgtgaatgctgctgagaacgtccccccatggatggctttttatttttgacaagaaaaaaaaattcatgtattatatatatatgtatatacacatagaggcatatagctatatatacagaaaggcgtttattcagaaaatgatggtaagattcagactttaaagcacagttagacccaggacctgtactgagggttgagcctctggaaagcatggagttcctgacgtctcagaggagtctaactgctggtagtgccttctatggttgtattattgctctgtatgtgttcttttcaggatattttctttctaaatgtctttctatgttttttaatgagtaataaaagcttactgtaaaaacaagtcacgatggaatcgtccttgctgaacgtcaacatcttctggaaagtgggctggagagaggaagactgaggcaactgcaggtacatttctagacagagccaagctttcttctccagtaagctagagaatgaaggctaccattcaaacgcttttgagaaaattgtccacacagtagagggtactgcttctggctgcctcttctccatctctgcggtgctggacg

SEQ ID NO: 18123 - DNA, 1165 bp, Mus musculus
gttcatggttgtggacaacccacagaagtttgcactttttaagcggatacacaaagatggacaaggtatgagtttctgacctctccctagtctgctaatgcccacagtcactaaacctcactatcagtcctgggtgggaagtgtaggcttccaggcagcaggattcatggaagggccaagcacaggctctgggcaggaccaggcagctcatgcctactgtgcccagctccatgcacacacaggaaagacacaccctgggctctgggctcctaatctctataatgggaaggagtccgcccactgctcctcttcctctggaagatgttgtaaatggaaatatggctaaactttgccatatgggaatgaaggtagtgcctctcaaatggcaggaatggatggaaggctcagagccaccactgccgtgtcaggtccacgcccattagaaccaccatgactatttccagtcatctggccaacctgtgcatttctgagcccgaccccaccctgtcctcatttgagatgagcacccagcccttcattctgcttgcagtgctcttccagaaactctccattgctgactatcctctctaccttcgtctgctcgctgggcctgacaccgatgttctcagctttgtgctaaaggagaatgaaactggagaggtggaggtatgtctgggccctttacaaaaaccagttctggccagatgggtgctgctgtcttaactgcaaagtgtaggtggggcagcaggacttccagaggctcagcatttaacccaggatcatcagtggggcgcgcatcacagggaagcaagttacaacctgcacagggcaaagcctgtgggaaggatttcatttgctttgtggaaatagggctggcatgggggtgggtgtcaaacacagaaactgtgttcaggccccacctagtttttcctaaggcccagtaagctcaaactctgggctctactagacatagacagttttgaaccacctttctctcctaaaatgctgacttcctttctccaaagggggtctaaccatgttagactcctggcaaaaatgttgtcaaatcaggcagaaatcttccaagcccagaatacttgggatgcggtctttagggagtgatggaatggaggagaggctcagagtggggttgtttttgttgttt

SEQ ID NO: 18124 - DNA, 2202 bp, Mus musculus
cgttctggtccttcctccactctttgcttccctctgttgttggaatccagccagctccagtacatactgttcttaggttagccagtgacaggttgtccatgatcgggttgctgcgatatctgccaaggcaagacatagggacataagcctacgtctgtcccttcagaccatagaggacaccttgaccagatgtttggctgcagctctcagtgacatcttgtttttcagtactgatttaaaaaatcatatatagcccagttttcattttatataaatatatatatatatatttgtgtgtatgtgcatgcacatgcacacccatatacaacacaggtttttctagcctctcctggtcatagaccactctttgttgtggtggcagttcacacagaagccacctggagtctctgttctcatcacaaactttgttctgtttggaacagagaaacctggcctttgagatctctgtcataaacatttagcagaatgggacagtcctgtgacctgccgtgcgggtgggattctgtcttcttcctcttgctgtgagggagccaccggttgtttgcatttgctctgctccatgctgtagaagtgcatcctagtcttatctcggagctttggaagtttttctgaacatagagacttttcttccgttcctgtctttgtctctgacacaccattttccatgtaagatgttttccaatataagacagttctatagctagctccttttagagtaaaaagtcttaaagttttattgtgtttatggcagatttaaaaagggtaggaaatgagtccttctttctcccactatttttggcatctgatacttttaaaatttgccattccattaaaaaaaattaagttgctctctgctaatccaaaaattgggcccagattaaaactatttcaagttcacctcttggcttagttttgttataaagctctcgggatgaacaggggcttgaaaatccctcgataaattctagaagtgctgcctcttgaaactgttttttgtttatccaaacaagggtgactaagggaactttgacctccaccaactcaaaactgttttcccaaaaccagaatcttaaaaaagggaaaaactgaatgtgtcacattgggtcctgcctttgacctttttctaccgttagatgctctcccaacctacaagcctggtgcttgaaacactggctcttttacatcgtgcttccccaggagcaccagagctaggaaatcacaccatgggatcatgtgtttcaacagctccctgccgctcaggctcattctctgtttcctggcttgaatgctatgcttttattttaactgtattgttttctatagttcaagagagatgggtttgtcatttgggttggaatctctgagtgttcttagctttgggctagaaatgatccttttggaccaacttgtgaagctggcagttgaatctgtagaaagtggtggatgcctctctctgagtgaagggaatggggagcttgaaggagtcactaacgagaagagtaacttgcagcaccaggaagactgccccctgagctagagcagagagagcttgagtggtgtgagtctgactgcatggggcaccccttggtcctttggatgtctgatccttgctgtgctttttactgacctgggcttgtactgctcctgagccaataggggcttccagacccaaggatccgtttccttgatgactaagaagccccacccttccctttttacattcctcctaacctaagtgagcagagtttccaccctgccctacatcctctctccaggcactaccctctaagaaggtaaaagcaaaggttcttgaagaccatgctttgggcctgtactttccttcttgccttctctcttaatcctgtacattatttgtgttttttcatccctttggtccgatgtccatctgctgatttgcataatgaactggacagtgtacaagtggttccctactaaccccagctctgggagcctagctgtcttccttatctctggtgcttctgacgcctgtgagacggtcctgttagaaggagtaggaaccagaaggaggagagtcctccgcagcagagctcacttcaactggaattgaggttgcacactgtgatttcacaaccaaaagccaaaaggagccggccaccccaggccttaggcaaccagccttcctcaaataggcttgcctga

SEQ ID NO: 18125 - DNA, 1186 bp, Mus musculus
tcttcagacacaccagaagaggtcattggatccctattacagactgggaatactcaggacctctggaagagcagtcagtgctcttaaccactgagccatctctgcagtccaaactcagattttaatgtcaagtttattgacaggaatctgtagtcacttttctcattccattttccaaatcaagtgaaatgccctattgacttgagaaatagggcagactttagaccttgtattttggcttccaataccagggtctggggtagagtttagaggcacctcttcaaggccaacaacagggtggagaatagtgtgtgaagacaggattgttgtagcatgcacatctgaacccttccatcagagttaggatccacttgaaagcagggacacacaggggatggcagcaaagggagcccttgatgttctggccttcatctctcccagaacagccttctctttaaaccaaaatcataacagtaacagtgacaggtcatcaagatggctcatcaggtagggttgccacttagcctggcaacctgagtccaaacccaggagcccacattgtagaaggaagagatgactcctgcaagttaccttccaacatccacagagacataaaggcatgtgtgcatacgaacatacacactgcttcacatgtatatgtcaaaaaataagtatatgtttttaattttttaattaaaaaaactaaacattaacttgcattttctttttagcgacaagccaagtacacagaaaataagctgaaggccattaaagcccggaatgagtatttattggctttggaggcaaccaatgcatctgtcttcaagtactatatccatgacctgtctgatattattgatgtaagtacctaaagctggggtggaaggctgagaccacctcttgcctagtttcagaaacatggtcacgtgttcctcatttctgcattcaggcattttggccattttgagaataatgtgaagatagcagccatgatccattgtaaaggtggtgtaccttatacaccttatatcattcgctcctcacagcactccatgagaacaaagcaataccgtctattgctgttgactaataaatcagagtttagtgatttacccagagttagtaaaaggctgaaaaaaatttataccaaattctgattcctaaacccatgttcatgacttttgtg

SEQ ID NO: 18126 - DNA, 1208 bp, Mus musculus
gtcatcttgattctttaatttaacatttaattacccattttgttgcttatctgagtgatattaatttttttacaccttattgaatccataaaaggtaatcccattccccagaggcgaatagtgcctgttcatttgtcctgtcaatggatgcctttctaaatgaccaacaagaagtgtggtggtttgagtttgtcctcccttgctttaaatcatagaacccttgtacttcctttactatatttttctgtactcaccaagcaaagaaagtcagttaaagatttaaaatgttaaactcagaaagatgcggcagtcctagttaggagcagattttaccatgcaatctcagtcttctttttattattacaatgcgtagtgtgttgtatcccccttttctttgtagttctataatcaggagccttctattttcttccagtgttgtgctataattagtagtctagtctgaagtataaaatgaaaggtttttttccctagcagaaatgctgcttattcactttattttacaaagagcctactcagtctctacgagtcattcaataatccaagaaacatcaattagaatgggctgtgtaaaacaagtgctgtgggactggacaactggttaagaaagcttcctgccctttcaggagggctggagtttgcatcctagcattcacatctggtgcttcctaactgcctgtaacttccgctccagggagtcagactttttcttctggcttctgcaggtgccagaagagatacttctcttctgtgtgcatatgcttacacacaactcaactcacatacacgcacaacagaaacactgtttaaatgctgaattctgagtattcaaggacaaattcatgccctaaatgtgcatcatctaattagaggcatacatacaaataacgaggtgaccagaggcatgaagagagttctgacttggtacttgttcattaataatagttttcatattgctctatttgcctgttcacttggcagttctgtaagggctcaagggccaggaaggactatgaatatggatgtggagtaaatgagagagtgagtagatatctcttaacagtgccaggcctgtggcttacaggctctcctgcaagtcggttcacttgagtttgagagaacagtctggtcggtttacatggcaagttgcaggccagccaggactacaaagtgagaccctgtttcaaaaa

SEQ ID NO: 18127 - DNA, 1210 bp, Mus musculus
caggtaggttgtggctcctggcctggcctaatatgatagtggtgagaactgactcagtgtctattcttttcttagaatacctggcccctctatctctctcttccctctttgctttcctttcaaaacttgaaacttacttaattttgctctagatgacatacacttcttttgtgtatgtgcacatgtgttgtggatgcacatgtatgcatgcatgtaacctactttttgatacactttcttgttggtctgggccttacttgctagactaggctacctggcttgtaaacatctagaatccacccatatctgtctccttagcagcaaggttacaagccccgggccactatgccagaccttttttctttgctttgggttcagcctctggtccttatccttgtgcagcaagtgctttaccagctgtactatctaccccgtctcccacttcttttttccaagtgctttcccttttccttacctccaggcaatctttttaaacccctgttgattctgtacatttctgttcatgagttaaaaccaaatcaaacccctgctccagggtacctttgctgtggcagatgaacttgaaaagctccagtgaggggcctgcaaagacggaggcctgaccacaagtcctagaatgtgatgaaagtgacaaagcaggagtactatcaaccttgaaatcacctaaaagtgctcctgatcatgaaatctgagttgacgccctcatctcccttaaatgaaattccttagacttcatttttaagaaaacaaagcaggggctggagagctagcttagtggataaaagtgcttactgttcttccaagggacccaagtttggttcccacgttctgttcggacccaagtctagcactcagacaactcacaggtgcctgtaactccagctcaggcgattcaacacctctggtctctgagagtacatgcactcacatgcccttgctcacacacagacacatatatgtccaatttaaaatacaactaatctttaaaaaataagcagataaaaccttctatatttcttttttttggtctttagtaatgcagagaaagtgggatttagagttaagaaggccaacattataggccattcagtagctttgctatactgaaacttttccaggttttctgtgcttctgtctcttttgaacatatgactaatatatgatggaatagccaccaatccatagtgtc

SEQ ID NO: 18128 - DNA, 1193 bp, Mus musculus
ttgggtgtggcaccctctttccaaataaataaatgtaattttaaaaacagagtacatttctttttcattgctaaatactgtcccatggtgtggccgtttgactgtttaaccatttactcattgaaggagccctgggttgtttcctattttgagctgttatgagtaaagttactatgaacactcaggtacagattcttatataatgagatttaaaaaaaataatattgtggattattaataggaaattcaaagtttttgctcatctatagaagaacataatataggatattattattcctacatctcagagttttgtatataaactgagatagtatgaaacaataaatgtcataatatgtaatgaaatataaacatatgagccaagatgctaactcactgtgctctatcctttaatcttagacatcagagtagtacttttaaagattactcacatacatttatttatttatttatttatttatttatttaatttgtttgtttagtgatgtgtgtgtgtgtgtgtgtgtgttcatgcaattgcatgcatatgtactggtgtgtgtgtgtgtggaaatcagaggacaacttgcaggaggtgtttctctgtcttcagcatgtgggacctgcagactgaatttaggttatcaagctttgtagaaggtgcctgtacaggctgaatcatctaagaggcccattgtggttaaattatgattcagagagcttttaggctgccttcttttcttattactgatgtataggtagtctttatatactctggctgttgatgattattggttgaaataccttctgtcagagtttatcttctttttattgaattcattaatgtgtgagtaatgtaaattttttatacaactaaattgtctaacctctttatagcatgaatttgttcaaaacatatatacatgcatatttttcctattctgaaattataatatacttgtattttcttttaagagttttaaagagtattacttgtcatatatctttgttgaatacaccaggaattaatttttgtaaatgctgtgagctagggatctaactttattttatattcaatatgaatgtttgtcttaccttcataatcctttctctccactgatctgtaatagtcacctatgtgcttacttcagatttatacagatttgtggacaagaccaattctccattatgct

SEQ ID NO: 18129 - DNA, 1183 bp, Mus musculus
tcttcgggcggagcgggcgttgttaggccaagatgaatgggccaaagctggacttggagtgtcatccccgaccccacccctgttgcgattaggatcttccctccgactgatcgccccctccccccttttcttgcatttacaggctagtgaaccggagcaaagacttccgacccactctgcgctgcagcggcacccttttgggatttgatttgcagaatctttgagctggtaacacacacacacacacacacacacacacacacacacacaatcccgcgaagaacgcctagccctcctctggcaccccaagacaaacccactccctcctagggacacagctgggcgcgtccacacccccgcatcccctacaccatgttgtgcggaaggacttccactcccagcctgtgtcgttgatgtcagaccccaggccagcctccgggcgctgcagttctcctggttaatgctgcggttgtggttagggctttagtacttaagccagccgccgccgccccccacttccccacccccggcctcagcgcccacagtctgcatgtgtgtgcagtagccggctgcccatcccgccgctcgtgttctcctggagctctggataccaccgcggggcatttctctgcctgtgggagaagtggccttggaggcattgatatcagtggttggatttttcccgtggatctatcaattcacaattcggatttggaagaaagaaggaaaacatgacgtctccagccaaattcaaaaaggataaggagatcatcgcagagtacgatactcaggtcaaaggtaaggattttgaaaattagcataaagcatatgttctgcggactggtgaagcatgcgtttccaccccaattttcagggcgtttgtttcttgggtggagcaggtggtaagttgaccccagaggtggtttcataggtggatcagcagtgtcaggggccataggcactagaagagggctttaggaatatctttgtggggctgaccattaatttggcagttttttcccaaaggctgggcagggtgggggaggggcaggaggttctccggggagagagagagaaaaaaagctgctatttgcctttgggtgtcttgagtcaagcttccttgaaggacagctgaaatctgacaggtgtttggacatttatttcaaaggttgtagagaagccc

SEQ ID NO: 18130 - DNA, 2948 bp, Mus musculus
aggaattgcagtaactgaagaatgatctgacccagaattgagacaagggcagccttcctgtaagggcaggatttagtttagaaagcccctggcttgctgtgagctgtcctggcaaaaaggttgtgaccggccaagccttgtgatccactgaacacatccaattttgtggcctctggctccccctgcagaaagcgggtggctacaagcagaacccctgtctccccaggtgctgattctcctgtacatcgcagactggatggtgcactggatgtggggccggggcctggaccccgacaacttctccatcccatacttgactgctttgggggacctgcttggcaccggactcctggcactcagcttccatgtgctctggctcattggggacagagacacagatgttggggactagcttagccattcagtctttcccccacccctctgcactttctatttggatttttattttccttttgtttccctaccccaccctacactacactcccatgcctttctgggatttcactttgataccaaattctcattattttcaatgggaattttttatacattgagccaagtttggataggaagaattcgggacagacagatgggctgacataagcagtaaaagtagacttttgagacaatcaccaagtgcaattccacggtgggtgcctccagaggaggttagatcgggaccttggcatcctgtccagcatcggggacctttgcattagctttagcgacctcagcctcggccctaatgagaaactctcaagtgggctctgggttgtttagggtttggctgaacagagggaggagggataattaacactcccacacatgcacgcacttttatagatgtggaccaacttcacagcactgggcaggggaacgttgcttcaactcctcgtaatcacaggcctgctccaggccagcctgcccgcagagtcacgtgcactggagattccatctgcgcacatgtgccttgcccaactgcctgattgcttcccagctgaaatgagtggtagtgacccgggctcttcacggatccatgtcatccacaggtttccaaaggtccatgtgccccctgagtctagagaaccgagttcaagcctcctctctttaattctctccacacactccgtctccgcgcagcttgccagatgggcttctaagattggggataggacaagggaatgtgccaaatgacctggagattgaggcaacggggaggggtggggggtgtctcactgccgtctctcatgacataatcacgtggtcagtcttggcctctgtcacttcctaaacacactcattctatcacacgagggctccgttggcctttctctcggcttctgcccacagacatgcatcaaccattcactcattcagcaaatctcagcctccccgagatgagcccttccacagcaccggcctgcaataattcttcactgagcagtcgttacggggcgcatactgtgctaagttcagtgcctggcatcaacccaccagtgctaagggaatcgctgctctaacctcacctcatcccctaggctacagaggccattgtgcctcttcaacctgacagtaaatgttccctcgttcgcccctaactctgcagtgactgccaaccccgttgctcaagcagcagcatgtcctccaataccctcctcccgcagcctctctcctctccacatcttgctacccactcagaagagggcttggaattagcaagctggatatcaataggctgcttcagtatctgcctcgtccatgattcaaagaaaaccaaagtcccttccctacacatgccccaaactgttcaacaaatggggtgcaggctgtacttctggcctgtctgtctggaatccataaattcttccccctgtgtagcctaaagggtcagcctccaagaaaaggattaagcagtgctccgtgtctaccaacactgtgcttagacctagagactcttctcggcctcatttcctctgtcatcacctgaaatcagaactgtcgaattggacagattcatagagattgtctagttggggttgtgtcaggcagatcagtgtggatctgagtttatttctgctcttccctctggcctaactccatctcaaaacacaagactcttgcacaggcatcataccctaagactgtgaccccagggtccccagccacttgctctatcctgacatctggagttggatcaggctgtctggagactgaagcatccttcttcctttgcctagaaaacagaaaggtaggggcgcccaggctcagcgcatgtgagtggaggggcctggagtgacaggagagtgacttcaggagattcatttcttcccaccgggttgcacctattgcatgtacttttggcctgactggaagaaacaaaattggtttactttcatatccttcaaaagttacagaactgtgtcttaagagaattatttatagttactataactgaattgacaaatgtcgacttaactgataaattatatttggtaaaataaaatggaagtttatttcaatggcttgtatccctgtgtgtctcatcaaaaagcagactcagctatttccttggaccctgttctgtggtcccgcccccacctcagaaatgggaaggggtcgatgtgccaaaagtgaggaaccatcttagaatataatagaaaacacatcagacacaagcaatgatgctatggggcggatgttaagggtacaaagtccttgtgttaaaggatattagacggtgctctcccctccctggcccccatgcattaccttggtgcaggtgataccagcatctatgggttagaattccttccttgcagaggtttatagctgagttgagtcagtgtagaaatgcttttaccttgagtatttaccatgtaactggctgcaaaagaattgtacaattttatatgaccttccatgaatca

SEQ ID NO: 18131 - DNA, 6028 bp, Mus musculus
gcttttgccaggtattttcctggttcaagctaatttattaaatcagaagtctagatttgcttagagtttcattctggcaaatataattaatatgtttcttgttaaaaagttttactcatctcgccatattttagagcttccaaacctgtttgatagttgtagtttctgctcagaatgtgacctaatcctcactaggagtaatgcgccttttcgtgtgtttccttcttagtgagatgggataaatttttatacttacagacttttggttttgtaaatgatttttttaaaaggcatttttttctgttccccaaattgttactttccatatttcagtgacgccaagtccagtgaaaggcaaagcgaaagtgggtcgccccacagcttcgaagaaatcaaaggaaaaaactccttctcccaaagaagaggatgaggaagcagaaagccctccagaaaagaagtccggagacgaagggtccgaggatgaagcctcatctggggaagattaaaagtgatgtttagggagaggttttattaaaaacaaaggaaacctctgtaggacacggtttgggctgtggcttgactcatgggctttcagtgctatttcatttgtctagaataatgtttttctctctatcatatatctctttccctcttaaaaccattgggttttttgtttgtttgggttttttttttgtttgtttgtttggtttttgttgttgttgggtttttttggttttttttttttttcaagatagggtttctctgtgtagccctggctgtcctggaactcactttgtagaccaggctggcctcgaactcagaaatctgcctgcctctgcctcccgagctctgggattaaaggggtgcaccaccaccgcctggctcttaaaaccattgtatgcttacgtgtttaagttgccattttgtctcagtcttttctttgccaatcccctccccccacgaaagccatgtcaatcaatcactggagtgactgtttgattttcgagttgtcaatggagggaaggaatgccatggctgcaaagcaataagatttcaggtggacgctatggaaactgcttcttgctagagaacagcaacttgaacaataatcaaaaacaaaaaactagaaaggttttaattaaatatttgttctttcttttcctgtacttttgacagaccagttgtcacttaacatgagtttatatgtctgaactgtaagtgtcaaaaagaatcatgactctaaattagtactagtgaggcagttggggtgaacatgaattctggattaactcagcactcacattatttccttgggtgtggagggaatggtgttcctggaacttagtggatttgttattctcaaagagattcagagccagtgcttcttttgtcttgataacggtcttttttctttttttttttttaagtaggccaccagaatcagtcttaatttcatattttattcatgttttcattgattcaagtttttaaaatacttcctgtttttgggtagtttcaccaatgatccaaaattaaaaagagatttctttgaatttcgatgatgaatttacccctcacagtgcatttcttcacaggctgacaatgttaaaagttttaagcaaataaagtttgagttagtgtgaagctcagatataaaagattgagatttatcctttatgaatacaaataattgaaatgagggcccatgaaccatgccacagttgtttcctttcgatatttaaatctttcctccatagtaacatgataatgacataatctcacaacctcctcctgctgcttccatactgtggagttgtttgcttcttagttggtctgacccctcctttctgtttatgcttctttttaaagcaagagcctgagcctcaatgggatgaatgaactgtattttatttagggtgcctctgtgccattgataacagtctagataccttagcaaagcatcaagatcaggtttgatcctccacattcaggtcccactcgccaatagaagaaaagattaggggtcctattatgctattaaaaatttagtggagtaatttctgtatatttttctgcacttaagctaaatttgcttcctcagtattctgcctttgtgttttttaagtgacatgtttgtctcagacagtgtcattttcttataggtgttcataggacaaagggttatttaagaaatatttttactctggtttttaagacactttaaagaacattcttagatctgctttaaaataaataaatgaataaataaagcacctagtagcagagagttatttcaaccctgcactgctaataaatgagtattaacatggccaaaaatagaaacttgaacataagcagttggattattgtattctgtaatgggatataaggttgtgagctatgtagttggtattacagattattctatttgctgtggtgggcttgctcaggaacccgtccttaaagaaagaagagactcaccatttccaccaggcatctctcccttttaggggtttataactcagtcttacattcctagtgacatttaggcttttcttaggttatgtttcatgaaaagttgtgggtagggtctctttcaactttaggcctcaattttttaacaatctctttaataatctgcactaacatctctgattttatctacctataattgagaaataatactatcttctacgttacttgtgtaaaaggtgtgtctgattggacttgtttagaattccttttaaaactaactcattagattgaaggtatattttctaattacagttcagttgggttaatggtgtctcaaatgagcacacaggctttaagtgacctttgttttcacttttttttttagtggtttataacactctggtcttcccttcaaatcgtgtatgcaaacaggaacacatttaatgtgactcaactggaaaccggtgctcagcagttaggtgtaacaatgatatgagggtgtgcccctcagttcataatgactggcccttggcacctctatggcttactctccttcctcttttcctctgtctttttctttctggtgtgcctatagtgaagtggcaatgtattcaactgtcttactttgcagtgctcaggaatgggatgctcatttgaaggtgcttgtctgttactgatgctcagctaggtttacctctttagtagatgcagcagttgagctaacactacattctagttctctaggctctggttaaagcctttgtctccccctgtcagaaatggtagcctctgtgttgcccagtggtaagttactgctgcttttaaccgtccaccactgatggggttttggagagaggacccaaagggtgtatttacatatctgctgaaaaacttaactgctttcagtacctccctctccatattaaccttacaaaggaaaactaatggtagcatgaatatttctttttttctagggtagccagagaatctccacagacaccttaccaaaaccccagtattttgtgtaccccaggctggcctcaaactcctgttttgttttgtttttttcaaaacaactgattttttttttcctgtcttcaatgcttatatatggtactagttcagatagcattttcttccacataaaaatcagtggaatttgaggttataatctagaaggacttacagtcagctgatcttgaccttttttgagcctggtttcactttgtagtgtgtctgggagtttttttccccccacccctcactcacactgctgggattaatgccaccatgtcaggtgacactttttaaatgagcttttatttttatgtccaggaacatgtgggttagagagggaaatagtgtaaacaaaactcaggtttaggggcccctgccagagcagacttgaagaaacagaaagctttgttgctgctgtgaatccgtgcctctttggacagttctctctaccagtagcaccagaagctacactagaaacattcccacctgtgactgggtaggaagaaatgcaggctaggcacttcatggtgtgcggacggaggtcagaaactagcagtacttgcttcttgccaaaggggaggggaagttaaagccactggttgctcttgagggtagaatattgtcattttctctatggaggaagctgctgagttacttgaagatggggaaggtttttttgttttgttttgtttttttagtttttccttttgttttttgagtattgcgatgtcaagctatcaatagccatgttactatttgaacctccttttttttccccctttgtcttagaaaagagaatacatgattctgaatatcaaatccataggttatacttttgttcaaagcctaattcacagtggtgtgattgtactaaccactaggaggatcccatatgcctacctgttgccatgccaatgaagaatgaactggtgacatctgagcatgctctgtggctgtagagcatcacagttgggtggacactttgtatattgggtgtggggggttttctagatcatgggggagggtaaaatgattttgggtggggttttttggtggttttttttttccagttttgggggttttttgttttgtttttgctttttatggagggttggggagtatagtactcagttatgccctaaaaataacatgtataaaaccctgaagtgtgatgtgggtatgtgtgagtgcgtgtttgtaaatgtctggcatttaaacctttgtcttctggaagttagtgaattctttcccttttcctctggaagtatttgttacaagatttgtaaataagagctctacatagtctgtgtaccgtgaacatattacagcaaaccttccatgcttcattcctctgcaaggcataagactgccaggttgctcagctcccgtgatcagtttgccttcattcatcttttagacttaatttgacagttctaaaaactcctagtcttcctcaattttagtctttaatctttcatgttctgagcagaaagggtcagaaagttagcctgtcttcggccatggctgagagcctggcatccttttcttcatacagtagtgtggcttgatacatggctagacaacagagtgttgggcattcttgcaataccttagcagtgctgaaatttgcagcatggtactaaggaagctaaagtttgaatgtaaccactttatttaaagggttttttctttaatttaaatgataccgagttgaagtgaacatgattttgttgaccatgttcatgaattatagatgcaacatgcattggtaggctcatgtgatggtctgatgtgatacttcatttcatccatttacataatcctggtctgtacgcatttgcataaacaacaacaaactcctgccttgctctgattgaaggatttccaggactgctgtctgctcctgaactttgttttaagtatgcgtatcctttgcttgtattttgtattaagaaataaggaaaagaaccccttattgttgagcatgttggtattgtcccctttattttttttctcttggggacattatgaagcaagttattctttttctgtatctttttcttttcttttgtaaaccttttggtttgttttgtttaaaaatggctttataaaagggcttttgtaacccagatgtgtgcttcgtgtgcttcttgggatattgagagcaaatacactgaccattgtgcagcagttaccttagcccatcactctctgactccccctgtgctgaaaaaggaacacagcagaagtcagtgcctagaaacaatcaagggacaataggttgacaacggtttgtttgtttgtttgtttttaatatatatattattatttgtgtgtgggttttggggggtttttttgagacagggcttttctgtgtagtcctggcagtcctagaactcactctgtagaccaggctggcctcaaactcagaaatcagtctgcctccaaagtgctgggattaaagccatgtgccaccaccacccagcttttttttttttttttaatttatttattatatgtaagtacactgtagctg

SEQ ID NO: 18132 - DNA, 1366 bp, Mus musculus
gaggggcaggacagtgaagacttccctatggcccagtggaaggaagggtgtgcagggggttgaggtagtccctgtggaacttgggacctcgaaagcacctcctttgtttgtttgtttgtttgtttgtttttgtttccccctctgttcttctgtctctattctgtctcagtttcctatcttttctagagggctctgcacttttctcaatctgtggatctgagttgactgactccttgtgtattctaagaaaagctagaatagacttcaggctgtttccccaaccatgttaagggggtggggggtgggggtggagagtctgcttggaatccacaccaagtagcacctccttaggttttggatttttttcccccccctgaaagccagttgcctggtttcctatagcccctgattagaggcagtgagggcctgttgtcatatacgggaatccccgcacctgaatacacacctgtctttgtttcctttttatccccaccctcaggtgttcctgcccaaataccgaggggacgctggaggtagcagcggtgaggacagccagacaaccagcttcttgccaggccctaagccaggagctctcttccccaatggacacgtgggctctggcagcagcggcatcctggcccctccacctgcactctgtggggcctctgcctgcgatgtctccatgcgagtggtggtgggtgagccacctgaggccagggttgttacgggacggggcatttgcctggacctggccattctggacagtgcctttctgctgtcccaggtggctccgtccctgttcatgggctccattgtccagctgagccactctgtcactgcctatatggtatcagctgcaggcttgggtctggtcgccatttactttgctacacaggtagtgtttgacaagaacgacttggccaaatactcagtgtagaattgtgtaaggcatcaaagagagggtctgcctcatgggttctcagcccttagagggctgcagagctggcctctccaggtctttgtcgcctaagtggctctctgctgccaccctaaggcagtgaggtgtattgttgcacagataggagccagagctttcggggctctggcttcagagtctggctggcctactggcagcctctcgcatggaagtcattctgaagttctgcagggattgaaatgtggtctgttcaggtgtcctgtatcaaggctccaggttaacagctaacctcctgcttaagtcaccagagggaggatttgggggacctgaacaaacttccctccaagtcccttgaccagattctgccactgttgctcttgcatgggagtttcttgtaggatgctctcctccacagggtttggcagggtg

SEQ ID NO: 18133 - DNA, 1190 bp, Mus musculus
agcgttggctgtccagtgcagagactagaagtatgctggctggggaggggagggccacggtgccttttagaggggtggctggagacctgttactggttcatttatggctatcttaagagctctgttcccaggatgtgcaatagtagtgtgagaagtagtgttcagagtggtgggaacaggtactgtaatgggcttgcttctcatggtgcagtatttagtttgcatgcatatttggaatttccctcagcagcactttgtagtaatttagtgggttaatattgtgtaaactaagtaagtattgatagacgacctaactagatatttgaaattctgaaaacataaaactatttttatcttcttgagttaaaggagaaaagccattggtgtgtttttacagatgaactatttggtaatttactgtcttagcacagagctgccttgggtccgagggtaccatttaaactcaggctgggtgtggtagcacaggcctgtaatcccaccacgtgggaaatggaagctggaggatcaagagtctgaactagcctcagctacatagtaagttcgagactagcttagactacaagagaccctgtctcaaaaaaacaagcaaaaacctcacaactttgtaagaaaccatgaggccttgtggggttggatagaccttccttggaatgaatttgtggaagcacgtgcttggtctgtggacgcgcatgcgtgtggcctttattttttttaagttggtatataaccttgctgtgtgtgtgaggcagacatttctatctatagactacctccttcctagaaaagtctgagctttgtgttggtttgaatagccatagagttcttagcatcaacagatactcagggagagacgctgtcccttcagctcatccctggtgtgcatcaccagtcaccttgctaggacaagcagtgttgggcatcagtagcctgaggcaagggaggagcagcctgtcagagtttgagaccccttctgaggcattgtagttctaattctgctccggaccatctccgcttagctcagtgactgaaggtttagagttgggggtctcagggtggtcctgtgaaggcctgggttggagggtctgccagttcccttgggtgcccattggtcccctgtggtgggtctggaggctgtgcaccgtggctcagagcagtgccacacacccctg

SEQ ID NO: 18134 - DNA, 1563 bp, Mus musculus
tctgctgtctgagggtttctaaaatggatttgagcagctgagtgttcaacacacagtgctgggaaggaatagatgtgataacgctcccagaggctggcttcggtggcaggcattttgttagtctcctggacctgctgttttcagagctaggaccaccccattatttttcttagattatcagacctacttactgaaggtgcagtttccatcttggagggggatgcttacgggtgatgatgcgtctcacgctctgtggaacttgccgctatcagaatcatgttttcacctgtaaacacagcagatgtcatctgtcagtgcgcagcagcaggtgttccatctgaagctaacagtgcttcgagctgctttgcatggctaaaacagaaagtggtgagcagccagctagccagagagaagcgagcagtttcttaggtgctgctgtttgtagttagcccttgagaggtagagatgccgagtggcttgtgggagagtagctgcctgctaatgtgatttgacttgatcccatggtgctggggagaatatgacgaggggcctcacttgtattaaagaagtgactgccgctggattacaccttagcaacactccctcccataactttagacagctttaaccaggaaattcctggagagtacagtctcttgaatgttcagtgtaatgcacatggggaagtttcatgaagttaacttgtctatgaagtacttaagttggaattgagcaccttaggtactcctgaggtactggctgagtacatctctgtgtatatactgccatggtgacccacggtatgtgaatctttttcagagggaggcatattcatccccgaagatggccattagtctatttgttctaaacctaagaaagaaaacctaatcactgctgcacgtgtgggtgtcacttaaagacagtgccttgttcagttcagttttaaatgcatggaatcacaggccttaaagaccagttaccgacttggtaggacccagtgctcagacatacttcagtcagtcaccttatcctcctctcttctgttcacacattaagcattaggacatcttgcctaaagttctttgcaatctgtttgctttcatataaaatgggttggctgggaagttcccgggaggtgtctagggtgtaagagtcctggctcgttggcatgatgtatccttcaaaccatatataagcagcattagcagaaacctcaaggaagggtcaggaagaatggtctcgtctttgccttgttctcatcttagtaaacccactgattctgctccctgcagggattatgagctgtgctcatgcagcctggagtcttctcagtaggatgaggggagatacagagtgcctggcagctggtccagaggtcctgtcaatagaagcatttgctctgccagcatcaggcccagggctgctggagactgctactaaaatcgctctgcactttcttgggatctgtattagcactgtttgtttgtctgtctgtctgtttttgttggttggttttagagacagggtctcactgtgtagccctgagaagctttctatatggaa

SEQ ID NO: 18135 - DNA, 1210 bp, Mus musculus
cagaaatggtgaaagccgtgcccctgggaacagatgggtttccagcgtctttctgctaacgagcaatgctagttggttcagaaagtgcagggagaatgaaatggacagtctgttgttctttactgagatcctcaaggtacagaagaattttttttaaaaaaatagctcatttggtattttataccttttatagatgaaaattttatactgtgtcaaggccctccctccctcccatataaatctaggactactatataattcaagccatgcagtatacagagagcagtgtcagtatgcagaaaccagtgtctgtcaggagtgccctcttctatacagaaggtaggttagtaatccagagaatacaagaaggcggctcaccagcccgggcagggctgggtgcaaggcttctggcatcagcgacatgacatgatttgtctctgggaagtctctaggaggaacaaatgtcctgttacagtcattggtttaatctgtacattctctgtgcatatacatgtgttcatgtgagcatggactcatggtcccaagggctgtagttcacacactagacaccagcagagcagaggtgggccaggttatcagccttctagctgtgactccagaagccccccatcccccacctccagccttgcttgtttttaccagtatgatggcatttctaaaagcaccctacctcacaggaattctgagagaactgagagtgtgtggagcatctgctgcatgccctacatgggacctgccttccaaatgttcatggttttacttctattctttgtaacacctcatacgcagcttagacgtcatctccatttggtacaaactttaagtcaaatttaactttgaaacgccgatggcctaagcaaatccttttaactatatttataaattcattgaaaagtacctcatactagccatattaaaatctagctgggcaatctaactatggtgactgacctgggcaaagagaaagtggttgtatttttcttgtagtttttttttcaagaaaacatcctttttatacagatctagaaagaagaatcactgcttatacctacattggtgatgattgatgtgttaatatagaaaactcaaaagaatctcatactttcctaaaataaaatattttaaacctagtaagtgtgttatccatcttgaagggcagtcgaccctttatactgaagatcaaatggtc

SEQ ID NO: 18136 - DNA, 1597 bp, Mus musculus
atgttctccactgcattgaacctgagacccctagagggtaagtcacacttccaggaagctcacaagccacagagatgcgacctgagctcactggatcagagcacgtgaaggataggtgtcccttcaatcccttccccattcctccattgtctccagggcgagggaagagccggcggcagagcatcttctgaaccatgcccaccctgctgcaccttgagggatgagaggccacacggaacatgaactcaggaagtatatggggcctgtgtggccatcagagggctgaacaatgaatgcctgtggccagcctggagggccactcggcagccctgttggtagcatttgcttccttcccttgcttgccacacagctctgtggtggcctctacccggataccattccccttgtcacccactgtgggatggggcgtgaggtcacttcccgaggggaagtgaggtcacggaggtccttgggaccctttcccaatggaagtgcaggagaatgtgggggccctggccctgccgactcatcggcttgacaaacccccttcttattccttggaccctgacttcatcttcttcccctctgagaacgaggaatatggcacctgacctgggaccctggaattgttcccatgggtgtgctgaccccacccaaaggcagacattcctggaacatcagaaaaaagtagtacctcctcttgtcacctcccccaccatgctattgtcccctccttgccagaagccctgtaccctctggcttgacccaaggctaaaaagcaccagcatgctgcccatgtccagctgcatccggaagtgttctggtactccaagatgtactcctacagcctcagccagcccctgcccgtccccccagtctggaaagggttgccttaaactggcaggtggtagagtgcactctgtccttggaactctgacctagcacctatgtccttcttccctaagccactcctatgagtgttatcattcctgagggctgataagacaaccctgtctcagggtcctgaggctggcacccagataggcaaggtcaccttgacactggtaccatggtaaccttggctctttagggctggtgcagcctcctctccacaccccaccactttcccagccctgtctacctgaccctggcactggcctccacagaaagggtgggaagggagtccgcactgcagcctaagctggagagaggtgagattgcagcaggtttgatcctgagagcctcatcctacatccctagagaaggcacccttcctctgtactcctctcatggtgtagggtctctccaacatttggctgaacttgaagggcaaagaccaaggggaggtcaagccccaatgcctgtcctaacccctgggagcctgggttctccctaaccccctttcccactgactgtgaatgtcgtgactcagagcaaagacagagaatatatttaattcatgttgtacaaaaagcagtgagcagtctcattcagaaaaggagactgataggacaatgccagagacagaggactctgggtgtctgggtttgctgacacatacatacgacccattaaagagagtctggtctctgcacat

SEQ ID NO: 18137 - DNA, 1318 bp, Mus musculus
gatgctctagtcatgtaagccactaagatagaaggccagtctcagtttccctagggaagagcccatcctggaggcagccacagtttcctcccatggagatggtctggataaaagccagtgggaggccctgctgagcctagagagtgcagaaaggggagggtccccagccttggggccagagggcaggcttggcacagccactgggagctcagcctcccctcctcctgcttctccttccacttgagctggtttgagactggtttctggaggctgtggggtgtaactttgggtttgtattttttctgctcatctttctgcctgtcaccgggtgtgctgtttttctgaaaaaaaaacaggccccaagggccctgagcctccagcccaaacccttagacctctgggatcacgttgagttctatttatttatttacttatttatttatttgtacccacccttccctcacttctgcccagctgggctccagagagaggaccctgcccatcctccttttgaagccaggacttattcttggttcatcatactccagaccatgtatcctctggtgtcctggctggaagaaggggcgtgtggccatgcagcccgctctcccaagctgtcccagcaaatgggcaggaggggcatggcctcttttatatatatatatctatttattttatatgtgtgtttgtgaggaagaggatatttgtcatttccttaaggctctggagtgttgtgttcgattctgcacagcccagcctccccgagggcctttccaagcacagtggggatttcttagaacaggagagaggaatccatgaagcaggagaagcagtgcctgccagctgtggtggaccttcctaagaaataaatatcctttatgttttcaaaccatcctgtctgaggtctgctgattacactgtctctgaaaaatcacaggatttctccccacactgaagcattctgggtatcatctgctggccagatgttgtcttccatactgaatgaggaacacacacacacacacacacacacacacacacacacacacacacacactcacctgccttgctctgagcaacttaaatgatatgcctatcaatccatccagccccagctttgttggagcacttcccagaagggaaatggagaagcgcccatagatgctgtgaccagttgtagccacaaggggtcagcagagtccgtgctccaaaacctctctcaagacgaagtcctcacaaggctactggctttagcttggctttgttacacttgttcagctgaggcagggagtaccagctttccaagtatggtgtggag

SEQ ID NO: 18138 - DNA, 1118 bp, Mus musculus
tcttacattgcctttttctgtttccctcctagctggaagctggccattctggccgtctggagaaaactgaagatctgtggctaaaggttcgaaaagatcacgcccctcgtctggcccgcctttcgctagagagccggtctttacaggatgtcttgcttcaccgtgagttcttgcttctttccaagtagattggaagttgagggccctctggcatttttatgcctggcctccaagaaccccagagtttagactccggcctccttgcaaagctgcctcagcacttagtgctggttttgaattcctgtttggttctgctgcttatgtaatgtgaacaacacgatcaaagttaagtcatccaacttggttagaatacactgaatttctttctattgcatgactgcatgattacaacttctggcctctaggcaggactgcatctaagaatctaaagagaatgcttggtaagtctctatcccatctgtctttatatcttataggtaaacctaaattaggacaggaactaggccggggccaatatggtgtggtatacctgtgtgacaactgggggggacacttcccttgtgccctcaaatcagttgttcctccagatgagaagcactggaacgatctggcattggagtttcattacatgaggtaggccttggtttccttaatctctctggggaatacccaaagaagctaaaaggctgggataagtttcctatcacaagctgcagcatcctatccctctacacacagattgcaaagtgttctacctacctagtgatctggtccagacatgctctttccttagtcttttcccatcacaattctcaattgttcatgctgttttctttcttagtcacaaggactgtcagtattgatagtcttgggctttttagccttagtggagaagcagttctcctttccctctctctggacttggactatgtgtggacctgggattctttcttttacatcctggtatctcatgcagagttagagcccaagtgtagttgccaaaacctctttttctcataggtctctgccaaagcatgagcggctggtcgatcttcatggctcagtcattgactacaactatggtggcggctccagcg

SEQ ID NO: 18139 - DNA, 1147 bp, Mus musculus
tggaaggagagaacagactcctacaaattgtcctctgacctacacacacacacacacacacacacacaaagcaaatgaataaaatgtaataatttaggaaaaaataccttccagtgtcacatgataacacccatgaagttgcagtttgggggagagaaagatggcctggatattgtagatagaaagataacaggccatcaggaacaggaaggggcacatttattctctatgatcaatttttgcttgtttgtttttatatcattgttgttctttctactgtattagggtagagccaaggtcttatatgttggtcaggtctcccacacctaaccctttattagagctttaagaattaaagaattgctttggttgctgaagagggaaatcaggtgccagcatgttttcctcattttacagaccttcattactcgatcttccaagactatagtgatcccagtatatgtcggggatataaagaggaaagaaacaacccctgccatcaggttattgacagtatgggggaagaggacaatgacaggagagagtgtgggatagtgaggttggaggcaggactttcttaggactgctttgaggctgggtgtgcagacaaaaggtgactctgacctgctgtttttggcagctggacaaacaaaaccgtgccaagatcaccgacttaggattctgtaaaccagaagctatgatgtcaggcagcattgtggggacaccaatccatatggcccctgaacttttcacaggtaaggctagagggcaaggagtaggtttggcagactccagtagtctgctgtggagtgcttccttcagggtaagtagtgagtgcacgttaagtctgacaatgaagaaaccagaacagagggagagtaaagagggacggaagaaaggaaggaaagtgtggatggagttggggttagtgcatgctctgatctctgggtcattagctctctacctgccatacttagcacttattaatcacaaagtattggctgaatgacttctaaatgatggaacttgtcattaaagaacttatcaacatggaggtatgtggagaggtaagataatctggaagtgctataaggcagcactaaatgataaattgcagagttatgtactgttgatgcagtgtgaaaga

SEQ ID NO: 18140 - DNA, 1156 bp, Mus musculus
cttgtgtagttagaagactgctgaccctgctcttgagtctagctgtaataaagaggcggtagctccagtatggaactatattcctaacattctttggaccacttagcccacactcagactcctaagtggaggttagagttttgttccctcattcagagtctctttttcgtctcctgtcagattacaggttccttcttttaattttaaaaagccagttttcatcattttctgctcagtgggaggagcagagagattaatgccttagggaaaggaggaggagttgtatagttcattcattagagtagccgagcaaggcccacgatagtcctgagagtatccgggcaagccaaaggccacattgggggtatttggtgttggtatttcaatgctcagcgggctgagtatgtgaacacatatgtctaatttgtgtgtgttgtacttcataacattgtaagctattttttgattctgtggtttttggcatctactattatttcagcgataaaatgccacgaaatgtactgtattgtatatcacttgggaagacactaggcggtcagagaagtgtggtggcacttgggtagtacagggcttgacagggccaaagttttgaagatttacctctgggctgagtgaggaagaagggtggcatgaagagtgccatccttcaaaacagttgccacagctccagcccagcactgacacccggctgcttctcgggagctcaaagtctggcctcagaatggagtgacaggcctttctgcagagcaatcagaaaaaatgccggcagagtctgagcccaagagctgtatctgaggcccagatgactggcttcttgactgagcaatctttcagtgttctcaggaagaggactatcctagttgttgccagaccaaagagagtcacttctgactctgtcaagtttaagggacagggctaggcagccatgttaacactaatgctcaagaaaaccaaggaaaggctgcaatgctgttacagccagagcaggagaatgggaaactgaacacctggcagctcccaggatgcttttctgtatttttgcttgagctgtcaaacaggttggagcactcagggtagaatgtgcttagcctgcacatggccttgggttcagtgtctagaaccaaaaaaaaaaaaa

SEQ ID NO: 18141 - DNA, 1217 bp, Mus musculus
gactggcaggaaaggaaggaggaacgaaggcccctatcacgctatcttaccatgccctttgctcaggaggctgggctctagagaatcaggggttcccttgcattgcatgttttccagtattagatccgtttgaataatcatggcttttggatatgattagttttatccatctccagctaagaatcatcagtagtttgtgtatcgctttacctgtgttgacttccagagttagaaacaaagcaaggtgtgtttctccacgaggttcttttttatgggtgtggggcactatgcaaggactgacatgagagacctccacccccaaatcaaagcaacagcagcccacttcaaatcaaagatgaggttcgttccttaaatccttgcctgtggagaacctgtccccggcagccatagtttgtcctttcctggagctacgccccattactgtcttcactcacttcctttctgtgaaaggttgcttagcttttacccttctctttctcaccttggctctctctgcatttgctgttcttttaataaaaatagcaaattgaatggatttgtacaataagtgtttgaaattttctgaaaatccaaagtcaggaagccaagtgtgcgaagggttagtgacgcctctggcaatagctttggcttgccctgggccatactctgtcagcactgaaaggaggtttaaatactatgctaattgtgaaatctcttatcagttggtggaggctccttcagacagccaaacccgttgattacattgtactgtggtagatgtgacagggacacgctggaagtttctagttctgttgctcctgtgctgcttccaagtgtgagtgagaccaatggttgtgattggtaagtggctcacgggatgtttttatttgtagacattacctccatgtcatgtctctgtacagcacactgcagtggtgtgcaagctgatgcaggggtttctgccttccctgtgtgaagtggcttgatttccctccatctggatgctaatgctgtgtcccatttccattaatgagctactgagtaaatcagctcaaaccctgccagattgtctctggcagcagctcctaataattatttatgctttgggaatctttttgtcggcttctagaaccttccgtccactctcagcttaggtttttgatttgtgtaatatatgtatattctttttccttgctgtcgtcctccctgcctctccg

SEQ ID NO: 18142 - DNA, 1211 bp, Mus musculus
gccttccccagcgcatcctagcccgtactctagccaagagctcagcgtggctagctaagctatccttccctcacgccttttcttctcctagttgtccaatagccaataggactcctgcatgccagggggacagcagtatcctcacacctgttaatgagttcaagtgtggtgttcgctctcgctagctgagactataccttgccagggagtctggagtgtgcctcttgaacctgtatatgtggtcccaggctttgggaaatcagggcattaaagaaaacaagagaggaggaggagggaaaaagaaggagggagaaggaggaggagggaggggggaggaggaagaaaagataaaaaagctctgttcagagccccaggtagcctcagaggcctagggtccttaagtttctttagagggaacgcaacctgccttggcaccagatacctccaacttagcccccggtttcagagcccacatagctctgagctcagggcttcactggaccactgatgaccgttcttgtttaaatgcagctcctccaccccagcccactgttcgctcttgtagtagttattgattgactctggtagcaagcagttcttaaataaagatgtgttctgaacccgcctgggcggctggaagcactgcacttctcacctcattaaagcctgcctgcctcctgggcctgttgttcagccagtacacccacccctcccacggccaacctcgaggaagctgtgcacacagcccatacagcttcctccaactagagggaaaagccaggctgggagacctgcaggcagatggaggctgagcgctgctgacatcctgagcaggtttcacctaatggtgctcagcatgctggagtggggtgagttgaggcgtggagccacttccagttcctcggatttcaatacacttgaagtgttgactccctggtccctaaggagtttcccctcctcccccatgaagagattaatgtccccaactggtaaggaggtgactatcacctctgttgttcaatcagggtgacacaaagtggtggaactcctagtcaatttccagccttgacactctccactgggtccatctgactgctattccaggtaagcacacatagggatacatgcaagcagccccagtttggtttttcagtgtcaagtaggtaggacccacgttgtgtctcaggtttgtgtgtgtgtgtgtgtgtgtg

SEQ ID NO: 18143 - DNA, 1189 bp, Mus musculus
tgactttgggggaggcagctagtgttctgaacacagcttcacctttaaaattagctcctaatctaggttaggcaccaggggccactgcttaacttactccatggcctcaagacaggcccttaacttttccttaagcctcagttcacttattcctaaagtggcattgacattcccagctcaccaggtcgtaaaataaaatcagctcacatttgtaaaatttgtgatgcgtagttgtccctgataaatattagagaatgttttttagcagacttttaattatctacccaaataaacaggagtaaatcagtcaataatgttgacttctggtggacttggtgaggttttcctctttaaatatttgaaatactttcatttattcagcaaatgtttattgaacatttactactgagtacaagcacccagccagatgcaggttttttggttttttttttttttcctggtgtgttggtgttggactagtttatttgtgcatcgttcaagcatataacacctcgcagaattctggcaccctggaagtggtcctgatgtggcttcctgggagtggctgactcctagccgaagacctgccttgggaaggctctaagcaatgcagggagagaatgctgtccaactcggagaaggtgagcattttcagggctgacttgatgagaagggcttagggttaaggagctgagcggtgatcattctgctaccttgaagaacttttgaagcagcaaatggccaccaaggaccaccccagccaccagctaaaagaggagcagggagtacctgctctctccttgtcagatgagcatgtcacagctcctttgactgtggcaagaacagaatagaggagaacaaggggagctaggacacttggcttcctctgtgccagcagatgggcttctgcctgtaacaagtgtctgttctttcatgagcccgcctacagccacctctgagaaggcaccatggagatgctggtgtaatggcagggatgctgggccccagggactggctcaccagttgggttcacactgtagctcatatccaggtgacaatgtttagggattcctgctgacccaggaactatgggattactatccgaacacaccatactgtcacttctaacctgggctggaagccagaccttagccacttcctgagacctacttttatttatgagaaagtt

SEQ ID NO: 18144 - DNA, 4174 bp, Mus musculus
ggtctaccttttccaccgactggggtccaagtattcaaacttaagagcctgtggtttatattctcatgtaaaccaccacattccatgaaaagaattactaattactgtgctgcagaaccagtattaggcgttctggacacctcttctatcaaagaaattacttttcactccaggcttaggcaaattcttaggacaagggtagaaggcagccacattctttgtcaaacataaccagaataagtctttagccagttgttaatagttgttctaccctgcagcctcttgatctaggcttcctctcagtactaactgtcttttaggctccaactggacccattaagctctgtttacagccttgaaccctttcttagtccaaagtcttacacattcctccaaaaaaaccacatggtcaggtctttcacagcaaagatccacttcctggtagtagcttctgtgtcttggctactctaaaattgctatgacaaaacatcccgaccaaggcagaatgtacaagaaagcattgagtttatggtttcagaggtatttagttcatgatagaacagttgagagcttacatcttgatctgtaagtaggaggcagagagagaacccaggggatggcatggacttttgaaacctccaagccttcaccttgtgacagacctccccaacagagccacatctcctaatcctttccaagtagttcctccaactggggaccaaatactccagcatgagcataggggagcattctcattcacaccaccagtttgccgaggaactttcctagccatggcttgtcattcattgctcccagttgataatttcactatttgtagcaaactcagtggccaagtccttgctattatgggtcttctgcttgtattgaaaatactgcagctcctgttggggttgctgtgcagtctctctgagggactgataacagacttgtatatccatatctccatggcagtgagaaacggtagcttagaggtaatcctagaagccatcactcacagtccctgcttgagaataggctatgatatgtctagccctggactttagtcatttcctagacatggacctgctgggtggaattgggtcattatgatgtttaattccaagcactgcattcaaaataggatacatgatatagtatgtcagcttcattctaacgtttctcctaatcttttggggcagagtcttgctgtttcaccatgactggcctgggccttaccctacatctcaggctggcctcagctttgcagtgaccttcctgcttttgcctctcgagtgctggaattctaggcatgtaatgactaaatttcttattttgctttttatttaagtttttgttactctatcttggacaaaaagtgcagagcagaggtgtcggattactaggaaagtctccagggcttcgctgttactgtgttccccacagggacttcctggttgttgacgtgcttctgtttactactgtgtcagatgagcgactcagagctcggcttcagataggtgtgactgccgccctcgcccatttaggatgtagtagatttatgattgagggctggaacgggtagattacattgtaccgccaagcatttgtgactgtgtggatatatattcattatttatgtatatttaggtgtgtgtgatactttgcatggtttgaaagaatctattctgaaagccaggatcatttgtaacctttgtgtgtcagttcaatgtaatgttggggcctttgaaaagttgattgagaaattggggatcattcccagttctccgatgttacttgtttagtcctctttagaaagaaagacacttttggaccagctgtttcgctgttttgttctgtttccatgatattctgtgaacctccatggctttagatactgtgactgttattttcctttttgcccaaattgttgattcagtctaaagaatactattttttgatgcctcttacaattcatgcatgtgcacactatagattgatgctacctttgctaaaaatgtcttaagataaagaactagctctttagaacctgcacttcaaagataaacctggaagctgtcctgtgccaaaagtaaagtgtacaatgtttacagatgggtggaattttgcactgccatagggaacggtgagctcgcatcacggggttccttagatgtatgggtagatagttgcagttgagcttatgagaggaactgtggagccctctaaggctaagctgctaatgagtatccaagacaggtggttggtgaacgtgactccctagacctagctggggtcttctgttgacagctcttcatggtttgcagacactatatgttttctttagaggagctgccagctctcccctcttgtgaaagactgtcttgtagacattttgagatcttttgatgtaatgtgcaatcccaagtaatgccattattggtgaatgtagcattgttaaacttttattgtaaattatctctgatcttaccttgatagccttagggttttttgtttttgtttttttttgttatgttttcagagacagagtctcgctatttggtttacctagaatttgctttatgattaggctgtccccaaactcacagatgtctgcctttctaccaccacgcccatgtaactgatgttaccaaaaatgatctcatatccatggtgttgcttatgtgtctttgcataggcgcctccttcagtcccatctaggagcacagcacagtagaagtccatttcttaagtgggcagagtcagagataagctaagagggcaagtagttgcttcagtggtttttagagcttggcaaacgctttactgaagattagcattgtgttgtgacacttgagggccaatacgagcatttaatttgttacctaaaggtgctttgtgttcttaaacagcaagtatttgatgtgtgtaaacatttcccttcattctccctccctcctcaccgtttttatggtctcctatttctgagttagctgcatttggacattgcttttatgccagaggccatctgtcaccttggatgtttagaagtacagtgtacttatgtagggtcctccttgagcctgtcctgagcagtgttgtggttacagaattgcctacgagctccaacagagaggtggggaagctgggagggcacagctgtctggcttcctttgtggaggtgttggtttgtttgaacactaaggaatttgaggttaatcttccccctcttcctgcccatagttttcacttccctttcagtaagaacgaccccctaaaagaaaacaggaggagatgcagcgctttaggccgccttagccagcagcttgtgtcctactctggaagttgtaacctacagtttttctcacctgtaaagccaacacacacagctacccgtttctacctcagtttgatgtggcgactatggaggaacaactcttaaaagctctgactgccttgaagatggaggaagctagtggtcttggtcgactgtgctctgaggtttatattgagaatcctttattctggaagtgagtgcggttctcctgaccgcctgctcagtagaacctgtgttgcctgctttaagtctctgcccacctgcctgtcctttccttgacactaggctcttgattaggaagagttgtctccagatgctttgagaagcacatgtaaatctagatagcacattctaccctgatggaacttccttgcttgtcttgctgtataggaattcattctgtatacacttgagtgggtggcatgagatgctcgacttgtgtgtcgagaggcagtgtcatgacattcccagtctggtacttgccagtgcagaagcaaatgaggggtaataaactgagaagaagggcagcttactaacgaggccagagggaaatgtttccgtgtgtccttatgtaactttttacagtgccactaagttaatagccctgtacatgggtgtttgcactatgtaatgcttttaatgcggttttattgtgtttttgtgtgattaaacagttttcatttcattgtgttttgtcattattggaaataggtaattttgcttatgtacagctaacccattttctgttatctttggcatgatttggggaagtgattaaaagtcattggcagcttttccctaagttgcatattagagtaattgtattcatttctgcttccc

SEQ ID NO: 18145 - DNA, 1099 bp, Mus musculus
tatctacatttctttctttcttccctcccctcccttcccctcctctccctttcttcttcccttcatctcccctccccactctgttctttcctccttttgaggcaggatcccaccattagagcagactggtctggaactcacagagatctgtgtgcttctgcctcctgctgctgggattacggtgtgtgtgcactagcacacctggctggtctgcgggcagccttctgtaaggcagccagattgtcacatagctttcttgaatgtgaagagtaaagctttaaagtgctctatttcattccctgtggccaccgtgcacaacataacatttcctgcataggaattgctgcttttattttccttctggcagttattttctttgaagctatgaatttgaacacctctttctgaatagagaaggtatttagtagccctgtggtttttaagtggtagtgatgtggggtgcagtctcccgggaagcaggtgcgcttgtctaatgcggtctctgttccttcacagacggtggaggtgggaaaggatgatgatcttgaggactccaggtccttgagcgatgatactgacgtggaacttacctctgaggtaaaagatgctttgctgtggccaagttttagctgaatcttagttcccgtgcattgcagaatgtcatttttttcctgtttctgtctgcttttcctagtttctaagatatgttggattcttttttttcttttcttttttttgtttttgtttttgagacagggtttctctgtgtagccctggctgtcctggaactcactctgtagaccaggctggcctcgaactcagaaatccacctgcctctgcctctgcctcccgagtgctgggattaaaggcctgcgccaccacacctggctggattctttacattacatcttcttcagaagtttttaattggaatttgagagaataaaagaataatttgagctactatttatttctactttggagaaagatgatcattctatctgtccctgctaacacaactctggacagggcgtgggggctggtttggcagggcaacacttgatgtgaagcacgaggagctcccgagtcccagaaccca

SEQ ID NO: 18146 - DNA, 1238 bp, Mus musculus
aaaataaatctttgaaaaaagaagtgtacagatgaatgcagtaacttaagtttgtatatgttggatgctggtggtgcacttagaggtcgggcaggagcatgctgagggtgaatccagtcttggctacatagtgaattccaggctcaacaggactgcatcatgaaactatttttcaaaaagaaacacaagagtatcatgttcaaagaatgggattgccacccatttctgtttctctggaaagcagtcattgatattaaataggaaggatatgtcagaaagcacagaacttttctagctttttactcacggagatgactgtagactgcattctgtttaatagaactattaagttctttttataccatttcttgtattttgtatctcatttactgttaaattgcttgtcagctacccttgcatccatccattgtgtagagacctgctgaatgaagacgtgtctactgaggagaggcaccgtgttctctgaacggcaagttaccagttacagagctcatgtttgtttttctctgttaggatataggtactgccattgtttcagacactacggatgatttgtggtttttaaatgagaccgtgtcagagcaattaggtgttggaataaaagttgaagctgctaattctgagcaaacaagtgaagtagggaaaacaagtaacaagaaggtatgtcccagcattcacactctgtctgtatctgtgttctagagtcatctgcaggtcttgagtatttctctatacccagttttaggatttcaattgttagacaaggctgcttcagaaatgagccaagattcatggagaagttcttgctgtgttagggacatgctgcccctctacttcagtgaactcattgtggagtgtttcttttagaaacttttgcttatcaggcaaacctataaatggccttaacagtttctgttacaggagaaaagaatccttgtatttaaagaactttggtagctttgtaactacttcataacaaaattggaaaaagctaatttttaaaacctatgttaaagttagtatgattttctcctatattaagaagggagttagagattggggataggacctggagcttccttgctcttcccaagagcttgagttcaggttctcatacccatgcctggtggctcactgcttggacactgttcacatgcttaaagccgtatgcatacatagaatttaaaagaaattagagctagttatagtggtatata

SEQ ID NO: 18147 - DNA, 1255 bp, Mus musculus
cctggctagcctggaacctgctatatgctgggataaaaggcaggtgcatacttctatgcctagctctaagtcattatcattagttattacagggttgggaatgtttaaaatttcagaaaatggccattttgaaatccttttagaacagcacattcagatgcttttagagttttgtgtcctgaagtgatcatcatcatcatctttttttttttttttttttttggtttttcaagacagggtttctctgtgtagtcctggaactcactctgtagaccaggctggcctcgaactcagaaattcacctgcctctgcctcccgagtacttggattaaagacgtgcgccacctcgcccagcctgaagtgatcttctgttcatagtgttcttgcttgctaatgaaacctaaatgggaggtttgagccataccattaaggtatttgatttctgtctcctccttactgagaataggagctcctttttactgattttacaaagattgttaaggattctgggaaacatcttggttcttctgtattacttacagtcattttcatttggtttctgtagatgaagacttgatagaacatttatctcaagatgagacatctaggcttgaccttgattttgaggagtgggacgttgctggcctgccttggtggtttctagggaatttgagaaacaactgtattcctaaaagtaatggctcaactgatttacagacaaatcaggtaaaagttgcatctgaggggaactggttttgctttgtgttgttttgttcttttactctggctgtagctaagaattcttactggtttgtttcatctgtgtgtatatgatgctcagatgtagtcctgacttttctaacttccacattgaaccctctgcaaaggctgtgttcactgttggagaatctgaccttgagcatgaaattgatgtttttttttttttaactaacattccttccctatcttttccttctacttaataattttagccaaactacaggagacactgacttcttctctgtcatatatactcagaccaggctggcatggagctcagagatgtacttgtctctgcctccccagtgctgggattaaaggtgtgcactaccactgtctggcacctgtttttcatgtaggtagttgagcattttcacaccacatctacatttcttgattttgatatctttgattcttttaaaaaataatttttagtgcatgagtgtgcatgagcgtctgaatgtatgtatgtgta

SEQ ID NO: 18148 - DNA, 1239 bp, Mus musculus
cttggatgtcagagcttttctgtgaaagatccaaggtaaaaagggcgagggtttatgtatctttgagtgcttatatctgctcactcagtctgtagaggttatttttctttagccagtaagtgttttaaaggctacatatgtcgtatagccagtgagatatatgcacagtacaatggtttgcagtgtgcacagtctgatttgatggtacatacagaatagtaatcatcttcatacatggtcaaatagcatgacagagctatagagagaagtacatgaagtgggggatggctgggacttatcctgtcaaagcttccttgaggaagcagaatgtgagctaagctgtgacagtttttagagggctaatgggtggggggcgtctggttgaacaggagggagtcgtgtcactaggtcacaagctggtgttctgtacaattattttttaaagttttaattcatgtgtgtgagtgttttgcctacatgcatgtgtctgctcaggtatgtgcttggtgcccaaagaggccagaagagggtgtcaggtctcctggaactgaagttgcatatggtcatgagccaccatgtgtgcgctgttgtttccctgtaagaacagtcaatgctattcagttgatccatctttccaccccatcgtcaccttctggtgttgcccctgccctttatatatagtgattgcttttttctgagctagcttcctttcctttcctttccttttcctttccttttcctttcctttcctttccttttcctttccttttcctttcctttcctttcctttcctttcctttcctttcctttcctttcctttcctttcctttccttccttctttctttcctttccttcctttccttcctttctttcctttctttcctttctttccttcttttcttttctctttctttctttagatttattatttattttattaattaaattaagatttatttattttatgcatatgagtacactgtagctgtacagatggttgtagttgttggaaattgaattttaggacctctgcttgctctggtcagccctgctcatctggtcaactccactcgctcagtccctgctctctttggcccaaagatttatttattattataaataaatacactgtagctgtcttcagacactccagaagagggcatcagatctcatgatgggtggttgtgagccaccatgtggttgctgggatttgaactcaggacctctggaagagcagt

SEQ ID NO: 18149 - DNA, 1223 bp, Mus musculus
aactaatatcacacagcagaaagaacccaaactatataggctgctcttctcctggtgagcgtgccaagggcggagctgtcagttcagatgctcaagattgtgagtggccaagcaggagccccacccagcacctcacaaccccagtagccccagtgctatagtgttggagaagggctcaccgagaggagaatttcttaggccagaagactcagctcttcaggagaagtagtggttcctttgaccaagccgaggcatagggttagaaaggtcatattggaatcccagatacactgggacctgaggaaggggaggccttgcctgcttctctgtattatggtttcagtaaggcagtttgccccttccttctttctttccttccttccttccttccttccttccttccttccttccttccttccttccttctctccttcccacggcaaggtctcatactcatgcagacttaaattgaccttgaaatcccagccgtcctcctgcctcagcctcccaagagctgggattacggccataccacgggtcagctcttcctcttgttggatgaccagaccaacttcctctccctggctgtggggtcagctgcttctccctcccactgtagttggatggacatgggatcagcttgctctcaaaataggcccagcagccatgctctgtcacctccggccagacccagcctggcatatcccctggctgctgaaggggccctaattatagctgtggggcccccagggtagaagcagctggggcagagccggattgtgccagtctgcggctgctgagtgccttctttgagtggagactttccccaggagtgaggggcagtgaagagggaggctgccttatctgtgacctctgaccttgggggtggcggccctgcctctgtgccctttgggtgtagcagcagtcgggcctagggccagccaggagggtgtggcagtgtggactttggcccagggacagcttcccggaaaggtaacagggtgggccctggctctcttttccccagcccctcagctctctccacctccccacacccaaatctccttaccctgaactcagagggtgtggctgggtgtggccccgtcagggcggaccgtgaagaacatctggccttgagcgctgcttatgctgcttatgcgtgtcttggcctggcctgtttcctttctcactcttctctgaaaagccccttctcttttttccca

SEQ ID NO: 18150 - DNA, 1237 bp, Mus musculus
attagacacctgatctcaggcgagtcccaattagctacagaccctgtaaagcgaagagagatcccaagaggcctcacagttgaccaaaccctgacaggtgttgcctactgccctctagtggctctacttggaagtagtaccatcgggccatcccctggtctggtattgttgacctcagtctgagaaatgtccctgagattgggtcagaggtgagatgtggatcctgttctccaaacctgcaatcatctgtgatcattaaaaaaaaaaaaaacccaaatgtttagtttctgtagacattctgactcaactggcattggtgtgggagctagtcgccagaagttaccaaccccttctgtaataatgtgtggtgacgttgggaagccactgaatggtagcgtgtgggtcagttccctcggaacagcagttctgtgtgccctggctcactctgccgctcgctctcacgtaggctcacggatgctgacaagaagcagctgtgggagaaacgctattactgccacactgaggtgagctcactccccctggttctcgccagtgcacccagctgggagtgggcttgcctgccggacatctatgctctcctgcaacagtggactcacatgaaccaccaagatgccctgggactcctgcatgccacgtgagttgtagctcttccttgtcccggctccagcactgccattacttgacaggtcagctcagggaaagcagagtcgcagatgtgccagcactcggctttcctactctcccattttcctttgtctcattttcccctaatctcataacaccatccgtatccccaggtgcacgtcacatagagtttaccactagatttccatctgcacacgtcacaaggtgcgcaagtgctggcctatccacctgccacacagagttcaactgttgtacatactttggtagaaactttttgttaaacaaataattttgtctgggcggtggtggatcaagcctttaatcccagcacttaggaggtagaggcaggtggatctctgtgagtttgaagtcagcctggtctacagagcaagtttcaggacagtcagggctacacggagaagtcctatcttgaaataaaacaaggctggagagatggctcagcagtaaagagcaccgactgctctcccaaaggctgtgagttcaaatcccagcaaccacatggtggttcacaaccatccgtaatgagatctgactccctcttctgtggttt

SEQ ID NO: 18151 - DNA, 1189 bp, Mus musculus
tcatagaactctgcctgcctctgcctctatacgggaactaacttttaaatgaagagttagcaaggacaaggcaaatagtttctctgtgaccccatttctggagagagaaaagctccattgaagccacatggaaacaagaaaggtgtttgttttgttgttgtttattttgcttctggtttttaatttttttttttttttttttttatgagagagggtatcatatagcccaggttggcctcaaactcctatgtagataaggatagtcttaagctcctgacctacttgcctttccaactcacaggtgctaagattacagacatgagctgccccatccattttctccttaatttaaaatgacaggccagtgaggtggctcaggacttgcctggtcaacttaagtttgatcactgagacctttaaggtggcgggaggcaaccaactcctacaagttagttttttttttttttttgtccttcatatgcactacacaacatgtgcacacacatacacacagataacataattttaaaatgccaaggataaagcagcctgatgaaggcaggagagtagagcgggaaagcaatggaaccttccagatgtttggaccatagacgagctgctggctttttgcctgcagctcattttcttttgaccctttatgtctgacttaaagaggtctatgtactgtacccacttcccacactcctttatcttctactttctctggaattgtattttttaataaacgacatttgagaaacaaagctatcattattaaagatcggtggatgtgcaagtgttcaggtaaaagcatgggatgtgtgtttcggtgccccggtgcaccacagtggacattcttacagtcttcagcttgtaaccaaagcttctgggcgaaagccctgatttggcaggcctaatgggctgggcttggccactgttctggggcgcccattgaagggatagtggtggcaaaaggcaaggcggggagatttgtccactgtggccatattggaaagagtaggaaggggttcctgtgacacacgccccccccccagtttatcctcaggatactgacatgacctctaggtcaaaacaggaatattcagggggtgaggggcagaagtattcatagtaaagatgtcttcctcaaggtgtgatctcttttttttttttgtaagatttatttatt

SEQ ID NO: 18152 - DNA, 2252 bp, Mus musculus
tgtctgagaagccgccaaggaaaggagatggagacaggaacgcacagggcccggaagcggcctggccctcggctgggctcctggttccggctgcccttccttcggcgatcgcacgcctgctcttcggagttcccgccgccttcctctcgacaaaatcccgggaactccgctctgcccgagcgtcggaccaggtactggaccaaattgctttctcagctccttgccctgctccctagcctattccagaagctgctgctttggagccagcttttcgggggcctgattcctaccagatggctagattttgccgcaagttacagcgccctgagagctttgagaggacgggaggaatctgccgctcccacggtgcagaagtctctgagttcactgcggctggactcttcggaagacttggttgtcagttctcttgattggctagaggagggactccagtggcagtgctcgtcctcagacctggagttaaaactcaaggcccaggaaagagctttagactctgcagcgcccactttcctcctggagcagcagctgtggggagtggagttgctgcccagtagccttcaagctggtctagtctcccaccgagaacttgactcttcatcctctgggcctctgagcgttcagagcttaggtaatttcaaggtagtttcctatctcctgaacccttcctacctggactaccttccccagttagggctgcgctgtcagagcagcgctggaggtggccagtttgtgggtttccgaacactaaccccagagagctgctatctttctgaagatggttgtcaccctcagccgttgcgggcagagatgtcggcaaccgcctggagaaggtgtccgcctctctctacagaaggcctgccggaaatccaccaccttcgtatgaaacggctagaattcctccaggctaacaaagggcaagagttacccacccctgaccaagataatggctatcatagcctggaggaggaacataaccttctccggatggacccacaacattgcacagataacccagcacaggcggtgtcccctgctgcagacaggccggagcccactgagaaaaaaccagaattggtgattcaagaagtttcacagagcccccagggaagcagtctgttttgtgaattacccgtggaaaaagaatgtgaagaggaccacactaatgcaactgacctctcagatagaggagagagccttcctgtttctaccagaccagtttgtagcaacaaactgatagattatattttgggaggcgcccccagtgacttggaagccagctctgattctgaaagtgaggattggggcgaggaacctgaggacgatggctttgatagcgatggctccctgtctgaatcagacgtggaacaggactcggaaggccttcacctttggaactctttccacagtgtagatccttacaacccccaaaactttacagccacgattcagacggctgccagaattgcccccagagacccatcagattcagggacatcctggtctggcagctgtggtgtagggagctgtcaggagggaccccttccggagacccccgaccatagttccggggaggaagatgactgggaaccgagtgcagatgaagcagagaatcttaaattgtggaactctttctgtcattctgaggacccctacaaccttttaaattttaaggctccttttcaaccgtcagggaagaattggaaaggccgtcaggactcaaaggcctcttctgaggctacagtggccttctctggccatcataccttactttcttgtaaggcccagctgttagagagccaagaagataattgtccaggctgtgggctgggtgaggctcttgctggagaaagatacacccatatcaagagaaaaaaggtttgttcccttttacatgactaataacttgctctattttgatatggttactatagcagcatgactttgcctctggaggcacagttgtgcacatttttgaggaaggcatctgagctggtgttcttgaattgagaaatactccagtgtgatccttcttcccaatatagagaaatgttcttctccaaatgaaaggtgccagtattagatgttagcaggggtgtcattttggttggtggaacctgaaagttagaaatggttttgcatgtgttttatttgaaagtatataatgttttattttcatggctacagtgtccttattcctatccattggaatccagaggaataacactagcaag

SEQ ID NO: 18153 - DNA, 3600 bp, Mus musculus
acttcttctgtagtgggcacagcgatccatcccgtctagtgttgatgtggtgttaattctaagatcccagaattactaacattggtttttgtctttctaggtaaccttcctggaagaagttactgagtattatataagtggtgatgaggatcgcaaaggaccatgggaagaatttgcaagggatggatgcaggttccagaaacgaattcaagaaacagaagttgccattggctactgcttggcctttgagcacagagaaaaaatgtttaatagactgaggatcgagtcaaaggacttactgttgtacagcaatgttaagaagtgaacagcctgcaacccgtgcccactctgtctcttacttgagagtttcccttaaaaacaaacactggcagctgtccttggacatgtttttaaagaaacaacttgtatctagagatgcagtttgattatttttgggtaatgtgtctcattagaaacaccaactccgataatgaagaatctcttatctgtaatcctctcttttcctatttagttggatgtgggttttgtctttttgagagggtctcactgcataattctgtttggcctaggtctatgtatgtagaccaggttggccttgaagttggtatttccttgcctctgtttcctgtgccaccatgcccagctggaagtgtttttaaatatcctctgcttacctggggtgagagtttaattttgcactttcaaaacgtttcttctggaggcaggggctggtctggtttacatacaggcttcaggccagctagggctatgtggtgagacctagtcttagaggacaaacagaacaaaacagtcaggttactgtggaaactgaggcaggaggataggaaggtccaggtatgcctggaactcagtgaactctgaactcaaggccagcatggggagtttagcaagacctttttacactcagaatggaaaaggaagctggggatatagctcggtagcagaggcccctgcctacatgtgcaaggtcctgggttcagtccccagtactgcaaatagaaagaaaaaacattgtcttggataactataaggtttaagcctcatagtcagttctaactcaaattatgcatgcattgagttcttgtgtgctttttctgttctaaaattaatgggctttatgggttttgtttttgtatgtttttatgtctgttatattttgaggtaggggattgaggcagggtctcactgtggccttgagctcatggcagttttcctgcttcaactgagtgttttggtttgtttgtgtttgtgtttttttactttcatagatttgacttaatgaaggcaaaaacctgttatcaacctaaaagacattgatgtgtcacttcagtggtggattttctccctctttttttttttcccccagagctgaggaccaaacccagggctttgcacttgctaggcaagcgctctaccactgagctaaatccccaaaccaccccccccccttttctttttttaaagacatggtcttatatagtctaggctggccttaaactcattacttagccaaggatggctttgaaagatcctcctgtcctcttgtttggcttgcacatggcatgtgccatacatccagatttttctctgtatctaggtctttttaagatatttccaaggactgcccacaaatccacagtgcagtactttcttgactgggaaagcggggttggtgtgcttttcaaaggcacacaccattatgcccagctggtctgccaaacttaacatatttggtttctgtgcaaactgtccatttggaaggtttctgtgtgttgtagtttcagttgaatgtggctctctgtagctttcaagaatgggtagaaatcataaagcactcttaagtaatcattgcattgtagacatttttttttttaactagggggtatttgggagacatgtcagatattcacttttgttttatgtgtcttaaaaccagtgttacttacaccctgcctcagcactggcacttttcaaacctgtcttggagacactgtaaacttggatggtgcagttctgggttttcatgtgtaaaatgtcaactacaaaggtcaatatccaggtttgttgtgttctaccttatgtagagagaagcaaagcagaaagggcagatagagcagccagaaagtgctagtgtccccccccaaagcgtgcttctagatagtgtgtggatcaggtgtgcttggtttgttcagttagcgtcacctgttgtgcatggttgaggtaatgtgttaccagttctttagtggttacatgcacaaaagagaggacctctgagtcgggtgtgggatgagctttccagacctggcagggtaaactacctcagtttataatctccctggttatttccgtttgatgtgatctaaggtctgcctcagtggtgatgatgttcatccacacacaaggttagtaagagtgcacgaccagaaacgttggtcttatttttgagaacccccatttctgtgtattttatgcacctgcctttagtgaactccagagtgcattaaagagtctggtttagtgccgtgggaatgggctagtttagaagctatgtttggaaagcaggcaagttgactttaggaagaaaagctgtgacagtgtgtagacatttcttttaaaccggactgcagcttaacaacacttgatttcagatgattaggtttttgtttctgagacccagcacctgtatatttaaaaattgttccagattacaccttcactatcaaatgagtaaatgactcatgcctgcagacatgtcctgatggtggcaagaacagaaggatctttgactgaaggagaaaaactgtcattgtcatcccagcccccaggaaagaacacctccaaggcaggcaggcaggcaggcaggcatggtggttctagttgaatacacattcaagtcttgcagtggtgctttagatctgtgtagcatgtgaggctctgtacaggtgggggccacacttctgagggctgaaatgtggcaaccctttatctaacttgaaatcaaaaccgtcaaattttattttttataatttaagaaagagttggggaatgacattttttgagttggccttttcagctcagtcattttacgtgtaacgtggagatttgatagctcagattatatttgtatataattattaactaatctgtaaattgtaataaatatatttgcaattattaaatgctatgtgactttatgtattttatgttggttttagtattatgggacaggattttcagacttagctcagttttgtagaatctgattttgtagaagtgctgtaggcaatttgaacagaaatcttggtcatctaaattgccttcctgtctaattgaggggaagagtggggagaggagagatgcagtcgaaagctacttggatcttagagccggatctttttgaggaggttttaggtagtttttgctaagtataccaatcctgctgcttcagccgctggagagcagatagagcgtactacggagcctggctaccgctctcgacaacccctcctaagactcaagatttcactctaaatctgcagcaagtccttccagccctca

SEQ ID NO: 18154 - DNA, 2805 bp, Mus musculus
ttgcctggtattggatcaggttctcgctggaagtccatgaccaaccaggagaaacagccgtactacgaggagcaggcccgtctgagccggcagcacctggagaaataccctgactataagtacaagccaaggcctaagcgtacctgtgtcgtggagggccggcggctgcgagtgggcgagtacaaggccttgatgaggacacggcgccagggtgctcgccaaagctacaccatcccgtgagcaggccctccctggtggccagaggcggcttgtggctgctgtgagagactggggttgtgtgtgtgtctggtctttgtgtgaggcaggcagagcagccagcaaggatctgggagcagagttgtgtgccatctgcctgtgtgtgacccctgatggataatgactgtgtgcgagactggtgactgggagttgggtataagacctaaactggggcacctgcagcctgacaaacgcagggcaaattgagaacaccacaggtattcatcccgtaggaaggccccttatttgaccatgacaggcactagggtagagttctgtggtcaatgacactaaaacaaaataatattcacgtgccaccgtccaacataccctcgactctgagctttcgagctatagctggcagtgaatttggccatcaggaagcacacgcaagggccagagtatgccggttacccagcctgcagggagggctggaagggctgggagggcacatgggtacatctgtaattgcgaattttctctgcctctcagcccgcaggctggccaggcacaggtgagctcagatatcctgttccctcgggcagcgggcttgcccctggcacgtccactggtggagcactatgacccccagggcctggaccccaacatgcctgtcatcatcaatacctgcagtctccgggaggaaggggagggcacagatgacaggcactcggtggccgatggagagatgtaccggtacagcgaggacgaggactcagagggtgacgagaagagtgatgaggagctggtggtactcacagactgatccccagctcgctgggcccggcccgtcaccgctgggggaaagaccttgttcccatccggacaggcacagccagccttcctgaactatcttggtacttggacttgggtgtggccaggtgatgggtgaaactgcacttgtagatacattcccaagatgggggtcctcctcttcatcacacctctgggcccatcggaggagccaatggcctggctgggtgggagtcatgtggccgtggtggacaaagcttgctgagggttttagcccttggggacaatggccagggaccactggatgtacttcctcctgtctgcccacccactcaaggggatgacagggacacacctgcccccctgaggtcacatgctttgtttccatttcttcttggtccagaccagccattgtgggacaacacacctgccctacaagctcccaggtcacccctctgccacctgggttactttgaactctgcagtctggctgtgctgtcttttgtcttccaagtccatgtgcctctggctactgtgtgtctgtgcgcggcccacacatgttcatcacgccactcttggcagaaggcatttgctgagtgtcactgtgagccaggcacgcccgtgagctctgtgatgtgtgtcttgatgcttctctgggggctgcttctgtgttcctttgtccccacattgctacctctttgtcagtctggtgtctcaggttctgcgtattttctccccatgtacacttctccctcttcctcctccgtctgtccctgtcccaccacacccgctgtatcctctgggtgtttgtagggcccagcctgcccctgggactggcagttcctgacccccatgaccccttccctcccttcagactctgccagtcagttcccacggagccatttttagctcccagggccgtgagagccagcccaggcctccaagggggctctgccctgattcccaacgtgtgtgccgcagtcatgaggatctttttctcagtgacagccctgcagaggggaccccatggcagctggtctccatcccttcttcatgagcttagggtggcttcttccctcccccccccctttcctcctaaattagcttcctggttgtatcccaaggaaatcattagcacctagtcaaagatctggagctgccctggggcagggaaagaccccaaaccccacaaggccaggtgcttccctccccaccgctgttgaccctatttctctccagactgtttctttttatgactgtaaacatagatagtgctttattttgttactaagaagataatgatgaataacttaaccagcatatttgttttctgatgggtgtaataaagaccgaccatttcaggacgtgccctttctctgctgggaggctggcctggccgaattctcgagtctagcgccagccagtcgctgctgccccctggtggcagcatgtgggagcatcaggcaaagtgtctgaaagtaatggctttgaccggacggagacctaggacaggcctgtgacagacacactgctgagggaggcactgcagcagcctggagggacagtggctcagctccccccttcactgaaaggaataagtcttaaaacttcctcatgaatcttaccgtctgggagagggagtcacttggatccattgaaagctgtgggctcattccgcaacagggttcacacacagacactcaggagggctccctgccatacttatctagtgatggtcttcaaaactccatgacccaacacttagaatggggatct

SEQ ID NO: 18155 - DNA, 1134 bp, Mus musculus
ctgtctactggggagggccaggcagcaggcaccctcttgctctctgctcctgtcttctgcaattcagcaagatagcgttgtggagcccagcaggccccccagtaggggtaacgggagagaggtcttttctgtaggttcaatatgttccctagccaatagtactctcccctactgctcatcccatggggtgcaggagacaggagacagagggaagggctctatgttgtatcttagtgtgtagtaggaaacagcagcagtttctcttcccttctctttggtatgtgagaaacaaggcatggattgactgctgtctgcctgaggactgttgaaatgagtgtccaactcaaggtgagtggtgcttggtgcttgggagttttgcagtgtgtagtccgcacgactgtacacttgaccctgttgcaatcggctgcttccgggccctatctaaactaggcgttagactctctggtaggcagatgagaagaggggccttggctagatagtcaagatagtgaacttccagtatggccagcttcttcgcccaaagcctgacagcttgaaacaaaggccttgtatgtaggcttttgtctcccaccagcaggtcccctgctgctggactggctcagctagttgaggctggatcagtttgtgtcacacaacagttttcaaactggctgcacgttgactttcatatcgttccttcccttttcttgagtgcacacacgtgaggacaacttccaagagtcagttctttctgccatgaccctctttgatggatccagggattggactcaggttctcaggcttggcgggaagcagccttcctcctcagccacagcttgcccttacctttgcctagttttagatcagtgttcttcagtgtgacacctcaaattgtgagagtgatttgggctatttggctttttgtttctttttttgttttattttgtttgagacggggtttttctgtgtagtcctggaactcaccctgtagaccaggctggcctcgaactcacagagatctgcctgcctctgcctcctgagtgctgggattaaaggctgcaccaccatgcctggcctgactagctatatggattcttctttcctcggcactgatgtgaaattgtgggagagcag

SEQ ID NO: 18156 - DNA, 1743 bp, Mus musculus
cctcaaactcacagagctcactgcttcctggagtgctgggattaaagctgtgtgcccccattgcccagctcttctttcaattccttaagcctgcacattggcctcactttctgtttgaggtaggatcttcctgtttagcccaggctggccttaactctgagatccttgcttcattttctaaatggcagtgttaacacaattatcacgccatggttattacacttgactccatcaaatattgctacgtgtattgttcactgatcaaactttctctaggaaacccaaatttaatttagtttttctgggatgggagaacacaagatgtgatatgttgactctgtagtgaatcatttattttatcgttgcctctttgttagactgcatgctccctgagtgcatgagtcatgtcctctctgcttccaatgaccaccgtagtgcttcacataaactcagaaagcccagggaacaagaggacccatggtctcattaagagatactttactgaggttaggttatcttttgttagaatagtcagtgctcacgtgcgtttattagtgatggagttcaggtatctctttcccaaaccctactgaccaaagctagataggtggaaggtagattctaagaaatgactctgtttttatttgcttttgaggtgctctacctctataacccaggctgtccgatcttaccttagccttccagtactgggactgcaggtgtgcactgtctcacgcagcaagaactcaggctactgcagatggaattgaaatgtatacttgacaaacactcatttctaaaccctcatgaacttagtattgggagatgctgtattgggccttttcacttgacctagactataggaactatgtttcattaaaacagcgctgtttcgttctgttactgaaagcccagtagacctggtggaagccttcaatatggacgattgaaaatgttcacatagcgttatgagagagagaagtgcctcagtactattcagagccaaactctgaggctgaaagataagtaaatgtctctctctgattagtcacagcttttgtaacactttttttgttgttacaggtcggatcatgctaaaaggagataatattactctgctccaaagtgtttccaactagcagtgaatggtgaagtctgtaggatgttgagaagaccccttgagcgtgtttaaagatgtctgctgcaacctgcatttactcaacttgttttacttgcacattattattaggtgacaataaatgctgtaggaagtttttgttaaaattttacattgtttcattctggtggcaaaatgcttttacctagggtcggtatttaaggtttctgagggcttccagtcccccttgacatttgcttttctcggagcatggatctgtacgttcttgaggcagattaagaattctgcctgcacaggtaagctgctaaggttggtggaaaaggctgggggggagggggtaattgaaaataaacaagttttgttttttactagtgatgtactcatcagttctaagtgcttgtctgtcacacgtgaggccctgttagatccccagtgttacagaacaaaaacccaccgctgacttctgagtactgcgacaccagcacttgtaagtgcaggaggttgcaaacatgcttgtagttctgtttgcttagcaattactgagacactgaagaattgagaatcttatcactaagatgagaatgtggaaagcaggtatggtgtcc

SEQ ID NO: 18157 - DNA, 2781 bp, Mus musculus
gacagagcacaggagaagactctgaactctacatacttgcacacaggcacttgcacacacacacacaccccacaacacacagacactaaaagagtaaagcctaactcagcaattgaccctttctctctcttcctttataggctgttgtcccactcctctctgaggataaacccgtcaccatgtctgagacagaaaacccaaaagacaggtaatgctgtcttaaccaaactccatgccatttcaggtcttgttctctagcaaaaaaaatgctgataagtcactgaacatttacgggttatcccctctaactccaaactgagggccgcacgccctgcggtgtttgcctttactaatgaaaagatactttagataactggctaaattcacaatgtgattccaaattagtgggcctgttcttgtgtgtgttcagaaacacttttcctaaactgccaaggctgtggtcatttaaccgtgaaagaagtccaccgcctgctctaacagtatgcctttcttccccttacagttctgtgctgtcttcagcccaagctgcttcggaacccttgctcccggaaggctctggcccttcctcatcccagacggcaacaaaaccgcgccggctgagctccgcctccacgggaaagcctccactctctgtggaagatgattttgagaaactaatatgggaaatttcagggggcaaattggaagctgagatcgacttggatcctgggaaggatgaagatgaccttctgcttgagctctcagagatgattgacagctgaaacccaaggggataatgaggacacttaaaaaaaaaaaaaaaaaaaaaaccctcaccaaaaactggacttagtttcatctatttacctgaggtgataatttcttttaagtctcaaattttgcccaaatcaaaagtatacctctgaagtacctgtgtgtcctggactccctggggtcggatcttttacatcccttgataaataactgttttgtccacttgctgccattgttgagcatctttgagaagaaagttctgtaatgcccttctctccacctgagactgagctccaaatgaaacggtgcacgagaactcagtggtcctcgaggtgtttgttagtgtgggctagcttccctgctctatttatttatgtattgtcttaattttatcagagtttaaaaatgaagacagctgctaaccattgtggaccaaatgtcatgctaccactaaacaaaagacccactcagtctgtgttaaattgtatgtcttgtatttggaaattcgtctaagctttaaagagggccgggcagctcgagaacctgagatacggacctaactctggacctggtcctgttgtgttagctgttccgtgagcctctgaagagcaatagctaatttattattactgtaattttttaaaggctttaaagtgcctcaggggtcccctgaaactaattttctatttctgggattccctggattctttataagagatggtgacatgactagggaaattctttttttagtatgaaaattgtcccttcaatacctttctcttactggcattgaattatcacagagacagaaaattggtaaatttttttaatttctaactctcccaggaaactccttgcctagtatttatttgatatgctttaaccatgggggggtggacctcaagctgccagtattgatctacagactgtagcagtacactgggctgtactgtcagggatggcaagatgctctggggtgtattggatacctccagtttcttcacttctggattgagttttcttttcttaatgttggtcctcttcacatcacctcaaggtttagacttgtgaaggaacaagtctgatgaggataatagtcttgaaaggagacactgtacagaattggaagaaggaaagaaaagacttgttcattgtgatactttctgtaggtggccagtttgtttctcatagggaaatcctggaccacctgtcatgttggctcctaaggaactgctgttgtaagcggctcatcaagagttgaagttcatgtagccttgttgggaatatggaaaaggaagaaagccacaggactgccagttcagtctgggaagatctggatgattctgcacatgcaaaaatgacttgaagtttctgtatagacgcttgtaccgatccatcttcagctgactgaatgttgtatgatagcccttctccaaagcagaggtggaaggttctggtttcaccacacattttataaacacatctcctgttttgaattggcctataggttgtaggcctcttttgtatataacctctattattttgctttaaaaaaaaaaaaaggtctgttcatatttaatgccctgtattagtcaatgatttgtgttcaacattatttgaaccatttgccattaacgaaagagaaatacttatttgtgttttaaataaaactgatataggaaatccttagttcttatcattataactcaagtgatgctattgttttaaaggagggcagatctaaaagtgatcttaatatccaatgattgagaattttcaagcatgatgatgaaagaaaatatttaggagagtacagggtttttcagtgtgtatgttgacttcttactgttacaaaaacacattaattgttagcagccagagaacagaagtttctacctaatagtagcctaatagtccccagactgaggctgtagcttagcagtggcccacttgcctgctccatgtgaggcctctgtccaacctgagctgtctttcccccagagtcta

SEQ ID NO: 18158 - DNA, 2333 bp, Mus musculus
taccacccttggcagaagtatgcttgcctaagtgccctgtgcacattttatacacacacgttatgagtgaatggagagctcattgttactttcacttaggatcataatggcgcaggtttcctcactggtaagtgatttttcagccattggcattgtagaaatacaaatctctaggtttgtttcgataagagtttttcttacagttacctacaactgaggatgatggaacatttgatgttcctttggattttttacttgtctgtggagagatcatagatcattaagataatgagagcttaaatatctgtcttccctgaaacagagcgaggtcataaagctggggagatccatgtgaagacactggaagaaattcttcttgaaagagccagtcagaaacgtggagaattgcaaaccaaactgaaggcagaagaaccttcaggagccgatgattctccatcagggacaaaaagttcttcttcagtgcggatcaaaaccttctctgaggtcctggctgaaaagaaacaccggcagcaggaaatggaaagacagaaatccaaaaaggatacaagttgcctcacgctaacagacgacactgaaatgaaaaagacagtgagtctgcccactgttgctgttagcaaaggacaaccagaggagcctgcaggaagagccaggtctatgcaggaggtgcatattaagacactagaggaaattaagctggagaaggccctgagggtgcagcaaagctctgagagtagtggcaactcccgacctcaagctgaggctgccccagggacaaagaggctgctccgcatcaccaagagagcaggtttgtatagcccctccaaactgtgtcactgttccagcacagggcagcacctacaggagcctggggaggtctttgagggcttttcattactgggggaactggagtcaccggattcagtagagtaaggtgttgacactatggcggtctgtagttcaacactgtattcctgtaatcttgagattttatggagccagtctcttagctatgaagtttttttccttgtttcttttcattactgtcttagtttcctttctgtggtttgatacaacactgatcaaagccagcccgagttggggagtattatatggtttacacttccacatcacaagtgcattcttgaggaagcaaggcaggaactgaagagagcacctgaggcatggtgcttactggtctgctctccgcggcttgctcagtctgtctttttatatagccaagcaccacctgcccaggggtggcactacccaaggtgggctggacactctacgtcaattaccaatcaagaaaatgccccacaggctagtctgtggtttcttagcttcagttccctcttcctagatgaccagccaatgctaaattgacagaaaagctagccaataaaattgtattcgttaagaaaggttttgttgagccgggcatggtggcaggcagatttctgagtttgaggccagcctggtctacaaagtgagttccaggacagccagggctacacagagaaaccctgtctcgaaaaaccgagagagagagagagagagagagagagaggttttagttcagttcatttttccagagcctgcggctttattaaagcaatggtgttttttttaatatgaatacaggtgtaaaagaagagaaaaaatgtggccttgaagacagtggtgaccctcctcagagcagtgtgactaagatggaggctaatgaggtaagtttgttaccttatgtcctaggcagacctcatcgggtgagtgtgcttttagtttagcttatagcgaatttctgtcagtaattccagtggtacattgattgtggttttaattgctttggttcatgcttttgttgtttggttttgggttttttgtttggctggtttgtttttgagatttttggagacaatttctcactatgtatctcaatctgcctggctcagcgagtctcattccttaatgctagattacaacccaggactgtggttaaaattttctgtgaaatttgtattttttgtttggtttggagtcatttttgttgttgttttttgttttttgagatagggtctttgtggccctggctgtcctggaactcactatgtagacctgactggtttctgactcaacacagatttgcctgactctgcctcctgatttctgggattaaaattgtgtaccaccgtacctgtgggagattctcacagttccctgttagttttctttgttcttacagttactttatctgtgtgtgagctggcatgcctggattctttgcaagagcagcaggtgtcttaaccactgagcca

SEQ ID NO: 18159 - DNA, 2935 bp, Mus musculus
tgccagatttcaagttctgaaacatctggccctttagttaggttaggaactgattcgtttacttctataaaagaaggcacctccagtgcaggttctctggatagctcagccgcaggcagtgttgctgttgggagcaaaagctccttgctccccgctgcggtagcagtagtagatgagtacttcaaagagaagtattcagagctctcaggaggtgatgaccctttggtttactggcagaggaaggtgagcatatggccagctttgacccaagttgccattcagtatctgagttgccccatgtgtagttggcaatctgaatgcatgtttaccacaaatagccactttcatccaaagcagatcatgaacatggactttgataatatagaacagctcatatttctgaaaatgaacttggagaatgttaactatgactattctacattgattctgagctgggaccctgaaaataaggctgttcagagcaatgaaaaagaaatactaccttaatttccttttccttgtcctacttaaaatgggcagctttcgctatattactatatcttattgctgttgttactatatgtagtcgtactatttatccttttaaaaaaatggctgggtgtgttcacagtgcctgtagtcctggctatttgagacactgaggctggattatgactttagcacatgagtttgagaccagcccaggcaacatgttaagatcctgccttacaaaaatgaaaaacctgaggaaatccgaaattacagaaagactgaaaactccacagaggcagtgtaacgatgacaaaatgaaggttaactttgaaaatttcacagttgtaactcagtgtaactaacatctatcaaagtgtcatttgtatcacttgagagagagggcagtgttaatgagaaacacagtgaagcgttgaaggacttaggtatttctggttggtagattgagctagtcattgattagagtaaaaacttcttccactgtggaagattgggtttcagttattatttatataaatacagtgattcaggacttctatgagcacaaaggtgtttagaatgtgttagtgactgcattaacatagtctttccctcccctgttttttaatttctttaaaacccctgacacagcttgacagaatgaaaacccacaaaattgtttcatttttagaaattatagttgcctcaccctggtcagtttataatgtcaggttactgggtatgatagaattatcttttatatttaggattgggtctatataaaagggaacattacaaaacaattagaaaatgactttttggtctttgatttgctttttataatatagtaccaaaaacagggattatataggtgcctttaaaataacccattagtaaaaaacattagatgtttgtaaaatcaaaaaacaagcaagcctcgtgaacgtgcagaccccatgtgagtttcccagagaatatttctagagcttgttcatttttttcaagggtgctcctggtccatagcatgatgttcctaactgcagtttggaactgtatttttaactgagataagcagttgaaactttactgtgttaggcatcattgctgaaatgagtgaactgtctcagtggccctgcaggtgccttcccactcggagagtctgtttctgtgactgagtgggaggccacagagagctgacttttagtaagtctattagatgtttcagattgaataactaatgtaagatcccaatttttccttttttttcattttagatttggggatattccctgcccaaaaaattcctggaaaattgactagtattaagtgtgagtaaaaggtgtccacttttttttaagtcttgattttagttttgtcttggatagtatttggcaagatttagcctagaaagtctgtagtgtttattacataagaagcaaagtgactttgttactgggctggttttgaaactcatttctgtgtattaaaataactttttttttttaaattttaaattcttaaatggtaaatgcaccattcattgtgaagtgaaattttatctcccccaaatttacccttttaccaactggagtgaagtctttagctctaatcatcagttatcaggaagcctttgcagggccagcattgaatgccatgccagtgatgctctgttgatctaaaggaagaagagtaagcatcctgagcatctctgtgcttcccgtgagcatatctgtgcttcccccgcccgcctgcccacccgagctggttcagaatggctgtaatgctgctctgccttcttcagctcgctgccccactctgtagttactctgtaactatacacttgtacctattttggttaaacactccctgacgatgattgttaaacataccatatacattgacaaatatatgtatctatcaatacatccatctatatggatttcatcttgattttgtgactgggtaaaatttagtagcattaacttcatggtactttggtataagagtaagttcactatttttatattgaacccaaatataaaagcttttatattatattttaaaagaatagttacccaaatgttttatttctatacatttgtgtgtgtataagcctgttagtatatattatatggatattatatacataaaacactttatatttttacatacagtatgcttttattatacagataataaagatgggggaaggtttctgttttttttcttaataggtgaagaaatcttgaagaccagaaattggatcttattgaattttggtggtgtttttacttttttcttttttctttttttcatctttttatttttaaattatattgctcagctatggaagatggattttttttaaattctttgaattttaagttcatctttaaatgaacttttgttgttatttttttatttttttgaggagataactaatgct

SEQ ID NO: 18160 - DNA, 1111 bp, Mus musculus
acacggtgtccctagtgcccgtaaacactgccgggactaaatattaaatattatagtcaggctgcagagatggctcagcagttaagagcactggctgctcttctagaagatccaggttcacagtggcccacagccacctgtaaccccagttccaggggacccagtgcccttttctggactccaggggcatcagacatacatgtgttgcacagatacttgtgggcaaaacaaccataaaaacaaaaaaataaagtttttaattaataaaaaaaaatacaaccataaaatggggttccatgttattgttgagaatattcatgttaaaaaaaaattctagttttaaaaaaaaaaaaaaccacattgaattgcctggctttaatctcagcagctgggaggcagaggccagtggatctctgagtgaaaggcagggtctaatctacctggtgagttccagaatggccggggctatagagagaacccctatttcaaaaacaaacaaacaaaaacgaaatgagccgggtagtggtagcaaacgccttcaatcccagcacttgggaggcagaggcaggcagatttctgagttcaaggtcagcctggtctacaaagtgagttccaggacagccagggctacacagagaaaccctgtctcgaaaaaaaaaaaagccaaaaacaaacaaacaaacaaaacgaaatgaaactaaaaatattcatgttaaaagctgggcatggtgtgacctttaatctcagccttcaggagaaagagactggctgaacgctgtgccttcaagactaatctgatctatatagcaagttccaagacagtcagggctaggtagagagacactgtctcaaaaatacagagagagagagagagagagagagagagagagagagagagagagagagagagagagagagagagagagagaataaaggggaaaaagttgatattgccacatacaggggtgtgtggtcctggagttctagcccacaagcccaactctgaggatcccaacaactcaggtccagcagcttgcccaaaagccaaatgcaaaaggtaatggaggagaaagggaattcgaatcagcatcactacgttaggaagacacgg

SEQ ID NO: 18161 - DNA, 1148 bp, Mus musculus
gacatcactgtgacttagtgctggtgggctgacgctgactaactgtaatcacttgatgaagtggtatctgccaagtttttccaccacagacttagtattttctgcttttcatgttctaaacgttatcattaaacgcagccggagagaaggcttcaggggaactatggaaattttgtgaacttgtgttgaaaccaccgcaataatgaagaaatatttagggaagagcctgtgtgattctgtgaccttgctttttggtgtcactcacttgtcttagcatccgtcagaaggcttagtgacagcactgttctgcatgcttaatggcaatttgtctactctcgtcatcctttctgcacacagtatttgggattcacctatagttcagcacatcctttcttcatggtggatttacttattcacccttggaatgaatttatggaaatgtattttgtgaacaattattctgagactactaatcaataactttatttttcattgcccattggcataatgttattgtgtactatataaagtttatccttgtatgactcaaatgatatctatgtccccatatctggttgtgatcagaacgtgcattgtaatgcttattctaagaatctcctatctcaatgttgtttaaacattgctccccagttatctctgattggtcaacagaaagctgatcagccaatgatggggcagaggaaaggatagggttggacttccaatcccagtctgtagaggagagggaagaagagaggaccctccctggaagaaggacccaggagtcaccatgagaacattctggagaatgttccagagagatccagaacaatactaaaatgcaaatatctcggggattttggctggggcaaagccagattaacttagaggattggaatagataaatatctgcccggttattctgccttaaagcttgttgaaaaaaaatctaatagtctctgtctcaattatttgagagctagctgggatagagaaaaactgccactttaacatttgtactaacaatttccccggtcgtttcaggttttagaattgggaactcagccgggcgtggtggcgcacacctttaatcccagcactcgggaggcagaggcaggcggatttctgagttcgaggccagcctggtc

SEQ ID NO: 18162 - DNA, 1313 bp, Mus musculus
ctccccccggagagaccccactagtgaggttctgtgtatgactctgagttgtaacaacctgctgatacagcagagaggagccagagctccaaactggaaaagatcaatgcaacaacaatggctacttgtagctccggctgacagtctcaggactaggccttctcaatagttcttccatgtcctttccagtacttttcccatcccaaaagctgtaggagagaccagctagaaaccctccggacccttggaagttcctcggggttggatttcttttttgccttcaagctttaggggagagttgcaaagatcaatcagagggattacctcactgccaaaaacacaagggaacttgagtgtgcccgaatcctcgcccagaccccgctctttctccccactcccctcgccttacagttgaagctaccagtggcaccattccagtctgcacatccaatcactttctgcatctagggtccaccccatggcacttaggggtgggcacttgcaatgcctgctgttctaaagccattccggcctcctcctcagaatagaccagatactctcggtcccttccgttttagctcagagccagaacttttaccttcccagtctgcagttcggcctgctgcctcctttcttcttggttgggagaggtgaaggaaggtgagattccctgcaacggaatcgacctttggcccgtattttctccctgtatgtatatatgccatatgtaaatatgccatatatgtgccaacaaattgttctacgccatcttttctaatcagcatgcagataggaattttgagtttcttctcagtaactagtataatgagcactggtatttttgtacaaaacaaaaagaaaaaaaaattgacttttgtggtctgcatgacagacatgttatcaaagcaatgtataccctagcgtgtgtggccatagtttgcagttcagctgagcagtgcacccaatctgtatttgcatttgatattatttaagctctatgtataatgttttgcatgtatttatatggttcttgggaggggggatgctagaaactgacaaatctatactgcaaatgtgttatacaactgacacgggaagaaaaggagttttaaagggggtgactttttggaaccaataaagctttttgctgatgaacagaaaccaatgccatgcactgagaataaaaacccatgcccacttgtaatgtgctatcgtctgggtctgcatgtctccactttggggtcgcaccaccagggcttgctggggctgagaatggctttctcttcactacctttggatcaagcacaggaccc

SEQ ID NO: 18163 - DNA, 1274 bp, Mus musculus
gtcccatctgtatgtgacggtgggacttgtcattgttgtgtcagctgctcctaagtatgtgagaacccccacccgaccatgaagaagcaggagcacagacctacctggattcagtcaaaccctgggcaggtaacggtagatccactcctcaggtgtactcgctgtcattttaaagagatggtggcaaacctcttggcatcacccaacccaaaatctccacagcactcccacatgcgccaccacctcctcttgactccaaaattttatccaatgagtttctgccatttacatttacaagctaagctgtgggctcggtgcaagacaaataccctgggtttgtgtttcagtagagtggtttttcttaaaacattttttttttcctattttgaaaatgtgcactctaaggcctccagctctttctgcccttcattctgatgtcccctcaaggttcttatatggctgatatctctctctctctctctctctcggtagttataagaatggaaaggacatggacaagttgagccaactttgaccctttctggccccagtagaacctttcattctgttctagaggcaggcagatttctttgctaaaaatggtctttttggagcaaatgagctggtgaaatatttccctattcttaccaggtcagcacccaccttctgaatgtctgtcttcttgggtatataggggttttgaagtgccacggcaatcagccctaaccatggggcttgtgcatgtggaatctatagtttttaccgtaggcctgagcttccttcttgcccagggaggtagcagaagagtgaatgggtcatgcccctgcctcctagatggttgaggagcctcagaaggaccaggagtcactaaagcagacttctttcaagggtttttgccaaggctctcccagggcaggagcttctgggagagggtaggggggatgagtgttaagaagtcttgggaagggctaaagaaccagtccttcaggatctgagaaacctccctacactttgccccacatcattttctgtctctaaggaggcccctaacttctgcaaacattctaatgttgaaaatgcatagccacaagaggaggctccctgacagcatgctggttcaaggagcaaaaggctctccctgggaagccacctcctcccaccccccaccaccaccccccacccccgttttcatgcaccctcctccagcgtctctactgctgcccagggaagtctgtgcctttctgccccaacactgcccagagcaccctctgccc

SEQ ID NO: 18164 - DNA, 1170 bp, Mus musculus
aactggttcctagctcctattccgcagcagttgcatcactcagaacttgcccctccatctcttctgccatctcttctgcagttacatctcctcctgtgggcagtgagtgagagtatgttacaatgcatgatttactaaagcgaccacaagagagcacgtggcatccactttaaccaaccatggttactagtgcttttcgggtcccccacccacccctttgatcttttgacttaagggaagaaaagaaaaaaaaattctaccctaccccagctaaaaccaggctggataccctggtttcattttattgtttttttttttaatgttggaaagttattaaccttaactattttaaagacgataaccctgttttctgattgttcctctgcattgctcgctgcttctttccttgagttgctttgttttgtttttctttgtttcaccccgtcctgctttgttcctcccctcctcttctaactccgcctcttcagatgtgacattaattccacccccaccacccccccccaccaccccccccccgcaccccacaggactaggaactctgtgtacttaggggtgagggagcctctgcccaggggatgcttagccagggtctgtcctgatggagccagtactgaactgttcactgataacagtctttttggctaccagtgtactgttagctggcaacaaaagttgtaacttagattggaaagaggaagtcagctcaacgagtggtgtcttacctctcagaaatgaccttaaatcaaactctagttccagaaccaattagcgcacatacaacccagctgtcggaggctaaggcaggaggattgtgagtttacgccctcccctccccacttctcattgtttcgtctagtttgattgtccagctagcctttgtatcatactttgcatattccgttttaggaaaccctgtctgtccaggcttaattggcacctgtccggttttaacgtaggacttgctgctccctctggtagattattagacacttgctactgccttcctgtttctggtctatttaccttcccagaacgggaggcagaggggagacagtcagcacggtttccagtgagggaatgtcctctgtcatcacacatgttacatacttgagtgtcccatccatcccttcccacaaccagccctgagtt

SEQ ID NO: 18165 - DNA, 1160 bp, Mus musculus
gatcgtaagaggttattctgggcttcctttttccccctggtgtcctcctactgtgtgccacctggaagtacccctcgctaatcacagagctttggacctgcctgtcgcatcccatgaggctgctcaggatgtccaggctggaaagagtgatgttactgatggagtgtcccaacttggcccaccccaggtgcgaggaattttcaggcctggttagccaagccacagaaggaaggcaaagaggcacaacatgttttggaaggtggctggcagctccggctgtctgcctcgtgggccagggcttaacaaatggccataagctacaaagtgatgtggggcccaggggtggatggctcaggatggtggctctgcttccacagaggctccaaaaagtaagctcctccagcttccaactatttccccaattcagtgttagcctagctcttccaaatgaaagggccccgccaggccttccttcggcctgtctctcctcctcacccagattgtcatggactgttacatacaccgtcccgggtctaaggacaaacttggctttgaagggaatgttgggctcatgagaaacgggtactgggtaaagggcagagtattgttattagaaccataatatcaacagtgtgatccacgcgtgaaagtggctcttcatgaaagtggtagctttctgggcaagcaagcacccttgcaaggaagaatgaagggacacggggggagatatggaggggagtgagcagagggcaggggacagagacctccatggctggctgtgtcaaaggcagggtgagcagagggctctgggtgagtgaggacctcatgccctggtactgtggatgaagatgcttttccagccctccctccatctttcttccattcttctatcactgcctctgccctctgtccctcactcctcaccccctttctcatttctttcccctgctgcccacttcactgtctctggcttcttccttgaactcagaaagaggccgtggcattcctcagctgctgtgctgcagtgggtaaggccacccacagatgtagatgaagtccctctgagctccaggcctctagacccagcagttccctgatcttgggtgcttcagtcccagagaggctctctcttctagagctgagtacaaccccccacactc

SEQ ID NO: 18166 - DNA, 1210 bp, Mus musculus
cctgtgttcatttttgctggggttagaggaaggagaaggaagagttgctatggccagactctttggtggtacttaaactgattttgagcccactcaagtgccagttccacacccttacacacacacacacacacacacacaagcacacatagacaaacaagcacacctacacacacacacatacacacacacacacacacacacacacaccactcacttctacactgactgctgctcacctctagtcatttgccaaattttattctttcataaaaaaattgtttatgtctcctttttacatgtgacccactgagtttaattagtttgtctgtctgtttgtttgtttgtttgtttgttttttggcctgggcgtgggtagaaggttatttactggaacaagggcaacttatcagtggctacactactgaagaaaatgacacctttctccaacaccctttaactgccaataatcccgcagggaaggatggagcctttggggcccctcccccatcttaatcatgcacaggtctacatcacgtccaggaaacatctttgctgctcatcctctggctcttatgttcttttcttctcctcttccttgatgtttcttgagctttgaaagatagtgtactggctagtttagtgtcaacttgacacagctggagttatcacagagaaaggagcttcagttgaggaaatgcctccacgagatccaactgtaaggcattttctcaattagtgatcaagggggaaaggccccttgtgggtgggaccatctctgggctggtagtcttggttctataagagaacaggctgagcaagccaggggaagccagccagtgaggaacatccctccatggcctctgcatcagctcctgttttctgacctgcttgagttccagtcctgacttccttggtgatgaacagcagtatggaagtgtaagctgaataaaccttttcctccccaacttgcttcttggtcatgatgtttgtgcaggaataaaaaccctgactaagacaaattggtaccagcatagtggggtattcctgtgacaacctgaccatgttttgaggaggactgtggaaggactttggaactttggacttgaagatccattcgttgttaagagctctgtcagatgttgtataggagcttggaagataatgttgagaacagtgcagaagatggaggtctggctggtgaaatttca

SEQ ID NO: 18167 - DNA, 1180 bp, Mus musculus
agatcggcagcagctgctcccttggcaatccctgatgctgctggagcaccggtatgggactgggtcttgccagactgatctagacctcagagttagtgacgtgagaaagcaaaggcttcctggaacctgtcctggtgaaggtggaaggtaaaggcaacagtagccagactccacacagaagctgggcacagttctcagcacagctgaccaatgcatgggcccagacagttgggggcgggaccatgatcttcatggacacggtgaccttgcggctgggttgcacaggatccacgtccatgttgtcagaagtcctctgctcctgaattacttttatcattaggcagggagctgtgtgccctgagccctgatatgctccgttctgcttggggacttgggctttctggttcttgatatgcaacatctttagttccaccttctgagtacccagctattatggctcttatctggctcccatctcctcctaaaactgctggccaagcctgaagcccatggcactcctctgttttctcagcctgtctctagaatctaatctcatcaagacccaaggctcaacaggacagctgggaaggagaggcggggttgagatagactacaagtccaaagctgttgttgatcctctgtggacctacggagattcaacacttgccattcagttttcctccttgctccagtcagggactccgacccattttccagtgtaattgtgccctttgtccatgccgtgtgcccagcagcccagacttaggtggaaacagcttgtttgtcttccgcgttcgcaattcctgttggggcccagggtggctgggtgtggttgctgggccctttgtccttccgagccatttgcctgtagtctcccttcctctgctcccagggccgtgctacagcaaagccttggctctgtctgcagagtagtccttcttgctcctcttgtgggctttgtccccagggcatgaactagttttcaggagagaaagcttgtgcggctgcataattgagcaatgtattggctccgtgtgaacacgatttgggggcttgagatacctagggtctcaactggtggctgaagtcacatttattagctcctatctggatgactgaggtggaaccttctgggaaagtttgaggtccacatgggaccattagtttcctgatgacattt

SEQ ID NO: 18168 - DNA, 2017 bp, Mus musculus
cagatgatgctgggcaggagcagcccctcgaagaactatgtgatggccgtctccagctagataggagccacccgaccctggcactctactgttctcatgctgccctgacaacaggccaccgtatacctcaacctggggaactgtatttttaaaatgaagagctatttatacatgttttttttttttttttttaagaaaagaggaaaaaaaccaaaagattttttttaaaaaaaaaagaaaaagaaaaacaattctttaaagggagctgcttggaagtggcctccccaggtgcctttggagagaactgttcttgattgcatctgtgagccagtgtttgcctaggggaatgggttggggattggcctagccaaggtaaaaggggattcttggctgatccccccaggaggtggtggaagggagcaaggttagcaactgtgaatgagaggggtcagggtctgctctgggttaccgtcccagctgggatgcctgtatgcctggtccctctcttactcaggggcattcaagcctgatcttaaataatactacattgcctaatcttctcttttgtttttcggctgagatcaggggcagactgaaaggcctctcctgtcccttctgttctaagcagtctcttgaagccgtgtctcgtttctgagtctacccttgggggcctgaagagcttgcttcccagcccggaatctgtctaaacattttttggagggtgggatgtaaggcaggcgcgcaaagactttggggctaagatggagaggacctgcacaaaacctttgctttgctctgtgctgctttgtatgggtggatagtgaataatttagggatgatttgcaatggaattttgggacccaaagagtatccaatgggggtaggtcttttggacccagtccttccttttgggaaccacacgacagtctgaatgctgctaccactattcctttgagaggtggctcaaagctccagggaactccaagtcctttcttactgccttctcttcaagagcaaccttccccattttttctttcccctttcctgcggttgggtcctggagggccctatttcctaggacaagcgttctcagtcactgtgcaatagtcccaggatgctctgagaccggacctcccagcccctcctgatgccctggtaggttttagggacccattcttcccattcttctaggggttctgactggctggtgggccttgcggagatcttcctgggccacagggagggcacctgtgcactgcaggactacctggtattcttgtagggctgccatgaagagtcaaaccttgggcacagctttagctccttggtgctcagagcacctgtgggggaggttacctctctctctctcttagtaaaatccaaatttatttgtagatgtgtgcaatatttactgttctgggttggagaaaattgggaaacactgggaagaaatggctttccttcaggttcagtgacactgatgagggcttcttagaaggcctcaagtctctcaaactgaaggacagagctagagctagcccgtcaccccttggtgaggattcccttccccgtttctctccaccgccatggcatcctgtgtcctagatttctcagctcctcagtttctgctcaaaggtgctatttaccaaactctctgcctgcccgggcagacaggccccagcttcgcacagccttcccaggtggcttcgtctctcttgctttaaccttaactctgggcccacagacctgagagctgtggcctacaacaaagctgtgaattgttccagatggttcttgtgttttgtccgcacacaggtgcctgccgtttagaagctgcctcctggtctcatgcttaaatcttcaattctttactgtccttgttcactttagaaatgacaaaccctagagctggactgttgagcaggcctgtctctcttattaagtaaaaataagaaatagtggtaagtttgtaagctattctgacagaaaagacaaaggttactaattgtataatagc

SEQ ID NO: 18169 - DNA, 1176 bp, Mus musculus
tactggatcagattgtgaacggttaactctgccctgaagtgggggtgcgggaatggggaggcttcccctttagtgactcatgtcccaggtctaagaaatctaaagtggactgaggcaggctcccttgtgtgtccctataccctccagccctcctttagggttcttttgggggtaaggggctaactgctcaagaaaatcttgatcccctctcttgtctccattattttaattgctttttctggcagcacggtggggacagggcagatttatgagaaatatcaattgcccctctcttctggaccaattccttaaccttgggaaagctcagggcctagtatcagggtgggtgatagaacccgaaatggaagaggacgggaaagtgcctgggctgtgcttgtgaccggcagtacagtgccatcctggaggtgactggagtagctgctttgccatttcatcactgggattctgaacaggcgccaagctaacaggtggagaaatgagccagaactccctgtctgaaaaggatgccgagccttgtgctcagcagagggaagtttggctaatgggctgatcgaatgagctaacatgggctggggcaggcaactacccgtcctcaagcccgctgtttctgtctccctaccagacaggcctctgggaatggagagagaagcagctgagtagaacatgaactagttagagcgagagaacccttggtcctgaatagtggagttatagagaagggccagtcctaagatggaaggagccctacaatctgactccttctagggactctggggctagctttgtgggagagtcagccctgcccctcctctcccatgtgaccctgtcatagtttgcagtgtcctaggtagcacttggggagccaggtgcattcagggtcagtagggaggacaaaatagggggctctacgtgcagtgaggaaaggctgctgtcatggtgtggccctgcctcactgtcaatatctgttttctctggagagtccaccagtgacccaagctctccctgccagcctcctgtgtcaaaccaggtcccttctcagtactgtattggctcagtgctttcaggagtgagtgtgtgagtgagtgtgtgagtgtgtgtgggcgtgagcgggtgtgtacgtaccaataaacatcctggttttaagacaatgtacaa

SEQ ID NO: 18170 - DNA, 1160 bp, Mus musculus
ctcttttggggaagcctgggtggaggctccaggtttcttgactttcatgtctcccctgacatgcggcactggctcctgctaggacagtgaggagggcagctgggcccaggtaagacccctcctcccacatcagaactactactctatgaaggtcaaggcagcatcccccccaccaggctctgaatggcacagctggccgagtccagtgtgtgcatgtccttgtcacacgcggagccctgaacaaagttccttcccctctctacccccaaactccctttttcattctttttctgctttcctaggatgacaggtgaggagtcctggggggctgaggccccagcatgctggagccttcacaattggactctctgttcatgtgtgatgagtcttagattcagacagtcctcttccattccttatccttccaaaggtcactttcgtgagcatctattaggattggccggtctaaagtttctcaatgtgtgaagggatggcatgagaggtttgatggaataaaaggaagggtgatatttacaaacacagtgacagggtgggacagtggctgctgtggtggagagtgtggcagggcagtcatgcttgctctccctgaccacactatcggcctacacagaattcactccatagaccagactgtcctttgaactcagagatccacctgcctcttcccattaagtgttgggattaaaggcatgagccaccaccaccaggctaatgccttctttcttgtagtagaaggatggtagacagttgggtatagcaactgtgtgtgggcaggcagtggggagcaggacgcaggggaaagaaagggcagaggctctcctagttctgcacttggatgcggactatagaggataacttcatttgtctgcttgataataaacatattctattcggtgtacaattttacatatatcagcatgtgcagtttccttttaaaacagaacagctcaatgtgaaaacatctagcaggatatgggaaaggtgtttgagggttgctatcaaaactgaactgtccctgtttgctgtctgtagaggtaatgccttgtagtgcagtcttcttgaggcgagtgacatcatgagtgggaacattaataaaggacctggagaattgcccaagtgatgacctggcctttggggaa

SEQ ID NO: 18171 - DNA, 1161 bp, Mus musculus
gaaaggtgtggggggctggggcaggggagagggtgcagcttgaggaagggaaagacatggggaaaagaccagtgtgtgccgctgcccactgtagaggaggaagaggcgggaagattggggcagaggaacggatggctggcctagcccatcttcctgagcctgagaggagagtcagaaatcccccagtgactggagcattaatgaatctctcagggcaagaacttgatcagccggaagaaaggaacctatggacctaaatgcataattagaccttccctgacttcacatccctggaagggtgtgaatcagaacacagcaatctgagaaaagaagaggacgaggagggtaggagtctcactcagcctggaagaggggcagagcaggcaggaagggagtggagccagcgacagaaaggtctgctcggtggcagaggcaacctgcaagaggtgcgatttctcgttcctcacccagtgctgacagctaagcttgtccatgttgcactgctgctgccgtgtggacagaggggccaggcctacagtgacttcagtgacaatgccctctcccaggaattctccagggtttcatgctgaatcagggagattgtcagtaggagagggtgaaggggagtccccctttgtggtctgtgcaagtgaatgcacctggggagaggctggtgtgcaagaggacacccagagatggtgcgtgcatacatgtgcatgtgtgtgtgtgtgtacatgcatatgcacaaagagtgagacagaaaagtagagggagagaaatagagggagagacagacagacagatagacaggtctctcttacacacacacacacacacacacacacacacacacacacacacacacacacacgagtatgatagagtgtagccagagagattgcccaagagatagatctctcaatagttttttttatcaagtcaggatagtcctttctgaattcttttctgtgtccattcatattttcacttggggtttgctttgcaccttggcttagagacgtagtgggctctgcctagggatctagagtggaacaactctgatccatcttgttggaaaacactcccagggctcaggatcccccggggatgaatcaaccagtgtcactctggggctgcctggaatgtggagacttcgggggt

SEQ ID NO: 18172 - DNA, 2737 bp, Mus musculus
taaatgtgttggtagtataacttacaaaacaaaccttgaggctgaaccaaggtatattagaccatctcatggagagcccaaagaatccaaggttaaattaactactaaacatttaaattacatgctaaatgtgcctttctcttctagtttaccattaatgtgagtacagacatgcggcatcatcgagtgagattggtgttccaggattctcctgtccgtggtggtcagaatctgcgtagtgaacagggtgtgcaagtcgtcctggacccggtgcacagtgttcggctctttgactggtggcatccgcagtatccattctccctgagagcatagttcctgcttcctgtccctcgggatagcttccagtctagtccattagtaatcagattctgtttggaaggggcagctgtattgtgtagctgattagtgatgcacaggctgtttgggttcctggggctcctgttacaggaggtggaaaggttgaatcaagaggaaaaccaactatgatttataaacattttcatgtaaaatttgcatatttgaaaggagaaacctggcctcattttctgtgttaaacctcaattggtgctgttgagtttgttcttcgttcatttatctcagcaaatggatgatctttcgttaggggaaagttaaactcttactcttcatggaagaacgtttttccttacagattagaggaactcagaggcttaaaatggttgctccaatgttgctgctcctcaaattcaagtgaatatttttttcttttccctttacccttctccagaaataaagcaggtgacagggttgtcagaatcttataagattgatttgtgcatcttttaaaaaaaatgctttttggatatttattacatgaatattgattgttttgatgattttgtattttgggtttttgttttattgcatgagacttaatagtgatggtaataattatgtgcccctggtactgttctaagaactttatagattgtgtctctaatccttgtgtcttgcaaggtagttgaaacccttcccattttaaggttgagaagctgaatcattgatttacccaaggccagaactgctggtccatgcagagccaggattctgacccctgtcttttgctacacaacaacttcaaaggccagtttcatttttcgtgtggtacttagtggtacaaagaggaggcagagtgtgaggaaaaagtaaaacaatgagttatttgaatctttcagatagctatgcattaactgaaaggtaaggcagagtttaggaaaattgtgtttacattaaattgttaggctttataatgctaaaggtcatctttaaaaaatacattgcatgttgaaagcagccttcaaatagagcaattagtggcttttctctgccctgtcctgtcctttgatatctttgtttttcctttttaaatcatcctgtgtgcattcaggatcctggtcttcatacagagatgttgacacccttcttagtcacagttcttactgtcactggcatgctctgagaaaaggatgtgggtggggttttgtttatttcttttgctaagaagaaagtcttactgcttcctttcccacctggatgtggcaggagatgctcattaagacaatgctctcctactcaagacctggagttcatcctgtagcgctgcagtccagcctccctgccccacaaaaatagtcctttggagacagggtcttgctgtgtagcccaggctggccttgcacttaatcctcttactttagctgcctggagttgttgggtgagtcaccagacaggacaaagacagaaaatgttctttaaacataaaaatattgtggggtggatacttttgtgagctaaattgctaaatgagtatgttggtttttatctttccccaccccatgctatttaaagaccattcttaagcatctgtttaatgctgctgctgacagcagccgtacccacactgaggggcatgctgtcactggttgaacagatagtgagcctgggtcaataaaaagaaccaccagaatttgggtacttaattaacaaagcaaacaaaaaccctaggacagtaagcctccacagatctctgcagtcagaagctgcctagaggcagaagaaaagaagcacagagtctggagttccctgaacaaaagatgccatggagcaggggaagttgtccttgtggattgtgtgtctcccatttaggtttaccctgagtgggtgaaataaatgtggcttaattgttttctggctcaacttgtgagtttttatgtcaaactccatggtatgatgatagatgctatagcctccctttgaagttcctgctgcctctgctgtggtcttagcacattgccaacacttggtaaaatggttcttcatggttaccatggctgcagtctcctcagcattggctgagttgccttttctggcattattcatgttttgttaatggaagggtgtgaagagtcaaggattgcctttttgtaaaaactagtccacctagagaacgactgaaacttggtaggctctgggtttaaaaactgactaatgtttttcacttcttgatgtatatattcttgttcagagtgtcagacaaataacagattcagctcctctcaacccctatcagaattaatttccttgccattttctaaagatgaaaggaaaattggatatattgggagagagggaatgaaaggctatgttaactgacctcagcttcagcctttataggaca

SEQ ID NO: 18173 - DNA, 1124 bp, Mus musculus
tttttttctttttgcaaatggtattacttctggaagaacttagacttcctatagaggtgtatcttattacgtgatgaataaacatgctagattttcatgtggggtacagaggtctagtggactttatgaactgtaggatgtggtagggatggatagagaacttaacatgtctgacagggaaaccaagtggctcttccccgtgacagattctttttgagcaactaaagcatattacatgatttccaaatcagagacttgtaattctgtagaacctgaaatagtccagatttaaatggaaaactacagggttaccaagatgaagaagcaaaagtcatggataatgtcaggagatggtgatggtagtggtgagaactgggcaaactagtatccaccagtgcaatagtggagtaaagttcacatggaagttggggtcctgggaggctgaataagaacaggcaggcaggtcacatattggtaggagtcatgtgtcatgtttcaggcactacacgctggatgcgtctctgcctttgcggctgcgaccagaatccatggagaagctgcgctgtctccgggcatgtgtgatccgatctctgtatcatatgtatgaaccatttgctgctcgaatctccaagaatccagccattccggaaagcactcccagcacactgaagaattccaaagtaagtgaaacttgctgttggggtttggctaatggattcttgtatggtgggcttgttcttgagtcttgtttgtagcttcttaatggggagggctgtaggtcccaaccattagggggctcatgtaaacttgtaggttcagaagtgtcatttctctgacacatccctgctgtgctggactgctttgctatccttccttaaagctttcttatgcttatagtgtatttcttaagtctctattttaattctatgcactgtacatttgatcactgtagataaaatggttttgatagcttgggctagaaaaaatacttgaatggtaggtgtatactacagttttcacaaaatgcttagtcatgacacaaataacacaaggaattctactgattgtctgtttctaacgtaacctcggcatcttgctttaaggattcaagtatagacatcttt

SEQ ID NO: 18174 - DNA, 1198 bp, Mus musculus
gctcaacattccactctccgtgagactctcagaccggcgagatttctcatcatgctaattagcctggctccatgtcagacaaaactgtcatcctttggggtaggtctaagttgcagagagaagaaagctctcaaaaggagggcctgagacggccaagatacccacgcccttggaccacctactccgcacggaagaggggggggcatagtccccgctagtcctgcctcagtcaggccctcctccatagaccacgccccggagagctccgcctccgggcccgccccgcggcgcattgtgggatctttccgccccaccggagcgggacgcacctctaggtcatggggatccagccggtaagaccctcgttctgtgccctgagcccggggtcaccgcctcagctggttctgggcagtctgccccgcggggctgtgccatacccaccttggatgctggagtctcgctgcacgagctgcgggctgagttcactgctccgcttgcttctgaggttttggcatgctttctcgctggagctcaggatcgctactcctggtcctccacccacaccctggcacttcctcagcgtggcgatcacgcttcctcctctatccacagagcccggtcttgctagcctctctgggggtggggctgcttactctgctcggcctggctctgggtacctacttggttcgaagatcccgccggccgcaggttactctccaggacccggatgagaagtacctgctgcgattgctagacaagacggtaagttgtgaagaagtgggctagggcagagagtggatacttagtttgagggatagcatcgagagtggttggattgctccaaaagacttggcaggccagacctgcctgatgaaacatcttgtcatctatcctctagacagtgagccacaacaccaggaggttccgctttgccttgcccaccgcccaccacattctggggctgcctgtgggtaagaaaaaagggagtgggcttctctacttggcatcgtatgagggcgagtcacttcttaggtggttttcctgctaagaaaaaccattgcccttctgtcaatccttcagcccatgagggaccactcttttagggtgtggcttctgtgcccctacgcatctctaacctccaggcttctctctttccttaggacttattataacccgcctcctatcccagaaaacacta

SEQ ID NO: 18175 - DNA, 1643 bp, Mus musculus
gtatcctaatcgctttaagctctggttcactctggactctcctccagaaggtatcttgccatttctgaacatctagatagtccgtcgttatcaaaatcaaggccttgcccctctttgagttctggtttcagtaaaacagatcctcctgacactgccagaatcacaaatccaggtacacacagtgatccctttaaagtcaggctcctatcttcaggtgggcggcagggctgtggctgtagtcgctgctccaacctgagacctcaggatcccttctggtcatcccaagggtctgtcctggagacatcacattctcttgctggtatggacctgaagtacgtgttttcctctcctccctgtcctccagactggacctacagcaagggctttgttacggctgacatgatccaggagcacctgcctgccccagcagaggatgtgctgctgctgctctgtggaccaccacccatggtgcagctggcctgccaccctaacttggataagctgggctattcacaaaagatgcgattcacctactgagcttcgcaaagcctccctcaccccatgtgtgcagttgtttctagtcgattcttgaataccaagaggccctagggcctttgctgagagcatcagccttctgtgtctcatcccggaatctgggtgcttgcagaaacaacactccctcagctatggtggatgcaggtcaaggctaagtcactcccttgaagcttcctttatcctaactaatgtccttgtgataaaaggtccagatgaggctcaaggagcagtctctagagccagaaagaaggaagtgtgtgtacatttgttatgaggctgcctagtttctgagagcattatggtcacctctgtgtctgtaatgaaagcaatggacagggcaatgcatttcgctccgtgttcagcacttcatccactacttagatgagtacaggttgagtgcgcttatagacacagtcctacagaaactgtaggaagggaattattttccggaattctagacctcagagaaaggaggctggtgtgtgtgtgtgtgtgtgtgtgtgtgtgtgtgtgtgtgtgtgtgtatctcaggccctgcccaggatagcgtgaaatgattactcataacttaagattgctgcctgtacaaagtgtgtctggctgttcaaataaatggagccgaggccctaatgatctcaaggaatcattgtcgtcgtgtctggggtccttgtcctctaatgcttaaggacattggaagggaagggctcccagcacaaaatcttctgggtgttttagagagcttcttaggagctgtgccatatgctgaaatgtgagctgccaccaggcgcagggctcatgcctgcagctgttctgcagagccagagcccagctcctccctggaggctttagaggtggaggggaggaaacagagggggcttttagagtatggatacccctctctatggtcccttaacttggtcagtcttcccttctttctgtgtacccatcttcacgctaatccttcagggtacccggcatacaaaacaaagtgttgcctttccatttggatgagacgtctttaaaaagtaacctgacatcaccagttctgcacagatttggtgactggaccgagttggcctctctcaggc

SEQ ID NO: 18176 - DNA, 2233 bp, Mus musculus
aacttaaaatgaagaagaacgaattactgctttacaaagatacagaattagcacagtaaggacttcagaggagtaaacaaggagagaggagcaggagccagaagactccaggaaaacatcaggagagatttgtgtttgtgaaaaacatgcttaggatttctttgtcttctctcagtatattaattttgaaaattcaaggagcataaaggaggttccctataaagtggccaacatatcagccagtcccctgctgggtatctccaaggctagccttattcccctgggacttggcaccacctgaagcctgagtgaccacctcctaagcaggttctcttcagtgcggtttccccaggaaagctccttttcactacagcccatctaaaggcgtcgtgtgtgttgtaggtctgggagggacgttggagagtcatcccgtatgatgtgcttcctgactggctgaaagacaacgactacctgctacatggccacagaccacctatgccctcctttcgggcttgcttcaagagcatcttccgcatccacacagagactggcaacatctggacacatctgcttggtgagtgatttggatgaggaaaaaaaaaaagtttgtagtgatgcgtgctgtaccactgggcaccattctagtcatgggttgttggtggcgatgcactcctttagttccggcacttcgatctctgtgagttcaaggccaacctggtttacataggagttccaggctaaccaaagaaataaacaaaaaaggaattccaatcttacttgccaaggaatttgtccatggggagagaataaaatgtttctgaatagttgatatcaggagtctggccttttaggttattgttcaccttacttgatagttgattgctggtctttaccacaagacagaagacccagaacatgagggaatggcgctgcatcttggctttggcttcttgctggaacatctgtgtagtgggaactcatgattcctaacttgccactctaaaaacaaactgccaccattcacagactaatacttttgtggcctacgagtgtgtgcttgcctagctccaagaagccctggctttgactcctagcactgagtagactgggcatggtggcacatgcctgcaatcccagtattcaggaggtggaggcagggaggtgagaagttcagggttaccctagctacacaggggttggcggccattcaggagtacatgaaaccctgtcccaaaataaaaatgtcagggttggagagttagctcagtggttgaaaactcgtggttcttccagaggatccaggttcagctcccggcatgcacgtggcattcacacatcctcacacagacacatacgcagacaaaacactgatacacataaaataaaaataagtaaattatttaagagataataagataaaagtgtctgtcttggtttgtctggctggctgatggcagttcacatagctaattcccctgtttactgatagaaacagtggctgcctcggtgtgtgtagtccagatttcctcacgggtggtttttcctttttgtctcgtgcaggttttgtgctatttctctttctgggaatcttgacgatgctgagaccaaatatgtacttcatggctcccctgcaggagaaggtggtcttcgggatgttcttcctgggcgcggtgctctgcctcagtttctcctggctcttccacactgtctactgtcattcagagaaggtctctcggactttttccaagtaagttgaaaggccagccacagcaagagaccatgtgtgttattgtcacatcttgtcccagggctgagcaggcacttggagctgctggaattcttaacggatccctgttgtgcccggggaagtgaagttttctcttctgttgttagagcaaaatgacaaagtttttcttatagaaactaaaacgtcataataagcttcccacgacctcctcaacagatggaaaccaattctgggatatgttttctactgagacagtagtgtcttttgtgaaacttgaggtgctgatggattgctttcaacaccatgtacctaatactagcttatctttattgactggggccaagtggtgtgtggcaagcagtctgtgcttcagaccccacgcaaggcttatcttgttggccagacggtgctagaagcatcagctatctgccgggcactccatggccctcgctcagcatggggctgtttacttgggtagtggttgct

SEQ ID NO: 18177 - DNA, 2767 bp, Mus musculus
ctctgttcaggagtgttcctgggacttggcttgagtggtgttgtacccaccatgcactttactatcgctgagggctttgtcaaggccaccacggtgggccagatgggctggttcttcctcatggctgtgatgtacatcaccggcgccggcctgtatgctgctcggattcctgagcgcttcttccctggaaaatttgacatctgggtaagaaatgactcttagcggggcctgtgatggtgagtgactggcccgggtcagagctctgagtaggtggtgagagagttgggtcatgaagtatttaagtgtacattgtgtctgaaggaagaggatgggcaagatcagccctggtgtcagagtttcttataatgctctagaacaagtatcatttttatgacgtaaacagtttttatggagaaagcagaagaggcaaatgtttcctccaactcctctgtcctaaaggtgggtctctgtttgttcccacagttccagtctcatcagattttccacgtcctggtggtggcagcagctttcgtccacttctatggtgtgtccaaccttcaggaattccgttatggcctagaaggtggctgtaccgacgactcccttctctgagcctccccacctgaggggtggaggagggacttcccaagtgcttttaaaaataacttctttgctgaagtatgaggaagagtctgagttgtctgtttctagaagaaatctcttagagaagtcagtaccagtgacatgtcagctcactgtcccagcctccgtccgggcagtacacttcccatgtgcattcccggcagtcacctcggcaaggcaactgctgctccttcacagataggacgtgggagctcatgttgagattttacccattcctccagccattttgggaaaaaaaaaattatgaactgggattcttcagaaattatgttttgttttttcttgaagaaaatatcccccccttacccccgtccttactttgtaacctggctgataacgggccatccatttttgtagcacacttttcagaaacaattataacctggtcccatctttctaggacaaacaaagccacgccttgatgtagcccggctaatcatggaagtacgtccaggcttcaaataacttgagtttaaatccttttttttttttttcttggcagagtaatgtaaaattaaaatggggaagatatttaatatttaatactaagctttaaaaagaaacctgctatcactgctatgtatcttgatgcaaagactatggtgataataaaagaaagtatagacaacgcttggcattcaaagagttaactgtgttgtctccactgtttgcacacaactcctgaggctcgaggtttctgaggactcagcttctactgagatacaaatcggaatcataccagcagtgagacgggtgtggtcagcgaatgagcataactcagttcctaacctctcatctctaatacaacttagtaccatacagactcctgattagtgtccctcagatggtagagtgtgtgcctagcacccacaaagccctgggtttcgtcaccattatcagataaaccaggaatggtaggtcatgcctataacaccaataccaaggagattggtatatacatgagactgtctcagaaaggaaaatcactgtgttaccatagtatttttggtttttcgagacatggtctctgtgtagcattggctgtcttagaactgaccctgtagaccaggctggcctcaaactctcagagatccccctgcatccacctcccaagtgttgggattaaaggcatgtggcaccactgcctagtatagactatgagagtctccagtgttgaggcataccctagaacttagttttagtaacactaccttgttggtgctagagaatcattcagttactgctcgctggagagaaaccagggaaggcggcatgtgattgtgctctcagagctgagggctcaggcaggtagatcactgctccctacgcagcaaacctgcatagttgactagtttcagggaatcggacagtgcttccagaacaattcttgagtgtaacctcccctcctcggcctgaaatctggctgatcaggtttgactgttagtgctaggagagcatcaggggtggagcctgccaccctatcggtctgccactcccactgctactgcctgccttctagcggttccggagccgacttgaggtcacctgaaactggactccaaggatgatttggctggaatgggcccctcccccttcttcataacccagtgtctctgaatagtaaaattgaaccttgatcaaactgatgtcttggttccattctttcccgcgccgcctagttccctcttctcttccagattccaagatgccttccaggctagaacccagacatgtgggccactggccggcctcaacacttgagggtattggcctgaatgtctgtactccttcatatacacccacccacctacctgcagaagcccaccttgtttactgtgattgtctcaccaaagagtaacttactatttcgtgcctttgtgaattatactgaacctgattaagaggttcaattcattgggtagtgtaagctggtagtgactcagcacataaggggggggagggggggagccaggaatcacacagtgtaactgtataacactatgtacaaagtttcaactgaggacaagtgatcctttgaagaaacaatttagcccagcatggtgatacacgcctttaatagcagccgagccagaagcagaaaagt

SEQ ID NO: 18178 - DNA, 1383 bp, Mus musculus
tgcacctacgtgtctgcctttgggaagtcctaggtcttattgtgcctgtcacttttctggtggcataatacatactttagagagtgcttcttactttatctatctatcgtgtataatctaagttctccaaagatctgaatctgtgtgtcagaacagcacagaatctaacacatagtagttgctgaaatgctgactgaacatactttgaaagctgaaatgttatttatgatgataaagtgaagttcttgcttcagaggcaactacaaatgaaaattatttcaattttaattaggataacagatttcctctcccatgtttactaaagttgcagaaatgaccagacaaaaattcaagaatggatgcagttctgaaaagaaggccaacatgtgactcatcatttattaaacactgtctctgttcttttttaaatttaattttatttataattcactttttatactccatattccattccctgctcctccccatctaccctcaaccgttccacatcccatgcctcttcccaccccaccccaccccatcttagttctttttaaattgcatataattctcttcctgtatctgaaaagactgttttcccagaactttcttcatatttctgggagatgggaaataacagtaatggaggacaggtagcacaaaggagactaagcaaggctgcctcgagtttgtggggaagtaaaagtctgtgacgtgtgaatctacattaataggtggattctgaagagccagtctttgaggctgttatcaactgggtgaagcatgccaagaaggagcgagaagagtctttacctgacctcttacagtatgttcggatgcccctgctgacccccaggtacattacagatgtaattgatgctgaggtaagtcacataaggcgcttggcatccagaaactccactaactctgcagcctagctactcaaaaccagcagctttaatgcaggcagagtcacctggttcccttccgcaggaatggtggaatgataaagctgggaacgttataggcataagaaatgtttattgcttggcaagtcacatctctgtcacaaatgaaaatccataattttatttaattttgtactgtgttgttgtctttttgttttatgtgcctcttatgttttataaaaaactgtgtactgaaaagcataaaaaacaaaacaaacaaaaaaaccctgtgtattgaccgagcagtggtggcgtacacctttaatcccagcacttgggaggcagaggcaggcagatttctgagttcaaggccagcctgtctacagagtgagtgccaggacagccaggactacacagagaaaccctgtcttgaaaaaaaaccaaaaccaaaacaaacaaacaaaaaactgtgtac

SEQ ID NO: 18179 - DNA, 1254 bp, Mus musculus
ttgagaggccaagaaggaagattcatgctgtcctcacttaggaagacattgttggtgcagagatttgaataagtggctggagctgaatggaatgtaggtgaacccagaagatcactgaagtgtaaattggaaggctggaaaggacatgttatttgatttcacagtctttctaatgtaaaatgttgtaccatcttggcactggagacttgagagattaacagtggaaaaggttagaataagagatgctgtaaatgtgcagagttcaatatacctgtggtaaactagaaatatctgtgattttacaattgtcttagtccctgccagggctcctatagcagtggcagtttggtcttcaaatgggtgaaaagaccatcttcctggcgaatcaagtgctaccacgttactacgcctccacactatttatttggggatgggtggggtggctgcagcctagtagttcaggtacgtgattactgccctgttgtttagggcacacttccactaaggagtgcttaagactgctgtgtgtggtatgttcagttttcttcctgctatatcttctgtacctgtctttacagtgtattttactcatcctgaaacaaaataatcaaggacaattgaaaatcttttgttagtttctataccttcgtatagaatggcagttctaggcacctctgtgtcgtggtgaaactcttgagttactggtatagcaaataggagaatgtggcagcctaaactgggctacactttccttttgctctggaatcccacttttcctctttccttgaattgtgtttgctgacagagttaatttcctttgtatttttttaagaaaacattaaaatggactgtctcaaatggctttaagagaatttgtgggtagtgctgccttcagcagacatgttgaaggacatctaagctcaaggtctttcatctaccctgtttaccttatgcctgccaacaagctcagctgcttctctggcagcatcagtaaaatgtttgcccaaatttgttggatttattgtcctttcacactgtgaatctacatgaaaaagatgcaggagcgcatgaggtggcgcacacctttaatcccagcactcgggaggcagaggcagttggatctgtgagtttgaggccagcctggtctcacagagtgagcttcaggacagtcagggctacacagaaaaaccctgactcaaaaagcaaaaagataaagcagcagccttgagcagttttagcacacatgaattttag

SEQ ID NO: 18180 - DNA, 1713 bp, Mus musculus
agtcgtctctgtcgcaccttgtcctaaagccctttcccctgttttggaacatggaagaacatgcaagtactctaccagtgtagcctggtccctggcactccgcctccatgccttgacccagggctcgcttcttcctctcaacaagagcagcattcatctttttagccatgatgaaaggaaataagatgtttactcgctaatcgttgaaactccaccttttctcattctagaagccaaatgtaataaggtgcacatctgtaatcctagtttttgggaggtagaggcaggaggatcaggagttcaaggccaacctcagctacatagcctgggccaggtgagacactgtctcataaaacataaagcatacaagtatttgagagttcattcgttgtatgtgacctacttgtccacagtaatttattctttttaaaagtaaaacatttacaaatgtcagtatttaaacctattcagaaacacattactttagacacattttcaattctcttcttgagagcccttcttctgggttgatagtggcattttatagtgaagatgaactcgacccttcttcctcagatcttggtcagctttctctttttattagctcctagctacttcagtctctgcaccaggctctcttggaatcagagtagagagtatacggtatacaagaggtcggcctcagccagataacacatgggttactaggaaagacttttttagtggcactgccaccattcattaaatataggttgcaagggccttgggattgtggttcacttggaccttgtctataccgaccgagaatgcaaaccttgtccatggagatttctattgttacgggcttggtgtcaccttttcttattagccaacttaagtcttcaacgtgatttccagttgctctgtcatttctcatctggagtgacctggtagcttaaaaggactctgtataaccaggttcaaatacattgccatcatcccttcttctggggggcctacactgagataagtagacctcattattcctcataatgtcagtgcttagcaagtgggagcagatcaagagttcagggttggcctcggttacatatcgaattcaaagccagcctgtaccacatgagatcctgtttcaaatgaacaaacacatgaaaaaatcaagtaggaactggagaaacgtctcacagttaagaatgtttgctgctctctcagaggacccgaattcagtacccagctcccagcaggaggctcccagctgcctgtaactccagttcatgccccttctggtccctgcagttgcctgcccatgaatggcgcacatacagacaagcaggtgcacacatacaaataagtaaataaaaattttacggattaaaccttgtcatctgttttctgggtgttcttcccttgctgaagcttttgaagggcttcctctttaaagtccctcttacccatgtcttgggcaaggttttactggcaccctgctcgcttccttccccgcccagagtctgaatgggttctaagcgcaaaggagagaccatgttttccagcaaataggcaagcactcctgagtgtggggtttgcaagagaacaactgagacagcccacccgtcaaaaggaacaacatagaagcctctagggacacatgaccactcacttcacaagtcaaactaggcttttaattctgccccccttttaaatatcccagaaacaata

SEQ ID NO: 18181 - DNA, 1209 bp, Mus musculus
ttgtatatgtgtagatttctgtgcaacaaccctactttccagtaaatagactgaactgttggatttggtcaaatgcttaatcccctcacagactaaacaatcccgaaaagcacttgcactttacacagtgtctaggataagcaagtgctcgaagagttattgctctcctcattactctatgtgtctgtccttgctgctccttgtgttcaaggtgttttctctacctggagaatcctccaatttcagtactctgcttctcgggttttactaagcaaatctttcgtgccaaaatatatgacgtgattgatggattgtaactctgttctccctactagactgttaacttcttgagaggaagaattctgaaacttcagaggttaactgaagcattaaggataaacatcccaggcggaaggcccctgcccctcccggctagggggcggggcgagacctggctcggggtggcagcagggacttttttcctcgccgtggcggcggaggagcactgcgtggggtagcggcaagacgtcgtcggaggaaggctgaaaaagccctaggtgttgccgttgctagtagaagtcggacctgtcgcccgagctgtgcgtctgcacgggtttcggacggagcggagctcgctgccgcggttgcggagcctgccctgtgctcgcccctgcccaggtcgcggtgatggagccggccaccacgctgcccccaggcccgcgcccggcgctgcccctcgggggcccgggcccgctgggagagttcctgcctccccccgagtgtccggtcttcgagccgagctgggaagagttcgcggaccccttcgctttcatccacaagatccggcccatagccgagcagactgggatctgtaaggtgcggccgccgccggtgagtcagccagcaccccggatcctgctcgcggctgggggagggagcgaggacgcgcggcccgggaggccggaggcgcgggggcggggagcggtcgtcccgcgggcccggtcaagtttggggtggctccgagggtcggagatgcggcggtgggaggaaggcgcgggggcccccgtcccgggtgggatgtgggccgtgaggaccgcgggctccggcggggcggccggagggggctaggtcggtgcggctccgggggctggtgcgctgcaccgcccggcagcggtgcgggctggagtggttggcagccgccggggtggt

SEQ ID NO: 18182 - DNA, 1152 bp, Mus musculus
ggcgctactgggggaggggaggagccgctgggccggtctggagcggctggttgagtggtggtgggggtgcaagggtcggggtggggggacgacactttgaggatggtgggggcaggccaagcggcgggggccctgatgctcgcaggtcctggcggacgctcccacacggacttggggccggactgctttgctcccggcgcgggggggggggggaggcctggctggggctgaggtggagaggctgtgcttgtaggggagatgtcagacgagctcttggagatttcatcctggtccctagctttccctactcggccttcccggcgggggctctagcgcctcgagcttggggggctctgaggggtggggtgtccccaagacggccctaacggctgcaacgtccgcggagagcccggcccactccttccccgtccccgtccccctccccgtaccccctccccccgcagccggaactggatgcgctgcgacaccccaggtttttcgcctaccttttgggatgacctgagtctgagttggcctaaacgaccgttggaccggccgggtcggttggaaaggtttaactgccttgcctaccgtttaagaattttctatctttccctgctctcaagtgaaaaagacccccccccacgccttttacccctttctcccttaaacttgctctatgtaatggcattttgatttaggggattgtgtacgtagacgttctagaaaagatgtttgcgagagatccctgaataaagccttatcctttcactacccccacgaaagaaaaattaaaacacagataccatattttagttgctcttggacaactttgaaagcagaaatgaaatgcctcagaaaataactggccaggtcagctagtatggggggaaatgtttggaaatagattcatttcttctggtgaaatggacagaggcgatggaaggtttcttttactgtagaggcctgcagaagttacacccttgcctggttagacctagggttttgattctgaaatgtggaccacgtttcaaacattgagcgatttagctttatcttaatgtaccaggaaagatgaatgtgactgttgcatgcttgcattaatgggatttttatctagaaattaggaaacttgacaaagttattagaaac

SEQ ID NO: 18183 - DNA, 1160 bp, Mus musculus
ctacagatggttgtgagccaccatgtggttgctgggaattgcttctggaagagcagttggtgctcttaaccaactgagccatctctctgctctgacattttttcctttatattatatatgggctgtagagatggattattattaggtaaagacactcaatgccaaacttcatggtcagacttcaatctctggaactctggtagaaggtgagacttctgatttggacatttaaggtatataatttttcccactcctgttgtttctgggggttggcgcatgttaaacacctgcctagctttactagcacccggaaagccgggtattggggctgcctgccagtgcttagatggtcaaggtctaaggtcatcctccactaagcgattaagaggctacctgctcacatgaagaccctgtcagaacaagagaagacaaaatgaaaacagaaactcacaaaatgaagtaacaattcaaactcttctgctctctgtaggtggacctgtatgtgtgcctcttatgtggaagtggcaatgacgaggaccgactcctactgtgtgacggctgtgatgacagttaccacaccttctgcctggttccccctctccatgacgttcccaagggagactggaggtgtcctaagtgtttggctcaagtaagtattaatgactgagagggagaactactttgggaagattttcctttgcctgtgggttttagattcatcgataataagtccatgaacaaaacaaggcttggaagtgaatgggaaaggaatctttccaagttcctcagtgtatatatgttcttcagatacattttactcctttaatcaccatgttatcaaatgcaattttttaacgcatgttctttgtaggaatttatgagcacttaaaaaacttggatgatttcatatgacatagaaaccgtattaatgttgtagtgtgaattcatgcagatttttttttccatttcttgctccatgtgtgtgtctgtgtctgtctgtgagtctatggtttgagttgcaggacctttgaatctgtcacagtgcatgtatatgtgcgttcctctgtgacagggtctctgattctgaagctgtcacattcatatggtgacagctatgcttcagctatctccctatctcccctacccatcaagcgctagtg

SEQ ID NO: 18184 - DNA, 1379 bp, Mus musculus
ttttatgttttctgtatagctatagtgtaacatgagaagaccacacaaggacaggttattatggaagtcagatagcttccatggtgttagataaatattaatatttaaatgtttaagtatttaatacctgtgtagagatgacctcctcgttaaatggtctgaatatgcaaacctatttgactccattgtgttggcgagttttatagtgcatctgtaacctcttagtgttttggttattcctttcggtagcattatttggctatcattaaatgtttcattctgagagctataatatttcatctacttactaatttttattttggtaagtttaagttgatttttatagtttaaactcttgaacattatcaatccccttgttttcagtaatgaagacatttgatcatgaaaataaatgaaggttaaaaaattgtatttgataaaatgtattttatttgtaccactggaataatctcattcttcagacatatttgatttttcttatgtagactgaatttaatgaaaaagatcttaaaaatctttttaaaaattgcttttgtgactgttggctagatagattagtcatttgaaagtgtcacctggaaaacagcttttcttcttcccatgcaggaatgtaataagccacaagaagcttttggttttgaacaagcagcaagggactatacacttcgtacatttggagaaatggcagatgcattcaaatctgattacttcaacatgccagtccatgtacgtagattgatttagaccttaaacatttttttgttatatgtgtgtagcgggtgctcaggcaacactgaacatgtagaaatcaaagacaccgtgtagaagttggttcttttctgctgtgtgggttcttgggattggactagagacatttgcccatctgtaacttacgttttattttatgttacttttttgcgatcagacatcatttatgtagccgcagtcagcctggaattcactctgtgaaccaagccagcctacagggccactagcacacatggactaattacaccttttgtttgtttgcttgttttttgttttaaacgaggtagctggtgaggaaagagttaatatggatagtgtatagacagtttctctgcaactccattactggataaagaaaagcttcattttaataacagcaaacaccaatatgaagtcctacagttcctgtagtccagcagttgcaacttaaagaaagacagtatcacaacactggtggaaagctcgctgtgtatcaagtaatgcagcgtgtgctgtgtcttgcacccttgctgtgtctggtgcactctgttgtctaatcttagactgtaaattttactataagactccatggttactccttgtttatttag

SEQ ID NO: 18185 - DNA, 1199 bp, Mus musculus
gagagcagtggatcccctggatctggattacaggcccacgtgggtcctgggaatcgaacccaggacctctgcaggagcaatcatttaaaaaccccctcaaactgttattttactttctttggcctctctttgtaattgtggctaggttcatgatcagtgaacatgaatttttaactttttgcaagacagggtttctctgtgtagtcttggttgctctggaactctctctgaagaccaggctggctttgaactcaaagatacccctgcctctgcctcccaagtgctaggatcaaaggcgagcatcaccactgctcagctaattacagttcttaactttaaaatttattatagaaaatggagttgttgcctggatagagttattcacctgtgggaaattatgaacagatttttttgcttagaagtttattctgtgatttccatctcttaactagttaaacagtttgtgaatgaaaaaattcctcttttaatttccttgtacttgcagatggttcccacagagctggtggagaaggagttttggcggctcgtaagcactattgaagaagacgtcacggtggagtatggagctgatattgcttcaaaagagtttggcagtggctttcctgttcgagatgggaaaatcaagatttctcctgaggaagaggtaggctccagctttcaggacttgtgtgaggtggagctctgtgtcgaaagcacagccttggactcgtgacatcctcactaagaacagcagccttgaggattgttagtgaaattctgtttggctagcttgaagtttgttgttgttgttgttgttgttgttttttttttaatttttgagtacacggttgctgtcttcaaacacacttgagggggcattggaccccattacagatggctgtgaaccaccatgcagttgctgggaattgaactcaggacttctggtagagcagtcagtgctcttgattgctgagccagctccccaccccctgaagtatttaattaaaattactttcagcacagccttaactactaaatttatttgtttgtttgtttgtttgtttcaagacagggtttctctatgtagccctggctgtcctggaactcactctatagaccaggctggcctcgaacccagaaatccgcctgcctctggctcccgagtgctgggattaaaggtgtgcgtcaccaccgcttat

SEQ ID NO: 18186 - DNA, 1254 bp, Mus musculus
tcagacacaccagaagaaggtgtcaatccctttacagattggttgctgggatttgaactcaggaccttcagcaaagaatagtcaagtgtccttaaccgttaagccatctttccagcccaaggctgaagcttattaaagcttgcaaactagtaacaaatattccagccttaaaacttggtagggtttcaggttagcactgttgtttgaggaatagtactaacattaccagttaaactccacattactcggtaactcattatcaatatatctttttcctaaaccagttttcaaataagttacctaatgtgatagacctttagagcacaacaatagacccagggctctgggaatctgagtctaatttagggttgataagtgataggtgttttgacctatattgtattatttggtaatatgatattgtaagtcagaagtctttagaaattaaaaaagactatgtcattttcttgtgccctgtgtacagctgccattgggccgccagtgtgtggagcattatcgcttgctgcaccgttattgtgtcttttcccacgatgaaatgatatgcaaaatggcttctaaggctgatgtattagacgttgtggtagcgtcaactgttcagaaggacatggccatcatgatcgaggacgagaaagctttaagggaaactgttcggaaattggtaagatttctggaagtccaattccatgtcattaactgtgattttctaagtcaagttgtgttttctactactgttttaagaagcttttccacgttgtatttaatggctacagagctgccgggagccctcctccggcctggagagggtagtggtatagtcacagagtaggactctggtgatggctttaaagtctgagggccccgggctttcaagctctttaactgtactgaaaagctaaaaactttcttgctctttctcagggtaaaaagactgctggctaaggtgattaacacttacagcctaacaaaggattaagcagtgtggcctttgttctagctcagcaagaactgctgggctctaactgctgggcctgctagtaggaagttgctggaagaaattgggacacttagagaggtggttatagagtttatactaagttgtaaaaagtttcctatgaaaactaaggggaaagccaaaaagatcctaagcggggactaagtgtggaaaggcaaaaaattctctctctccttgtcctcagcacttatacatctttcagaatacatgatcacatggta

SEQ ID NO: 18187 - DNA, 1193 bp, Mus musculus
cttggaaaggtatgttgggaggaggttgtagtaggggtagatgtaattaaaatacactggtagccaggtgtggtggtgcacgcctttaatcccagcacttgggagtcaaagagaggcggatttctgagttcgaggccagcctggtctacagagtgagttccaggacagccagggctacacagagaaaccctgtctcgaaaaaccaaaaaagaaaaaaaaaaaaaagataaaatacattggtgcaaaattctcaataataatggtagctaatttctgcaacttgaaaaactattcttgacctgtggaatgtggaatttacaagttaaaattgtgtataaactatatgttttccattctcagcaaattcagagttggtatttggtcttctttaacctcaactctttccagaccacagaagtccttttcagtgatcatgattaaaatgaaaaatctgttcattagcattttttactttgtcttgtcattgttgatttaacgtgtaattgtcagaaattattaaaatattaatgtaaaaccaaccaaccttccttccctccctctctccctctcttcctttgtccccttcctccctccctccctttcccatttttactttgtttgtaaagtatgtgtgttggtagaaggccttagatctctggtggcagcgacaggtacaggtggctgtgagctaaggtcatctgcaagagctgtgttcattcttcttaatcctagagtcatctttcaagtgcctctatgtatgtgtcttgaagatgctagggatcaaatccagggctctctctgtgcattgtaggcaagtgtgccagtgtttttacttttcctttgtgatagaaagcatgtgtctttagctcttcctctctgtgccccaatctttctgtaaggtaagtttggtgtaaggttgctaacttcagcagtattcatttatcaacaattttattaatgctcaaatagaaataagtggttagacttgaggacctgcctcatccaaagaaggattctccttggacaagtagaataatgtgctattattatttttagattatttagttctttttttttttcatgtatgtgagtatactgtttctgtcttcagatacgctagaagagggcatcacattacagatggttgtcagcaaccatatagttgctgagaattgaactcaggacctctggaa

SEQ ID NO: 18188 - DNA, 1154 bp, Mus musculus
ttctgcatgtgcacgtacaatgatgaaagccatacctgctttcaataacttgatcatttgaaatgagtgaacttgatatgcagtgattagtgccattacggtttttttattgttgtggtgaatttcttcctagaaatgatcttcctagtcttttggcatctataagaaaaatgcagtttgtggctggagagatggctctgtagttaggagcactggctgcttctctagagatcccagtacccatgtgccagttcaccactgtctgtaactccaagggatccatgacaccaggcaggcatgtggtgcacatacatgtgcgtgcaggcaaaatactcatacacataaagtaaaataaatcttaaaaataagagagagaaaaggaaaatgcagttgtgaaatgtctgtgcagttggaaatgtctctgttttgctttcacagaccacggcattctttgagtagccttgctacagcagtcaaagagatggaggagatccccgcctacctgcccaatggtacagtcctgaaggattctgtgcaaagagccagagactgggttcaggatgtggatgcattgcaggtaggttgaaaaagaaaaacaacatcctgagtctgtctgtgctgttagtgtgatttcctcctacctggacaggcctgggtaaggctttcagagtttgacagcagtgagcagaagaataggcaggcggaagcaggagcaggaggctgtagtcctcccaacctggtgtctgtggcccttgatgctaaaggttcagtagctctcagtcatgtgcagtctcggcctgcaagctggcttcttagagctgttgtccctcatctctgtgttgtttttggctgagatgtttggtgtgtgattgttgtgtgtgtggttatttttcttgagtgtgttcacttgtcatttagttcataaatgtattaaagcctttttaagatttgttcatcatgtgtatgactgttgtgcccttatgtgtgtctgtgtgtcatatggatgcctggttcctgaggaattcagaagagggtgttgggtcccctgggactacacttacatgtggggcctgggaatcaagcctgggtcctctgagccacctccccaaggacagttatataaatctttctttgacaatttccccaacttcttc

SEQ ID NO: 18189 - DNA, 1126 bp, Mus musculus
tttctaacccatagacctattcgtgacttactgaatcagaatgtctgggatgagaaccaggaaactgtgtataagtaaatgggctttccacatgattcttatatgtgctgatgttttaagaaacattgggttttctagcttatattttaatttcctgagtaatttgtactgacttgttttaggaagtcactagtgacaagtgaattggaataaaatattatctttaaaagaatgcaagtcaaactcactctagtacaaatatttctgttgagataaatttctttgatactgttcatagaaaccaatgtgagagaccttataggtataaaaaatttatagatggatataaataaacagataaaagagataattgtgtcactttttttatcctttggagcctagcattaagtgtttgcccacccttgctgaatttaacatgttttagtcatggagtcattgaccatgagctacactgaagtatacttttcctattttatgtagaagtatccttttcttaatttattaggcaggaggacgtgtgccagtgttagagacactcattgaacttgttgcaagaggccgatctatcccagtacatctcaattctttaccaagattggaaatgttagtagctgaagttcatgcatggaaagaatgtgctgctaaaacattcttgcctgagaattctacatattctctgttagaggtaagtttgcaatgagcttgtgtgcaggaactttgatctctagtttgaatgagtttatagcaagcaaaagtgacctcattggatctaattgtgagtagtttttaagcaacctttgaatgttttctggcttcatttaggatatagttgagaacatttttttcattaggttttgtgtatgtgtgtaagataagtctctctgttctcagggattcttgaattgtggcagtcttctgccctgcctcttcagttcagggcttgcaggtgtgtgcacctccgcagctggctgtgtaacagtttctatttatgctcaaattagactccagtcctggctatgattcaccacctttgtttcatgtgtatggctggcttgcctgcatgtatgtctgggtaccatttgtgttcagtgcccatggaatctaa

SEQ ID NO: 18190 - DNA, 2062 bp, Mus musculus
cagacatagtcttttcagcgaggtaaatattctaggcaatatatgtctacaggttggactttaagaggtggtgcaacatgttaagtaattgctgagtaaatagttgtatttactatgtgcagaacagagtgttgtgtctcatctcagtagggtctcaccatagaccttgttggcttgcatcttgctgtcctgttcatttagccatagtagattgtaacttagccagaggcagagcttgctttggactggaatgcagataggttctactctgtaacctatctaattagctttttaggatcatgagttgtgaaggaagggatagttctgtgacagtgtctttgttggccttttcagatggcaactcttggggaagctcgcctacgagagatggaagctttgcagtctctcagatttgccaatgaagagaaattgctgtcacctgtccaagacttagagatgaaagtctgcttgtgtcagaagactccagccactcccatgattcagtgtgaactctgcagggatgctttccatactagttgtgtggcagcacccagtatttcacaaagctcccgaatctggctttgtcctcactgtcggaggtcagagaagcctccattagagaaaattctgcctctgctggcctccctacagcgtatacgagttcgtcttcctgaaggagatgcactccgatacatgattgaaagaaccgtgaactggcaacatagagcccagcagctgctttcttcagggaatctaaaacttgtgcaagaccaagtgggttctggactgttgtctagcagatggccagcctcagcaggacaggcatcagcaacagacaaggtgagcctgcactttgtgggatactgtggtctgcatagctctgtggttctgtctggtgtggccattcctgagaccatcccctaccggccccagcattcacgacactggcctctccttttaccttacctgggttctgaggaaatccgatcatcaggcttaggcagcacaccatcttgctagccctgcttttcctgttttgagcagaagtctcagctggcccagaatggtttttgaatttactgtatgtgatcttcagctactgtcctgcctctatgctggggctatgggcggcatgtgagactgtttagttctggggcctgaaagtaggacttcatgcatcagacacttgaggaagccaaccgaattgcacccccacactgaggagtctgtctcagacatgctatttctgttgtacctcttctgcatataattctacttcattatctgtaagtgtatgcatggttagtttatgcatatacatttttgcttggttgaattttctttttcctttcatgtaagtcccgggctggaaagggaaaccgccacatgcctgtcctttaagggagaataatgtgtgcagagttcagatgcgtttacacgcttgtgtgcgtaggcctctgtggagctgtctactttggttttttgagtcggggtttcttcactaaaatccaaggctgaccgaccagtgagctccaaggacctgcttgtcccctattccatcgtgctgggactaagaacatatgctaccataccgagcttactgtttttgtctgcttgcttgcttcagtgtaggtgctggaaatcaaactcaggtgtttcatgcttatgcatgaggaacacattataaattgaaatgtcttccctgttcacgatcttcttatggagaggtagaaccttctaccagttaccctgcaggtggtcaggttcccttggctcctgtgtgggggctgcaggaagagtggtggtaaggagagtgcagttagaatggcagtagtcagttccctcctttttctttagatttgttatttatgtgtatgcatgtttgccacatgtgtgcctggtactgacagaggtcagaagaggacactggatcccctggaactgggtgctgggaattgaacccaggactctactggaagaagtgctcttaactctgagccaacccctacagcccctttaattttttaaacagttcctttgatcctgtgagtcctggttattg

SEQ ID NO: 18191 - DNA, 1153 bp, Mus musculus
aacagcctgtcctacttgagcttttcctctgctggcatctgagtagcagcacctgatgaaatattgcagagttccgtgcacttcttgaccaggggtgttctgagaggttaatttgattgattataaagggaaaggacaaagttgtgactggtttctgagacagggtttcatagaaccatggatgtcctcaacctcctgattctcctgctgttccctcccaagtgctaggattacaggggtgtgccaccatgtccagctcatgacggttacacgccggctgagtaatttgtcgtaaagttacacaagcactgaaaggtggtaggatcttctctctctggggtcaggctgagttaacttggaaagttggatggctttgtttccatgagagtgggtttggctgggttttaggtgctagaggagacttactgaaaaaaagaaaaaaagaaaaaaaaaacccaaagcctcctactaaggtgtttgtcttccatcaggtgtctcagcctcctggcacaacatccttttcattgcccgatgactgggacaacagaacctcatatttacactctcccttctctactggacagagttgtctccccctccatggtttgtattttattttgtactattcctagatgatacaaggccatctggcctagggttttataatagatgatctggcatcctaaagagcaagtatggttttacatgtgtgtaccatgagcattgtggaggcagaggcgggatttgggctacaaagcaaggaagacatattactgtacattttctaatgttgatcatatttgaagatctataaacacaaaggatacctattctgatttattttgactacatttaagttagtcctgtgccatctagcaccaagcaccgtgtattcagggcagatgctaagtcatggacgaccttgtttgcgattctggaggatattgaaagtcattcatattttaaatctacctctttccattcccttatgggtggccttaaatttaatctttagtcaaaattatctcttttttaaacatttgttttttattttaattttgtgtgtatgggtgttttgcctacctgtatgtctgtaccatgtgtatgtggtgtctgtagactgtcagatctcctgggggtggaattacagaca

SEQ ID NO: 18192 - DNA, 4962 bp, Mus musculus
atttggtaaaatggacggtctgtgtatgtcttttctctgctgttactagcaggccgcattgaagtttggtatccccagctcgccaacagtgctgagcgaagggagttaagctggctgtggagactgaagctgtggagatggtagcagcggttaggatgcagggttctcatttgcacgtttttctttagttcagttttggtaatgggcaaatttctttagttcagttttggtaacgggcaaactgagagctaacactgaatttgccatctcccacacagaacgattgccttcgagggaaacgagatgcaatcaacagtcctgagaggaaactgaaaaggcgcccagaaagagaaggccttcctagcgagcggtgggatcgagttaaacacatgcggaccccccaaaagaagaaaatcaaactgagtcaccccaaggacatggacagtttcaagttagaaagagagcgtagctatgacttagtgcgtaatgctgaaactcattccctgccctcagacacatcctactccgaacaggaggactctgaggatgaagatgccatctgtccagctgtgagctgcctgcagccagaaggagatgaggtcagtgaggtttgggccatagaggacgcgctttcccctaactcagaaaccctgtaagctagacctcgtctccttgggtctttctcttctgcttgtctgctttgagctgatctgagtggattgctcagttctcccctcctgataatctctgcttttaacatcgtcctgggtctcctccttttcttgaagaaactctcgttcttccttttatccttctctcgctcctccagctttcaccgtcccggcgctcagaaggtgggagggatgctgatggagtgagtgcccttttgcttactgtcacagggcagcactgtctaccccaaagcaggcacaacctgaagagtgactctgcctcccagctacactcctgtggttagctgttgtgccagaggccccagtgcggggacagtggcaaacggcctgcccgattttgaatggcattgtttcctctgaaccccccatctccctgctctttgtaaccaggtggactgggtccagtgtgatggcagctgcaatcagtggtttcaccaggtctgtgttggtgtctctccagagatggcagagaaggaagactacatctgtgtgcgctgtactgggaaggacgcaccaagccgaaagtaaaaacaaaacacacactcacttcatgtaattcaggactccaataaagaagatttcctcaatctcagcaaagctacaggactggggtcgagccagcctgtacacggtgctatttctattccttatgggatcatttttccagaactctttgaaaaaaagaaaaaacaactaaaaaaattttgacacttttttgtaatttttttccttaaaagctgtttgtggttgttgaagtttaaaatgctgactgttttttgcaggggtctctactgattacgaaggtattggagtttgcacctttttgtgtacagcaaaacattgtacttctgcctgggatatgccggcttaagagtccaactcagtttcagagcccagcaggggcaccagaattccagtaaccctcacagagcagccgcgctcctttgtctgtcaccacattggggggattttaagtttttactttggggtttttgttcctttctttctccccttttcctttctggtaggctaggtttatttatctcagcaataacttctatgttggtttcagtggctggaattaaaacaaaacaaacttctaaacagtgtgttggtgctttagcatttggctcatgtacagaaagcaaatgtctagtttctggtgtcactgcactagtgatttaggaagagactgcgctgtaagtaatcgcccgccacggctgtattttggctttctccctactcagtcccccacccccaccctttttttttttttttttttttggtagaatgtatcaaatgttgcagtttatattgtggaataataaatccttggtcctattctaacactagactacagcttcttctgcccttccacctcgtgggcctgcagaaccagaagggttgcttgcttctgcttcttcccaggcaggcagccgcagaagtgtgtttgctctaggagactctgtagccttattctctgggtgggcctgtgccttcatgccccactaataaagaatccctgtctttaaagaccagagccagtcctttaagccatgttctttttcagtaagccctcagaatattggagtggtccccaaatcactccagactgtaagacagctctcctatggaatgcttttattgtcattgaattgacagggaagtttggttgagatgtggtccatcatcttagaggctcagatctgttgtatcagttgagggggaccttgggcctgcctgggatttctctgccatctatgtaatttcatcagtctctctggttgtggacagccgataccagtttcccctgatctgcagagaggaagacttccagtgagcagaacaggctcttgctcacttttctcctaagttgttgcaagctcttgttttcctcactgtctgtagccataagcctgatggtgggcagagttagcagacctttaataaaacatcaaaaagcagtttgtgaaatagcgaaaatttaaatgtactgtcccctatgcaatccaggtaattaaatctgtttaagaataacccagtggtctgcagtgtcctgcagtgctgtgatgtctcttcttgtctggggatgaaagtaagctttgaagagggcattactgagcctggggtgcaccttagtgggagagcacaagcaagactctgcttcctatgcgtggcactgtccaaggaagtaaatatgtgtcaaagaagatgggatgctgctgaaacccagtctgatggctgagaactttcacccattgagatgagccctctgtgtaggcctggctgtcctggaactcactctgcagaccaggctggcctctcacttagagatccacctgcctctgcctcctgagtgctgagattaaagccatgttccaccaccaccaccgagttccctctgggtcttaatggttgttttgcttattcatttgaattttaatggggtccaatctagctctgtagccaagagtgaccttgaacttctgaattcgttctgaattcttctgacgatgtttttaattctgtagctaaaacgtgtgcatcactgtgcccaatttctgtggtgtcagggatcaaatgtgagggccttgtgcatgccaggcaagcactctgccaagtggactatatatgcgccctcaccagcttttctttgtgtaagccttgtgtatcatgtgtatctgatattagcagatttgctgatatgataggagatagaaccatccccttcccaagtgggaatcatggtttgtttgtatgtgttgataccaagtctgaaatgtcagctgtgtaaaatgaaatgaaccctgggattgcttcagctttgccagtgcatcctaccctgtgcagtaccaacactgcacacactgaagacatccagtttcaactcaggccacccgtgtgcctgacagaagctaaggttttataaaaagaacacattttactatgttagctttgaagcttgctgataccttagagtagtggttcttaatgagttggtcacaacccctttggcaaaccagtctccaaaaatacaatacaaaaatacaaacagaagcaaggttacagttatgaagtagcagtggaataaataactttatggtcaggaatcaccgcaacctgaggaactgtgttaaagagtcacagcgttaggaaggctgagaaccactgccatggaggaatgctggataaatggagaaagaaggtaaagtaaaatagccactgagtttctaccttaagaggccctgcaggagagaggactggagttagcacctgagtcaggaagacgatggcagattgggcagatagactagagaagtctactagctagaccagagagagtgaagttccagttttaatggcggacaaaactacaaaccttcattctgtcactgagcatggaatcccggattttgcctcagttgaaggtccacttggattaagtagcatgagcctatataaaaatcaaaacacggaaagagaggggttaatagcttctggtttggtagaatgactaagatacatccaggctgcccaccgctgaaagtggggttgtaatcccagcacctaggatgctgggtcaagaggactgtggggccgcagccatcctgggggacaaagtgcaaacagtgttggtgggtgattagtgtgtgattagctgaataaacagtattcatttctgtggccgtggtagaaactgggcctctcagcagggccgtaccataagtaaaagtcccgtggactctattatctcccaccctaaccaggcttctgcaacaagcacctttccccacgagccattgccagccctgaggccttgtgcaatggatatttggcagacttagaagacctgcttgtgtcttgggatggacatggagaagtttttggtgcccatggatgttttactgggcccagtcctgcctagggttgttcatgtaatttgactcttaatagattcctatatacatgaaacaggaggtgtattggacagcaggtattttaaatgggcacaaagcatgaagccagagctgagcagtagtagctgacataagctagtcagcatatattaaaatgttctgttgagctgggatgaaactcgggaaaaccacttgccaaggaccagagagaggccttaggtttggtttccagaaacatcagaagaaaaggtttccttctgccacaatgctgcagaaatagaatctggaatattgcttgttgaagagtttcggaagagagcattgaagaccccatcgtcagcatgttatgggct

SEQ ID NO: 18193 - DNA, 1194 bp, Mus musculus
agtttaatcctttcctggtcttggccacactgcccctgactctgtccctaagcattctgaagccttactggtctttgtcatctctgtctcagcacagacagataacagtctttaccgtgtaagattggagactgtgtactttccacttttaaacatctataccccaggcgggaccagcagcctccctgttgccgaggtcagactgctgctgtcccctaagcccaggtcctctagagggaacttaaggatgtaagacagtccttatcatcccaggagggtagacccccatccgtccatgtgactcagaaactccatgtccttctcccaaacccaaaagagaataggctgcaaccccttcatttcgagctggaggccagagctccaaaaccaactcacctccctccccaacattgctgacccttgggggctccctgccccgccccgcccaagtccactaaaaataaaaaacaaatagaaatgctccccgcccccaggttgctttcagctcttttctttaataaggagacgcagctcattacaaaataacaatttgacaagagatcagacaagaacaacagagtccacataagggaatggagagagcattgccaagcagagtgggaacggggagggctacacacgtccttcttaggaagacagggagggctcctggcggggccagtgtattccaggggggacacagcttgctcagcttctgccccagttttgaaagtttctgggcccaaggttttcagaaagcaaatcaaatccttaggtgagcaggagttagggcagaatggtcaggcttgcaggtcctttccctgaactcctggctgctgaggaaagctgggggtgaaactgaggcccacgcactgctcccgccaccttgccagactccgttctgctgctacagttcccaatttcagtttctgtggagactggagatctccagccagccccaccttgttgccctggccttgcccaatacacttgcccaattctttctgaggtcccctgtattagtaacatacgactggcttcttggggggggagggggcgttctgtgggtgcccaagctgccccagccctgtctacccatatactcattacttgccatactgctcaggctgccctgggagctgaggtgaggggcagagcctagtgttcctcagttgtgagtggccccttttcacc

SEQ ID NO: 18194 - DNA, 1207 bp, Mus musculus
cctggtgacccagcgcctggctgcccaggtctggcatttcctgactggaatggggatgtacagtttgtcccagtgtgctctgtctcttgctcctcatcgctctccccgtttcccaaagcacttctcccatccaaattgggaatctgccagaatgacattttgttattttgcctctaaaatttcccctaatgtttccaataaaattttgcttgggtggccccttaaggtgtcaccaagatgctaaccgaggcccctccaaaataagcacacctcccccttccttccctctcagccccctccacacgccttaggccttgcttctacacttggacttgatggtgctcgagggaagaggttttccattaatcagccaagagtccttgaggattttcaaatgccaacagcatgtcattctgcccaccacccacggctacccccgtctactttcgaaactccctggctgtgctagcagccctcaaagacaaggtttggcttataggtcagcacgacccctctgtttcagggtcgtgtctgctcattctatcttttctgaaagatgtgactggtaccggctgaaggcagaagtgtttcctcagcacaggctggacgagtttatttgcatcgtgacagccactcagccaagcaggagagaagatccacaaaaggtccaaccatgaggagtgagaagagcctctgacaggcatcagagctgggatcctgaccaagggacactcaggctgccaccagcttgactctctccagagtgcgtgtgtctgtgctgttctccaccctgttctcctgagaacttgagcagaaggtacccagcctatcctaggataggggagactatgtgaaagcagttgtagtaaaggtaccagaaggcacagggtacagggagaagattcggagaggatgcacccgtccaacatggccacctttctagtcagcatcccttgagcccctggcagctcagccctcctatggctggcacctctcctctgcagggtcagtggttcagacccagctttggttttacgttttcttccaggcacgtgtgctccgctccaatcctggtcaccacttcagcactagcattttgtatttcctctctctacccttcacccatgcttgatgcaccgagtggagctgttcgccagccgagttgtgtggattaacctcagtcaactgtaaatacacctggaggagg

SEQ ID NO: 18195 - DNA, 1422 bp, Mus musculus
cagctccatcccaggctaggggaagagctgtgcacattcaagggcgttgcctctgaagactctgaagaatagctctgtcttggagccgcacctccttgcgtctgcctagcagtgggatgtgtcctcaccctgcttgccaagcctcagcccctgagatgcaaggattgctcagtgggattgctggcagcttccactcaggaagtccaggagcagtctgtgggcctcaggagagtacaagaaccagagtgaagggcctctccaagccatgcccctgtggggctctgctctctggcccctctgcagcctttgctagcagagacagctctgaccattgcttgcacaccttttcagcggagggccctgtccacatccatgcccagggatagctgcagctcatctgccattctattctgaagagaagtgcaaagcctcaaacaatatagactccctcaaccccggaagtgaggcagctttgagggcagggtactttaaagtcctcttggcttaaaattctgtgactttattcaaagatgaggacttttttacacttagatttctgcttcaaaaattgcttaactttgaattttcaggatcagtcttgcttttttcccaaattcaggctaatgctggcctgtcagggtcgacctcccctccgtgttagaaagtgaatttaacattgaaagcgactgagtagtggtgtgattgctttccctcctggtggttatgtaaaaatattaccaagctgcagaggtagagatcggagctgctgtgaggcctaggcccgccctagcgtacagtgggcatcctaggaaaccggctgctgctgctgctgctgctgctgctgctgctgctgctaggtttgctcagcctcagactctctgcttggcaccaactcatttctagtctggagctctgccctgggcagcaggagagccttcctcaggctgctgtgggaggtactcttcccaggagacaccatgaccacagcacagatgcacagttggggcttggatgtgaggaaagggacgaaccctggggctgggtgcctgcatgctgtagtgggtaaaaggcagaggaaggtgtgtgcatgtggaacagggtggaggtcggagcctgggagaaaggaagccaggcttctgcacctgcaagtgtgttctgtctcattgagttcgtccctcagctccagctgagcgagattttaatcagctcctctaatgggtattgacactgctcggagcagtcgactctgtcagggacaactattgattgcttgtgttctgattagattggaaaaatagatcaacttcattatagcccagaagctgtcactgtcacagctacaaagggatgaagtggtctctgagggctgaggagaatcagttggcctcctgacaagccagagagtaggtgaaagttgtggcc

SEQ ID NO: 18196 - DNA, 1137 bp, Mus musculus
gaagctagaggatggcttaagggtcagcctgttgttcttatctcctatgtgtctgcttacaaagtggttttctgtactctccaagttgtacaagtaatatgcatctataatcccagcacttgggaagctgaggcagggggatcaggaatttgaggccagctacatagcaagaccctctctccagaaagagaaggcctgggtgttgagtgctccagtttgccttgctcccgttctccactcaggcccctgctcctcatgagaagtggagttgctgcaaggaggcctggggagagccggggcggaagctagactaggggatggaagcaggccagagacgtgagagcatccgaggacacttggagcactgcggtgacactgcctgggtggtggggactgctttctggtggccacatccaggggagaggtcccttcctagaagccaacaggatcagtgactgctgggtagagactggagatgaagaagagtacttgtggactctcaggagtggcaagccccatagaccctctggcccagtgtccctgtgcctccctgctgccataactctgacctgtggtcagccgctgagagctatgtctgtctgtcttacttgaacttcaggcacctctattacattttatactaatagaagctgggtctgctgcttcctgccaggatagcacactaggtgtgggtgtagtggtctctacttacctagtccctgagtccctcctcagatgttgtgattttgatgcctgtcacatcttgactaccatcctctagagtctaggcaagcagccctctagcttatcatgcctcagcatatataaaatatgccatagttctagcacacagttaaactgctagctcttgtcgatgatccagtgctgatgggtataatgtggcattttgtcctttggttcacattaaaggacacatcctttaatgcctcattgtttgagggttgctagtgatgtggaccattctaacactacctctgttagtttttcatgaggacaccactgtcctttttggtggcccttacaaactttgtgtgctcttaaacagaacttgtaattcagggtccctagtacaggatgggaacagtgtctcctctggcactttcagcacatgtaaga

SEQ ID NO: 18197 - DNA, 1253 bp, Mus musculus
tagttagggttttactgctatgaacagacaccatgaccaatgcaagtcttataaaggacaacatttaattggggctggcttacaagttcagtggttcagtccattatcattaaggcaggagcatggcagcatccaggcaggcctggagcaggaagagctgagagttctacaccttcatctgaaggctgctagcagaatactggcttccaggcagctaggatgagggtcttaaagcccacatccacagtgacacacctactccaacaaggccacacctccaattagagccactccctgggccaggaatattcgaaccatcccagagccaaagccaacacttggcagagccctttcctacttcgctcacattccctgtgagcaagtcctcactttctccttagagatcccccgggttctatctggggatgcagcctagtggagagtgcctgcttggtatgtagtgggccctgagtttgatccgtgtacatctaaaaccaaaactctttccattttccgttcttcttctgtagtgttatgttaactcaggccctgccattgaacctgtggctctcatatccccttctttcccctccccccaaggctgtgctctgctgttagcaccaggtcactggcgcctactcagacctgagactgtgctccatgaagtgtgccccccccagctccccaggaagcctcttaacgccttaactctcctgtggtgtttcattccttagcccctcgaagaataacaggttttctctccagaagaatctttggcatctttggtcttgaatattgattatcagtgtgtacatcttcccagaagattctgctcaagatcaaggcttcttcatctttatctatagtatccagggtagataaaacaaaagtaaggtgggaaaatgaccaaaatgaatgagaaggagagtgaatgaaccaacgcagtgccagctaaactaggaagtagcaagataccaaatgaataggaatttagcataataaggcacataactgggagtcataacccagttccatttttcacgcataaccttaattcagttcactaattatttggagtacccaatagagtaggcaggatgctatctgtcaatgctgtgatgacaaagaaaaacaccacattcttaggactttatagagaggaggttagcattggacagatagaatgttttctctgctgttggacacagatgtgcgctctgtatgcctgtgtctctctctgtctctctctgtct

SEQ ID NO: 18198 - DNA, 1223 bp, Mus musculus
ctgatgctgtatatgtttttcatgagaactggttacatcatttttgagtgttcttatttatatacttgaagtatagtatatctttctgaaaattcagttggatcctaggagtttgcaggcatgaggactacatgcccgccctattttaccccataaagcaaggtcccactttgtagtataggctagtcttaaactcagcacataggccaggctggcctcaaccttgaactcctcctgcctctgcattccaagtgctcggattacagctgtgggcagcacacccaccttgctccccatagtatttagaaagacttagtatttccagaaatgcaagaattgatatgtaggaaatcttgacattgctcttgttgggaaatggagaaacttacggtcctaattatcataggctactagggtgtgaaattaataataaatgaaaaatgaaacatctcatctgcaccatatttaaaaccccaaatatgccttgctgtacattgaacttaagacacacagtacaaagtgatatcaaattgacagagataatattgatttttgccatgcaggtattttattagccatggagccagtgtgggtattgtgaacagtgaaggtgaagttccttctgaccttgcagaggagccagccatgaaagaccttcttctggaacaagtaaagaaacaaggtaacctaggagcctgagcagcctgcagaggctctcctcacagtgccccttccagaccgtgatccctcttccttatcatgtgacagggcaggatgacttctgtccgcagagcattagtcgtcattaccagtgtcatgttcatcttagtaactcacacgcacaggccagatgcccggaggatgaccaggctttccttgtctttgctgttctgagcttgtgtatccatcctgtagctagggttggcctgaggaggatcgtggactgttccatggactgttctttctgagtgtgtaccttgtattatctctgttgcacaggatagcttgaagaaaggctgggggacacagtatggccaaatccacactctgactttgggtcatattcttttccccgggaacctgcaggtggtgctgtgaactatttattaagacctctgaaggctgggcagtgttggcacacgcctttaatcccagcacttgggaggcagaggcaggcagatttctgagttcaaggacagcctggtctacagagtaagttctag

SEQ ID NO: 18199 - DNA, 1218 bp, Mus musculus
gggctgaccagcaacctttcatcagaacatcaggtgggtttccaccaggactctcccagggctctgggcattccagagacgatcaaggattagacttgaattcgaagacttggattcaaatcctgacaccgccaccagcacgtggcatgttcaagtcacttgacctctcgaaagctttagctgtcacacgtaggaaaggaggccaatattttacaatgcacaggacattgcaaaagtcacactcaatgcagtgactctgcacagtgctttggagcactgttgtgcttagcttatgttggccgtgcctttcggactcagcacttggtgttagctggaatgtgtctgaaggggtcagggagggtgctgcaggggcgggggagggggtgtcactttacagtgctccctgctgtgactcatcactccactaagaatcagaactctcaggcactcaggacatgactactgtattagtttcctgtggctgccatgacaaactaccacaaacttagtggcttaacaaaacagccatttattcttccacagttctagaggtcagaagttcaaaatcaaggggttggcaggactggttacttctgtaaggtttgaggctgtctgtattctcttccccaccccaccccctgtctctctctttctcctcacatctgacagctgctggcaacccttgccattccttggtaagagacatattctccagtcacagcctccattctcacaaaacttcatttttgccttataaaaattctcaacattggttggagagatggctaagaacactggctgctcttcagaggttctgagttcattcccagcaactacacggtgcctcacagccatctataatgggatttgatgccctcttctggtgcgtctgaagagagtgacagtgtactcatcatatacataaataaatgaaccctaaaacaaaaacaaaaacaaaaaacaaaactcttatcattggatttagtgcctgacctgataacccaggcggacatctggattctttcactagattctttcagcaaaggtgctgtgcccagtcactttcataggcaccaacagttaggatgagttgggcatgtctttcaggaaacatagacagacagcatggcttcctactggcaagcttcatggcagagggcagaggtctaaatgaagttttctgacctttctctttcttgcttctttctcttcctgcct

SEQ ID NO: 18200 - DNA, 1241 bp, Mus musculus
gctccgcgcgtggagggtcacgggacgcgcggccggagcgtgttgccagggtgccctagcagcccagccccaccccgagggctctgcctacccttgctggacgcggaagccgcggccctttggggcggggggaaggtatccctagaggcagaggagtcagctgaggtcctggctctagtccagactcctccccggaacctgtcccgggcctgccttagcgttggggtcccgaaagcatggcaccataaagggagttgggagactccacttggctcagaagttgcaagagtaggtaccgaggacccgagaggatgagctggaggggcgccatccacctggggacaggggagagagcagctttggagactcagcactgggggaggcggaggagagaggggggtgattgcagttgtatgtctgtgccagaggagtggtgaagaaggagttaaattttctctttaaaaaagaggaagatgagctccctgggcgtgagctgagctgcagtaatggctgcagcctgtatttccaagctaggcaagactgggcttatgggaccaagtaaggcttgggacggggacatagttccccccccccccccagaacctaggcccgttcccaaagatgggttttccaaggactgtgaattcgccagatataggctaaagatgctgatgtgcaggtccgcaaagatgtgagaccaccagcttcggtaccaccacttgcctgtattgtattgttgcccgaccctgaagccccatagggctcaatatccctgcaaggggagccttcagagggacttaaaggtgatcatagcatgggcgctctctcttccctaaatatgctccgccattgacctctggaccttcccctactcagtgacccttcttattccacgggcctctgctgatgtttgggacatgtttttctgaactaacacacatttgcttcctgactgccatgctgtgtccctaggaccaaacaccctggttaggcttggtgttgacttgcctcttaggctgtcagagcaggaaaccaacacccggattcccacctgtctcttcagacctaggtggcttggtttggggcatttgggtctgggagatgtttttgtatttctcaaaaggagaaactagctgtttggactctgccaagacaccacttccagtccctagggatgtctttctcagcggcgtgttagtatagggatgcagagacacctaggtgggttcaacttcctggcc

SEQ ID NO: 18201 - DNA, 1174 bp, Mus musculus
ttttattttattttattttattttattttattttattttttggtttttgagatcaaatttcatataacccaggctgacctcaaacttactatttagctgaggctgaccttgaactcttaattcttccccctccacctgaattcgggggttttaggaaccctgcagaacattgctatgccatctccatgaggagctgtgaggcaggccctggacccacccctgtggatgactgtacatccagggggctcagaggactttcaaaatccagctgcagttctcagatgaggattccctgctattccttgtcactgggcattgggccttcagaggcaggggagtggctcgctcatctggtacacctggagcacgtcactgaggcttccaggcactgactgagaactgatcatctcctgctctttgtctagtggtcagagcccctggtctctgtatgggactcaagcaaagtagtctactacctggtaggagacaaaaagctgtggtacaggcacacgatcatcaccctcagcttccaggtacatcaaccctctcctgtgtggcctccatctgtctctcctgctcccacctgtgaccgtgacgggaaggtgacctgggaggagttagggctggccttatttgaagcctgtgtctactttagattaacccagagatttcaaacacaatgaatgcagggagagaaaaataccagacattgaaaggaattatgggagctggaattattctcagctcattctgtaaacattaacactgttactctagacctggctcctctcccccagaaagctctcagcccagagaggagacacacatgtaggtaaataataggctgtggattatccatggtagaggataacagatgaatactaatatgtgttgcattttgtgggtggtgaatttagtcccaacccacctattcagacatagtctatttatgtagccaaggctgtcctagatctccctatgtagaccaggatggcctcacagagatccacctgcctctgcctcccaagtgctgggattaagggtgtgcgccaccactgcccggctcctcatttttaaaaaacattttactactactttgataatctctgctttcctggccatgtctcttgtggtgagcctcttttcctgagaagtaatgtattctaactcaact

SEQ ID NO: 18202 - DNA, 1234 bp, Mus musculus
tgggaagtccataccgagccactttgtccttgggtgcagcaggcagctaggaggccccagttctgggtgttaccctagccctgccccctcttccacttctgagattggttagagcaggtattccagtcccttctttgctagctgtggctttgtgtcttttatatcactagcttggagcttttggtgcggggggtgggggtgggggggggtggagctgggggtggggggtgggggggggtggggtcacagctctaagcttgatccaggctgccattgcaggaacctggcttaactgttcatacctcccaggcccttctcacacagggaggccttacaactttctctcttgtctcccctcagacatcaccctacagtggcttattcaacactcaaagtcacggagaagctgagactgtggctcttcttctgactagggaccacagtcacctaacctgaagccgagctccccgcccaccctgttgtctctccctaagcccactcctcctcacccagtgtggggagggccctctggggctcctagagccctattctgctgaggtttcaactcctgtttttattgtaaaataattgccctctccccaagtctggtcccctaacctctctcccttgctctctttttcccttcagctaccccactcccctccctgtcaacagccctggccccgcaagccctctcctcactctctgccccaccctcctcttcccctttcaacactctgttattgtcctgtgtgtacagtatatatatgtatatatattttaattttttaatttaagcaaagactaagatcaaccatttgatgctgcaggggccaatcgggacctgggaggggcaaactggaaaggcagagagagatgcagggtcgatgtggggcaagttcatatgcagaagaggggagactgccacatagggcagtggttgtccccatgtcctgtaaagtatctctgtctcccagtggaggacctgaatttgaaggccagcaggagcctccttttctgtccccagccttgatagggccaccaggtacaaccaggtctaagagggaggaccagggtccatgtcgtcccagcaacccccactgtcactgttcctggccccaggtcctgcccctacccagggtccccacctccacggcccatctcattttctgttctcatttcacagagttgtacaaggagagaactcagcatgggagggttggttctttggttt

SEQ ID NO: 18203 - DNA, 2216 bp, Mus musculus
actcagaaatccctcccaagtgctgggattaaaggcatgcaccaccattgactggcaggagagtctttttaaattaaatatattttttcaaactattgagacaacagcttgctctgctgtccaggctagcctcaagtgggtggctcatacttctcctaccttggtctttataatatccagggctacagatagtcaatcccacagtcacccagctgagagtatcaaacggcttctaattgacttttccaagtgccgcaaccgaatgttttgtttttgagatacagtcttattatatagtccttgtttgctattgaacttgctatgtagactaggctagcctcaaactcacagagatctgcctacctatggggtgctgggattaaaaatgttattcttctttttttagcgccatctgctcgcggcgctgcctcctgctcctcccgccgccgctgccgccgccctgagtcactgcctgcgcagctcccgccgcccggctccgcgtccgagcctcctggaacgacatttggagttcttacaagatggccgacattgacaacaaagaatagtctgaacttgatcaagatttggaagatgttgaagaagtagaagaagaagaaacgggtgaagaaacaaaaatcaaagcacgtcagctaactgttcagatgatgcaaaatcctcagattcttgcagctcttcaggaaagacttgatggtctggtagacacaccaacaggatacattgaaagcttgcctaaggtagtcaaaagacgagtgaatgctctcaagaatcttcaggttaaatgtgcacagatagaagccaaattctatgaggaagttcatgatctcgagaggaagtatgctgttctctatcagcctttatttgataagcgatttgagatcattaatgcaatctatgaacctacagaagaagaatgcgagtggaaaccagatgaggaggatgaagtttcggaggagctgaaagaaaaggccaagattgaagatgagaaaaaggatgaagaaaaagaagacccgaaaggaattcctgaattttggttgacagtgtttaagaatgttgacttgctcagtgacatggttcaggaacatgatgaacctattctgaagcacttgaaagatattaaagtgaagttttcggatgctggccagcctatgagttttgtcttagaatttcactttgaacccaatgactatttcacaaatgaagtgttaacaaagacttacaggatgcggtcagaaccagatgattctgaccccttttcttttgacggaccagagattatgggctgtacagggtgccagatagattggaaaaaaggaaagaatgttactttgaaaaccattaagaagaagcagaaacacaaggggcgtgggacagttcgtactgtgactaaaacagtttccaatgattctttctttaatttttttgctcctcctgaagttcctgagaatggcgatctggatgatgatgctgaggcgatactggctgcagactttgaaattggtcactttttacgtgagcgcataatcccaagatcagtgctgtacttcactggagaggctatcgaggacgatgacgatgattatgatgaagaaggtgaagaagctgacgaggtaatgtttaccaaatgagcaaataattcactgtataacacattgaggaacaaaaatgagtgattaatgtattccttataatcattctgtgatttgggataaattttggaaactatgattttagaattctacagccaaacaatgtatgtataaggtttcaataaataaattgcaaaactcaaaaaaaaatgttattcttattacctgggttttcatttgttcaagacaaaaatcttcaatacagacacaggctggcttgaattaaaactcttcttacagccaggcagtagtggctcacgcctttaatcccagcactcaggaggcagtggcaggcagatttctgagttcgaggccagcctggtctacagagtgagttccaggacagccagggctacacagaaaaacctgtctcgaaaaatcgaaatatcttcttatctcgacctcttcctgcttccagcctcctaaggcctttacccacaatgctcagcttctgagtgtgtgcatgcatcacattaaggccagagtctggatggtcaggtctatccttctctatgttatccctttgagacggcatctctcactgagtct

SEQ ID NO: 18204 - DNA, 1436 bp, Mus musculus
gcgctgggcagagatcgtgagcacacttagctttagctaacatttctgtgtttcctgcagacttgttctaagaaagacacttgagagaaagaatagaaattgacagctcagctcccttgtctctgggccacaaaggtgaactagctcagcgttgctaaagtcccctctccctcagttcacgggcctttatgaaaagccccaggacatagccagaaggcacagagaagtaaatgtagaagcaggtgctctggccataattacagatcaccgcggccacaacaggtgaggagagggaacactcaggcagagagggccagctcagcacactggggctgggaaccaatgcgaacctcagaccatagcatgcctcttgcctacacctctgaccacctccttcccacgcaggtattactacaaacgggagatcctggaacgggtggatggccgacggctcgtctacaagtttggcaagaactctagtggctggaaggaagaagaggttggagagagtcggaattaaggatcggggctggacccaggacctgactcaggcatgaactccagaactgaagccttcctggaaggacaggcaggcctgatggcccccttaacatggatgtgttccctgtgttgctgtagagaggaagaacctgttgggcgtgccctctgcagtctcctcaagtgcagcctttggcctctctcctcgccctcttggaattacaagccccagggtttgaaccaacttgttcgataactctccagctgtgactccagttccctcccgtcccaacatggactgcaaatgagacccacctgcagatgcctggcctcagccaaggaggctggggagactgtggcaggagactgcagggacggaggggacagggttgtgtcctcggtacttcctggactgccttccacctctctgctcagtactcaggctccacagacgggggtcggatcatccctaatttatgtgctataaatattccaggtgtatatagagagctattttttctaaagcatttcccctccctgctcttctccactgagtgctggtggccagactgatttttttttaggccccctaactggaccagcgagaagtagggtgattccaggaccccctcttcccccagaggggtctcctggatcccctttcctgtgaatggaggctccaataaagtgccttctgggctttttctaaccttggcctgagctctctgtgtactgaaatttgggactctgcattggataaggcatggagacaggtggaagaagatgttaagcatgaagaaagatggggtggggggggggctgggtgttgatgtatgcagctggagggtcggcaggaggtcgagaaaagagaaaaaaataggtgtaggcagctgacaactgaagaaggacccatgacttcatcctagtgaggatgtggg

SEQ ID NO: 18205 - DNA, 1172 bp, Mus musculus
gttagggtgacagggccttcagaaggcaagtcacctgcctgtcagctcaaggctgtacatgtagtgagtgcttaattgctcgttgtcgtttcattatttgagggtgtcttctaattgtgacaagatgggtataaaatagtatttatcattgtgacatttgtacatgtgttttggaggctcagaaatgcaagaagagtctttaacccttggcattctgtgtgctcatagtgttaccaacctgagggttaaaatctcagcaccaggaaggcagaggcaggaggatggtgagctcagtgccagcctagctcacaacagtgaaagttagcatcacagatagaagccctgtacccactcaacagcagcttccctttatccctgccctcaactgctggcaatccactgtctaaatttgcctgagttacctcatttgcatgtgtcttagggttttattgctgtgaagagacaccatgacctaggcaactcttaaaaaggacagcacttaattggggctggcttacaggttcagaggttcagtccattatcggtgggaagcatggtagcatgcaggcagacatagtgctggaggagccgagagttctacaacttgatccaaaggcggcagcaggaaactgtcttcctcattgggcagagattaagcatatataagacttcaaagcccacctccacagtaacaaacttcctccaacagagtcacacctgctccaataaggccacacctcctagtagtgccactccccatgggccaagcctattcaaaccatcacacatggaatcgtatagactcatttcgtgcctgtccttaattcacttagcataatgtttgcaggaccattcatcctgaaaattctttaatttggtgcctgaatgtttccttgtaagcattcaccaactgggattaattcattccactgttgacaggaacagttgtctctagcatctagctacggtgaattatactctggagtgcaaatgtctgacttcctactttggcttctcttggatgtctacctgagactaagattgctagctcatgtgataggtctatctttaactctgaggaactgccaaattgttttccacaaaggccttaccattttactattcccaggagaaatgaaagagagttctctttctcctcaccaccatgctag

SEQ ID NO: 18206 - DNA, 1196 bp, Mus musculus
ggtcccatggcagccagaagagagtttgaggtccctggagctgggcttgcaggtggttgtgagctaatggatgtgggtgctggaactgaactcaatcttctgcaggagcggcaagcacttctcgccactgagccacgcgagcataaagcacagtgttcagtaggaagggaggctccctgatggctttcacgtctctctcttctttgtgatgggctcagtagatagcccaggctagctccaaagcaaacttacttaactgtattttaatgtaaggcaaaaaagacatttaggttggttgtttttcactcgttttgtgtctgaaacaggtagctttgcagtttggggaggactgttttccacgattgactgcagtatggttcaaatacgaggcaaagaagacccctggaactccatcactagcggtgccttaacaggagccatcctggcagcaagaagtaagtgagcactgcttgttgtgtgtgctttggcttttgtaatactgaggttgaacctgggccttggacgtggtgagcaggcccttacactaataccgttacgtagatcatcatttggacatattgtctaagcccgttgcttaggaggacctatctgcctttaagtaatgaaacttgtcttgaatgccagcactcaggaggcagagatagacagatctctgagttcaaggccagcctggtctaagaagcaagttctagaacagccagggctgcacagagaaacaatcaaaatatggaacctgtaatctatgagtctgagcattgctttatttggtatagaatgaatatggtgctctgaaaagttagtaagaataaaaaagtatgggattggtgggtttttaaaaaatgtattactattacattatgtatgtaatacatagctcagatgaccttgaataccttatcctcctgcctctgctcctctgtactgggatggacaggcgagcgagtgccccttagagaatgtgcatttctgcagtggttagagcaatggccatttattaccttggtaactgatagaatgccaaactctttgtatgtagttttctaagttctccaccgtgttcagctgttaggaataaagatcctctggatcttaagggcagagtgcaaaccagaatgcctttgggcttagactagaagtctacatttttttctcgtaaaagaccagacattaatagt

SEQ ID NO: 18207 - DNA, 2111 bp, Mus musculus
tatatttaatatgcctcttctgcacataaccacagagtctgatattcaaaggtatccctatccctcaggaatcctctgaagtggttgagttgtagcccttgaatttacaacatgtatttttctaggacagtaaagcgatctttacaaatgaatttagtctgcatactctaaggtgtctcaacacctccaccttctgtttcttccttccagaagcaaagtaaaaaacagaagaaagcatagcatattttagcatcctactgtgatttggcaagcagctcaaaaatcttagagaactggtatttttcatccaaatatgtttaaagagtcagtggtacagcgtgcggaggatggcccagggttcggtccccagtactacaaaaataaggacatcctgcagtggggttccctcgtattatgagttgagaatgggtgaagattaagagcagagtagttgccccatgctccctttgtttggtagtgcccgggtctgctgctccatttttaatagctggagctttttctttggggtgatgctttaacaaaaaggaaaggggatgtagtggtcttgagctccacttaagcagaaggcgtataaggcctttcctgggaccaaaggacttggcagcttgttactgactgcgccaccagatgtccttagtgctcaaccttgagttcagaagcactaactaaagtttccacttttatttttaagagcctaagaaagtgtgtatagttgtcttctggctggcggtgtggagaccagtattgcctctgcccttgctgcttttcctcctgaagttgaagttcctgataaagagaaatgataacatacctgtccagtggtacccaaaaacaccacagtaagagctttggaacctcgttctatagttgacctcaaagtcaactggatttggtgctaaaaacagtagaccattccacatgattaagttgtctaatggttttgtcacattagagtggtaccaggttagcagcactggcctgctgagtttgaggaagcttggagaccccagttcatatgccgacagtgatgtgggttcattctaagcctgcacattagaacagttcccagtgtgtagtgccaaaattagtccaaagggtctgtcctgttctcatggttcacttttggtaggagggctaagctcctggcttaagaaaacttgaaaagcaggtttgtaggaagccatcctggccaacatacataactgattggaagtggaggggcttctgcaccctggtggacagatgcttgtgttttcagagcaattaactcctgcaacagtgaaatctcccatcctgccgagagactgttcctgagagcaaggagaaagttctgttggtgtgacgaagttgaactctggctcatattttatctcctatgaaagccaacttcatttgggaaaggggtgaggcagaccgttgaagactaagaaaagaccagtgaactcatgagaggtgtgggctccctatgatcaaaggtttccaggttgtgggtgaaacactggagagctagaaagcagatgagattccaagaaagagttgttccgctaacccctgactaagacgcatgaacctacaacagatggttcgaaagcagatgactgtcagcggggaaagcagtggctggggctgagagaggtggtcattgtgagctaggagctaaagtggtgagctaatgaaagcaagcctcagctcttgttagctgtcctaagtaccccagagaagtaaagtgagcactgaccagccgagcgacaagtcagccttcgtgggagaacgggggtgggtctttactgtggagatgagtgggttgatttatgccaggacatttgaagccatttgcaaaagaaactgacctacacaaggaaagaatgctcatcaaatcttagatgacaggaaacccctgggaagggtgacatttaggatccaagtagatcaagtataagaaaaggagtttggcgacagtatttatcgggaagattaaagatttggagtactgtgtacctcattaaaagtactgagtgttaggagtccaaaaaactccagtgtgggcccaggttatggtctaggatactgcagattttcctccacctctg

SEQ ID NO: 18208 - DNA, 1239 bp, Mus musculus
ctgccctcttttacatttttccttctaagccaaagtctttgttgccacagatatttgttgccaaatagggtaagagaaagtagggccaagatcaccagaaagggagaacaaacacccaaaagactagaaaatgagtctaacattgaaaatgagactagaaagtaaagagaaggcaaagggttccttagaaagctcagaggatgtctgtctgaagtggaggcacccggtaaaggcaggtgaaaaaaatttcaattaaccaaagaaggctcttcctgtttcaccttggcaatgggagctaaggggaaatgtggtccctgacagaatggctctaggacttcctatagctctcacagcaatgctctttggttcagtgtcttagattgaatcttcatttaacctgaattagtctcttccaggcaaaagtccagtgtacatgtctcttgtgctttctctgctttcattaaaatgtttcttttttgaacagatagttggctttttccccccaaagttactgtatagattctgtcagtacaaggcttcaaatgaggttccatgctattttagatggggttctctgccctcagacagaagtcagctttgtgaagaaacaacctgtgttgatcgtggttccgccaagcagggaactcaacagctgtttgtttgtttgctcttttgatcacactgtcaacttcaaagtctttcattctctgcattaatcttacagcagacctcattatcagtaccataccatcattgtcattggaaacagtccttcatcaacttttgtgtaagttacagtttttggtatgatacttttctcagagctgtacaatttaggcagaaatgtcctttttcataccccactgttgcctcctgcaaattagggtggctttttttgtttttgtttttgttttttgtctttaaaatgtgaagcttactggtttaaaaattctgggaacttagagaagagaatgtgtcctgtccattctgttttaaatcttgtcttagttagccaagttagtctgcaagtcatcttgcccaggagactcttaaacaggcatttgtactagttgaactttcaacctcctctcttaggtgaaagaaataaacttttgtagaaaactcatcttaagatatgtgtagtggaaactcttggctgacttgctctaaggccctccatatagatctaaccttaggctaatctctgttctgggcatcctctactgtctcgctgctgag

SEQ ID NO: 18209 - DNA, 1151 bp, Mus musculus
ctcctgtgacctcatcctgcctccctgcatcccagctcctgtggcctcatcctgcatcccagctcctgtggcctcatcctgcatccctgcatcccagctcctgtgacctcatcctgcctccctgcatcccagctcctgtggcctcatcctgcatcccagctcctgtggcctcatcctgcctccctgcctcccagctcctgtgacaccatcctgcttccatggcatttctctaagaaggaagataaaaaagagcaaactcccacccagcagccagtttcccatatagctctgctgcaccccaccccacttcctaatgctgttcggtttattgcttttaacaaaacaaatttatagtgagttccaggccctggtggcttcctttcctccccctccctatcctgttttacacagcactgctcatgtaagagtctgtttctcaaatgcacggcattcctcaggtggaggatgggcaagaatgttcactttttaaaacttactgggtagaaaaatcccaaaccaggatatgtgtgtgtctgtatgtttgtcttattttcttctcatttgaccctcaccattccagtctgtccccttttatacctgatgtagaaaaggcagaactgaatctggaaagcaaattgttgtatatagttgcggtaacaatcacgaagagagctgggctgtcccctcagtaattcattttaaatgaaaaaaaattggttgaaaatgaaatccatgccttggccagctgaaatggccttcctccatcgccactgaggctacccttccctgggtcctctgccgaccaggcatgtctccatccagcagatttcatctgtttgctgccatttgcgtttcaataaagttatctcctgtattgtcctctggtttctctctgcttggtttctgtgtccatctatcttaatgcttggtatgctatgacaaatagctcgtggtcctttgcctaactcagaagcaaaccccacctgcttttaaattaccccaaccaaatgctaataagcaggagtctttacttctgttttgtgggcaggagagaaccctactttgtacactgtggacagttctgtcctgcattatttcagctgcagattatatgagcaaaagcaatgtggggagggtttttatttcatctt

SEQ ID NO: 18210 - DNA, 1176 bp, Mus musculus
caacaacctttggagggcctcagctccaggagaggctcgccagagtcccttgcacttggggatgaagaccaataagttgtgttcaatgtgtttgtttctcagtccctgcctaagcactaaaataaaatactctaggtattggaggctgctaagggacctgatgtctgtgcatttttctgtctctgtccttctctcttacacacgagcagtttgttgttatcttctggggctctgtggaacattatttttgatacctgctttctggtaactcgttggtgcttgtttctgtctctgtaaatccttattccagtgtctttcatgtagtctaatcatttggaaggtagaggctggcaaggaaggagaagggggtaaaagatcatggagagagcccacaagaaaactttcttggttggtaaacatttgggtcttgagttaccaaccttctaatctgtctattctgatggacataagacaaaataatgatttttttcctccccttttcattttgtgccgtgtggtttttctagtttacaagagtcgatgtggacttcatgtacccatctccttcctgatggctctcaaagatgagtcatgctattcacaggagtgccacccccttccaggactctgaggatgaactcttgtttcctgtcctattccagaaaagtagttaggctctcacaccaccttccatcaccccagatggaacccattcccagcagccagcctgggcacagaggacacatgcctgatgaggtgatccaaatgacattaatgatcttttttatggcataggggtttgggagaggaagttgtgctgatcacaaatctaatccagggttccagagttaaagtgactcagatggttaatcaaagacccttctcattctgtagccttccttcccatagtcctgtgcactagctaaatcgaagctggtaaactggctccgtgagccaacagcccccgtggtaagaactgaaatggctgtaacaacaggttggctaatagagatggataggatggatgcaccaacagctgttggtaccttgtttttccttcaactgttgggtattgactctagggtttctcataacactcagcaagtacccaccactgagctttctctctagcctttatactaagttgtccataatggctctgaattcagtaaatat

SEQ ID NO: 18211 - DNA, 1804 bp, Mus musculus
tacctggaagctcaactgccgtcctccagcatggtagatctaccccgagcttcatctcggactgggaggaaaaccaaaatactggaaacacctgcctgtcttatggcctgttagggccctcactgcactatttggatggtagccactttgcctgactgaatcaagattccctagctagcccttattatttgtttttgacagatgaatagtcacttataggagatggagcaaccgtgtgacctgcttcagatcagaataaaaggctcaaagagtttgacttggtggccaatatctgccttccaaagagatctacgtcttgcagaagttgccctcttcctaacccacactccttcatttgacaagtacttactgagtatttaaccgagtaccagtcactacgtttttaaaaaagacaagacttggtccttaagttcaaggtctaggaggcaatgttaatctcctttaagtaaccatccctttattatctggaccttgaaaatcatctgagagatgcaggtgaaggccaaggagtcaattaaaagaagcctttggttagatctccaatatgttgtaggcagaaggttggggatcagtttaaatgaagcctgaagaactgtggaatcttgcttgtcttgagtgggaaaatctacttctgtcatttctggaaaccagtggaaccaaattccaggttgagctgcctcatgggctaatgtgttagcgctctgcagtgcagggatatatactatacgtctggacctgagaatacgctcttcaggttccttagtagcacacgacgtaccagaatctataccaagattctttaggcaaactaacctgggccattgttccacccaaccaaggaattacgtgcccctgactcttaatagtctattttcatttagatcctcaagaaggtctagcttgtcccttttgtacccatccacccccggcaaaagcttctatattcacctggtagccccagggatgacagggtcctctattctggagactgttattgctactgctgctaattccacgagctgtgaagatccccaactcagctgcaaaatatgcaattctgtggtgggaagaggctgactgtccgaggatggtgctgaaatcactgccttaaggtctttgctgtgcagaatgagaaggcccccccagagctgggtgttccaacttagaaggaagggaagactggataggcctactttggacataggtctcttctgaaccctatccaaagctccagtacatggcaaggctcagacttttgctaacatcctaacgcttgagcctttcaccctctttttctggtgctgcccagccagtgccttctgacacggatgttactggctacttaagaagaaggaaagtaggaaatgccttcttccattccaactgcctcagactacagagagagtgtctctgtggtaactatggataccatcgagaattttatttgggtctgcagcaagttgattctggaggcctcgcatactttgacttcatttctattcctgggatccaccaccctcttctctcagttgactgctgcatttagttcaggcctcaaatagctgtcctccaggaagtgcgttcccatctagtgaagtgctctcgaagcctacactttccttctggagcctgggaccctgtttacagttgcacatctgggcccctcacagtaggatcaaccatctcaaaaaaaaaagaaaaaaaaaagggatcatggttcggtggcaatttcggaaggttgagcctcctcatggtgctataacccctcgggatgctcatccag

SEQ ID NO: 18212 - DNA, 1158 bp, Mus musculus
tggttcgtgtgcatgggttacaatcaggattgaagcagttgtcacttctttatgaaccatctctaaactccatgttcttagacacaccaaggatcagacccatgatgatacaggattatagggtttggttggttgggttgggttgggttgggttgggttgggttgggtttccctgtaggcaggacctagcacccccctctgcattcacccatgtctgcctctttttagatggccatgctactgaaactccaagaagctgccaactacattgagtcaccagatcgagagactatcctggaccccaacctccaggcgacactctgagggcccggcagtcactgtcaccctggagggcagaaggctggcttcagcatcattagctctcctctgccctcttccttcatagctctggctcaccagcctcgccaagagaacaggagggaagaagagggcaggaggagggatgggttctcggtgctgaacctttgagaacttcctactaggaattggagggggtggagtttgagaactccgtgccccttaactacatttgctggcctcctcttacgacttaggagaaaagatgattctggtcttttcttcaagttttgtttcacctacaaactcttgggctttctggggagggattcggaagatataaacagacaaacaaaaacaaacaaaccaactacagcagttccaagctcgttctcacaaacacctctgagacagtcacatgtgggcaaatctaagggaggcaggaagctctacagactttcttgcaaacccttcccagttctgtcgacactgccaacaacctccccgccagagacctggccagagccaagaaaagagaagcatgtggtttaacagaaaaacaaaacaaaacaaaacaaaaaatatatgtgtaaatcaacctgtagaaggtaaaaacggcaatggaaaagatgaagctggaaggaggggcccagttgccaagatggaacgagagctgccagatcttgccttctggatgacaagaggggacattgcaagatggctgccagtctaaaacgtcaccagaccacaagagtaacatcacagccttcgaagaaaggccacaagctgtctttctgccctctaactgaacatgcatgaaaagtcaataaaccctacttt

SEQ ID NO: 18213 - DNA, 1220 bp, Mus musculus
cccagcccagcatatagccttgacatctctctccctggaatctgctctcttctagcttcggagttccttcaacaaagccttcagtattaaaaagggtcccaagtcagcctcctcctactctgacattgaagagattgccacacctgactcctcagccccatcatcccccaaactccaacacggctccactgagactgcctccccctccatcaagtcctccacctcatcctctgtgggcaccgaggtcaccgagtaagtgctcgctccaccagccaccctggtaaactgttggctggagctagctgtaagcccacagaccctgacacatgccaccatacttatggcctttccctgggtgtgtgagacccatgaagggaccctttctgatataccaattaagagtctatacacagaaggaaacgggactatgggccagacatgtcagtatcctctacgacacagtgcatctgtgggatccaggctgactcttgctttcttacaggacccctgctcattcagtcccccacactagactgttccaagccaatgaagaggaggagccagagaagaaggaggtatcagaactgcgctctgaactatgggaaaaagagatgaagctcacggatatccggttggaggccctcaactctgcccaccagctggaccagcttcgggagaccatgcacaatatgcaggtcagtgtctgggcagagctgcaggagagaagggcagggccggacatctctgccaccctgccacctgccctgtctgttctgcccacagttggaggtggacctgctgaaagcagagaatgaccggctgaaggttgcccccggcccctcctcaggctgcactccagggcaggtccctgggtcatcggctctgtcgtcccctcgacgttccctgggccttgcactcagccatcctttcagtcctagtctcacagacacaggtacctgcttggggagaacttgtgtgggcagagggctgcgggggctggggagcgtggttcactggcatccttccacctgtggcatccttaaaccgggaggtagtggtgttgagctcaatgctgtcagtaagcaggagcagttgttaggattttagctctatgccttttgagctggggctcccggctcctcttggccatacacaaggaatcattgtttggaaaggagaatagctgcaaacttgaagtaagcctggggccttaaaaccga

SEQ ID NO: 18214 - DNA, 1243 bp, Mus musculus
aaaagtgtttttaggatatcatgatagcaactcttcctctctttcctaccctctttcaggcaaacctgaaggcaaagctacagacaagggtaaactcgcagtgaagaacactgggctacaacgctcctcttctgatgctggccgggaccgcctgagtgatgctaagaagcccccctcaggcattgctcggccctctacttcaggatcctttggttataagaagcctccccctgctactggcacagccactgtcatgcagaccggtagctcagccaccctcagcaagatccagaagtcctcagggatccctgtgaagccagtaaacgggcgcaagacgagtttagacgtgtccaacagtgtagagcccggatttctcgcccctggagcacggtccaacatccagtatcgcagcctacccaggccagccaagtccagttctatgagtgtgactgggcgtggtggacctcggcctgttagcagcagcattgaccccagcctcctcagcaccaagcagggtggccttacaccctccagactgaaggaaccttccaaggtcgccagtggtcggagcactccagcccctgtcaatcagacagatcgggaaaaggagaaggccaaagccaaggctgtggccctggactcagacaacatctccttgaagagcataggctccccagaaagcactcccaagaaccaagcaagccaccctccagccaccaagttagcagagctgccaccaacccctctcaggtacccacactgggcaatgacttcctcccctgtgtctccagccttaaactagatgtggcatggcctatccgttgcgtctctagacctttgtttggatccttcctccctcttctaccatttcttctctctgcttgaaaactcaccttgtctctactgttccgtgtgtcttcagtacccgtgcatgtgattttgctgtgttcagccgcacattccccagatgcacgtgttgtctcccttacgattgaagatgctataagtcaggtgttgaatctccttccagttggtttatcagcagcagcagcgtaaacctttagctgcataggcagccagaaaagaagggaactagaaaaagattgcctgttgccctgtaatttgttattctaaatattgtatttcatcttcactcctctcagggccacagctaaaagctttgtcaagccaccctcgctagccaatctagacaaagtcaactccaacagtttggatctaccat

SEQ ID NO: 18215 - DNA, 1168 bp, Mus musculus
cctcttccccggcttccttctccgcatttctttccctttcgccctccgctcgcccccttgctccctccccttcctctccccttcctccgcggtttcttccgtcctcccccccattccgccccctcctctcccggcactaccgccccctcccccgccccgtgcctgcagacgcgcggatcgtccatgcgctcctcgcaggcagaatgctgggcagcagcgtcaagagcgtgcagcccgaggtggagctgagcggcggcagcggcagcggcggcgacgagggcgcggacgagtctcggggagccagcagaaaggcagccgcggcggacggcagaggcatgctgcccaagcgcgccaaggcggcaggaggcagtggcagtatggccaaggccagtgcagcggagctgaaggtcttcaagtccggcagcgtggacagtcgtgtccccggcgggctgcctacctccaacctgcgcaaacagaagtcgctcaccaacctctcgtttctcacggactccgagaaaaagctgcagctgtatgagcctgagtggagtgatgatatggccaaagcacccaagggtttgggcaaactggggcccaagggccgcgagactcctctgatgtccaagacgctgtccaagtctgagcattcgctcttccaacccaaaggtggctcaaccggcggcgccaagaccccactggctccgctagcgcccagcctaggcaaacctagccggattcctcggggaccctatgcggaggtcaagcctctcagcaaggcgcctgaggcagcggtaagcgatgatggcaaatcggatgacgaactgctttccagcaaggctaaagcgcaaaagggctcagggactgtgccctctgccaagggccaggaggagcgggccttcctcaaggtggaccccgagcttgtggttaccgtgctgggcgacctagaacagctactcttcagccagatgctaggtaagacttgctgccccgccccaccccgcccctggttttctcctggccagctgcaggaagaggtttgctttccccctttctcccttctataccgatcactggccaggttaggaggggtattactgcccagatgtgcagagctggcctacctccagctgtgtctggctaacgtgtgtcttaaagatgtcgctgatgggag

SEQ ID NO: 18216 - DNA, 2132 bp, Mus musculus
atctactgtaaaggtgggtagctccacttctctctgaagatctgaaggctggaggaggctggagaccaagcgactatgctgtcgctaaatgaaccagccctcttgccttccaatccaagggagaatgagacttggccagaatcagatggaacacgggccagggatgagagtggagcctaggatcttaatacccgtctagtgaccgaaagacagcaaacgatttactccctcattgaaataaaggggacacggttctcctcactattgaggctaggagcacgatggagacggggaggtgggcactgatggactgtcctccagagaccaggcacaaggagtggtgggtggagttactctgaggacaggagtacatccttacccttctctcctctctgcaggatgctatgccaaaaactttgggcccaaaggttttggctttggacagggagctggagccttggttcactcagagtgaggctgccaccgcctgcgcaccctgcttactcctaagcttttcatcagcggtccattcccaagccttggacacctccgagctcctctccctcactcagccccgctgcacatcactaatgccttggacttgggtatctggctttttgtggctcagggatctgcctgagctccttccccacgaagggtttcctcctgcctggcatttgataccattacctttaggagacatctgtctagtcgcccctttccagagaccaggtccctttccccacaccttaccctcctctgtttctaggctgaatgtccactctctactggccaggacacctgagcccacatctttggagaccaatagagcaaagcaggagacctggggcagggaggcaggaccagaattggcctagggagggttatggtttttgggtcccagagagtctcctctgagtaggcggctgagttcttggtgtatctcagtctgggaagtctccatgagaggcagggaggtgcagataggattgtgggccatcggaaggagctctttctctggcccttgcctttgaatgtggaaatagtatcttttcacttaggaatggagaacaagccagttcagaggaccccaaagtctagagattgcctgacctccttaggcatcaagttcccagtttgatgggcaagggagatcctaatgaataccttgaccaagtatttgcatttatcagtggtccagatcttggagtggccaattctagttctaaccttgggccaggtggctgaaatagacagtttctgttacagcatagcccagggtagagctgtgttctagccactcctgagggttcctctgaaccccaagtcctcactcccctccaacccagactcagacccttctttcttcaccctacctttctctagtaaccttcactaccttgcccaccccatccaggccccaaggtcaggagcggggggggggggggcgagggaggggaagggccgggccttgatgctccccggaactgaggggacaaggctgtacagctgtttgctgcaagggctgtaggcatgggctgttgaagctgatttatcatctgatcaataaagcaatttagaactgaactctgctttcctgtctgtctatgggggcccggccacaccctggagtcagcgctggatcagaccagaacaatctcagcaaggcctagtagaaatgaaccaaaaagaaccactctggaactttctatggaatgtttactttttagtatcgattctaagggaaccaaatgaccaaagaccatggcctcaccctgtttgcccaccccaggatgtgggaattttgtggacttggcttttgaaaggctcaatttggtcccaacaatatgttcaacacttcagcttttggaaagccccctgtacagagaaactcagccagaggaacgtcctgtatcaactccagaagtctcacttcttggaaaagtgtgtgtgtgtgtgtgtgtgtgtgtgtgtgtgtgtgtgtgtgtgtgtgtgtgtgtgacattggggggaggcaaaaagctgtctgtttttctcttagggcccaacaaccaggtacacggaagaccaggcgtgggaaataggcttgtctgaagggttgtagtgttgttcatcgtacccagagctaggct

SEQ ID NO: 18217 - DNA, 1258 bp, Mus musculus
tttccctaacactcacagaccttttttttttcttgtcaatcatttcccaaacagtatagtttaatgacaatttatataacattacattgtgttaggtattaacaataatacagggatgactgcaagcatatgggaggtttgcataggttatatgcaaaactacacccggttagagaaagaagcccccggattttagtgtctgtggcatgacctggatggaacctgttccctgtggataacaggagtggtcacattatttccttctgttctggtgtagacaggttgagaagacctggtgtgaggcatgcaataaaccaaccatcctaaccactgttcttgctttccagcttctctgtccactttggttggttgggacctggctacatgtgatgagccagaagctatcaacatgaggaagataaacctatcatcatggaaggagccaaccagccagagacggagagcagaagccagtaggggctgagcatgaagattcagttcctggacactaagactgttgttatatccagctcagacttgcgagccacaggcctggcctccagtatcatgacttgggccttacctggtccagcccttggttctgggttctgcagactgctgtttgacctctggctttgagacatgcccaaagaagggctggctgttcttcatggcgtgctaagccagtgcctcagaactcaggaggccagcctggggtccagaagatgaccaccttaccttaggacagccactggactcagcttgtggaggggggtctgctgggctggagtcctgtgcctggggggggtctcctgctgcttaggtccttttgggacccccccgcccatctgtaccctttctttgcacacttcttccctcacccctgttgccctctcctcacttcggtgttgggcctggagggggtgggggtggggtaagggttggccctttaccatttcatgcttattccagaatgaagaggcccagttcgtgggcagtaaccacgctgtctactgagtgaaattcttttaagtacaggacacctagagctttggaacatctcttctctagtccacaggccctctgaaagatgtaacttgaggggtacaagcactgtacccccagtagacatggcctcatcggccataggaaggaagggccccagtgtgactgaagaatgtcaagtcctgcagctgcctcttctgtagagggtgactttgtccctactaacctgggaagtgactctagtttccaggta

SEQ ID NO: 18218 - DNA, 1099 bp, Mus musculus
gaggttctagccccaccccaggtaagttgcaagaggaacaagcagaagtggcttcaaggtcaggcatgtggacctatgtggacatgggctctgtgacacttggcctctgggtctttgaagccttttccttcccaccttctagatgttctgtgtccttcctgtctttttttgttcttttctatccaatcctggacccgaggtcctctcatgctcatcaggctgtcccctacaggacctgccactcccttagctaagggcagctgaaggaggacttttgtggtcatttggcacttctgcacccacatccagtataacactgaattcctacactgctatgatttcccaggaatcgtatgtaatagttctgagaaagtgagtcaatgaatctatacattgcttccaaacataaagtgtacataaagatgactggaggtgaagggcctcccagacgacatccccttccggaaccccaacacctatgacatccatcggctggagaagatcctgaaggccagggagcatgtgcggatggtcatcatcaaccagctccaaccttttggggacgtctgcaacaatgccaaggtgccagccaaagacaacatttccaagcgcaagagaaagagggtctctgaaggcaactcagtctcctcctcttcctcctcttcatctttgtcctctaacccagagtctgtggcatccactaaccagatctccctcgtgcagtggccagtgtacatggtggactattccggactaaacatgcagcttccgggcccccttgattattagacctcagagccgaatcaggacctcaactcaaaagactaaaggaaaatgtaatttatgtacaaagtatattcggatatgtatcaatgccttttagtttttccaatgatttttacactatattcctgccaccaaggcctttttaaataagtaaagaaaatgaaaaagaaaaaaaaaaagatgtcagatgacggcaatgtcttgtgtgcattctgtggcttggcatagttgtgtagggacagcaacaaccaggcacgcaacaggaatggatgagtcttacccatgggctgttaagctaaagctagaatgaaac

SEQ ID NO: 18219 - DNA, 1267 bp, Mus musculus
tgaagccaatattcagtccttctcctgagacttaggaatggttagggtgagacctagacttgagccagctctgctggaattgcttgggccccagaagatgctcctgactcttaaagacaccaaagctttctggctaggcacaccattgaggtcttcagatgaccaggcaaggccctcatggagcccacagcccttggggaattcagactttagaagtgctcactggggtacttggttccatgccagactttaaggatccagagccctgacccctccatcctcattcagatcgtttcccttcttattccaatgcaggatgctcgcaccatggcaacagccgctgcgtccattggaggaccccgggcaaacactgtcctggagcgggtggaaggcgctcagcagcggtggaagctgcaggtgcaggagcagcggaagacggtcttcgaccgacacaagatgctcagttagatggttgccatgattgcatcagagacctgggccatggctaccagcttctggggctcactgcagtcttccctgggtcttcccttcaaatgcccatggcgtttatccttctccctctctagaaatgtactcgactgttataacgagggagtgtgattgggtctctgtaggtctctggggggtagaggggaggggagggaaggcagaagggaacagagacatttgaggtggccacatgattgggtggaattcatccctcctgtcttcaccattcctcccagctccacatcttaaggatgcttacgggagacgaagctgtgtcatcaagagctcagtgggtgcgaggaaagtatgatccagcgctcagccttcgctctaggatgctgtggtccccattcccagttcctccagtgccagtactttagcttggcctagccccagtctcaggaactgttgtggtgcccctgagcccacagtcatctccagagtccacctggaagcctgttcccctctcctcggctcctggtccaccagtgcatggcagtgcccatgcatgccggcatattcagcagctgtcaccttactcccatcccaggaggccgtaaggcctcccacctctcccctgtgactgcagctgctgagccataaagttggaccatatgacacaaggccaatggggaccggagtaccatggctcctgtccttggatggtctcttgtccctgaatttcattgtatcatgcatggagagaaatgtttgtctttctgttgtctatacatcaaagaagccattaaattgtttt

SEQ ID NO: 18220 - DNA, 1199 bp, Mus musculus
cctgcatacttcatccttgtcctcagcctccccttggagctgagagctgctggatgctgttcctccggagagtagagcaccatgtgcaacctccggatagcactgcttggaggaccagggttcagcaagttaaattgcagagcttgtttctgctttagcaaattgagatgctcttgaggcttaagcatgtaccatatgaccccagccatgctttcctccctatcacagctctacaatgaagagatccttgacctatttgacagcacccgtgaccccgatgcccgacaccgcaggtccaacatcaagatccacgaggatgccaacggtggcatctacaccacaggtgtcacttctcgcctgatcaactcccaggaggaggtgagcatcttatacatgggcatctttaaaggccagagccctacagcacgtggggcctgagtcctctcctctgcgtctgtccccagctgatccagtgcctgaagcagggcgccctgtcacgtaccacagccagcacccagatgaatgtacagagctcccgatcccatgccatcttcaccatccacctgtgccagatgcgcgtgtgtgcccagcctgacctggtgaggtgctcttgagggcccaggagctacatgatctagggatgtctcagggacaggacaaacaaacgtgggcctaggctaggaactccagaggtggggcttgtctctatctctcagtttttatttctctccagcctctcgtctcatccatgcaatggagtgagacagagtaatgttagtgtgtcccagcagtgtctgctctcaggtgctgagcacccatgagggttgctgctgtgcaagctaccctcactctcatggatggtggtactgtggggcggaaggctagcagaggatcaggaggtacggtctgagtgagccgatgtcaccttctgctgcaggtgaatgagaccgtgactgggcttccagatggagccgcccccacaggcactgagtacgagactctcactgctaagtttcacttcgtggacttggctggctcagagcggctgaagcggacaggggccaccggcgaacgggccaaagagggcatctccatcaactgtggtctggtaggcaaactgagagtcaccagccccaggagccagatggcacagactaagacaggccatatgcttcagtggctgcccagtcgttctcttt

SEQ ID NO: 18221 - DNA, 2315 bp, Mus musculus
tagggaacatcttcagcttcttttcctttagttgttccagaaacagccttaaaaccagcctgggacaaaggccctcccttttcaattagcgtgaggaggcagtgactccttgcttctccccttggtgctgtggactcagctgctgggatgaggtgaagtcagtgtctagcgccccctactggaacaactctgaatttatagaactgggccatgagaggggccagctccgttcctcccccggcttcccctgcccttaaactggtccacacttactctattgcttcactggtcttatgcatcctggtctcattccgggatccatgagcctcagccccattcagaggccgtggtgacttgtggagagctagcatagcgccactgtacttagctcttctccctctagggcgagtacgttggtgcctgtccatgaggccctaggatgggagagttaggaactgataaggtcagaccctctctgaaccttcccagagctgtgtctgaagctgaaactaagaagattgtcccgcttattggtggctccagccagacacggtgttaagtctgggtaagtggatatttagaacggagcaccggaaaagcagatcacctggaacctggaccgtctgtctgcaaagaccagaaatcctccttcccctgctcatcctgggagtgttaaggaacatccttagcactcagaagtgaccacatcttctccttcacccatctccacctaaatggaaagcccggaccttacaccctgtaagaaaacccagaacccgtctgcatggctgtttacaaactacagaaacacgtgagactttgtcccgacccctcaggctgggccgccccagcccggggtgcctgtactgtatgtatagctgcaaggccagttcttgcacaaagtgtgtgtggtcttacagcccccgcgagaggtgctcaccggcattaccccttctgccatttctgatgggtcactacctcatggcggggctgctatgctgtcccagcgagtgtcattgactaaacttgaaatcggagctctgagctcatcgtcctgagccattctgagctgtgttctgggaacgttggagtccctgctcacccaccctttcggggatgtccaaggtacatagtcaggggcaggaccccagctccactcattgcacaagcatccttcttgtcggaagcacaaactggttgtaatttgagcacaatagcaggtctctgggtagacagtatgagcaaacttggcaccaggagatctttcccagatgggcttcgtcttaggttagaccagggctgcccgtgtctgtgaggttagaccaaggctgcccatgtctttggctgacgcactatgtacactgggaactattaatttactccttgtgcccctcctaggacttgaggcccaggccacatctgtatcctgtgggggtcctctctagacctgcacaccccaagcctttaacaaccagagtatagctggtacctgaccctactgagcctgaagagcctggacccagactcccatctcttgagctaaccccgacatccttgcttccgatattgattagcttccatggaaagtgtctactgtccccactctcttaggtcttttctgtgcacagtcctgggccaggacccatcccagtattaaccagttcagtgtttggtcttgttggtgagacttggtccgacagcagccaactcaatgcacatgctgcctggagcagcctttagagactgcagaggaaagagagagaactcgaagaatgagaggctgacccagcgcagcccttgatgtggtcagagtgccaccacagctacttgaaaagggacagctatggacctgggagtagcctcccaccgttgctccagctgcaggcctggaatggtcttaggctgtgtggcttgggcaaagggcagcttaaagcacaaacaaggagaagatgctgtcttgctgaaggattcttctgctagccattgtggtggtggcgccagcaggaagctgctgagaaggcaggacattacatctctgccctgccctctcccagttcctggaggcctcccttggagtctgggctgggtgcagcaggcacacccccttggctgtgcctggtatgtttgtgtgggcaggacttgccctgcaggagcggtgaattccttcccaccatgtagcccaaacctgccacatctatccctttgtcctttcaaataaaaaactgcttactgctgctctctttgctgagcacagtggccagttccccaacagaccttcttgagcccagccctttcacctcctgactcccaggtct

SEQ ID NO: 18222 - DNA, 1216 bp, Mus musculus
tttccctatcaaagcagcctcatggctgtcacctgagtactgaataaagaaaagtcaggtgcaggacattgagagaactaatgaacactgacctcgcctgtcttcgttcttccatctgtacatccagcaactgagcggaatgtctagtgtctaaaggtgtgatgtgaatattgccacaaagttcattgctctcagtataagattttactttattaatgcaagaggaatacagatatatttctttagtctgcagatttttttttattatggtgcagctttttaaattatgttttaaaattatacaaatgaaaaaatgccattccataaagtttggagatttccatccaccttactgaaacacaagcgttgtcatcgttggaggtcaaattaccatggtaactactcagttaaatctgccaaatccttgtcatggtaaccagtgtggcctgtcaactcctgctacttaccacaacttctaaagttttcctctcagtttctcagttttgtttaggaggactattgtttgtatttggctgctcacagccagagtctccttctttgatgtgactcatggacactgttgggcgatgtgcagtgtgtagtgtgcttcctgtccactcctgagcgctgcagatgatccgtcaggcttgctcgttcctgggggttacagtgtagttcccctttcatctgaataaaagcatggcaccaactgacgctgattcttcaataaagtgcgtgttgtcttgtcttgtgtttgataacgttatttggactcaggaaaatacatcatgaagttttcttgtctcagcctaggtttaaatttagtaattgaatatttacctaagtaatttttaatattaaattatgcttgaatgccttttgaggtggcattgcggtgttgttaagtttctgtgctttgctctgaagtatctgtctctatgactctcacatgtttatgttccttatacacagtcacactggctctagtgagttgagaattgtgaggtgtgagtaccactgcgtcttcagtgtggctctgagcccctctacacagtggccagttctgtaccagtctctagctgtcacttgtgctcagtttattcggatgaaggcatgaaataaatcctgatagccagaacaaccctcatgcataactgtgcgctcagacactgcctgagctcttttgtaagatgctcagtcctcagccaagtggttg

SEQ ID NO: 18223 - DNA, 1306 bp, Mus musculus
taaatattttcttcatttcttgtggtccaagtaaaaaatattgttattaaatcaatatttcacaagacatacttagttcaaaatagtaaaatatttctaacatcacatagcatgtcattagtatattgacatgcgtgtaactatttgatgttatagatttagcaggatttttttagtatatttaaaatgcccttccaagcttacagaaaataatattataaggtaaaattcaaatattgggggctggtgagctggtgagtgtttgcccacttagtgcaaactagggacatgtaggaagagagaccctcacttgaggaattgcctccagcaggccagcctgtgtggatgtcttggggcgttgtgcttgtagtggctagttttatctcaatttgacacaagctcatcagcgaccacctggctgctggtcctgggttctataagaaagcagtctgaaggaaccaataagcaacattcaccacagcgtctgcatcagctcctgactccaggttcctgctgtgtttcagttcctgtcttggctttcctcaatcatggactacaatgtttcagacatttggtgtatgtgcttggctgaggagccaatggggcgaagctaccatctgtgggattatgactgaacgcctctaatcctgcccaggcagcgccgaaggagcctcggttggccccggatagccgggtcccgtccgtcccagctcagcggggtctccccccccctccccccccgccgggcgtccggaccggggtctggtgcggacagccattcgttcatcttgggaactggaaagggggccgccctctcgcctgtcacattgaacatacgttcgtgtggaacctggcgctaaagtataagccatataggccctctcctccccaacttcctctttggtcattgtgtttcatgacagcaatagaaaccctaactaagacattaattgtctcttttattctttttgaattgctagttgatggagaaggggcagtccactgtgggctggctcacccctgagcaggtggtctgtatagggaatgtaaccgggccagccaggggagcaagccagtccccagcattcctctgtgtctctgcgtcacttcttgcctccaccttgattgggctcctccactggccttttttcctcaatgatggagtaatgtggaagtgtagaacccctgagcaatgaatgaagccctagattctaatcttagcaacatacacacaacacacacacatacacacacacacacacacacacacaccctttaggagtgagaggagggcctcaagtgtatg

SEQ ID NO: 18224 - DNA, 1201 bp, Mus musculus
aaagcccagagctaagagagaggaactgaggtgcaaacaggtacaaatcagagacattttccccaaacaccaagatgctgtccacagctgtcatcctagatgctgaccttggggtatgtatttgggtcaaggacatgtcagggacaagtgcgagacactgctctcttcaagtttctggaaagccttctgtggtggtttgaaagaaaatggttcccataggcccacaggggcggcaccatcaggagttgtggccttgttggagtaggtgtggtggtgttggaggaagtgtgtcactggaggcgggctttgaagtctcagatgcccatgctaggcccaatgtgtcccacctgctcttcctgctgcctgccaatgcagttgtaaaaccctcagctacccttccagcaccatgtctgcctgcgtaccaccatgccattcccaccatgatgataatggactgaacctctgaactgtcagccagccccaatgaaaagttttccttcagaggagttgccttggtcacggtgtctcttcacagcagtgaaaccctcactaaggcaccttctctattttctgtcatatcagggacagctaactttgatccaccacgatcctgtcagtgaggggaaaggggtgagaacctcagcattgtcggggttctgctctaccaaactgaagatgcaccccattaatgtctccagagctgtactgctagctccggtcaaatctgcccactgtggtgatctctctgtgatttcctctgcggctttcagagcttttcctctgttgtttctgaatgatctccctcaggttctggcttcctacgcagaggactccggctccaagaggaagacagctttgaaggttttttttgtgtttgttgttctttttttcctagaagaattgagtttaaattgctcacgtagacatccatttggataggaggatacggtggctgataaaggccacaccctggggttgaaaaactggtggaagggaccgggatctctcatgacaggaagatctgtatcgagtcctcaacaacctattccctgtccatgtctgcttttcttcttcttcttcttcttcttcttcttcttcttcttcttcttcttcttcttcttcttcttcttcttcttctccttctccttctccttctccttctccttctccttctccttctccttctccttctccttctcct

SEQ ID NO: 18225 - DNA, 1200 bp, Mus musculus
tttggtgttacgaaatagaatattataatgttaagattccaagttttttagtagggaaaaaagtcgtaatttctggtaaaacttaaagcgttatcatatttcctgacttttaaggagtgacataagggagagttagtgtgataatatttgtgaattgtttcattattgattgtcagtaattattaaaagattattaaattattgagcaagaataaaatcattagtaaaattgtttttttctttttacttcttaaaaaacaggaatgttgtgagttcttactctgatattcaggtaagattggttctattttatctcgttttaactagatagagtgcaacgataaacattgatgagactgttttccctaaattgttggcgcgagtgaaggggaaatcttgtgaactgaacgtgcacgttaagttttagctaaactagcgggtttctcagctaaaatactgcacatcctgtcactgtaggagattacagagagagagagggagggagggagggagggagagagagagagagagagagagatttcctctttttttgaaacagggtttcactgtgtaattctggcaatcctggatcttgctctgtagaccaggctggcctcgaactcagagagatctgcctgcctctgcctcctgagagcaggtattaacggtgtgcgccagctctgcctggccagcaagattctgaagggtaccctggagcacgcgtctgtgaaagaaacaagtagagcaaaaaccaaaagtggcaacggccacgcaaatcgttaaaagatcatttctttctataagttacctaagcatgtgtgtaagttacaaatgtatgtgaccatcaactgtgcttgcttttctgttacttaatctttttgagtgagtcaccgtaggcccgcctggcctgcttctttcttactagagctggctggaactgggaaataaacagagagccacggcggccaccggcatgaacgataaaagctcccggtctcattctgtgttcaccctggtgatgacacagaccaaggtattttttattgtaactcaatttcactttttagttaaaatataattacattatttacctcccttccatcctccagtctctcccaggctgcccccttcctccttctcaaatgcatgacctcttttcctgtaattgttattttacgcacacacacacattactcaact

SEQ ID NO: 18226 - DNA, 1182 bp, Mus musculus
ttatgtaaagtctagcttgacttttaagaattaaaaaaaaaacaattactcatacattgcccttctcttgtgatgcacgattaaaacatttgtttaatgtcatttttaaatttttaacattattttactttttatgtgtatgggtgttctgcctacatgtgtatctgcaccctgtgcaatgcttggtacccacagaggccagaagagggcgttagagatccagagttatagatggttatgagctaacgtgtggatgctgggaatcaaacctgtgtcctcagaaagagcagctgatgctctcggctgctgagccatctctccagcccctaatgtctgtagtatgggattattctaactgcgatgagtgctgtggtcagacatgcattttggctctaatctgtgtggtttttgttagttcagccaaactggaactccatgaaactctccacgatgattcaggaagccaatgccatcagtgacaaatttaaaaagtgctatatttttggcaggtgagtagcttttacatttattgacctatacgttatttttttttttttaattcaagttgctctgaagtctatgtagtagtctctttctaggaaagcacagatatcagaatccctggtaacaggctttaagattccatgtgtaagagtctactgggcttccttttgagttgaaatcttgtttttcagcattccatgttattccatgttcattttatgttggtgggactaggggttgaatccacggcctcacgtctgctctgcatgtgctgtgtcaccaagccacaccacccaatccacacctcgattttaaaaaatcattttgctatgctgtatgtgtgtgtgcccctgcttgtggttatatgcaccgtgtgcacacagtagccgttggaggccagaagagggcgccagggccccttgaactggagttacaggtgcttgtgagccagacagtatggatgcttgaaaccaaacccaagtcctctggaagagcagaccgtgctctttgccagtaagagccctgtggggtgttcatttgttttaggtttaagcatttttttctttctctccagacatgatgcatcagacaaaggccgttctgatacctctgttcgagttcgtaacctccagcttgggatctcaactttctggagcctggaaaagtttgaatctaaac

SEQ ID NO: 18227 - DNA, 1260 bp, Mus musculus
tatgcagagctgctggccatcattgaagagttggggaaagaggtcagactgacgtatgcaggaagcaagagcgccatggagaggctaaaacgaggcatcattcatgcccagagcctggttcgggagtgcttggctgaaacggaacggaatgccaggtcctattccctggtcggtctgaaggcccatctcactaacccgtggagatgagaagctttgtgcaaaatggcagtcatttttctaccacagtcattaagctctgaacccacactcaaaagattgggaggacattttgcagtaactgacgatgtgcattttaagtagttaggaatgacgcagctcttttttctttccaaacatttgaaagatgtttgtgaagccacttcacagcaagctattgtttgtccccaaataccagtgtcccctctagcctccctttggatacacatcaccccagttgccgtcctttccctgagttcacctgcctccaagttgagtgcaaaccacagcgcctttgctcagtagctggcctgcctgtgtacagtgtagaccctgcttcatggagcttctctgcctaagcgtttgcatgactgagtgctcggaagtcaatctttaaaatgcacagaagaaagagccatttacccaacctcccaagcaccctgcagatgtccatcctgaggctgtagatctcagttctgtgtttactgtgagcccatcacagcatctggaagaaaacgactggaactattgcatctttgtatttattacttgatgtaataaagcttattttcattaacaaaaagaataaatacaatcaggattgcattatagactcatagagggcactgaaattgtaatttcaaagctgggttcatgaaatgaagaagtgtactttttcttctttctgggagtcaatcttaccacacagatcttgtttgcctggaacttgaagcttgcaggagagtagttcttgtgcctctcactcctgagtgctgggattagaggtgagccaccgtggcctacttttcttcttactgtaactgcaagtctgagccgacctagacaagagcttagtgaagaaagccaattaaacacacagcagcacccccttgcagaagcttgcctccacctgagggggcagcagtgagcagaggcccagccaaggcttcactgttgatttagtttaagacttgcaccactgtgagagccaggagtccccatctgggtctgattgtcagtggtaaggtgggaaatgccatgtgc

SEQ ID NO: 18228 - DNA, 1165 bp, Mus musculus
cccgtcctgtcggatgtgtggcagcagagtgaccaggccattctgagtgccctgtcctgtcctgtcggacagagaggattggtttccctttccctctttggccactgggtttcctcctgcggttcactctgtaccggtcattgctctggaagtaacacttctgttaccgagttcatacgctgtgaagtacgcggaaggattcttcctgagcgctgagcttccttgaacttactcaagtaccaaaatggcagttttcaccttgctgtgcaataatctttagtttctccatctcttatcccccttgttttttttttttccttgcttttagacttggtccagctgagcagtgcggtgtggcctcaccctgtcaccttgctgcctttgcctcctgaatgctggggttacagtcagtcccccaaacccaagcccaaacccagctagtgtctatctttcaaactcatgtctgtcctcaaaaatattgtgggtatgcttgtaagcttatttatatttatgctaaataatctgtgggactgtgttcgagtgggtggtgcagaaggcattgctgtcagaatcatgtgcatgaaaagtgttgtaaaggaagtgcctttaataaatctcatgagctccagaaccgcctcctaatccaggacctttcttattgaattattttcattcacttcatcgtgatttaaaaaatgtcactgtggctctgcctgtctactacatatcaattaaataggaaacactagattcatgctaaaatcattgtggccactgtgtcgcttttcttgcttgttcccttctagaggtggggaccgaatccaggtgctgtcactaagctaccacgtagcccctcctttctccctcctgaacaatgtcccaccctctgggttggctggacatggatcagccttatttcccagttctctgcttggaagctgggtgtgcgttttatgcactgaacactgtactgcaggccggtgagtaactacaccaccttaaatgaggcactagctgcttccttcctggttcctcatctgcagaaggaaaagtcccaccacttcatggactatgtccgtgggcactgggtgacagagaggaaggagggcgcttgcccagtagcagatgataagccaatggtagtctcccttctgtaacgagcagc

SEQ ID NO: 18229 - DNA, 1115 bp, Mus musculus
aaaaaccatcctctttatccacctgtaacaaggctgtaattccattaagtgattctgtgaatgtcttctctagtacagtgttaaaattaaaaacccaagtgtttggttggtttcagtattagaaagtaagttcaattcacatagtctattgaaatttggggtgtgcattattcatggcctaaaacattctcttgtttaagctattactcaccaccttcacgtctgggtttggtatttgttcttaacttcttaaagttctgggccttcttgttccttctccctgtcttgatggtttcaattttagagtgatttatcatctagaagataattgattatgcattttatatgtcgtaagacattcaaatactaaacaatagggtaaacatccctgactttgcttttctttttattttgttaacaaacccaataccgacttccacgtacaagctatacatagatgtcaaagggttgtcatcctacctggtggcagagcttgtgtaacagataagagtgtgtattcagtaatgacatcagaactctttgtgaaattgcagcctttaatgtacattttgaaggggtgtattagtcagtattgtacagggatcttgtcatcaaaacttgctatgaacgctaattgccatttgaagctactgataggcagtggctctgctctaaaccactttttagcaattgtattttttcctgattatattttttaatgtactttgatgtttatgctgatgagtttttatgtacttttggtggtgtttagtcttatgaactcttctgacgtcagaaaagtcccactggttgtttgcagtctcattgtgtaatcagcctaccacaggcttccatgtataataaagtaattaatattgtgcaagtgtaaaacacttctgttataaaagcagtgtttggaaaataagaaattattaaaaatggttacaaaatactagttaattcccttttcccaccttccaccttttagctttagttagctaaagggtaccaacttgtcattgaaagatttttagaaatgtgtttaattcttttaatacactcagtactaaaatgtctgtatgtcttattaagtgcagtaagttctgttgggtaca

SEQ ID NO: 18230 - DNA, 2848 bp, Mus musculus
cttgctattaaaaggttaagaaattgagttcatagctattagagggaaaggtgagattgtgatatagaagatgcagtaaaggtatttgatgtaacttaaaagacagaagctgaccatgtgtaacacctgcctttttagtcccagcactggggaggcagaggcaggtgaatctcaaatccatattggtctacagaataattttcaggccagccaaggaacagtggaaccttgtctaaaaataacttttaaaaaaggttgaacatttcttgagatgttaaactgctttaagatttaagtgtatgaatattgatgaaatagtgaaaacaggaaagggtagaatgcagattgtatttatatgtgttctatacataatttacagtgagcattaagcatggggctgctcagtagaaggtagtatagtttgttgtcatagttactcctacacttggttgttggagtcgagttcctaagggacgtttcacgaaatctactatgactccagttacttgattttctgaacagcttgtttccccagatttgctggagctgataagaattttcaaaacccacttgccttgtctttttgcttttcttttatgagctgtatatgaatttgatttttgaatgtcttttgtttttaagactttagagtatggcctatgaatacagatagtttagtggaaagaggtcttgcccaaagcctgtagattgaatccttatctagtaccaagtaagccagcttctctggaccccggtaataagcactaaagaggtggaggtatccagatcagaagttaaggcgcatctctggctacataggaggtttgaggccagcccaggctactcttgtttcaaaaagtaaaaaggcatgagacatgaagtagtaagtgatgctgtgagttctgttgcactacagaaattcaacaattattgaccaattgtttgtgaggtaatttttaagtattgcaaacgtgatataaacatctacctcagatttcatgtactgcactagttagggagaagttcttgtccattttcatattgttctcattcctgataaacagcattttataattaccatttgtatagtgatttacatttaccatttgtatagtgtatagaggaagagggtagctgctcaaacctctaatttcataggtcctttttagaagaacttaaagaagggggaaaattttcaactacaaactatttttagagtaagacatctaaaggctgtcattttctgagtttagtggtcttcatgttttctggtgatacatagtgataagattccgttagtgcaggactgctagagctgtggtggggtccccagctgcttgaggagtcagatgtcatttgctctcctgattgtggagagaaggatctgggcagttgatacctgcttggacctctgagatgctagagttcctgagggattttgaggggaattatgttggtttttttatgtccttaatgtattgtttagaatgtacagcattgaaggtagcaccttgaaaatctgttgtcttgcccttaattttaaaaagaaaaactaaggaatttgagactacttagttttaatgaaggcatacactttcagaattctgttttcttggtttttgctttacatatttaaatgtgagtagcttactaaggttctgaaatccttaaaagcttatgcagtgaaatactacctgacagttctgggttcacagattagttgagcccacagttggtagagccagtcctccctccctaagagcacattagtggaaatgcatctgcacttagtttacaagtccgtcaataagtatatatcttacttacagagacatattaagaatctcttccttagaagatgcctatatacctaaattttattgtacaaataaaaagttaatgcctgaaatgtaatccagtacaaatttcttcatctgtagcttatctcatcaccatctgtggaatgcatttatttaggttatatacagccttggagttcagtgatatgccagtcaaataataagttgtgtagagtttgcacacttgcttataaccacctttcaaaaaactttcaggcttgacttgttttccatcaacaaaaatgttagcaagataatagccatttatgaaggttctttcattgtacaagaactatttgtggatatgtactgacagataggcaagcaagcacaaccagcccatacctctttatgtaacaagagtaagactatcctcaacgtagcccacgtatgacgagctgggctgaaatgtactgtgagaaagaagacttgaagagcatgctatattttgaaatgggtcattcttacgaagtataaagaaatagctaaggaaagctgatgatttaagacgttatgctcccaaggagaacattggtattgtctctgtgtttaagagaataaagaaagagtgggttaattgggtaaaggtcgagtattaagtggtatctcctaaaattaaggaacaggttttgaagaagcaaagggaatagaaatgttaccacaagattagtagggaaaattatccaaaagggtaaaggggatcttttgaaatttgttctttgtcgttcagttcagactaattgtggtactttggtttgttatgaactttagtactattgtggaacaattaataaataactcttcacagacagctgtggtgaacttgtgtttacattcccgagctagaaaaagacgattaacctctgtttatatattcaatctgttctttggtaaatcatgacacaacttccattggttggtaggaattttaaagttacttaattttcctggtcagtcaaaagtattgattatatgtagccaaataaata

SEQ ID NO: 18231 - DNA, 1181 bp, Mus musculus
atcccaggctctaactttctttaagaagagcatcttttaagtattttcagaaactatagtacaacatttagaagaaaaacattttaaattctagtccttttaatgaccaagctccaatgacagtatacgttaacatgctggagccaaatgcccagtattattagattaggatctctgttatgcagaaaaatgagactcaaggcctacagatgtgtttctgtttctgttgtgtttattaaggaattggagcatgacaaggtaacacacactcagaattccaactcttgggagtcaatggcggaaagatagctatgaacaggaagcctgtgaacttcagtgaactacaggccaaccagggctgcccagtgatcctgtgtctttaaaccaaacatagacaaaacctggggtatgccgtgcaatgagccaagcatggtaatactgtgacctgcctgtaatcccaggactcaggagcaggagactgaagcaggtaaattgagccttcgctacatgacttcagcctgggctaggtagcaataccatgtctcaaaaaaaaaaaaaaaaaagacaaaaattgtttgcttgggacatatatatggacgatctcatcctgtgtctaccttgttaacaactatttcctctgtgtgtgtggtgcatttgtggtcacgtgggggctttaggggttgtgcatgtgtgcgttagagcatgtggaggcaaggggtttacctcaggtatttttctaggttattcaataccttgtgttttgagactgggtcttttattgagcccagaagtcattgatttggctatcctgactggccagtcagcccaggagatctcctgtctccacctccccaagtgctgggatcgcaggcacacaacaccacacctgacgtttatttgagtgctagaaatcggaattcaggtcctccagtgggagtttattcccacatcccctctttttagtttttttttttcttttctttcttttttctttcttttttttttttttttttttttttttggcttttcaagacagggtttctctgtatagccctggctatcctagaactcactctgtagaccaggctggcctcgaaatcagagatccgcctgtctccacctgagctgggattaaaggtgtgcaccaccacgcccggctttttttaagttctttgaaacag

SEQ ID NO: 18232 - DNA, 1176 bp, Mus musculus
tttggttttgttgttgttgttgttgttgttttttttttttttttgagtcaggatttctctatagccctggctgtcctggaactcactttgtagaccaggctggcctcaaactcagaaatccgcctgcctctgcctcttgagtgctgggattaaaggtgtgcgccactacacccggctactaggcttttctttacactaatctctctctctctctctctctctctctctctctctctctctctctctctctctctgtgtgtgtgtgtgagtgtaatgtgtggtgtgtgtgtgtgtcggccatggtcagaggataacatatggagtagaaattgtctctctcctgctattatgtaggtcctagattcacactcagcccaccaggattggtaacagaagcctctgtccggccaatgatctatctatcacctcacagtctccactccattttaaatactgacttcttgccttctcgctcacgattacttagctatgccatgcatacagaagacatttccaaaaatgaacaaaaaagaactgtttttcagctctcaatggtataattatcccaccctcactcataatctctctctctctgtctctctctgtctctctctctctctcccctttggtttttcaagacagggtttctctgtgcattcatggctatcctagaactcactgtagatcaggtcagcctgcaactcagagatctacctgcctctgcctttcgtgtgatggggttaaaggcatgcaccaccagcatggccttaatatgatcagatttttttttatcagatatacctatatgatttttaactcattgcttcctgggtcatttatactgcccacttatccaaccagccctgaaacttcgttaatttttctgagggtgtttagcatctctcccttcccacacttctctccccactcctcctttacctcttcttcttctttgcccactttcacagtgctcactcacgctgggtaaaagttctaccactgagctacactcccagccgggcgtccctcttccagtccgcagtgacactattgccttcctgtaatccagtgttagttacattgtttttgtcatggctgctccagtttaacaggataaaatatcagaagcctggcaagctgtcacatgtctataattccatataggaagtggaggca

SEQ ID NO: 18233 - DNA, 1194 bp, Mus musculus
tggggaccatttttgcccgcatatacttacacaaaaaatatttatttttattttattttattttatttatttatttatttatttatttatttatttattttgtttttttgagacagggtttctctgtatagccctggctgtcctggaattcactttgtagaccaggctggcctcaaactaaaaaatccgcctgcctctgcctcccaagtgccgggattaaaggcgtgcgccaccatgcctggccaaaaaaatttttttaattaaaaaaaaaaaaattggacttttaaccctggtgcttggtaggcagcaagtttgagaccagcctggtctacaaagcgagttctaggacaggaagggctgttacacagagaagaaaccctgtctcaaaataccaaaacaacaaattttgtatgtgtgttttgcctgcatgtatatctgagtaccacttgcatgcctggtgccccgagaagctggaagccagtgttggaactcctggacctggacttatagagagttgtgagccaccactctgggagtgaatgctcttaacttctgagtcatctctcctgccccccatatatatatacacttcttaaaataattttcaaaaattttattcagtcttggacagatggctcatcaggtaaagatcatgtaaaatctgtcacctgagtccaattcctggaacacaagttgtcctctgacagggctggagaggtggctcgtgggttaaagagcactggctgctcttgcagaggagctgattttcgttccctgtactcacgtggcagctcacagttgtctgtacctccagttccatgagaatctaacaccctcctctggcttccataggcactgtgtgtaaaccatgtatgtacatttacatacatacacatttatatatgttcatttacatgtatgtaatcaggcaaagcactcagataaaataaaaaatcaagtaaattttaaaaagtcctctaacatctacacagatgccctccccatcctgtgtacatacacaattataatgctttttttttccattttttattaggtatttagctcatttacatttccaatgctataccaaaagtcccccatacccacccacccccactcccctacccacccactccccctttttggccctggcgttcccctgtactggggcatataaagtttgcaagtccaatg

SEQ ID NO: 18234 - DNA, 1105 bp, Mus musculus
gagagagagagagagagagagagcgcctagagcttgctatgtagggccaggctagctttgagatcctcctttctgcctttgcctcccaaggactatgatctatcaacataatttaaagatgaagtattctctaaagcaggcaccaggaagagcctttgaaacatgttattccaggtgtggaagggcacacctgtaaatcttgcagaggagggtaagatctatgagttcaagtccaacctggcctacatggacaggagtacacagtgaggtgaccccccctcctcaaagttatctcatctataatcatgaagtgcttatggctacatatctacatgaagtgcttatggcgttctgcctgcatgcgtgtctgcgtgagagtgtcaggtctcctagaacaggagttatagatggttgtgagctgccatgtgggtgctgggaattgaacttaggtcctctggaagagcagtcagctcttcactaattactctttagagacagggtattgtgtagttcaggctggccttgagcactgtctccttagtgctgggatcctgggctgtcctaccaggcctcctgataaatgaacttggtaacagagaattgttgatgggttagcgtttagctccgggccaggcattacaggcctccatacttgctagagaaatatccattctgcgaggatgggaaaccttgggctattctctgtagcttttgttcctttctgtctttctatttacctgctttgtttgaaatataaattgaagatgctcttaaaaaaaatggaacagtttccccattggtctctgtttaaattatttactgccctttcgagccgtatcttcattgaactatgttaaaagtattttgctgaaatgtttctttatgttgtccatcgggtttaatagacgtcccatttaataagctctctacctgtaaggatagactatttgacctctatgccctgctactgctagacatagtataagattgctttgtgaaataaagctgtcggtaacatcaacaaaataaaaaatgatcgtattccaatactctccgctgagtactctgacagcgctgaaatatggaataaaattgaaagtagatt

SEQ ID NO: 18235 - DNA, 1197 bp, Mus musculus
cagcacttgggaggcagaggcaggtggatttctgagttcaaggccagctttgtctacagagtgagttccaggacagccagggctatgcagagaaaccctgtctcaaaaaaaagaaaaaaaagaaaaaaagattgtgccttcatgtaatttacagataactgagggaagcaggtattcaatactcaattcatgaatatcttagtaattactcatataattctaatatcgcagtggaagacagaggtagcaggtaggtactggaaggaatttgatctagcaagacccttgaggaaatgtggagttgtatctgaaagatgaagtccagcatcaaatgggagctgagcctgttcttccacgttcctgggacagggaagtcagtgcctggggagatcactcaggtcagtagcagccccgtgctagaggagactggggccacacaggcggacctgtgtgggctgtggaagggagttccaggttcatctcccagaccagaagagtttgcagcagggagaggggctaccatttgtttctttgttgctcttcttactacagtgaaaaggatggatttgatatgggcccaaggtggatgtgaggagcgggatttggggccactgcagggctcaggtatcatagatggaaaagctcaagacagaggatggcagtggataggggtggtgtggaaagattcaagaggttattgggaagcagaattgaccaaaagcatgaatgaattaaagagaggacagttgttccatagtccctgagctttgattttggagcttaaggaaggtctgtattgatggggaccgtggataagaccagagtgggtctgccctgggaaagctgagtttggagttgacattgtgggtttaatgttgcataaataaataaataaataaataaataaataaataaataaataaaataaagttttaaaaaaagtaaattcctttagctggacttttataagaattgaattcaagaagagttaggagcgggcatgctcaatacctaccattctctcatgaaaccgggttttataggcgcgggttcatttattcctcgtccctcatcattttatgtttaagagcaaatgcacttaaaaccactgtttggaacatcgcttttactaaagaggggaccactctaccatcagtgtaattgcttcggcactgtcttcatgtagacagacttgtg

SEQ ID NO: 18236 - DNA, 1183 bp, Mus musculus
tatgtcagacacataggtggacaatcaatgccgactagtgtttaaagatagctcgaggtcatctggccccggaaactgcaacattccagttctctgcaagcacacagttttgatcagccaatcagtgttgtcgcgtctctaatacaagcgtgacatttttttctgcgaacatgagctcacaatttggaggatgaagtgaggtgctgctaggagacactttccgtgggcgttttgcagagacagtgttgttgttgtctggtatggggtgtggcagctttcccatcatatcccccccccccccacacacacacacacataggaggctgaagaaggggaaaatcacgtgagcccaggagtgatttctgtggtggacagagcatccccttcttgtattgttttagacagggcctcactgggcagccccggcttcctctaactccaattgtttctggcaatgctgaggacctgcgggagggtgtggtcccaaggggtttcctggggggggggggggggggaggagcgttgctggtaaagtgtaacaatgtaacaagcagaaagttgagactgcccgttggggttgggggtggaggattccctctgacccggaaggaaggaagggtctctcagtgttctttcctgaagctggcagcgcactgaggtagtgtgaaggatgggtggacttttcatggctcttggcttctttttacccaggggcctaggtagcaattgtgtccaggttctaacgtggacctacaaagtctttttaattcaacaggcagatccttagatgaaaagtctgttaatctgcagggtatctcagtatgtcatgggggcaattagcatgaactaccaacacggtcttagtgacctacatagctgtggaaacattcattgtatattcccagtggtcgttaaggagaaatcctgtctcaaaacaaaataaaacaaaaacccaaaaacattgtggagtgttggtgcttaatgcctttaatcccagcattcaggaggcagaggcaggcggatttctgagtttgaggccagcctggtctacacagtgagttccaggacagccagggctacagagaaaccctgtcttgaaaataaaaagaattctttttttctcatgtaatctattccgattatggtttcccttccccttgttctgcccagctccttcgcacct

SEQ ID NO: 18237 - DNA, 3676 bp, Mus musculus
aaatagaaatacaaaaggaaaatacagccaagtgaagtcttgtctttcctttttccttttttcaatgcagatgtgaagaacctggagaacctgcagctggtggaaggtgtccaagagcaggtgaatgccgccctgctggactacacggtttgcaactacccacaacagactgagaaattcggacagctacttcttcggctacccgagatccgggcaatcagcaagcaggcagaagactacctgtactataagcacgtgaacggggatgtgccctataataacctcctcattgagatgctgcatgccaaaagagcctaagtccccacccctggaagcttgctctaggaacacagactggaaggagaagaggaggacgatgacagaaacacaatactctgaactgctccaagcaatgctaattataaacttggtttaaagacactgaattttaaaagcataataattaaatacctaatagcaaataaatgatatatcagggtatttgtactgcaaactgtgaatcaaaggctgtatgaatcaaaggattcatatgaaagacattgtaatggggtggattgaacttacagatggagaccaataccacagcagaataaaaatggacagaacaatccttgtatatttaaactaatctgctattaagaaattcagaagttgatctctgttattaattggatttgtcctgaattactccgtggtgacgctgaacaactcaagaatacatgggctgtgccttggcagcccctccccatccctcccaccaccaccacccccacccccacaaggccctataccttctgacctgtgagccctgaagctattttaaggacttctgttcagccatacccagtagtagctccactaaaccatgatttctggatgtctgtgtcttagacctgccaacagctaataagaacaatgtataaatatgtcagcttgcattttaaatatgtgctgaagtttgttttgtcgtgtgttcgtaattaaaaagaaaacgggcagtaaccctcttctatataagcattagttaatattaagggaaatcaaacaaatctaagccaatactcccaacaagcaagttagatcttacttctgctgctgttgctgaaatgtggctttggcatggttgggtttcataaaactttttggccaagaggcttgttagtatacatccatctgtttagtcatcaaggtttgtagttcacttaaaaaaaaataaaccactagacatcttttgctgaatgtcaaatagtcacagtctaagtagccaaaaagtcaaagcgtgttaaacattgccaaatgaaggaaagggtgagctgcaaaggggatggttcgaggttcattccagttgtgacccgagcgtccccaaaacctgggatgcaaagacagtgattctgcatatggcctggaaagacaggaaagccagtctcctacaaaggggaatggaagatcctggcctctaagtcatagaccaaagtctgctgtagaacaaaaaaaaaaatactggagggcagagatagcaaaccaagtctccaaacaatgctgtcagtattagcatgcggtgccgtgggcatggaaaccttgccttacttcctggtcctaaaagggagctgtgcagatgtggatcaacatttgttgaaaataaagtattaatactttaaaagtcaaataaaatatagtgtttacattctttaggtcctgggaggagttgggggggggggactctgataatacagatagtaaaagcagtaatttctttaatgttatttttctggttagtaattatttttaacagtacttaattactgtatgtcgtgagacactaaaatcaaaaatgggactctcattttgtctttatttgttaagattaccagcagcacaatcatttgtagaaactgtataaaaaaaatctcctggtcccttaatttttttccacaaatgtttctggctttggaatagtttatttatattgtatatcatagtttcaactatagacaattacaatgctaatttattgttccttgggttcccctttgtataaaatagagccaagactgaagaaaccaaatatatgtgtttactatagcatgtcttcaagttagtgaaacatagttcaggggtatagaagggtcttaatgattaaaaccatccacttgattacatgtctcaaaactcccacaatccatctgtagtttatttaatatccattgtaaatcatgtgacttacaactttttcttggttttaacgcattttaacattgaagagtcttacctggttttcctttccaaacattgtaagttgtataccaaagatattagtttattacttcagtgtgtacaaaaaaattattttattacatttcttaatggcctctaatatccatccacaggaaggacgcacactagctgggttgggattgactctcagtgttatcttcatggttctagggaggagaaaaagtcatcagtcaaagctcagatccaaagccttaaaccagacagagacagggctgctcctcccgactaaaaaccaagtggttaaaggcacatgagagagactggagatgtcagtggttaatgagagagctctatcctggatgttaatgtgactagaaggatggctattttgagggtttttgacattgaaaaaaaatccatgtttccttattttaaatatatagtactcccccactgactattccacctaaaaattgtagcttttaccctgagcatggttagagaaacaggcgacagtcacatccataccaaggacagaagcagtttgagcaggtgtctatatggtaccctgcatccggggccctttgggaactggccggttatctgatgtcagtaggtagccagtttgcaacttagccagctgcctcattgattctgagatttcctaataaaggcagactaaagacgaagggtcttcacctgagccgggtttcccgtagctggtctctgtagagagacagtctgtgacgtccgagtctttggactgtggctcctctgcatctctcttggacttgtatccatgcggtgttccgagtgtgaagttggttacttgttgacgttttcttactgtatcagtgaaacacacattgtcatgtcggttcttgccatgaatttctcaatgaaatggattttttttccagtatttcaataaatattgatatgtccacctggtaactttttaaatcctttatgttgtccttgtgttgcatgcgagagcatctagtaattaaataacacagctaggaattcaaataatttcacaatgaatgtgctcattctgtctcccgaccttccatctaagactccatatgtcaacaaacaactcagaatattcagtctacaggccacagttccagtacaaagtgtcatttactgaaagcagctggcccagaattctttttgtctaccaaccactgtcctaaggtgctttttattaaagcctcaaaccaggcagtggtggcatacacctttaatcccagcattaagaccagcaatctctgtatctctgtaaaatggaggccagcctggtctacaaagcaagctctaggacagcctgggctacaaagaaaaaccctgtctcagaaaaacaacaaccaaaaaaaaaaaaaaaagaatcctcagaacagtgtttaaagccctt

SEQ ID NO: 18238 - DNA, 1192 bp, Mus musculus
agaagcaagtttctgcagcttcattgctctgcaaaagcgacaatgcgcaaattagcattgctaagcctagcaaagggaggtgtacttacatacagcaagtcactgtaggagtgtgccagtcccttacagcctccaaattttgccccattcattaggcaaaggcgacatttgagaacagtagagagaggtttaaaagacatttgaggttaacatttgtatggttcatgtttcctttctgatctgttggtttttggttaacagtggtcactttaaaatgttaaccaaaaaaaaaaaagttggaaactgaaaaataataaagcacatgtttattgatgcacaaagatgctctcctcatgtttaaaagtactcctcttcaataccacttgagtaaacattattttatattttatctgatatctggccaccaaccacatcagcaatgcttttcagtgcagcagcattaaaacctatattgggaaattaatagggcatgtgttcatgtttctcttttttttttttatttcagtgtctcaatttaaaatggtgaattactcctatgatgaagatctggaagagctatgtcctgtgtgtggcgataaagtgtctgggtaccattacggtctcctcacgtgcgaaagctgcaaggtttgccttttctgtgctacctaaaaaagatagaacggtttgaccaaacccatggaaactcttcaaagttaaacctgtttgtttctttctttcttttttcaactggaaagagtggggtggggtgaggtgggggaagtgtcatagagcgactaggacttacagtatgtctgatttagttccaaaggcaggtaggtgcctatgctgtagaaaactgtcagactggtggctttaaagtagtttattgtggtgcggtgctgtatctatagggggacattctaacagtcctaaatattgattttgcttgacttatatatatttaaagcatccttgttaaaaggaaacaggacagagtacaacccaagtgtgttttaatttgagaggaatctgtgctgcaagttggaacatttttctttagtccagaagacatgaaggtctgatttcccaactgcatgatttcatcctgatggattctgaaaataattttaaaagatttttttttaatcaaggtatcaagaaaccagattttagtttctaattgaacaatttt

SEQ ID NO: 18239 - DNA, 1234 bp, Mus musculus
gggaagtggggattgccctggcatattttccccaggcataaagcccaggatggggtatttattaggacactcttttagggtattgaaaatctgcaggtttgccccaattcgggattggcagcccgccctctcacggaagcggaggatgtccccacccccaccccctgcagctgcctacagtgcttatttgaaacaatcaatacaaagagaattttttttaagttttttttttttttttttttttttaaccagggaagatcactggctttaagttcgtgttttgttttgcaaagcttggtctacaaggtgcgctgaagttttgtctttagaaaccgggctgttctttttaaaacaaagcgctccgggtgagggcgtggagcccaggaaggaggtgggggggagggccagaacccacccagtaggcaaaacgcattattggctcaactgagttttgcagcttcacctgatggaatgttcaagtgggaggggtggaaaaattagggaagtcagagcttcagagttgataaattcgtttctcttttcccttgggctgtcacttcccttcaggggaagaatactttaaaacagagatctaggactcttcccgggcttcagaacgtagtatcatcagttcaatacaactagatacctaggaccggaaaggtaactttactcaattctttttctttccttccttcctgcttgcttgctttttttttttttttttttaacatcaaaagaaaaagagagaacagaggaggaagcgttaaattttgttactaagaaagatgttttccaagttctttgctaaattgggcgggtcgctccaagcttcatcttctcaggtgcgtgggacagcagtgtctactcctgtgcttctagcgctcagaaaacttcaattggtcctggatagtttggctcttctcccacccccatccccggctcagctgcagcctagagtggattacaaacgcagggaggactggcgcttcttaggtcaggtcaagggcaggcttgctctccgtgagcgctccaccgagcggcgcggcgcgcaacctcgggaagggagaagaccggaggagaacttgcagttgcatcctcgtgggtggggagtgcgagaccgcctcagctccagccagctgggtgaatgggggcgcgcacggccccgggaacgccgaggctggataaaatatgccaggcctgcgcttctcgggctcatcaaggctgcgggagc

SEQ ID NO: 18240 - DNA, 2430 bp, Mus musculus
ccttctatagctagaatagttagcactatgaacagtgctgaaggattatgctgttcaatattaaggaggctgattttaacttttgctttgtttcgttttcagctacgacagctagttaatatatgcatcaacccagatccagagaagcgacccgacatcgcctatgtttatgatgtggcaaagaggatgcatgcatgtaccgcaagcacctaaactgtacaagatcctgaagacggcaaccaagataacttaaaagtgtttttgtgcagatcatacctccccgcttatgtctgggtgttaagattactgtctcagagctaatgcgctttgaatccttaaccagttttcatatgagcttcatttttctaccaggctcaatcaccttcccaatccacaactttgggatgctcagatggcaccaagaatgcaagcccaacaagagtttttcgtttgagaattgtttcgagtttctgctgatagactgtgtttatagatagtcagtgcccgatggtgaagcacacacacataggcacatgtccagagcgatgcagaacctgaggaaggacctgggcatttgacttgtttgcttttaagtcacttaatggacgttgtagtggacatgattgtgaacttctgatttttttcttttaagtttcaagtacatgttttagttcttagcattagagatctcaaatataattcttataagacatgcagacataaactttttgagaaagatttaaaatttttagtttatacattcaaaatgcaactattaaatgtgaaagcatagaggtcaaaatgtgagttggacactgaagtctatgttttaatgcctttgaaagcctttttttgtgtgtgtttaaatggtataaatgaacccattttaaaacgtggttaaggacttgtttgcctggcgtgatagtcatgtttaacatgcacaaggctttgtgtttttattgtacatttgaagaatattcttggaataatcttgcagtagttatagttcaatttctttacaaatctaaatacacttaactcataactatacactgtaatgcaagcatatattgttattcatatattgaagttttgatcagttcctcttcagaatcttttttatccaagttactttcttatttatattgtgtgtgcatttcatccattaaatgtttcagattttctgagaatgagttccctttttaaaatatatttggtatgccaacacttttttaggattgaaaaaaaatttttttaaatgtttgggtcattctaggtgcatctgttttctcttgttagaaagaaaaggtgtgtgttaaaatgtgcctgtgaatgtcgatattgtttggcagggttataattttagagtatgctctagagtatgttgaacagcgtgaagactggcccttactgaagacagaactgttccaagagcagcattcccgttgagatgctttggagtaaagtactgtgtatgacgatgacagacattttagttaagggggtgaaaaaaaaaggaggggtatttaggaaaccctgaggtggaattttggtgaatgtcttcatcttaataccagccaattccttcagagaattgtggagccaaagaacagagtaatcgtggctgttgcagaacacggtgtgccatggtagagcattgggaaggctcatcctgccggtgggtcggtcagacagccctgtgttggggagcttgtactctggcccacagagctcctgggttgattttcttacagagtattctttctacagttattttcaagtaattgtaaattttcaaagtaatatctcatcttttaattcactatgtatgctgtcgtagacaaaggaaatctgggtttttttttgtttttgtttttgtttttttttgtcttgaaggctgaactgggtacatcccagatcttagtggctcataggatatacccagaggcatgaagaaatggcttccggtgaccatttgtgttgtgttatatccattgtaatgtcacaggactgattgagatgaaacatccccttcctacaagagttgttttctttccatatttaaaaacatgaggttctgcctggcagtgatggtacacacctttaatcccagcacccgggaggcagaggcaggaggatttctgagttcgaggccagcctggtctacaaagtgagttccaggacagccaggactacacagagaaatcctgtctcaaaaaaccaaaactaaatgaaaatacaaggcttctccccttgtagtgactttgctttatgaatttgtctcaaaaaaaaaaaaaatagagctggagggcttactggtcagggatggtcactttaactttgtacaagaagaaactttctttcaaatactttaagtccctcagttcatatccaccctcccccaccaaaataaagaatccattgtgtaga

SEQ ID NO: 18241 - DNA, 1157 bp, Mus musculus
gagccctacccagagatgagacaggcctggcctgggtaggtgagttgcttccactgctcagagcagaagaacccaaggccgagagcttgacatttgaagtggtgttagtctgtcacacctgcatcaggtttttcacagtagaaatctagtttctgtggccgacatttacatattggcataacaagctacggatatggaccaagggtagcagaaaggttggcagtgttggtgagggtgtacagggactgttgggatggggggtgggggtggggtcatgacagctttgccagtggtgaactctttgcccatgcatattctcagtgtaactactttttccccagtgactatcccacccccatcaacagcttggactaagtatactgttagatgctaatatcaaagttatttaattgacttcatagagtacacgatgaagccttatcaagaagaagatgtcaggtggcagtgtcatgtcagccatgttccttaggtttctggattcatcaagccaaaggggcaatacctgagagcacagcccattttatatcagctgtaactctttaaggtcccttcttatgtgctgtgtgaattgtttcatctgctcatacctcttctgttaagccaagatgtagtttaaggctagttattaccctttgtgcaaatggggttgagatgctccaaggtgaggatcagtctctcactgtttgttctggggcatgaaccccattgccacagaaaatgttcagttccataggaaatagaagccttgtttgctctgataatatgccctagctgtttttatacccaattcgcccatcccagttcaaggctgctgtttagaaagtaggagctggaaggtaatttcccctgactgtctcagggtagcttctgtgatgctgaagaattcgactcgcataggttgtcactgtaacttgtcaagattaacgagctaccctgggctatcaacgtgagccagcatttgctctaaaatctccacctgttcctcgagtctgtggatcagcatgctatcattgacatagtgcatccaagtcactcctgagggggactcttccatttctcagaaactgtgcatatgacagaagtcaggcctacctgtcgttagtccggaatcctgtcttggaaacctcagccacttg

SEQ ID NO: 18242 - DNA, 1099 bp, Mus musculus
taataccatgatattgttatgtcttaagggtgtctcagaatcaagttggacagcactttaccttcgtcctgacagacatggaaagtaagcagcgatttgggttctgcaggctcacatctggaggcagaatttgtttatgtattcttaggtgagtaattataatcaaaacatggctacaaaatagattgtgtctttgtccagctatatcatgcttgagatctcaaaaaataaaaacaaagcaacttttcttaattttttaaaaaaaattctttacttgttcagtctaaatccaaggaaggttagaaatagtctcccttctgtaccacatacagagtaaatcgctttccagtaacataattgaattgttcttaaaagaaagaataaaggattagttattgtgatttatttctgaaaatcaaatattaacatgggagttgtgatatgtgtaagtaggacaacacttagtaaagttaagatgcttttttctgtcattgatacacatgcagcctttgtgactcaattgtggttttaaggcaaagattgcaaacttgtagttgggaagaagttagagaatattgttaggccactgggtgttttaaaaagcttaaaagatgttgttaaccttatacattttaggaagttctatgtaaaatttatattcctaatttctttagataaatagggagggatatctgttcattgtaaatctttcctatcccagtgaagatgataagctggaaatagaaggggttttaggaatgtgatgatcttgctagattttatggtggcagttgaaataaaaggcatttaaacttagttcctgtaagatgtcattgtaaacaaagaatccagatgtaacctataaaaagtacaattctttataattataatatagatactgccaattctagattcaacagatgataacactcaatttatagtttaacatcttgtgaggaaagcattgtttattagtcacttttgtatggatgtgatacaaccaaacgacttatagaaggatgggttgtattttggacttagggtttcagagaaagaaataagtcattatcatcatggtagggaaatatggcagcaggca

SEQ ID NO: 18243 - DNA, 1163 bp, Mus musculus
ttctggaagtgaatatttatttattggtgtttccataagttcatagttttggatagcaaatacattttaaaatttcagttattgaaagattatcttcattgttcttttctgaagagcatacttgttacaaaatgtatttactatagttcatcatagaaaccttaggagctattttatagactcttcaaatagcctgcttttatttttcagtctacataaataatattttgaaaatacatgtttttagatatacttatatatatgtaaccttttggtaatatattcttttttgtgctaatacttgtgagattcttaccctgcttctggccaatttcaaaggctcctattttgggagcctcacttttgaatccttaaagttttttagatctgccgtgtcatctgacactctcccccatttaccaagtccagaatggtagtctgtagtcttcaatagtcaatgtttttttcttgtttttatttcaaattgtatagaacatggaatgtaatcttttcctcctgtgcttcatttctgctaactagcactcctgtttcatcacacctgacataactggactcccaacgataccggagagtgtaagtgtctgctttctacttctaaaactgttctgttacaaatgtctgtgaccaaggtggtcagcttagggacaagcacatacacttagctcctgagcatggctgtctgtaatgtgaggaagcgtcaaggcatggcttctaccagtgggaaagaatgataacaggaaaattttgccctttgcagtcatcttattaaatggcccattgaattttcgacttcctctttgtgagttggtttaatccttagtgtcccggttgttgatggcctgcttttaatttaatgcataggcattttattagatttgaggatattgtaagaaataatgcttattacattgttaattgtagctatattggaaatactttgtgcatctcaaaagttatacaaataggagcactcacaaataagtagaagtgatagatatcttttcatgttgtttgataactgcgggaaaggaaaagactctctttagtttttcttagaacattaaaataaatgtgttataaaccatcaaatgaaaggaaggtcagcaggaagggtcctgcagtcactgtattgactcaggtgg

SEQ ID NO: 18244 - DNA, 1210 bp, Mus musculus
tttgtcttgtaagatctctgccttttacaggtttgagagatggatctcttatgttcttgctcaaaaatatttcagccttttggctctttacccaccatcctctacacattctatgcattataatatttgcttcagacagaccctaagaatgtagctcatctctgttttgttgttgtttgttttgtagtggaagtctaacaggtgtagtctaacaggtgtattgccttgaggaatcaatcacaaaggtgtatttgaccacagtagtaaaaaggaagcctgctccgatgtaaaacctacatgttttctttaataatgaagcaaaggcctgcgtataaatccaccttctccattgggtacaaaagatggtattattagaagtggcattcattaaaaataattaaatctaatactatctgctgacataagcacagtacattctactgtcatttaaaacattatctactctatacaagtatttctcaaacgactgctaaatgtataaaatgttttcccttgtatccatgtgtatggtagttcaaacagttcttctccctcgtgcagagaaacctgaccgagtactttgttgccgtggatgtcaacaacatgctgcgactgtacgccagcatgctgcatgagaggcgcatcattattacctcgagcaaattaagcactgtaagtccttcacacttgcgcctttgactaacacatattgagtgcttcacaaaaagacctaaacacgtctgcacatttagaactgtgctctgtgtacttaaaagacaatatctacatatttttaatatatggtttttatctggctcttgaagtataaaggcctgatttaaagaaagcttcgcagatgcattaagtcaagttaattatttttccttatcaagagaaaaggtgggtttttttccccccttttaaactctctggagttcattttagtaccttgatcatgtagagaactcttaagagctattatgagatctttattattcacttgtagctttttccattggagctacttgaatgacactgtgggccatgataatagctgctcctaaccaggtaatagcagattcatctttgtcgcctcgcagggcctaggagggaatcctataatagttctggtttggaggagctcttcaggctgataataacttaaaagtcaaagtagcatttttatcaattgcgggttttatggcactta

SEQ ID NO: 18245 - DNA, 1206 bp, Mus musculus
tgtacatatatacgctgcccctctgaacagacatttccatcagagctttctgagtgtgactaagtgggagatggctgggatgaggtgcttgtgaaacactttgcaggaaggcatgtgtgcagggtgctgctggtgctggtgtggtgctgggggaggagggggagagcagggaaaggagggggagaaagaggaataagaggaggaagaggccttttaaaaactctcagcactatttcccctgtctcacagtttccctctttttccagggaagtgtgcacccttttctggctgagcttagcagcctttgtcttttaaaaatacacagttggccttcacttcatacatcaggaggttttatatgacagccatggcatcctgttagtggtgcattcagttaccatgcagattctaccagcttggctcctacaatgctgctcaccacagcattgatcttggaggatttctggtacctcaattaggttttatatagaaggatgatgacttgattttgtgctattgattataaacatgaagtttaagaaaagatctatctgtctgtctgtctatctactatctatctactatctacctacctatcatctgtctctgtctgtctgtctgtctgtctgtctgtcgtcttctccgttctttgcccaaactgctgctgaagataacttgatttctgtatttgtatggtttcttctttttttaattcttatgttggagtttggcagcatttttcttttgatgtgtgccctctggttataaactgtcaagcacctgactgtagataccgaactcaacattttcacagagaccttgtctgttttgataatcataccttactacttagggctgacttggtcaatgacctcatccactcctgcatcttccccagcagagacgcctagatcctgcttctgcagctccttttctctgacccctggctccattccagctgcccactgtcttagttaagggaacgatcacttctcatggacatttctttcagtaacatatattgatcaccaacatctcaatttgcataagatattatcagtatcatctctgtaacagtgcatagtgtgttagtcatcgttatgagcaaataatttaaaatgatttaattatcactcattatgttataagtgttgttgatgtctaaagtagatagttgaaaaagagatcttttaaaactcaggcaaa

SEQ ID NO: 18246 - DNA, 1155 bp, Mus musculus
tgtatttactcaacgtttttatataacaagtgcccattcatgtatagatttacaaggagaatacattttgagtatagtttattcttagactgtttcacgtatgaatactggcacctctcagccatctcccagtcacttttcatctcccagtcagtcactgaggcccaccaaggcaccaccaaggctttttccacaaacctgtctttgggattcacttccgtgagtttgtgtcatctgtgtgatgagggacttggagctctctgttggggcctggtgggctcagttacaagtgcataactctcctagaatctgtcagtagtgagtgagcgagtgagtagagtagtaagcagggcctccggagcccttccccttccagagcccactgcagaaagggccagtattgtgtaggcccagtctgggaaaccagggtacttttttagaatatgggaaagtgtctatatattatgatgtctactgtttttttttttctaaaacacctctataaagtatattatatattttaaagcaaaacatgtcaaacaaaatactgcttaaatcaccatcctctgactgtagtttgagtgtacacaaagccaaaagtaaactcacaacccatcctgtgtctagtaacatgcctgtcccactgtcagtaccttctgttttagtcatggtagtctagaggacagagattatagatgaaactctgtccgtgcctgtaatacttatcctgtgttgctgtagtttgtctcttttgcattcctgccttcacctttgtgaagcattccctagtttcctatgttccctagcccccaatgtcattgaatctgcagtatttttctatgactgtgttttcccattttgttaagagtatattgatcatttgttttgtgtcaggaagaatcactttaaatagttgaatttcagctactttcatagggctgagaatcttagtgaagtaatggctagcaaacagaagatatgaaaaatacttaataagtggaaatcagagaaggctccatccaggcaccagctcggcttctctgcattcggtgatctctatggatgttgtcctgggcagtggcactcctatgtccacttgctgagagtgaccctctgccctagtgtcagcttgggttgttgggagagctccactgg

SEQ ID NO: 18247 - DNA, 1170 bp, Mus musculus
taacagatcagccaatcaacatgaacattttacattttagaacgtctaatgaatgcataatatagcattttcaggtacaaatgataaatcgttatttgaagatcttgctcttgagagtgaattcctcggatcgagcactgagaccatctgaaaatgtcacaaatgcaggaacttgggccccaacactccagaagctctggagatccagagtctgcatctttgcaacattataaaccacgtaggagatgtgatggacaactctcgatggttcttttaaaaatgtgatagttgccttgtggatgcatggtgtgactgttcacctatatatctatttccagctactactggagaagctaggaagtgttgattctttttaaaatgctgctttgttctttttctccttgttctaatttgtcaggttattggatgacattcaaagctttgaaaacatatgtctaagtatttgttataaaaaattacattgttcctttaaaattattaaagagacatatttcaaatcagtaactcaacttattgtcaacttttctctccagacacacttgaaaaggcctcataagagcctagatggtaccctgtatgatgatgatgatgatgacgatgacattgaacgggcaagcaagtgagtccagcactgcgggaccctgtgcagtggcatggtctttaggcactagtaaagttcatgtttgctccctctcaatgttcaccaacaaacagaaatggcactcctttcaccgccgtgaggaatgaggcttaggacaggggcagggcatgatagacttgaaatgtcgtgttcttgggaagcagagttatattcagaggtgtccaaggagtgggaaagatgacagatgaacactaggtcaggttgtcaccccacactgagagggacaggtgacatggggacagtggtaacagtccagtgagccaggggagggcttaaggtgaaggcaccatcacaggaaggaaggaggtttagaactgtttcttgatacaaagaatggagaattgtataaacttcatttttttaagcaattttaagatacatagtaataaaatggacatcctacatatgaaataaacctgtctacataggagaatatttattcttctccaaaacaaataagaaaaggacaaccatatagaatatgaatg

SEQ ID NO: 18248 - DNA, 5786 bp, Mus musculus
gtagttactgtactaacctggctgagcatgaactgatcaagatgtcaaaactgatggaaaatagcctgacactgatgaaactgttaacccactaattgccttaatcttccagttatgctaaacatacagatgacgcgtgatgcaaagcttgaaagaggagttatcttgtcctgcagagcagtgatgcctttttctaccatgaactaagctcaccattcttttccagtttcaatgcactctagcagaaataatttgctttttatgaagacatgtagccatgttttccaagcaacgtgaatgtgtatatttacctttcagtgaactatattaagtgctgacttacaatgtgaagttaaaagcttctgcttacaaagaagcccctcaatggtcgatctcatgtatgtgttaaccatggttcaccgcccgaaagccaaatgccctgcagagtccagataggctgttgtcctcttctcttaactgacgtgctgtgaagatgctcatagccttaccttgtgtttgcttttttaaagaattaactttgtattttaaatgttcttctagatttgtagaaaaaatgcaaagatggtactgagttgctctctgccctggaccctgtctctgctgttgttagcatcctatgttagtgtgctgcatttgccctatcattgactcgctgtgtggtagtcagagctctgactgttccctgctgtcccctttctgttcccttatcgcctcagcgttctagagtatgttctacgatcatgtcttctgaggttcctcctcaccctgggacttcactttcttagtttgatggctttgaagttatcaggaatattgttcagatgtccagctcctgtactgtatatagtatttttctccttattacaccgaggttatccagctttgagggaggagatcacagaagaaaagtgccgttttcagcatctgaaggggtgtgctgcaagcatatgccatgttgtgttgactttgaacacctgctggggttctctattctgagtgtgtcccctgcaggcaagcaggaggggtgcaggcaaagaagagaggaagggcaggcacaatagaattatttagggcagagaagtatcaaaatgcatcctttgtgattctccgtggatcctgcctccctcatgattactctagctttggagcacacctgagagcacatgcagatccctagatgtgcaggtagtgtgtttgaacacgccatggttctagtctatacatcctcaagtgtgatgattacttttcaaaaattgtctttttttagtgaaaaaaaaaagtttgcaaaaccattgaagaattccagtaaggccatactctaaagtatttacttaaagaatataattttagctagaattttaggaggtttatttaacatagtccttaaaatatttacacaggtcttttttttttttttttttggtattaagtgctttattcagtcagctatgtcactagaccatgaatacactttcttaaaactgaaaaattaaaagttaaacagtataagctagtacagttgttcctggttgccttccagaagttaaaggtaactgcattgctgaagatatcatggacttcaaacccaggactgtgttctggcctaaaagcctcttccctggggactagctttcataatactgtaagaaactataaaaacttctcagagatggaagcatccactactacactgtttgacacacacaggtcattttttaaaactgcattccaaaatataactaggtagttttacttgaggtaatggttccctcttttgtagtggatggtggagcctgtccttctgaggatgggctcactatagaagggaagatttaatccttgtcttcacacaataataatatgcaaggttgtgagattgtgcctgtatgtgttgttcattagtcccagtttactgaaacaacaggagagtacacatggaagagctgatttcagcgggaagtggaaaagttattgtggtagtcacactgctgggcaggggttcccaccagattcctcaacagaatggagcgcttttaatgccatttttcaagtgaggtctctttttcacatcagaactcattgtctaaaaaaatgagagcatcctgactgcagcttaaaacactggcttccagtctacttccatggtaatcccatggccacaggtttgtggctctctaccttgagtcagcttgtgagatgttctactgtaacactagactatttggaaacatttatccactcacaaataatgtcctaagccacgaaagtgatctgtgccttatgtaacaagcaaaaacagctactttatgttaaaaagaaaaactgtacacattatttttaaatgtccagaaaactggaagcaagtaggtgcttcgcaccattaaaaccttgagtatttgaagtcagcttttaaatgacacttcccagtattatgatggaaacagttgtaaaaataagagaccatcaggtgagctctgaaattttaaaaaagggaatataaatggagtatttttttgttttgttttgctttgcccaaaccaaatcaaatataagttccctgctattgaaaatatgtgtttctgtttgcactgtcattctatatactgagcaccaacaactggagctcccaaaataaatctttcagacaagctgcttctgagcgatgagagacttgactaactcacagctctggctcccgaatcttgtgctttatacgcctctaaaggaaccctgatctgtgactcatcgagtctccctcaggctttgcatccaggccaggtcaggggctaaagatagaaggacaaatgtcggtctgcagttgtgttaaagtgaagacgttgccgagtaaaatgcatgggtgattacctagtcttgccaatcttactatcagcttatggcatactgacttttccaattcagagttagtaactccttcactgagaaaatatttattgacttttcaggagcaaggtataaaaattaaggatgtaagggtacgggaggaaacaattacccagctctggggaatcaattaaaagggaaaggaactgtaggtgttaaaataataactaataataataataataataataatataataaaaatacaataaggatgtatttgcttagatggtactcgctcaagaatcaacaccgagagatgctttttaaaaatagctgctttatttaaagtatgttcaaactacaaaatcgttaactcttttagtaattatatgagccactcactagaatgctgctaagatcccaccctaaaggacagattcagaggcactgcttggctgagtccttgctctgaccatccacacgacctgacattgtccctttgcagtactgatggccgtttcccccagttcaggagtaacttagagtatataaaggaagaacctagtcatgttgctgggagtcccgattttacatttaaaaaaaaaaaatcttggtaacaacattttctagggagccttttttttcttagctaatggtgtgactgttattaagatgctatgctgatatctaatggtgtgacccaggaatgcccatgaaatacttgttggttaaacaaagggaagattcctggtcaacagcaaatggctgtggacattcttgcagtcaacagctgtcccttctctgctcagatctccagttcaagttcatcactttcatgagtaaattgtctcctgagaacttcaggttctgggttggtgtcagtgagtctccaatctgagaagatatttgaaaatcagaatgaaagttcaaaatggaaactgaaccccctaaatgtaggctctccccaggcatctcttaatgttggtagtcagttttttagcagtctgattctctgagcattttccccacgttgaggccagaggcctattagtgtctgttttttaaagcttccaggaatagaaacgctttgcaacagccagttgatgttaggatttgtttataaaatagggaattatgtatattgagacagaaatattttattttgaaacataggattttgtgcaatatttttcttgcattgtttagtttatataaatatgcacatctgcttttctggcagataccttaaggtcatgtctttcagtatttgcctaaaactgtatgtagcaatgttctatgtgatttcagaaaaaaaaattactctttctattattagtagaagtgttcttgtttatttaaaataataatgtggagattgcattattgtatcataacgaactgcctcagccacaataaatatgcaataagaaattcctgttcctttgattagtattgacaatactgttactttaacagaaatgtttgtggtacagagtgctggttctatctgtgttcatttaacagctactctgcagcacaagaatctaaacggtatatttatgtgataaccatgtgtatgtagattatgacatcctttgtgatgagtctttgttgaggcttgtaaagggcattgccaatactttttgattgtaaattaatttttttgtatgatgtatagtttgtttagccttagagcttctttagatttctacttttattatacttgaatgaggcagaaagcactgtgggcagtttgtaactctggatgcaatatgcagatataccaaaaataaaacaaggtactgaacagcagcgctaatggaatgcgttataatccaggagttgtgtttttcaagccacattttagtgaaatgaagtaattgaagatatacagtcttttatctagacagtatagtctcaaatgattacctcttcaatgtgtcaaaggtgtgtgtcctttttaacttctgtatcagtccttagctgagcctagaggaccatccatcctccctcctcggaccacatgatgtctaggacagaacaaatcaactacattgtgcatattaggtgcactgtctgtgtgaagtcactgtgttttagatagagtagctttcataggtaattttgagaactctttaataatcatataccaaaaactaaaaactaaattttttaaatgagttattacttagctgtgcctaaaatctcttagacataaaggccacatgagggactcaggattgaatgtttccaaagtttatgttcattcctttagctaaagagttgtttgctcaacatataaccagtagcttaaaaaacaaaactaagcaaaacaaaacagaaaaccatgagcagcaagacactgagatgtgcttcgtggtgcttgccctcgagactacagtttatcatctctggacttaattacgattgggaagatgttctgtataaaattattgtttggaagttttttaatatgcaaaataaaatgttgaatgaactctgctttgccataaagtacccaataatgtcgctgaaaataaaattggtcacgatcaaacattgtgtgtggtgatggctcttctaactaaccagttgtcccctgtatggctaccggagaatggctttgaggactcagctagcttcatctcttatcctgtaactgctgcagtgtaaacttcagcctcattctttctggttgccctgtctgggtgccacctattctgttcggaaccatttatcagccttccggttgctgtggcaaaatgactgacatggtaacttgaaaggatgagacgaaaggtttactgcagcttatggttgcagggatattagtctgaagttctctgcgatcaggcagagtcatggcagtgggatcataggcagggggctgctcaccccagggcaaagagcacagcatagtaa

SEQ ID NO: 18249 - DNA, 1198 bp, Mus musculus
tcccgtcatcattcagaacagcaataagaaaatcctgcagtgtcccaaatgtgataagacatttgaccggataggtaaggctaacccctttcctagccctagtcacttaccccttgtgcctctcctacaacagtggtaatcactacaaactaaactttggaaggaatgtttaagaagagttctgaagggaacatgctctgattttcggcacatagtttaccttgttattttaaatttgttgtgaatcagaaataatttggtatttacccttttgtgttttcttcattttctcttaacagggtacaggttctgtgtttgggagaaagactccagactgtcagcagttattctatatagctttgacttaatatacctgtttaatcttagcagtgctagtagttttgagttacatgtacattgattatgatactgctaagtacattctgcacataaaatgattaaaacaactttacataatctgactttgtaaaagaaatcatgcagtttgatatatgactatcttgtgctgggttatgtatgctatttgcataggttaaattttgttttataagatttgtaatcatttcctatcaaagtaggtatagactggctgtacagtgaacatttttttttgcttttatgataccttttggatgtatttctaaggatacttttcagaatccaatttaatggttattaataattttactctttcatacacagagaaatgaaacaacttttgaataacttagtcaatgggaagactatatgtgcacaagaaacttgtcagtcctggtagtaaatggtcactagcgctctcagtatgaggatatacacagagagcagcttttgggggctgaggtacctgggaacatttaatctttcctatacatgtaagactttgtactccctgcttatggtatatacaaactttaattagcctgatttgacttggaaatcaatgagcaagggtcagttcactacgggcatacagccagcttgggaatggcttggatgctatccagaggggcttacttttatctaatgaaactgctggggatggggagcttaaaaaaaagagaatgacagagttacagccagatcatcttggcttcagtgtgaagacgaagttaggtaaggaaatgagaaagccaaggaggcaagaaggaagcagaggggcaaaagccatgctgcttgg

SEQ ID NO: 18250 - DNA, 1156 bp, Mus musculus
agagggatgcaagccagaaaagcatttcgccatgctttagcatccgttataaagattcagtcatattatcgggcttatatatgtaggaagacatttcagaacttcaaaaatgccacaataaagctgcagtcaattgtcaaaatgaaacaatcacggaagcagtatttacaaataagagcagctgcactgtttatccagcggtggtaccgttcccaaaaactggcctcacaaaagagaaaagagtacatacaggtgcgtgaatcctgtatcaaactgcagtcacactttagaggatgcctggtcagaaagcagttgaggttgcaatgtaaagctgccatttctctacagtcttatttcagaatgagaacagcgaggcagcgctacctgaagatgtgcaaggcggctcttgtcattcagagtttctactgtgcctacagagcacaaatcagtcaaaggaagaacttcttgcaggtcaaaagagcagctatttgtttgcaggcagcttacagaggctgcaaagtacgccggcaaatcaagcagcagtctacggctgctgttacaattcagagggtttttagaggccacagtcagaggatgaaataccagactatgcttcagtctgctgtgaagattcagagatggtacagggcacagaaggttgcttatgacatgagaattcaatttctaaagactagagaggctgtggtttgcctccagtctgcctaccgtggctggcaggttcggcaacagctcaggaggcaacatgaggctgcagtgaagatccagtctacgtttagaatggccgtggcccagcaacagtataaactactaagagcagctgcagcagtcatccagcagcatgtgagggcacgggctgcagggaagaggcagcacttggcgtacatccagctccgtcatgcagctctggtgtttcaggctgcatggaagggaaagatgctgagaagacagattgcccggcagcatcaatgcgctgccctcatacagtcatattacaggatgcacattcagcgcaggaagtggagcatcatgaaaaccgctgcccttcagattcagctgtgctatagggcttacaaagttggaaaagaacagcgccacttatacttgaaaacaaaagcagctgtagtaactttacagt

SEQ ID NO: 18251 - DNA, 1753 bp, Mus musculus
taggtctgctaaattaataaatttcaaaaagggttttatctactagtgttcttacatagatttgtcaagaaataaaataattaaactaaccttttcctgtgggagctgccgggtagagaggagcgtggccttctcctttcccgtcatggcttgtgcccgtcccctcatatcggtgtactccgaaaaggaagagtcatctggcaagaatgtcactttgccagctgtgttcaaagctcccattcgaccagatattgtgaactttgttcacaccaacttgagaaaaaacaacagacaaccctatgctgtcagtgaattggcaggtcatcagaccagtgctgagtcttggggtactggcagagctgtggctcgaattccaagagttcgaggtggtgggacccaccgatctggccagggtgcctttggaaatatgtgtcgtgggggacgcatgtttgcatcaaccaaaacttggcgtcgttggcaccgcagagtgaatacaacccaaaaacgatatgccatctcttctgccctggctgcctcggccttaccagctttggtgatgtctaaaggtcatcgtattgaggagattcctgagctgccgctggtggttgaagataaggttgaaggttacaagaagaccaaggaggctgttcagctgcttaagaagcttaaagcttggaatgacaccaaaaaggtctatgcctctcagagaatgagagctggcaagggcaaaatgagaaacggatggcggatccagcgcagggtgccctgcatcatctataacgaagataatggtatcatcaaggccttccggaacatccctgctattactctgcttaatgtaagcaagctgaacattttgaaacttgctcctggtgggcatgtgggccgtttctgcatctggacagagtgctttccggaagttggatgagctgtatggcacttggcagaaggctgcttccctcaagagtaactataacctttccatgcataagatgatgagcaccgaccttagcagaatcttgaaaagcccagaaatccaatgatccctccgagcaccacgcaagaagattcatcgcagagtcttgaagaagaatccactgaagaacctgagaatcatgttgaagctgaacccttacgccaagactatgcgcaggaataccattctttgccaggccagaaatcacaaacttcgtgtgaaaaagctggtagcagcagcttctgcactggcaaccaaatccgagaaggttgttccagagaaggggacttcagacaagaagccagcggtaggcaagaaaggaaagaaacctgtggatgccaagaagcagaagcctgcagggaaaaagatggttgccaagaaaccagcagagaagaagcctaccacagaagaaaagaagccagctgcataaaccattaaaaattgttaaattccagagagcaagtagagacagcatatttcaataaatcaaacatgtggtgacaaaaaaaataattaaataattacactaaaagtgaaatgttgtgttaaaggcagagagatcatgagaagtaaagggagagaaaaagcaaagcatagagaaaggagtggaggaccccaaacacccacagagcagcaaccttgcattcttacactaatacttacatattccaaaacataagaagaaaaaccagatagagttgaaatgacagcaatctacttattccaatcgaatacagttcttggcactaggtgataaatcaagaaggccaaaagtaa

SEQ ID NO: 18252 - DNA, 1158 bp, Mus musculus
tttattttatacttgaataacccattacagaaacaaacgtagaatcaaatataaaataaattgagctttaaagtagtttaacgataaaggaagttgatgttgggctttgaaaagttatttgagaatttttacttaaaagagaaatatagtagaatgaatttgggagctaggcaaacctgatgtgatttttcttcaacatttagctgctaattgcaaatgtgtagagaaccaaagttagattgcttctttcactaatggattgattgattgatttaggtgtttttggtggaattagatgcaggccagggagttggattcctttgctaggatggtgtgagttgacaacaggtagaatccaacttgtacaaagaataaatcctggagaagaggcagtggaagggagaagatggcacttctgtacactgaaagcttctataaagttggggagaaggggggattgagtgggaggccagtaccaaaatcattttttaaaatgcatctcttttacaatgactaacttgaagaactgagagttgactgctgggtgctagaaaaaaggcattcttgaatatactgatggtaggaaaagatttgatattctggagaacttttctttgacttctctgagctgcttgtttactgaatttgttctagacatggaaagagaacttaagatgacaccaaccatcttctgacagtgaggttagttaaatgctattctgattcttatctaaatcttcctgcttctctttcattgttagcatgaagtggttggtatgccttatgtttttggtggctaggtttttttcctcactttcctaccaattcctgattatgcagctgctacccagcaatattccattttcttcccagaagtgaccttatcttttcttgatagaggaaacaagccatggacttcaagatactgtattgcttaagccttgaatatacctgcgagcatcttttcttcctattggtctagtgtccaactcattagggacttgtatttctctacaacttcttcatgtttgcaggatttgccatcttttgtttcttgtatattcattttgtcaccctgtagttacacttttgtctcttctatgttcgttttgtcaccctgtagttataccctgtagcacacatttgtttgggtctttt

SEQ ID NO: 18253 - DNA, 3455 bp, Mus musculus
attaaagaaaactcaactttgtttacagagtttctcagcatacaaattatccttaaattatgtattgaataaatttcctccatagtgaagtagtcaacaactcaaacctgtaatattttaatgtaaaattacttgttaggactactgcaaaggacatgaactacctaccacctttccataaagatgtttggtatttgttcttaataactgaagtttaatttatagcggagtttggttaaaattagtatctactctgtgcatggtttattttctattttaaatttgctctgtgtatagtcaaaggcttctggattatacagtctttaactccagtaaagctaggaccgtgttttacgtggatcttgaaatcagactctttgtgtgcactaggatttcttgttttatttttaagatttaaaaacaattttttcaaggtagcaaggtaatgagtttcgtggtagcattttgaggatccatgtcatcgttcattgttcttttcctagccccggctctctctctcctcttgttttcttcttctttgctttcacatgtatctatttctttctctttttctacctcaactcttcttagtagctcttcttctcccttctgtatcatagtctttgtttcattacctatacatagacatggacataaatttaaaaaatttaatctcaacattgtgagcccttaagtaggtttatgaaaattttaatggataattataaaaataacaaaaaagggaaatgattcaaaaaaaaaaacaacacacacacaaaccatctgctctgctctacaagtcagtcattattcttctgtgactcagctctacagcagcacctgacccagtgctttgcgcattcaggcattcagtagctagttatatgtgtgaatggatgatatgttttcagcataagtccattaacacagctttgactttatttgatcttacaaactgagagcacagaattacagggcatgtgaagaaatagataatttaatgaaaatgaagtatgtgttattaagttcagcttcctataagttattagtggaagtactcctgccagctttacttaaaggagggttctctgttatttataatctcctaagttacagtaagaaaaattatatagtttttaaacagaagctcaccaattggagaaatagtaataattttcaaaagtttttcagaaaaaaagtttttttgagaaaggggtaagatccacctatttacattgttactggaagtagtaccagcgttaaagatcttgttttctcctcttttcatctatgtatgttttctgtgtgtatgtgtattttttgaggccactctttgcactagaccatctcttacattggtgatattggcctatatccccaaatgacaaaatcaaatcttatttatttaaggagtattttgctgtttaatatttaaacaacatttaatatatttcattattagtattatagcttacagtttgtttcctgtttgcttattgctttactaagtattttttagcagaggcagaacggcagcttatacaggaataaataattcatggtgacaaaaacctcaaatctttttaagttcaaggaactattattttctttgctgtgcagagtaggatacaatttaattattaaaagaaaagcatagtatgaattagtttacacaaaaaagttttcacctaaggaagattcactaataagtattgaagagacttttacctaaataaaaatttctgtgactcttaacccaaagtgatgagagtgctcttttttttggaaagtgggcagggattattcattacactgatgagctatgcaagattttttgacattttacagttactgagctggtcaaaattagtcatttagaacgtggctttaaattacgttggattttgtttgtcttactgttatttgttggcttgaaaataaacccagagccacctccatcctagggcaagcacttcggccactgacttagactctgaaccatgagttgtgaaattattaaagtacagaatcatagcgaaactagagaagtttatttttgattttagtcccctaccccagggaaagttcttaaagaatgagtgtgagtgatcgtatatgtacacacatacaagtcaaaagaattgccattctgttgagttcaaattcatgtagaatgttgagaaaaaaaatgagataaaatctatagaaatttgtttttaactgaaaagctggtggtggttttcaaatgaatgaaatttacattattccccttgaaattactgaactgtgttcattacccacttgtgttttattttcacatggcgattctcttcaattttatagtaaaatggagaattgactaaccttgacttagagaattggattagggatttaaattaggtcctacattttctggtgtattcatgccatgttttgaagtgtgtgttggccctaacataggttctgcactaacatgttggcagaaaaactaaagaaaaattgaagatgtacaacagttgtatagataattctttttaataagtacacagtaggttaattatgatttcaggtcattgatgttttagggattgtgtgttaggaactgttcataagagtatcttggaagttacaaattgccatatactgaaatacagtaagcattctatatgaataaagtttgtggactacaactagttttgtgccaaaattaaaaagatgggattatatgtcaaaattaaggaaactttccaagtattttgtattctgttaaattttgtttctattttaaatgtaagtaaagctacttagcctccaacttgggtcagacttctgaataggtaaccttatttccttccatggtagtatccaccgtcactgcttgcgtgatcattaacgagtgatgtttgtgaagcagagcagttcctgaatagagcttactttgaagtctctgttttctgatgaaatgttcccatactcatttcattttgggagctttttaaattgtgagctttattttacatacaacagtttgcagttaaaaatcttgggaatatacctaccgccccttaattccccctaaaagagtccaaacaaaacaactacagtgtgtgtgtgtgtgtgtgtgtgtgtgtgtgtgagtgtgtgtgtgtgtgtataacatacctaatgtatacctaccaagaaggcagaagtattgtgagtttgggatgttgttgtctttctgtaaagtgatttaatgggatttgtcaggcatagtatttctgttcaggaaataaagatgtttactttttggaaccaatgagttaaatccttttttcagttaataagttaatttctagaagtcttcataaaggcagcaggttttatggcctactgaacttataattgaagtatgtcgaatttcttgttattgtaatagtattaaaaccatatcccagtattttacatataaatat

SEQ ID NO: 18254 - DNA, 1157 bp, Mus musculus
aaatttgtgttgtcattataacccattattgtattttttccccccagatacatggtaaagcataaatcccacttgagattctgaatcatttaacccctccttttctgaaaccttggattacgaagcatggatacagcttgatctacagactgaaagcaagcttatgaattcatcaagaacttgcaaatgaagaaggacacagagtagtcttttataagaccttgtttgatgctgtgtgcttcaaaggggcaatgcctcccatccatacaagcaaacttttttggcttacaaatatttttttaatattagccttctagtctgtaatggaaattgtatattttgatagaagttttttctctattggttaaattagcattacttaaaatttgttctttagaaataaatacaggttataaatgtgtgtatatttaggagttattaggctcttcaagccatcttgcttctgatttttcattgctctgtggttccttttactggaaaatactgtcatgatggtattaaattttagactatagaacttcaaaaccctatcaaagggaagtaactatgaaatcagttgaaagtcagcctgtgtgtatccgatgtctatactaactcatgtttaaaaaggaataatgaaaaatcaagaacaagtcttcagtttcagttgaactgttcagccttttcaagatttcttttgtaaatgaatacatttaatgaatgtacattctctttgttgactttgatgattttaaacttaaagtgatatatttctatctggaatatgtttccacttgaaaagaaatcttaaaaaacaaagattaaagtgaaatagactgtagtgatttttacttgggaagctacagtatgatttggggggatgagtgtgtgtcaacatagttacagtgtaacttgaacctcctctaagtctgactatgattcttattttatatgcgataagattttgagtcttctatttgtacacatgtcaacttgggacttcttatcttccattatccctaaataatgataaattcccaggcaccaaagaacacatttgcttacgtgtctgaaaatgaaacaagataaaaacactggtatttttatgtgtgtgtgttcaatgtggtataaaatataaaacctatattttaacgtag

SEQ ID NO: 18255 - DNA, 2333 bp, Mus musculus
aattaatttcatttctgctggtttcactttactgtatatttgtattattaaaagtagggttaatattgttgactatgcgtaactgctaaattatatcagtgaaatcattacattgaaactgtatccaaatgatttctcaggctttgtttgaagtgtaaactccagccccattatgaccaaattagacttaaagatagtgaatgaatactaatgaagaaagctgctcttgttgcactgttctaaataatagaatatatatttggtatggttggtgaaatagcttttgttattatttaagttacaatttcttattgcaaatttaataatgaattctccaaaggaatgggatgaatggagttatatttgaaagaattggaagaaaagtattacaatctgcttctaaactatttgttttattacaatgacatttatttctataattggccaattgatggatctttcaggtatccagaattatgtctgcgtaaaataaattatagttatattaagagccttaaagtggggaaaaaggactcttttgactgccttaacatatgacaagctctcttttccagacatactaatttctttagggtctgttaaataagtaatgccttaagagtgtgctaatgatctgaagagtagagcttacagggtcttctagagcttttaattctacataatgaatttaagtgttaggtattatacctgattgcacattaataatttgaaataagaaaagaataatctggctatgctgatgtgtaataagtacatggctgcaacatcagtatattttatggttgcttaagattttgtattgttttgtataaccagttacccagaagctggacttcctggccataatatgacctccaaggaccatgttgcatatttaacactggatgaaaagttcagttgtatagctccaaaaagaactgctttttaagggaaatttttgaggcaaaaggcaaatgttttggttcaaacctatgagcaaagtcatttagagaattgaagatagtattaaaaccttgagactcttgcaataaaaatatcagaccagtgacttgtttcattgcattctcattttgcatttgctttgccgttcaaagcagaaaaatcttacaaaaccgaaagaatgctttaaaattgtcacgctggtgcttaaagatctattatgcttgatgtataactaacttgtttccaagaacggagcctggggaaggcttataggcctttcctagtacttgtgattattgattgtcaagtcttccaagtttgcaatgtaaataatgtgtaacaatgtgacattggtgttttctaatgaggagtggatgaatgcttcagttattacttctacttcatgataaaagttttcaccaatactgagaaatcttgatttttgtaaccttgcaaaataacctattacatacaagttgattgtctcttacctgaaatgcttggagcctcaagtattttaagattcttttttccaattttggaatcatctgcagatgtataatggaatacctgggatttgctgtatgagccttgtatgtgtcatgtgacagaaaatcatgttttaatggacttgctttggctgtgactttgcaattggtctatggaactttccacgggcattatgttaacactctcaagtttccagttctggagctttctaaaattttatatttccaaattggggatgcttaacttgtaagtcattccagatgtggagtgggcactacacaaactgtttgtcaccagtttattgtagaaatcgataggtgtaccaaataaattgtatgcatatcaaataactgtcttttaatcattttttaatcattttttaaaacatgaattttaaggttataatatgccttatatgtaaacccctgaagcagtcggttacaactcaaaagataaaaaaaaaatctttccataattaatattatctttttgatgtctctgtgtgtgtgtgtctgtgtgtgtgtgtgtgtgtatgtgtggtatatgtagttgaggactcttttccagttgagtaccatcacaggatgaagaaaattgattttaatcaaaatacaaatgtttttatctttggtgttgtgtttgagtatatgtgggaggcgggggaatgcatgttacaacacaagctgttggttctttccttccaccgttatgtggggtccaggcatcggatacaggtctttaggcttggcacaaatgcattaaccttctgaaactgggttttgctttaacatatgctaagtaccataacccccaaaactaaaaaataaatattgtatcctttaagctaagcgatagcacag

SEQ ID NO: 18256 - DNA, 3124 bp, Mus musculus
agccacttccctgctagacacagtagtgagaaatgtcatcagtatgtgcatgatagaaatgcactttggcaagaacaggagaagacagaaggaaggagacaaaagttgagcccaaaggtgcatgtactcagctagctcttgagaagtcttcaggatactgtagcttcctctgtagagaacttcgttttaatagacactgtacaatagtggtgttttacttcactgaatcacacctttgttctgaaagtgtgatacagagtataagtagcctcacatcatgtcacttgtatgagaagtgtttcttttcttaaatgtcttcattggaaaacgacagttttaataatgtccaaatactctgaggtgcactagaccatgtgactgtgatggaaatgaacctcaccaggtaaatttttatacaaaggggtttaaaaaaaaagacatttggttaaactaaattatgaatgaattttacaaattcagagttttctaagatcatatgaacaacagctttcttattcaatgaaaaagatgttttccttcagatgtttcatttgtacttgttaggatttgttactatttgggcaaaacagggtggaaatccctaagggacttgttgagtttatataggctgaggaatttgctttgtagccttgtgttggctgaacaacaacagtgtatcatgtacttccgctttcctgggtgtttcatgtatgtaactcccctgtccataatcctgacagtgtaacaattaaaactctactgtaaagacatagattttctgtacccctaaaatacctttaactaattttcatatttttctaatatttagtctgaagtctttcatatttttgccccctatgcattttgtgtctagtttcttttttgatagagtagagaaataatacagcaagctagatccttctagttcaaaggcaattttagagtagccatatcaaccaatcagtgtatgtagaaaatctaagaactgattttgtacaaattaaacttccttttcaccatattaaaatacattcttttcttgagcaattacatgttttcactgggaagcttagcatgagaatggcctattgaaacaccagtagtttttctcttgattcagtaatggtatctaaggtagtttatactaaaacgctaatttttatgtattactctttaaatattaaaggtttactgggggcttataaaccctttcaaaactagtatgtgtaggttacataaccttttaagtgtttaggggagtgaagttcttttatttgggagagaaaggggctttgctagtgtgaggatttatgtacatattttctttcctaagaaatttagtctcagagaataagaaaatgttcccttcagatgatttgagttaatgaagtttcatatgtagccattcctcctgacagtaacaaattttcagtgttattagcaaagatagtatcagctccagttctaaacaccattgcttctgatgctgttctggcttgaccactgtcacatcttaactaattctgatacattaaagtttcatgttcaagttgaatttaaagctttaaaccctagtaattacatgagatctattgaattctttaaacccaggatctaagttttaatatgatctaacttattatgaaatttacatgccatattatataaaagcttttttcttatttttaatgctacttagataatgcttttaggcaagcagagtatatctaggagctagtatttaacccataagggaaataagggtcacctcccggcagccctcctacagtataggtaaacctaattaaagagattaaaattgaatacagaggccaagtgtggtgatgcatgcctttattcctgggaaacagaggcaggtagatctcttaagttagaggccagcctgctctacatagtgaattccagaccagccagggctacatagtgagaccctgtctccaaaaagaaaaaaaggtttaagaggcagaggcaggcatttttctgagttcaaggccagcctggtctacaaagtgagttccaggacagccagagctatacagagaaaccctgcctcaaaaaaccattaaaaaaaaaaaaaaaaaaaaaaaagtcccaacagatagaaatcttatcttcaaattgcaaaacttcagagtagaaagaaaatttagaaaaaaatgtatttgattgataaccagaaaccagtctggatcttctggatgtgtgtgtgatggttattttgttttgttttgttttgttttgtgacagggtctctctccatagacatagtcctggctattctagagctcactgtgtagaccaggctggccttgaacagagagcctcctgcctctgcctcccaagtgctagggctaaaggtgtgcaacactatgcccagggtaaggctggatggttttggagaggggtctgcctctctactcagcattctggcttttagtctctcatccatgggacatgttgactttgtaagagaaacagtagaattatgaagccttttacctaatttagacgttaggaattgattaggaattgatgatatgcatgattactttaggaacctgtgaatgtgtgtgatttgtttgtttgttttgatttggagtaattctcaaacacaattatgtctctgcagcctatgttgctatggaatctagccacatagcaaggcattattacctcattaagcataggataccctcaagtggtaaacaagttttcttttccaaattaccactagggtgactcttaagtaaatagtacggaaaatactgctttaaaaagcaatcttaagaaaagtaaatgttatttcctagatactatgtaaatatttctaggatttagttgttactaataacacaaaacactaatcttttcatctcactgtttttgattagtggatagtccacgtattaaaactgttacttagtaactgttttcagggtgtgttaggaagggatatgctagtaagtagaactactccatcctttggagcttcttggtttttttttcatgtgctgtgtcattatgaacaaccagttcaacatatgtggtaaaattctgctctcctacaaattcatgtatcttagtctcagatcatagaagaaca

SEQ ID NO: 18257 - DNA, 1174 bp, Mus musculus
gcatacagttacggagttggaaattttaatgtgaataatcggaatgctggtctgaagaactgagagtcaatctagaataacatgttggtttacgtttaagagtatacagaaattgttttaactgtgtagatcacagaggagctgggcaaaaggaagcatgatctagtgtggttacctaaaggtagcttatggagcagccagcaaagtaactaaaatatggtgtaatgaataggcaggcagtgtagagatcttaggtaaaaaggtaaagccacgccaaatcagataccatattgtatagattagattgcctggaagtcactggggacttactctgaaaaagatgtggagatcaaacataattaaaattagtttgtgattaacatgattgtgcttacagtatttagagttaagatagaatgaatgagatgactctttttgaaaatggtaagtttgtgggtgattggcttgacattaagccctggggtacagagaaagtagagtcagcagttaggtagtatttcaatctcaggttgcatgtggaaataccttctcctcattctatttggagcaggaatgcatccagaacatgctacactaaaagaggagttctcagggctgccaaccttacagtagaggttgagtagtagtatatttctcctacagaaagagaaaagaaaattagcaggagttgactgactgtaggaaagaagagtcaaacgtgcttctggcttgggtggataaataaagtatcatttgaagaatagacttgataggaaagaaaattagatcagttttggacattacagaatttgaaatgtttacaggttaagtgataatttttcctctcaaaatctttaactgtcatttaaaaagttgacgttcagagatagtggcccaagtttattttgaaactaatgcagtctagggctggtggtatagccagcctggttaccgaagcctgatgactcctggaccatggaagaaggagctgaccccttctgaaagccacccactcgtttgtggcacatgtaccttagtattctccactcacatacacaataaaagaaagaaattagtggagtccgtaaactagctgctgttttcagtttcacatgtacagaaaacttggaatttgaaaataatttaaagttagacattttagtaatataagtgc

SEQ ID NO: 18258 - DNA, 1158 bp, Mus musculus
tttttgcttggtttttttgcttgtgtatatataaggtccatgtaatctgttgagcatactgtctgatggcaacactacggctatctatggacagcatatacttgtattagagattgaagtgagagtgggatgagcgttgcagaatttcagtctacaagccatctagaggagttaaagcttgggcagaatacttaaatatggctgagttgagaagagtaagttcaggaagaaggagttaggagggaggacaaatgattttgttgtagttatctgttttaggttaggctggttggtcatgctgccttaactggacttgtttgcagtcttaatggttactaaatttctttgactgtctagaatcttccacacaagaattttatcaagttcctgaaagtagaccagaatggaaactaaaagtttatgccatatgaaatagaatttgaagactacttctgtttggagggtatatgatcaactaaaaaaaaaattaaaacagactcataatactcttcctttttatattttataggtaattaataatgcttgtgccactcaggctatcgtaagtgtactactgaactgtacgcatcaagatgtgcatttaggagagacattatcagaatttaaagaattttctcaaagttttgatgcagctgtgagtagccttcttaatcttgcaatgacctatttgtgattgtgcttgttataataggctgcttttcaaaattgttttagatgaaggggctggcattgagtaactcagatgtgattcgacaagtgcacaacagttttgccaggtaaagaactgtatgtgtgtctctctgtctgtctgcctagcatctatctgtccctgactctctatcttacattttctgtctctcatttttgttgtatttgcttttgttgggctcttactgttttctttactgcaggcagcagatgtttgaatttgatacaaagacaccagccaaagaggaggatgcttttcactttgtcagttacgttccagtcaatgggaggctgtatgaactagacgggttaagagagggcccaattgatttaggtaatttgtcttctgttctggtatttactttggataaggaaaaaacgattttatattctcccttatgttagctgcaggtctgcttaaattttgag

SEQ ID NO: 18259 - DNA, 1178 bp, Mus musculus
cctaatactaagatggtgcacacattacctatgacttaattgtaagaacatataacaaattacacctagtttaaaagaaattaaaaattcaaattcatttgaggaaatggagtgccttacaaacgggaaaggagcagtggatggagcatctgctagatgggatgcagtatcaacttgggagactgtgttccccagcacagacttacccctgccatccatcctcactgactaatcaaaggcctcaagaaaatgtagttaacttcaaattagagctgctctcattagtcttggcttcagtagtgtgtacttacagtagcagcggtgtttatcttgtagaccttggtgagttggttttcacagcttatgtttttataaatatccttggaataggcttctttttttttcctatagaagattgttcagagaggactttaaaaaaccaatttgctaagctgaggggaaaatgttgtacctagaaaatacttgctacttgttttacattctttattatcgggagggatcaaatcttattcctcatactgtttatgagaatgaaggattttaaattgaatgatagaatgatagaatcagaaaatgtgttttattttcagattgaaaatatcagaaggaagcataattacttgcctttcattatggaattgttaaagaccttagctgagcaccagcagttaattccacttgtggaaaaggtaagtggtttcttggtgactattcaagctaggttagggtctccccagtccatcattgttatgaacatgaatggaggtaaaatatctggggcttttgtagatttattcttttgcttagtgttttgcattgtgtagttatttttttgcctagggttttgtattttgtagttttattcttttgcctgctgttttgaattgtaagagaagtaatgtagcctggtactttaaaacaaaaacaggtatcgccccactactgtatcagcccataattcttaatgtttacaacacaggttgttctgtattaaaacagtttttttctttaaacaaaaataaatttttattgttaataactgaaataataagtttttttccttagctaattttgtaaaattttgccttgataccaggatttagaactagaatggacattgatggggataaaagaatagtttggctagcacacaggtt

SEQ ID NO: 18260 - DNA, 1323 bp, Mus musculus
accaatctgtagaagacaaggcaatcaataagaaaaatgtaatatataacaaggccttaatatataaaatctcagcagacaaaagaacatccaagtacagaaaacaggtaaatcatttgcaatagagatagtgtgttcaggttaaacatcaccgaaaagttagaatggtgaagacttgaagaagatgggggtatgagtcatataagaagtgctttctctggggaatcaaaatccaagcagaaggtaccatgaatgcagaagtttggagcaaggaggatgcctgaagtatttatagggctgtcagaaggccagtttaagaataaagggtaatcagtagggagagactgtgggggttatgagatatgtgggttttgccattgggcaaagaatgaggttagaagactgcagtttagagtctctttaggttttcagatatttcttcacaatttgaacacttgacagttgtccctttaatttatttgaaatgctaattttttaaaaataaaggttcacctctcggtgcaataaaataaataaaaataataataaaattaaattaaattaaaaagccatctgttttgcggcatcatggctgccctccaacctctggtgaagcctaagatcgtcaaaaagaggaacaagaagttcatcagacaccagtcagaccgatatgtgaaaattaagcgaaactggcggaaacccagaggcattgacaacagggtgcggagaaggtttaagggccagatcctgatgcccaacctcggttatgggagcaatagaaaaaccaagcacacgctgccccgcggcttccactagttcctggtccacaatgttaaggagctggaggtgctgctgatgtgcaacacatcttactgtgctgagactgctcacaacgtgtcctctaagaaccgaaaagccgccgtagaaagagcagcacagctggccatcagagtgaccaatcccaacgccaggctatgcagcgaagaaaaccaatagatggcttgtgttcacgttttgtatttaaataaaatcacaaaatctgaaaaaaaaaaccaacaacaacaaaaaccccaagaataaagaaagggtaaagtccaagataggactgtctatataatatgcagtcacaattttaggctccatttaacattattaacaattcaaaaacagacataagaaacctttgttttgtattcatgcaaaattaagtataatacaaatgtcaacctcgattgcctcccagaatatgaagataaggccttattgctcaagaaataatgaatttcaggcacagggtttagaggagacaaatgggcactgata

SEQ ID NO: 18261 - DNA, 1209 bp, Mus musculus
tggagccctgtgcagagaggctctgcatgcccaggtggagaggtttgcccagcaggctggcaaccaggttgatgcctctgtcaccctttactatttcaatgcctctctatacctgctcctagtcctcaagggtaacaccagtaagaggcatcgagatggtcagaagttacaggaagctgacactatgtctgagcccaaggattcagacaaccagactgctagttgctttagacttgaactttgtgactcgggtgtatttggcatcattggaatctcttctgaccaagcatatcagcccactcatggtcgctgtactcctcagcatcttctcccaatacctggtaatctgtaagaaactgctccccatcctggtccagcatgtggctcacccatctcggtcccaccatcattcccaggcatgcttgatgcgccagaagaccctgtctgcactggagctgagagtatgttttgaggatcccaagtgggagcaactagttactcataggaaaggccacccagactctgcagactcttgaggaggcacaaagcaaggaggagcaccagagggagctatccatcttggagctgctgaacactctcttcaggacagtcaatcaagagaagctgtctgtggacctcactgctctcttggacatgtttcagagcaagcaacagaggctgcagcaaagcctgcagcacggaaatcactcgtctgtctccaatcgcttctatggtctgtactgggcaggccatgaggatcctaggagtccagtgtccaaggtcagtaaagaagaatgccaaagatattcctagccacacatagagcccgattagtacaaagcagaaaaagggggattcttgccggagatcaagaagcaaaagaaacttaaatatgagggcaccacaccagaaaagaatgctgtatcacaacaggatgcagtgacagagggtgccatgcctgctccactggcaaagaccagattcccagcacaagcaagaagaaaagtaagagggtgaaggccagcacaccattctagatgaatggagtatctgtggccaagagttgggctcccaataaccccacccaaaacccctgccaagaacccaaaactgcagaataaaaaagagaagctgtcacaggtgaatggagccactcctgtgtcccctgtagagcctgaaagcaaaaagcatcatcagaacactctaagc

SEQ ID NO: 18262 - DNA, 1140 bp, Mus musculus
acctgcagggttgcagatctctttagctccttagatactttctctagctcctccattgggggccctgtgatccatccaatagctgactcttttataaaaaaaaatgcaaacaaacatgtgtataaaacatacttatgataatctaaagactttggtaaattcagtcactcagtcacatgttggctactccctaaaataaaggtgttcttgacacttaatcataaattgaggagaaactggagtcaaataggatttaaatctatctttttaacttattaggcaaacaatttagcttttgcataaactttcatgactctgaaaataaaggatgatgttctcgaggttatatgactattgtgacagatgtatgatgtgagtgaaatcttggatctcttctataaaatattttatgtggtttttttctctgcgggattgaacgggtctccgtgtcctgctttgagcgctgctattgggtgctgtgaggggacctcaagtaagctccatttttgaaacatggatgcagtgacttatgatgatgtgcgtgtgaacttcactgaggaagattgggatttgctggatccttcccagaaaagtctctatgaagaggtgatgcaggagacctaccagaacatcactgctataggctacaagtgggaagaccatcatattgaagaatattgtcaaagttctagaagacatgaaaggcatgaaagaattcatattggagagaaaccgtatgaacgtaaccaatgtggtaaagcctttgcaagtgacaatcatctccaaatacataaaagaacaaatactggagagaaaccttatgaatgtaatcaatgtggtaaagccttttcacaatggagtactctccaatatcatattagaagacataatggagagaaaccctataaatgtaatcagtgtggtaaagcctatggacatcacagtagtctgcaatatcataaaagaacacatactggagagaaaccttatcaatgtaatcaatgtgataaagcattttcacaacacagtagtcttgaatatcataaaataacacatactggagagaaaccttatgagtgtgatcaatgtggtaaagcctttgcatggcagtctagtctcaatatacataaaagaacacat

SEQ ID NO: 18263 - DNA, 1175 bp, Mus musculus
aaagacagagtcaccactacgtcacgtggagtccgctttacagacttaaaagcaaggttctccccattagcagccagttgtcaaactgcgagctaagagcttcaggagtcagtcaggactctgctcacgaaggaactcagcactgcatcctgccagctccaccgccaccactactgccacctccgctgccacctctgcgatgctcttccgagctgtgctgctctgcgctgccctggggctcagccaggcaggtgagttgcgccccgaggcgccctgggactcctcaggctcagaccccctttctagcagtgtgggcctggctgtgtattggcaaagagcctggactgcttaagtcctgaggaactgcaacccactttcaggtttcttatttgctaaaaaccaatagtcttaatggcttacaggttgtcattatggtaagacaatctgatcaatacttgtgaaaagcatagatgtgggcaactgaacaagagtggctgctttgaatacctgttagagtttttctatccacagaaaaatccagaatacatttttaaaaatatatttaaaatgctaaaacttgactgttttaattttattttctttacactaaattttgactattgcactaggtcgatccattttaatatttaaagggatgcttaataattctagtctgtgtgtccgagttattttaaaaatgttggtaatgtgaactatgaagttaggtcctctgtgtttcttgcttaagaatacaaagttgcttgctatttccataaacagttgataagacagacttaattaaaataatgacctttttaaatctgggtctacctatgtatttgtcaaacttatcattgtaaagttgacccatagtgacagaattaaatccttaagttaagatgagaacaaccaagagtaactgacaggatatcttatttttttaatgtagcaaatccttgctgttccaatccatgtcaaaaccgtggggaatgtatgagcacaggatttgaccagtataagtgtgactgtacccggactggattctatggtgaaaactgtactacacgtaagtttttcctggggtatcttcctttggaatgtggccacatgtgtaaccatcattctgtagatttgtgtcctatgggggaggggcctgctcattcttcctcctgctt

SEQ ID NO: 18264 - DNA, 1820 bp, Mus musculus
attttcaactcactaccatatttttctctaagccaccactgaattttagtctgtacatatccatatctgtccattttgtagtgtgtgcatacatgtgtacgtctctgtgtgtagttgtctaggccatgttagctcgtctcagagcctaagggtcagtggcgccttctttcttttgctcatcccactgttatgtattgcttgcttccctcttaggtgtgatcgcagcactagctgttgcagtgcttgctgcgggcatctccttccattacttcagtgattagagctccctgatcatccagaaatcacggatcaacagctacagaaaataacgacatcaatgtccacctgcactgaagctagcaagcagctctgctacgttaacatctgttagatgtgtttctgacttacatgaaaccaccagctgccttgtttagccctgctttgattatctggcccaggtttccaaaagtaaactgtgcatctaaatggagttgcatgtaacaaatcactattatgtattttcagaagggtcaaaatgtgagctatttaagagtttagtgctttcaaaaaaaaaaaaaaaaaagtttagtgctattgaaccggatcacacattgattagaatattgaaagtttaagcagacagtagtaactatagcagatgtatcactaggcattatcttcatcctaaaggacttttctaatatgcacccagttgccgtagtttatagacactgtttaaattggaggccatgaatattattttaagcatacacatggactgtggtttcttggatggcagatccagtagtagcactgcagaatgctgtttgcctcaatccagaaaagagagaaatgtaaatctgagatgctatcctagttagggaagttaatattcagcagctcccccttgtagttctgtgtagctagctcctggcagaaataaactagaaacactcctaacttaggcccaagactcccataagttatgatcaagcaatatttcttcctgattctatatcatgaggtacaagatgcagtgagactgggagaaataaactataggaaaaacacattgaagtcatttcccaaggttcacgtcaacaatgtagagagtaacaggtgggtagagccacagtgtgggtgaaagccaagtagtgctcctcagaatgaggaggagaggaaactgtgggctgtttagtgggagtggacttggctgaagagaccagagaatggaaggtagagcagcaggaaggctgggaggagtgaggagggacaaggtctaggaggaccaggaggcgggaatgggagagaggcagcacttagacaacaggtttctgcacactcgttaccaaacaggcttataattgaagaaacaaacaaacaaacaaataattcacaagtgaatcaagtatgaaacaaggttcctaaaaagccaaagaggtgataaagatgcccagctaaggcaactcagtcacatgcatagtagaccggaagcaacagtttacccaagaaggtggtaaaatctcttcatagttgtgagggcaactgaaaatcagtgcaaagtgaaactcagaaacaaaccgttattacagaactgaaaaaggatggtccttgataagaagaattcctcaagaagcaagctttgaaagtgaagtgttaatgagcagacaaaacgatcaatattgtaaatctaaagtgttatttgtatacaaaaatcataatgaagtatttaaagaaattgtaatagaaattgtaaacaaatgtaacaccgaataaatattgttaatgcaacattaatgtggaattttaaaataggatat

SEQ ID NO: 18265 - DNA, 1153 bp, Mus musculus
tgaatctcataggaagaacttgagctgctttttctgagaaactaaagataaagaccagctctgcgtggtgagaagggcacatctgtaatcctagaaggccaaggtgggaactggccattacaggacagcctgggctacataacaagatcccatttcacgaaaggaaagggaaactagatgtctcaaattattttaaagatatttttttcctcactaaccccagctgcttctccctctcgagtgttaggattatggatgtgtgtcattggacacagcctaaagataatctatctttaattgtttactcacgtattattactgagtgtttgtgtgcgtgcatgtcatgcacaagtactgttatttccttagccattttgtaggcccagaataatatgtttctgatgctactatctaagcccaaaagtaatctgtcgttgaaatatgaaagtgaatactaaagtgatgcattttgttgtcttaattctccaagttttaaaacactaaacttagagttttctaaaattttaacatgccttcttgtagatttattcgacgagaaaaagaaattgctgaaactaggtttgaggtggctcaggttgagagtttgcggtatcgacaaagagttgaacttctagaacgggagttgcaagaactgcaggatagcctgaatgtggaaagggaaaaggtgcaggtatgtccatacaccaagcttaaagaaggaaagctcatgtgtttctaccacgatacactaatttgagcactcatcctaaagttgtaaatttagcatctgtccagtattgccgagttgtgtggtgattagaagctctgttgtagaggtctggtttggaattctgcttccataggattagctcgatatgctgaacattgcttagcttccctcctcttagtctccttgtctgtagatgagaggtaggattgagattgtgcatgcgaatcatctggactgtagtatacagtatataaaattccagctttctaatcttttgcagctgctatatataaataccttgtgattcattctaaaataaaagtctagagtcattctagatagaatagattgaaactaagaaattaaactaaacacaccatggtaactccaagcactggtggctctcaactcactgctgagtcc

SEQ ID NO: 18266 - DNA, 1282 bp, Mus musculus
tatctaaggttatcttacagcaacttcaaaaaaatactgttttgattttttttttttttttttttttttttggacaggcaggggtggtgggggggggatggtttgagtccaattgtttctctgtattaacagccttggctatcctagaaattactttgtagaccaggctggtctccagctcacaagagatgtgcctgcctcctgagtactaggactaaaggtgtgcaccactacacctggcatcactggtctacttttttattatatactatataaattgtgtgatgtgaatattttataattcctagtaacgaataatattcatatatgaacaagctcctggtaaagttaatttacattaacttaaattttttaggataatttacctatttttatgctggagtaagtaataaacatagatctgtctagagatttgcttactgagatatagatagtgagtgtaccagaactaatatatagcatagggcaggatgtaatgctaactgtacatgccatttaattgcataatgtttctgatgtctggttatatttatatgcttattttaggtgtgaaagatcagctgactaaagaaattgaagaacttaaacaaaggaacggagctctagatcagcagaaagatgagcttgatgtccgaatgactgctcttaagtcccagtatgaaggtcggattagtcgcttagagagagagctcagagagcatcaagagcgacaccttgagcagagggatgagcctcaagaacccactaataaggtgactgccgcttgcgcttccatgacaaaccacttgtgacttgtgtatattttatttggaagtgcctggtttttaggagtctgttagaatttggactaaaatttcaaatatacagacagttgataataaatagcctaacatctttgttcagtggacgtttgggtgtaataaacacagaagttaatccttctcttctttataggctccagaacagcaaagacaaatcacactgaaaaccactccagcttctggtgaaagaggaatgtgagttctagttcttttatagtctgcctttaaagttccaaaagaatcaggtgatgtagttttcaaatcttgttatcagtatgctttcattcctatgtctaaagctgtagtgaccagaaacaccttgtggcttagtttataattggtttataaataagataagctcctactcacgccttatcatgttcataacagctctaaaagtctaggctggggttggagagatgatggctcaccactggctg

SEQ ID NO: 18267 - DNA, 1158 bp, Mus musculus
gtttacttgatatgtgggataatagcatttgtatcaatttctaaggtaaacctaaggattgatttataattacatgttgatcgtgtgacacttagccagaaagcttcttttaggcaagttgtcatagttataaaatgaatgtgtttttaaaattggtgtattttatttcattagatccaaaaaaagatttggaaaatcaagtgttagcatgttgtgcattatctgtattcttatggtgttaagttttgttttgttttgttttctgcaccgaaagttttgtggctattagtagctagtaaagaaatagaagattttaatattttcacattcttcaaaataactcatttagactgtattaacatcataaatctagtaacccagctataataattaccagtcaacatggagaatatctttttatatccatatcttagatatttctactgaaaatgaattttgccgtttccttctacaggtataagccatgcaatgggaggaagaggaggaataaatagagggaatattaattaagtgatctctaaactgtgacacatgtgaataagattgacgaatctgttttaatataatgattgtcaagttgagaactgttttgtatttaaataggtatgctcatttcaacattctttattaataaaatgtatttcaatgtcaaaaagtatcactgttttcttcatttcattttgatgactcttctttgtcaatcagttcaaggacagttgtaccagattttggagagggtctgccctgaacgtgtggtaattgctcttgctgttcttgtaggcacatcaatgttatagtattgatctaaataaaagagaaaacatccttttaattaaaaagaaagtaaaacatttaagtttgtattgagtgttgtattcaaagtcaggatcatttcaatatcaaaagtggatgtcattaactttctgacaaaaaataatttagaatgatggaaggaataacttttcagcatccttcaggtaatattaggttcaactctaccttttttaaataaatatttaaaatagacaatttaaaagattttggctttaaccattttaaaaatgtatttcttagaaattcatactatagaatcataggcagaataatttagataactggtctttcaaaattaagtgt

SEQ ID NO: 18268 - DNA, 1181 bp, Mus musculus
cccttggttctgttcccagtgttgtatataggaaatggtgtctttacaaagaattttagttttccagggctgggagtatgtgcctctgataaggaagggggattgagttcagggccagtctcagctgggttctgaattgaaggccagactgggctatatgagatgtctcaagtgaacattggtttaattttgagagtaacggatggacagcagccaaatccctacatgcctctcttaagccgcttgctgtataggtttggaaagagaaagatttcattttccttccttccggaggaatgcgtgtttgacctggaaaccaggtttaggttgttgagatgctcactactgggtgatggttacaaagtcataggatcaaagtcaggctgaggtcatccgtatcctggaccagtgttgtttgagctaggattttgtgcaataaatgttttggtgtgttggtaggatagaatttgggtatgtttgaaaaatacataacattcttttttgaaacaatggtttactgtgtactgtgattgtccttgactttactgtcttgtgtatgaccaggcaggcctcaaactcaggaatctacccgcctctttcccaagtgctgagattaaaggtgtgactcaccataccctgcttgaaaaattttaagaactatttacatgtaaaataacttagctttcttttttttttctgtttagccaaatttataaggaaaaatgattcccaatggatatttgatgtttgaagatgaaaattttattgaatcatctgttgccaaattaaatgccttgaggaagagtgggcagttctgtgatgttcgacttcaggtatttaaaacttaattcatgaccttttgttactaaaaaagtaaactcataaaaccataagttgtgcccccaccccctaaacaggcaattaatgagatgactagggggttttttgttgttgttgttttgtcttgttttttgagatcttatttttttacgtgtatgggtgttttgcctgcatgtatgacttgtaccacatgccacatgtgtgcagtgctgtggagttgagaagacgggtaggattccctggaactggatttacaggtggttaggagctaccatgtaggtgctggtcccatggaagagcagccagtgctcttaaccattgagccaactttctagcggtga

SEQ ID NO: 18269 - DNA, 1290 bp, Mus musculus
ggtgggtggggtagatgttgctaactgcaacacaaagcttttgcatattgcatattattaaacatgctgtacatactttttgtgtttggaacggaatgcaaagatgaaggtctgtttctgtattcttaagacatctttggttattttactttttgaaggttgatactgtaaaagaataaaccacaaattgattgggaacatcatttcaagaagtccctgctcctccacatttgttttgccgatttgcacattaaatgactcttccctcaattctgtcttaagaggcaagaggggtagggtttacacgtaggcagttgggttttttaagggccccttttcaataactggaacactctataacaagatacttatttaaatagataacaatgactatttttgtttttattaaaagaaagttgacatgcctaccaatatttagtcttttatgattacatttttataactttttatattctcagcagagtgctttatctgttgaagtaaaatgtgacagattcacattatcaaagcagagtggcagaggaaaggatgcagagtggctgtttcttttaaaaaatgctcagaacgcagacttcaccatttgccgcagctgtacctttttttctttcctatctgagagtgcagtatcgatgttatttggatggagttgctgaatggtaacagtaattcaaacccaggtttgatgagttacttgacttactgaagcatttaaactgtctttatttatcattaaccaaacaaatgtaagtggaagcctttgattgaaaacaattaaactgtattgggtttgtgaatgcaccccttttcagaagtgttttgttcagctttcttacctggattaatactggttggggtggctcggtgtctgtgtagtgctacacctaatttatggtgcccaaatgagcaaatctaatgcttgctgcagatacaaacacattaaaggtactttgcagtaaatccttgcactgtgggatttaatgtccaaatgtttgtcactcagttcattacttataacggagggggggggtttgtttttctctgtaaggatgagtttacagtattagtagaaaatactcatttgccatatctgaagtaagggatggtgtgaagtttgtgtttcacataaactaagccaggtggtgttggcgcacgcctttaatcccagcacttgggaggcagaggcaggtggatttctgagttcgaggccagcctggtctacaaagtgagttccaggacagccagggctacacagagaaaccctgtcttgaa

SEQ ID NO: 18270 - DNA, 1253 bp, Mus musculus
cctagaccgcacagatagatacctgcctgccgctgcctctgggattcttgactgttttgtgatttacttcttttcccctagggaaagattaaccattggatgccgccagctgattgagatggaatgcaccatgcagcagtgcagtgcatctgtctatatggaggccagaagcagagggtggtgtgaagacatgctcaacaacaggccttaagtttacagcaggaacagcatctctgtcttcataagtgacacagtaacttttaacctggttgctttttttgaaaaaaaaaaaagaaaaaaaaaaaacatttcatagatacaaaaaccaaaatgttgtattgaccaatctcattgaatctagtgtagtataaactgtaccccagctcttctggagttgacaatacttcctacctctaaggagaagagagagagccatcttctcagtgttcctgaggcaggaatcactgtgacacgatggcagcccacagccttagtatctctcctaaccctgaatgtgaacacatgaccagacactgccaaaccccaagacttaagacatgaccatgccaccacattccacatgggctgctttcatgaacaaactgtcatttatataaaactggtgggaaaacccaccacctctttcagggacatgaagtagaattttgaactagcaccttctctgtagctgctttggcgatgtcatttcctgtgcgtttccagtaggaaagagcccctctgatgcttccccttacatgtgaagcgctggatttggggaattgaacggcagtggcagctatttgccctacctaaaactcaagtgtttaattgacttagttacacattaagttggaaatccttgtttactggagtgtattatgcttttgttaatatattagatgaaatcaaatttgatattctataatgttaatttatttttaaaacagcaataaataagttattttagtagcattttgcttttccgtttactcccaaatactgtctctgaaatgagtataaggtgtgattataaaagtctttccagtagaaagattggttatggtacaggtactgctcagctgtatggttgtgaggtgagaaaacctgcatgttaaggtttgtggggagatgagcgtccagcagggccatgagctcaggtaacgcttcagcatgtcaggaagttgtcctcagtttttgaccaagggcattgttacattactctggctggcctcactcctaggtcagtttggcct

SEQ ID NO: 18271 - DNA, 2345 bp, Mus musculus
acagccagtggccagttcaccgtgagtatttgtcaatgcctgttgagctccttggctagtggtctgggtgggtctggtagggggggagccctgaggcccacgaagcaaagccgcagattaatgactccgtgatgccctttatctctcctgctgtgcacgggatcctgtggccttttgtttatttagtctcactgttactgagcaccatgcattttcataatcttgcctctttttgttttaggttttaaatggctccttttctttggaattggtcagtgagaaatactggaaagtgaacaaacccatggaactttattatgcacccaccaaggagcacaaatgagcttttaaaagtcaattctaagactgaactttttatagtctattcctttactattaaagatgtaccattgttactttcatggacagacctgggatatgttcagttttctttctgagccagacttgtttacactattagattaccgtctccttaatttaaagacagtactttgtggaaaggactctgtgattcagagctcccactccctccatagacgctctaagttgttgcttacagaaaacggggttcctctggggaggagactttgaactaggagttttttgtagttctgtattctttattttttccttccattttttgatattttcagacagtgtctcattattataaagccctggctagcctggaacttgctgagtagaacaggctggccttgactttggagtaatgctcctgcccaagtactgggattctgcctggcttaagattcagttggccatcagccatcttttcccctttcaaaagttttttagcttaaagaatgttagacaatatgtattctgatgttttccccttgaagtcttgtatatttatagttttctatacaaactgtaatatcttcatgaagaccaaggctcaaattactgtgcttaaaacaattctcataggattattattttcatggtattttcttacataatatctcatttaaaggaggttctttatgaacttggtgtccattgtcatgcaatgttttgtttttgtcatgtgtttccactataagtttagaatttcaggtcacggggaaaagtcgaataaagttctttgagaacgtggttcatttacaggtttcactgaagaaagagaagtttaagatggtgaaaatatgtgtattcctctgtacatttgagagtttactgtccctttattatgtatgtttgatgcttttctctattaaaataccagagattatggagatattttgcactttagccttgatgaaaagtacaagatatgttcaaagcttcccctcatttcttttcttattaattcaagaataacatgacacagttaaaaatagaaaagaaaggttttgtttgaagagttctttgcattctgagttaccatgtgtttataaatttagtgctctgctaaattacactctgtagaaacaggttaatggagtgtgaacattgcattgacatagaatgggacagctctgtagaaggatgtcagcaggttgggcagccattcagaagccttagttttgtattgagaaagtgttggtagtctgggaaccacaagactttctgctgaccagtcagacttaatgtcttagatttcatttctgtcccgatgctacatatgtctctaagtttaaattctcacagtatttacaaagacatgtttgcattgaaaaatttaacccaaaggggttttgatagaaggaagagacttccggtaccattgtaactaaagtgtcagtcattttaactatttatctgtcagtttagacagattggggccagcttgatgctttaatcttgagccgactatgaaaacttaaaggcttattcaattttttaccattttactgaaaatatttgaaatctgtttttacagtttttttggtaatctgtgccataagatttgaaaaccaccaaaaattatacgaacttttatatccaattccttttctggggtaatgttaagttgtatagattattaatgcatgttcgctgaatataactcttgttttgtgatgtgattgcttagactttattggtgacatattagattagtggttgtattaaataattaaattctccttgtggttattgaaattttatctaagcagaaagttatttgtgactataagctttgtgcttagagaatgtatgtgtttttatctgtctatgggagcacataaactatttgcatcatttagtgaagttattagatgtgtactcctttgccaaataggtaattggtagaacattgtgtgtgtgtgtgtgtgtgtgtgtgtgtgtgtgtgtgtgtg

SEQ ID NO: 18272 - DNA, 1374 bp, Mus musculus
atggagagcaatgaggtggcccaggcttctggggatcaagaagtgctgggaggggaggatagctcagcccttggtatggatacagagcaagtcaatgatactcatgagcatgcttgtcagtggctggtggaggataccctgagcactgacatcctagccgtacatgattttgatgtgagctccccagagcagccctcagaggagtggtaggaacagtttgctagccgtttttcttttaaaactgtcagcaaggggggtcttagttatggggtatccttaggggggttgcatgtgacttgctataaaagttatgaaatatttctttgatttgaatggtgaagccagaggaaatgtctagcgggtgtgagcgctgagctgtctttgaggagctgaagtgctccctatgaatgatcgctttagcattttagtagaaatggggtaggagaactggagccttgggggtgaaaggcagttcaaggggctccagagaggggccagtgtaggagcagcaaatgacacctcaatattctcttcaccgaaacatggtacacatttcgaactgcacttgaaggcattctaatcaagcacgtgaaggactccagccacaccacccactcagtcggcttcactgtctcttgtccacaatcaggccacacgaaagaggaagttgggaaccaggcgtccctgtcctgtaaagtacccagagccactcacggctcgtagatctcaggtgatgcagagcagaaatccaaggtgaaaggtctgtgcagcatctatctagacctgttcctaatcctgctatcaattccttgttggttaattttgttggtttatattaattaatcaccttttaaggaaactcagatggggcaagagatttcattggcacaaattagccttgggctgtacaaagtgcttggctaaatgttctagctcaaaacctgccaattacacagacattatttgaacagctaccgtatgctctgttcgtcacagtaataaataagagatcaggtgctttgcttcatataaattaaaaggctcgtgaaaatttagtctagaagaaaagagtatttattccaatttttaagttttaaaccatgctggctttcactcttcccattcacaaggttctggtttattttctgagggagggaaggaattaatgaatgaaaaaaggaatgaataaagctatttaagtttaccaaagactttaccaatgtagaaattgtttgatcattcaacaaattgttttcttaggttccctatcaggccccaagcctggggatgccatgatggaaacaccagtgttccttctttctgaaggaaacagaaagaaattcacctctaaaatagattgcaacccataactgt

SEQ ID NO: 18273 - DNA, 1228 bp, Mus musculus
tgagtagattactacctctctgcgatccctggagttatcctaagacatactctgatttctgtgtgattgccatggctagtaacattctaatgattgtttgacagatctctagtcccatcaaactgtggtggaactaactgtcccatcggtgaactaactgcacagatggttttctcttttctccaaatcacatgaaatttggtgtttatttgggcagttcttgcataattttacttagccctagaccatagttactctaaggcttctagtaacaggttttgcatgtttgtactaagttaagtttgcacagtaatacagatgatataatatgtaccagggccgttcctgcttatgatatctgattctcagggtttatcctggctactctggacaatcaaactgttgtatgcagaacatgttcttttgaagacctctaaatattacagatagaatttgaaagagctagagagcaccctttccttcagctagtagattccacctaattctacagtcactttaagttgggtttcctgaaataggctttttgtttgttttgagattgtttccatatgtggctttgaactctctgtagcactggctgacctcaaacttgggcatcagcctctcaagtgctaagattagggctgtgcaacatcacactcaactgagtaactttcatcattaagccataagacctatttttaatttttatgcattttaaattcattactttggagctccagatttatgtccatctactccccctttaaaattttattttacaaagtatgcacaacacacgttgtagtcatttttagaaatgcagttccaaggcatttgtctctagaacaggggttttcaacctgagtgttgagatttttttgggggttaaaacaccctttcacagttgttgcttaatgtaagtatcagatatttatattaaaattcatagcagtgcacaataacagttatgaagtagcaacaaaacctgcctcatggttggaggtccccacattgtcaggaactttattgcatggtcacagcgttaggaaggtggagacccactgggctagagcactgtcttcccatctgaagctctgcagtaggcttttctttttaatcacttgttcatcaaaaagaataacctagggacagaatgtttatggagggtgccaggtcatctgtgagtgtgagtttgagtttggaacagacgtccacagctttcagt

SEQ ID NO: 18274 - DNA, 2821 bp, Mus musculus
ccataggaacctggagcacgctgtgttagagctgaccactgaaactgccccatccaaagtggagactcacaagccctcagatggcggtatccctggccagggaaagatgactgcccactcctgggtagacaagaagcaaattcagctaatggaacctgggaacagagtcagtgtcgctttctgattgaagaaagcttcactgccttgggcttggggaagatttgagcgagtattgtggcatctcggctttgctgccttcacaggaactctctaagtgacctacgggttctgaagcagatgcatttacggcaatgacagtttctgcgcatcgctgttacatgcttcaatcagtgacaaatggccaggacgacttgatttcttttcctctcccaacaatgaccttagcatttaaccaaagctgagcccagtgtacttttcccataggtctccgtaaagacctactacggggccatggagagggtccggtagatagtgtggaaatttgttgcttactgctcggggtaaatagagaaggagaaactgtaatgttgcaatatcaacttcccgttgggggaagctatgactactctagatggaactcagcattaggtcctggtggggtagattggaagtcttttctagttcatttctcttaaggtggttcctctaaccatcagccttactccatccattttagtatgcagtttgagatggaaggctcgtctccaagccctgctccatctccctatcttatagagccatgagaaaccatggtagtagactgtagtcccggggtgactactgtctttctcctttgaagctggagtctgtcacattttctgttaaatcatgggtttaggtttgttttgttttgttttaacaaatactccttccttctaatgtggacttgaaaattagtctctggtgacctgtgtaaaaactatatagccatataagtaaaagaaaaagattttttgggggtgtgtgtggcagtctggagctggtcacatttaattatttttggttttgcttattgatacttctacattgaaatcatggttttattcattttatttatttttgaacttgttttaattgcttctaaaggaatatttgagggacttcattcctttttaccatggcattacacagtaacttttctctacaacgtggttttgaggtactgaatgacttaggttatctatggagccatgaatgacagcagtgctgtgctgtagttgtgtaagttcatgtcttaggtcccaggtaagcgtgcccttttataagggaataaatacctgttttcaaaaggtccaaataaatgattggtcagtgagtgatgaatcttagagaattccttggggccggggtagcatggcaaggccttcattaactcgtagttaaacctgacagcaaacatgggtattttagtctctctgcatgggaagtttggtgtgagaagatagaaccgtaatacatagagtatacagaaggggagatgtgcttcgttttatttcattgcaaagctgccaaaatagctgacgcttaattacttgacttgatttctaggactggggcttggaggaagggaacagatgttccttggcgactttgattacagaagccttctatggattgattttgtatttgtagctcaaagccattgttgactaaatcaaactctgctaagttatcaaagccgcatatttttttcctttgagaacttaagggcatgaaggggagcccatggcacattaggaaaagccagcgactgccacttacattcctttggccactaggaggagctgttgcccttcattaaggcacctattgatttgtttaggaaaaccaaatcctttaaagaaataaatttaagacattttacttactaactagaaggaataatactcagttccccctacttaagaaaagaggaatacgttcagcgtcagaacacaacattctaactgagtctccatccatttttgtatttgacatactgcctgccacaaagtagtcttttgagttcactaggaaattccaacagcatagatttttaaaaaatttttttttcattgttgttgatgtttgttaaaaacctttcatagatattttatttacttgctgaagattcagggacttctgagaccctgagtttagaaacatctggtctacctcagttaaatgttgactgcttagaaatagagctgaaatgatcaccacagccataaaattgtttgactaagaaagatttatataatgtttacaaacctggaatcaagtgcggatattacctgaaagctaaaggttagctgttaagagcaagtatttaattcaggtatttttcaagttttaaaacttgtttaccaagtaaaattaggtattttttttcttcacataaaaactccattgaaattatatgccctaatttgcaatattttccccataaaatttaaatgtgaaagaacagtaatttactagatatgttttgggtggggtattttgttaagtaggttttcttttttctctttaacctatgtaataagcttccaaaaaaagtataattgttttagaacaaattattttgtaattttccttttcctttttctttacagtattagatacttttaagtgaaaaattatgcactctctgacttcaatttcactaatgtaattattttctcgggaattcttttagatctaaattaccatcatattaacttttcttatacaaagccagcgtttgttctctcaccagactccatgccagatccatcataagaaagctcagcctaagtaattcaaatagtgcttacaactt

SEQ ID NO: 18275 - DNA, 1177 bp, Mus musculus
acgacacgtgccagggccagccccagcattgctcatcattcccactcatcagtgtggccttgactgtgacattgcagctgctccactgggacgtgatgttaccaacctggagagttaaaagtatttttcctcgggttgtctcaggtgtagttactcctggtaggctcccggccctgagccgatgagcaagcaatatgaaggtgaaccagtttctcccctccagaggcctatcacgagggggaaacaatccagaagggccaccttagagacatcgcaggaccctatgggatcacatcgcagtggtagccagccagctccaggcatagaagcttccagaaaacaatgagaacaaaattcatccttgtctgggcacagagagaaagctatccaaggagtcgtccatgctgagaggacatgtcttgcataggtgggccatgggaccttcatgccattggaccttcatgggaataggggtggagcttagagtagcagagagaagcgcaaaggatgagaacagggtagcaaaccaggctctgcggcttcgctgtggattcgtagactgtgatggagttgctgatatgcctctgcacactccactccgcgttgtccctgagagcaagatgtgatcgttctcaggatggggattgccttcctctggaaatacacagcagctggctgaaaagattcatgcccaccatcctctctccccttcccaacttctcttcctgcctctaaaagctattggagttcaagggctttacctgggctcaatctcctttggagatttgtgggagagagggctgggtcatcctgacctgtctttagagaaatgatggctaaaaatacctcttgggacttaggttggcctagacctggagatgagagtgtaccctaaaataaatattcagggagtggtgaaggcttccctgtttagcatgtggttctagccaagttcgtaacctttgcatagccttcccctgggttaggtcactagcactgaccagggaggcagccaggcctctgctagggcacaagtgcatacctgagtctcgcccaggaaagaggagctggggagcttgggggtgggggctttgttttgttttgttttttatcataaagtacaaataagttgtgtgcaaatgcagactgtgcacagtggctgaggaccttgtggggc

SEQ ID NO: 18276 - DNA, 1126 bp, Mus musculus
ggcctgagccttgcttctcactggtaacgtggggctttggacatgggatggtggccacggtgagcctagtttctctgcttgaaagagccacaattgattgaaagcctgttgtaacctaacctgactcccggaagtgacaaaggaacaagtgagcagtaggttgttccgcttactaggactcttagtgcaggattaagcttgtagcattggcttttgctcagatgcaaatggaagtgtgaccacgtgaccacaatcattttcaacccctccctcctcacttttttttctaagaaaataaacattttgctgtttttctgtatccttgtcttctcccattcatccagttcagttaaagatgaccctaggtgtggaagctaagtcctccttcacagggacactgatgattggcctaaatggctccccacccttctggagacatcgaacatggtttggaagggctgtgagtggtcagaggagatgaggcgacaaccccgtgacttcttaggagggctggaaaccactgtcaacctttcactctgttaacttatcagaacacgctgttttctgagttcccccttcgatgtgttatgtgagccttgccccttcattcgtttctgtttccagctctggtagtgtgggttaaaaaaaaaaaaaaaaatgtctgcctactagaaaacataggacatccacgctggtgatgttacttggagaagtgaaagccaaaagcccctggtggtggggagtgttgactgtgtgttcagtagagtttatttttccatactatatgaagagaatgatctcttctcaaagacagaagtaatatttttaacaaatattgtcacaagtaaatagcaatcaaaaggagaaaaaataacttttgtatttttttaatcgtgtttgatagctttgatgagggttctctttgttactttcaggggagggcaccctattaaatgccacgccagcagtcctggattgagcttgtcctacacacacacacacacacacacacacacacacacacacacacacacgaatgctgtgtttttctcagagggttgtgaatttcaagggtctcacgatcagccacactgcctgccaccttggaagatggaatagttacaag

SEQ ID NO: 18277 - DNA, 1178 bp, Mus musculus
gaaattgtgaaaccatcctttatactctgagagccagggtttaggctgtacaggagggaaatgtgctggtcttgtttattttactaacaatgtatctttggggatgaaaactgaagcagtttctgtagtctgaaattacttttgagtcgtttgtccatattaccttgggggtgtttgcctatgtagtttgagattatatgtataagataagagttcattattttggctgtgagatgttattagagttatacctctaggtctgggcactgtgaagttagctactaggcagacataggaccacaatattggtggtgttaaaatgaaacctgtgatcatagaacatttttatctaaagaaaaataaaatggtaaaaccattcactttaattgttaggaggaaaaaaaacctaatctgtcttaggtttgttttccattagggtctctttgtttttaacaatagtcagtgctagtctagccctcctagactttcttcctccccctcctccaaatatcttattcagcattaaaatgcatgtgtattcttcccgaggttaagctgaagtcattaaaaattgattagtttggggctggagcgaggtctcagtgatgaggagcacttctgcttagacatacctgagttcctagcaccctcacggtggccacagcctttgtaactccagttccaagggagccagtgaactcttctggcctctgctgggcacaagacatgcacccggcaccaagcaaaccagcggtacacacaaaatagttaaaatgtaaaagtagggttatgagttagcctttaacatctccgtcagcaacaattttttaaaaaatattttaagcccataattaaaaagtgagatctgtagtaaatggagactagtctgtatacagataacagtgggaagattatctaaggtttggatacgtttgtcatcttttcagttcttttgcttttttgcctcaacattgcaaatctccctccttctctgtgattgggtgagccatgaacatcacactttctacgattgggtcagctgtgagcatcacactttcactgttgctagttgttttctgtgcctttcttctcagcctgttagcaccattctccttgaatactttcatgcactgtgtctgatcaaaccaaaacttaactgagagaaaaataaaattcct

SEQ ID NO: 18278 - DNA, 1149 bp, Mus musculus
gacctgatgcagaggccatggaggagtgcttgcttagtggctttctctccataattttctcggcctgctttcttatgccagccatggtcacctgcccttgtagtgatcatgtaccccagtgggctggggctttccacatcaatcattaatcaagatgccctacagacttgcctacaggtcaaccttacagaaacatttccttagttaagatcccctctgcccagatatgtctaggtttgtgccaagttgacaaaggccaactagcataacggggacatgtcagatcccgagaggaggaacaaggaggaaggaaagtccctcttccctgtgcacctctgggcaaacaccacagatatttcttcatcagtctaggtgaataccaggtattgtcatgcacttccctgtgtgatgtgtaatagcacaggtctgacagacttgcagaggacttttgtagaacatttgacttgtagagtgtctcctcttgccctataaagcccaacactggaccagaagttaataactgctcattgagtcaatttggttagatgctaggaaatcggctttgggttgtaaatatcacattggtcttcctatgggaatttcactgtctgtggttcacagctgatggggtaaaccaagtggacaaggtctcctggtggtagggatattgttagacatgcaaaaccaaaagcttagccaggctatcaattggcagttcgctgttccaacctcacgtttaatctcacgctctcgaatagctttatgtagcgtctgctaaaaccttggagtaccgtgtgtaagttttatgctctagcaactaaatagatagttctggttactggtgtcttgatcatcctgccttctgctgtgtggcttttacttccaaatggagactttccctcccagagggacgagagggactcaggaggctttcgaggctggttatggtttacaaggtttacaaagctgcctgaggtaaagctggggtctccccagtgtggggcatagccttcaggagtcctcatccatgctggactgggcccttgagtcacccgtacatctctaagtaacccctttctcgtgttcctcacagtaagcacaataaattcattggttcaccagtggggacttggggagaatcatttcttt

SEQ ID NO: 18279 - DNA, 1203 bp, Mus musculus
gataagaccttacattcttttaacttccattatatccagaagatggtttatgtccatatatgtatatatattttatatgcatatatttagtgaatatttgttaaatgaaagaaaatattgagccattattttcttctctatttaacaattccgttttgattttcagtatttagaaatgatggaattagatataggagatgccacccaagtttatatagcattcttggtttacctggatctcatggagagtaagttgcttgtttatattggtttgctattggggtgtgggaggttggggcattgggttgttatgtagggttgttcacatataataagcaaacatcttttcatttattattaattttgccagttaattttacatttctttattgatttacattgggacttactaggtcatggaaaagattagaaaaacaaagagaggaggtaatattacgagtgcagtttgttcagctgagtattagaagtttagaatgcttatctttgcttttgaatgagtgcatatgtccattcttgatgctctttcaggtaaaagttggcatgaagtaaactgtgtaggaataccagaactacaactcatctgcctccttggcactgagatcgaaggggaagggctgcagacggtggtgcctacacccatttctgcttccctcagccataataggtgagcgaggacttttgtcctagtttaaaagatccttgcctgttagactctttgtggattttctttctttcttgtttttttcttcacttttataagttctttttatatttttgtcaataatctttcattggttgtatgttccagtttttaaatccaccccgtgacatttttaaggtacgctttaacaagtaacatcataatttgagtataaccccatgcacccatcctttctttcatgatcaccattgttgtgcctagcttaaggtgtatttcctgcttggcattctaagtaaaggtttttaatttctaaaaggtagcaggagatcctgtgtttgaaaaatgacagaggaggaaaagggcttcctttctcctgaataacctctgtccccctcattttcaacagagctccccgacatttaatcagttaccaccccttggagttcccagcctccacagtgcagtcaggccggagtgtggttgttgttggggatcacggcttcattcccaggccctctgtg

SEQ ID NO: 18280 - DNA, 1213 bp, Mus musculus
ttccagggcaagtagtgggtgagccctactaccagtttccagccttctttccgcttgcctccagatgatgctataagtgtaagtgtgctacttcctgttagcatccaactttcatggcctctcaatctctttgtggtgacccagggtccggagcaaggagtcttgctctatataaatgtatttacacaatataagcgcctctttggcacaaacatcccatttccttctggtaataaggctgcctggggaaacagtcccaagtcagagacaggcctccagcagcctctggatgaaatactttcatcagaaataaggtagctgccttagccattacacaagtgttcactggaacatttcccatgatttcccgaggacgtcttcagtgttcttcaggtaatggggatctcagaagatttggttctgatccaaagacacagtctgtgtttcagctcagtgtttttaagaaagaaaaatgccacatagtaaaagaaaaaaagtgtttacttcgttggacaaaccaaattgattctcaaaaaatgaccggtgcttgtaaaaagttattacaaagtagttccgaaaccaaccacctgaatgtgcgtggccgagagggaatcagcctgcttgtctttccctaagatgccaactccagagtcactgactgaggtgagaaccagcgcagaaactctataaactgctgtttttgatacctgctctttttgttttgttctgttttgtaaaattatgataaacttcagaaaataaaatgtcagtgttgaataatttttttcttaattgaatacttgtaactctccagttagttaaggagaagggcattcagtgtagctgtctgtgtggaagagtatgaagccacgtgatgagagcaggtagggagaagagccactaaggatgccagagcactgctgaggccttggtgtgactctatccctctgggtcttagcaggacggaccagtgacctagaggaccaaattcctgtagctgtcaaaggcactcccagcttccaagctccccttgttacacctcagacctgtttctcgcgcctgcgtgctcagcaactctgtttttcaactgcccctgactgattcctgctttcctcgggttaggaccgtggcttaagtgaagctaagtggttcctattggaagtcgtcaagcagtttagcacagcaaccaccttagaaacaagagggagcatgc

SEQ ID NO: 18281 - DNA, 2938 bp, Mus musculus
ggtccagttccatgatgcatcctgggccctccgctctggagcagttgttaatgcagcagaagcagaaacagcagcggggacaaggtgccatgaaccctccacactgaggccacaggagcaacccagggaatgaaggctccataaaccatggcatgttgggtttgcaggactgacccacacagtctctgcaggtggcagctctcttgtctgtttcttgctgtcgagagggtgtaagtgttccaccagcccgctgagtgtgcacgaaatgttcgcagtgcaacaaaaagaaaaaaccatcaggaactctcgttcccccggggctttccggagggagagaggagctgctgtttgtcccactcggttactgatagcacgcctctcaccttctccaccgcgcatgtccccaacacgtgggaagtggaagctgagaagggaaggcagatgggagaaaccaataggaacttctcagtccttttttcctctttggggaataaaataggaatccattatgagtgctttgctgactgagaatgtagttgaaattattcttaaacatcttttattattactctcagtagcaaaatatcacactgaattcttccatacacaggcgtatttctagtcagtgtggagcaaagacagtcccgtttgctgctcctgtgagaggtcagtggtgacaggacagggaactgacctcttaagccagtgggagtgtttcatagggagggtacaaggcctcttagaaggttctgggagaggccttcctccagcctggaaactccagcaggaaatgcccttcactctgtaggtgctcgagccccaatagaggatgcagtgtgggtagtgctgctggcctagaccagcagatggctgctgtacgatttcaaattcatgtggtggattcctacactttacagtagcgtagcaagcagtctcagaaggcaggctagttcattcacggcctggaacccattttaataggtggatgctttcagtgtggttctttttgttgagttggtttttgtgtccccatcctgcttcccagcctcttgcatcagtctccaccctttagccatatgctgtaccgtagtcattgttttcttcctaccgtgtacaacatctcaccacgaaacagcagcatggggccagcacttggggcccaaaagcctgaagtctgaagaggaaggaagcggcagtgcaagcgtcactgcagaggagccgggctatgcccagtcacagctcctggccttcacctcgaggatgaagttgaaggccacagagacagatgcacactgtgcacagaagaaaacacagcagatgccactttggagagggcaagagaaaggaataaactctatttgataatttatattaggaggaaagaggactgaagatgttctgtgtaggaacagaagaacggacagcatttctgttagtcatttcctggaaaagtaatattttaatgggaaattatggaaacaatctaaatgtccaattgctgtgctagggtagggattattttctgggaggtgtgtgtgtgtgtgcgcgcgtgtgtgtcccacacatggctttctactctcccagagggcaagggctaagtgtgggaaatagtgtggagcttagctgaaggacagctgtagagcaaagcacatccaggagccccaggtgtcactggggtctgggcagccccgaaatgagatggggtaaggtattgctcattgctcttcagaaagagtgcttgaagccccaggcttactctattgctcttttagtttgacatggtatttggattttttttcttttttctttttttttttgtttttttgtttttttgttttgttttttgggttttggtttttgttttgttttgtttttgaaaggtctgaaagtgaaacccttcactaaatggcaaaagaaactgtctgtgctgctccagtccctccctgtgtccatctttgtcctctccctgtcccttccctgctaccttcacccagtttgtgtatgtaagctctgcattcagacagctgcagcattccgaggttggaaatgtcactgattcttgcaccttagaccagccaacaggtttaccagttccctccctgcagtacccacttcccagctatagccccagtctgcatgagaatttggtgtttggaatgtttatgactctctcggcggggttcctcgccttgccatcctcactgtggggtaatgaagaaggggaggagaatcttcatcaactggttttgtgtaataaactttcgtgttttgttttgatttgatttgatttggggttgtttttcccccctgtctgtctgtctgtgcaagatctgcagctgctgaaatcagctttgcctttaattaaaccgtgttctctccaagcagatcggtgtgtagaggatttattctaccttaaaggatatagcagtaaaaatacagcttagaacttcaactgctcacttgtcagcaagaaacaaaaatggccacaactgggtaggcttggggatgggttttgcttttcttagcatccagtgacttgttctagaaatgctagcttaaaatgtctgccatagctggacagtggtggcgcatgcctttaatcccagcacttgggaggcagaggcatcctctggcctataaaagccattgaatctgatgaaagccaacagtgatggctgtgatctggggggtggttgatttctcttcctgtttgtccatctgagggacagaaagggctgtcattctaagagttccattctccttgggactggatggtgtgcttcatgggaacctgattcaatctgccttttctttaatgcagcttaagttttttaatgagttgtctgtgtgtaccttcaggattacatataaatttgctttaagcttctggaacccaagcaattaataaaggaagaaccctttattaattatttttcca

SEQ ID NO: 18282 - DNA, 1192 bp, Mus musculus
tgctttttttgtataaatttttgcttatgtgtactctaaaagtcagacttgtgttttatttaataatttgtcaggactctaaactaaggactctgttctctgcgggctcaccgaggtttcgtgctttggttgcacgtgtagtggacaaggagattgtggccatgtgcatttggacccttaaaaagtcactgtaattcactctgaatagagatttgaatttagtgtggctattctttgtcactagctgaagaacatttccactgttctggacatgtatatatcaatatcgttgacaaattattttacacccattaaacgagacttggggaacagtatgcagtagtgcatctctcacacgtgttttcgcctatgtagttttgaaagtgtctgttgatttacatagccttgaagatggctgaggagtggggtgatgagtaaagagtggagtccttggagatgccgtttttgtcatttattagtattctaagttttcttgtataagaataaaatctgattttttttttttttttttaatttacagcatttggccctggctaatttctcttctaaatagtttccatccccgtgaagatgatctctcaaatactaatggtaagaggtgcctaaattgtgtattgtctctctgcttcttcatcagtaatgggaggttgaaagccagggagattgggtttttggtgaggctttttgttttccttttaagagaggctctgacttctggtactgatgaagtgactagatgtgggtaattctcctgaagtacccctgatactcattagagtagatattcatgacccttacattctatccattttcttccctgtctcttcatcatttctatctgtttgggatgtttgtttggttttaggtttatatattttgcatgtgtgagttttgcctgtgtgtacacatccacactggtgtccacagtgacagaacagaggcttggattgcttggaactagagttatagacagttgggagggggtgccagaaaccaaattcaggctcagcaagtactcttatctgctgagctgttttaaggaaacagttacctacatatctcacagaatttagcacatacggcatagaagatagaaattgccaatggatctcccatagtattatagattatattgtccacatgatagtgcatgatcttaggacatcctcct

SEQ ID NO: 18283 - DNA, 1168 bp, Mus musculus
tggttcttggtaactttagaatcttaacttttctcctttaggtcagccttacaatcagttggctatcttagcttcttccaaaggagaccacctgaccacaattttctactactgcagaagcattgctgtgaaattccctttcccagctgcctccactaatctacaaaaagcactttctaaagcactggaaaggtaggactgacttttccaagagaatttgtgtaacgtggagtcttaatcgctcaaattttgttgtttaggaaattgtagcaatgatctctagtcatctttaggtctaaaactacagagaacataattattttgtgcacagtcacgtaattttacccagtatgtggtttcttgtagctgagtgctgactcatctgagttgtagctgtgaagctagacctggacagaaagaacccttttcttgtctattggatgatgaagtaacttgcaagctaaacccagtttaagggttttgcaaattttgctgattaagattgattcaagtttttctttcatttcagccgggatgagttgaaaaccaagtggggtgtttctgacttcatcaaggcctttattaaattccacggtcatgtatacctgagtaagagtttggaaaagctgagccctcttcgagagaagttggaagaacagtttaaggtttgagttaaaaaccaaaaatgttggtcatctcttaagtggggaagcttaaaatttggagaacattaacttattattttgtggtgttaggggatggaacccaggaccttgcacaagctagacaattcccccacttagctatgcccagagggccagacttctgtctagtccctatgttgctatttaattatgaattcatagcaatagttaaatctgaaatatatgaagtccttgcatctagctttcctcttgctatctgaactatatggtatctagtcattgttgaaacagccttctcattgaccccctgccagttggcaaaacggattgaagtataaatatattaagaagcaagacatgccgggcggtgatggcgcccgcctttaatcccagcacttgggaggcagaggcaggtggatttctgagttcggggccagtctggtctacaaagtgagttccaggacagccaggactacacagagaaaccctgtcttggggggcaa

SEQ ID NO: 18284 - DNA, 3308 bp, Mus musculus
ctgggaagagtagggtttctcagaatttgagtccctggtttcagatgatcgtggtcttgatgctgtgtgtctgaccagtagcattgagtgggttctctgccaaccaggcatttgcagagagcaaaaaccctcggaggtcatgctaaggcatgttcctgttggtgagaggaaccacacaaggcaagactaagtcctgataatctattcttttttttttttttttgaaaacatgctaagaacccacttgactgaaaagatgctttgctaattggcattatttattgcccatttggctcggagctataagtccaggatgatctgggagaatgcagtttgttaccctgagaattcatgatccccacacactccacctgagcttgccaggctgtgcccaaagccctttccttcttgcaaagcaatcagccttgtttctgagctggccctacctgtctcctgcagagcccagcagtcaatgccctgggaggtctccctgacacacaagagcagtctctcctgtttctccccatttctcctcgatgtcctccccttctctctacctctgaagacagttcaagactggacaagatactcgtgtcctgcctggagagctcgtggggaatgatttttgtgttttgtgtttgcctttcagcctctggctcttgggtttctggttgttcatggggaacagctcctgagtgtcaggctacattttaatttctaacatcaacatggcccaggtgggactggatcaggggcgatgctttttgccttggctttccctcccaccttctccgctgacttcaggaggaagaagctgggtcaacagaagcgcataggccatctccagagctgtggcttttctttagactgtagaagtgacctccagagggaggagattatttctataatcgagaagtccagtgtttgactaaaagtcatggaaaaatagagaaaacttgcatgacccatctgctcccgggttcttatttgaaaacaagggagcagagacccagggagtcagtgtcttgtccaggatcactcagtgcatcctgggaagtatgatgagaagatgctgcttccctagacaaaagaaaaccaggagcctgcggggagacatgggtgacatgggcgacatggggttttgaaggctctagagctgacatggctccacaagagcagaccccagcaaggctacttccattttgttcctttggttcactgtgtttctgttctgaactcttgttgagcttcattcagtccatagcctgggataaggaaccaggttagcccagcagcctcagggggcaacaggcagctcagaacagggaaggaaggagaggtgagctaagaaaagaatcacacagaagaagtgcatttctgggaagcaggtgggcagattgtatcttgttaaggcgtgttaaaaatggtttccccttaacagaggtgagtccccatccgggtgggattgtccattcacttctctgtctctttctcccgttgttggatcaagggtaggggacccccccccgtaccccccaaccctgcccctaaggggagcacaatgtgactgtgacctgccgtggccaacaccaaaaagacagtttataagtggtgcctcaggtgtcatcagggtgacttgggtctgtctttggggacccattgtgagagctagcctattactggcatggcacagagatggtaataaagacacaaactgcagtgatcccatcatttactgctgcctgccatttttaatgtccccgccattttttttaaagcagctgatagaacagagaggacaaactttaataaccctctccttaaggaatgaggctgggcctccctggattaattgtctgagccacacactccccatcccaggtagcctctgggcccctggctttcactttccttgaatgtacattggaccagcaagggaagtctcttactgaagtgcctgaattcacagctgaagtcttagagacactggccttcctgttttggcttggctacaagttctagtctccagtttcaggatctctaaaaggattcatgaacactctattcaaataagtgggaagtaaaacttgataatcaaactgtatcaaaagccagaggattttagggagcccccaccctcaccctcatccctacccccgatgttctcatacatgcttgtaggggactgagagaagcatgtccatgtatttgtgttcctatttttaaaagtaacgcaacaccaggtgtggtggcacatacctgtgatcccagcactgagaggtggaggcaggaggaccaggggttcaagcccagcctctgggcacagaagaccttgtctcaaaacaaaagcagcaatgtaaaaccaggatgggacagtctcaggacctctcctcgtgttacagcaggagggctacaaagagtggaggtgggaagactttatagcgcatgtaggtaggacaccttggagatatcctatggtaatgaggatgggtgtactctgccacgctgatccaacctgtactgtcctgtgagctgactggtgaattccactcttgatgtggtttctgtgtagtgtgcatttggaagtgtcctagtagcctgttctagttagttagactgcagccctttcccatcaccttcagtggagtcccagggcacacagctcatctcgatccttgtgggttggaatggggaggaggaagcttttttttttttaattttttaaaaaatcatatctgctaatttaagagtgagatttgctttatggaagtcaactcaataaaaactgcattcgagttgcaaataccatttcacagtgaaatatttttgagtagagttctgttgctaggatagtcgtgggcaagagttttatcagcaaaatgtttcaattatgttaataaatcagacaatgctactagagtcttgtgtctttgtccagaaacttccctgtgagtcactctgaaaagtaatcacttcttctgcctactgttatttggtgggagagaacagttgtaaaaccatgcccagagtaagtgatgtcctgcctagtccagctgatgccacatgtgacagaaaccagaggggtcagtgaggaaggacttgctgtcacccctgacaacatgagttcaatccctagaatcttcatgactgaaggagagaaccaatcccagtgagttgtacacacaccatacatacatacacacacacacacacacacacacacacacacacacacacacaccatgattgcaggaagaactgatcatgcatctctgatacttccttcccaagccaacctagatctgcct

SEQ ID NO: 18285 - DNA, 3121 bp, Mus musculus
acgaaatgaaggccagcgacctggacaggaaggtgtctgacctggagagcgaggctcggaagcaggaggcagccatcatggactataaccgggacatagcagagatcattaaggatattcacaacctggaggacatcaagaagaccctaccaaccggctgcttcaacaccccgtccatcgagaagccctagtggcgagagggctgtaaggcagtgtccctgacaggggaccctgtgaggcctcggtgccttgacacaaagattacacttttcagacccccacttctctgctgctctccatcactgtccttttgacccaagaaaagtcagagtttaaagagaagcaagttaaacatctttaaccaggaacaaagggttttgcctaataaagtctctcctccacttctgtcagcaccctaccggaactttcccttgtttgcctgaagtcacggcatcttccaggggcctacccacatcatgtgaaccttttaatgccagggcagacccagccccctcccctctctcaacaccagcaggacctatctcagtactcatgtttctatgaaggaaatctttggctcctcatcgtagcattgagatggccagtatgtccgctctgcatcttctgcctcctctttgaaaggaaataaacatcctgtgccaaaggtattggtcatttagaatggtgatggccatccatcagacatgctggctggctgagcataggacacagagccatcgtgggtgacagcgtagttacatgtgggtccccaggagaacatggctcaaagatgcttagggtttcctcctgttttcattgactaggaagatgaatgtttcccaaatcctcaggcagctgataaaaagtctggatgggcagctcgcacgcaccactacgtgaggtagcttttgatatttttataagcaggacttaatgcagaagaaacagatgtgataacccactcaagtttttttccccaagtagtactaattcttgaagctttgttagtgttagtcttggaactgttggtaagatatctgtcaaaacagttgtcctctaaggtcttgaccaatgaaagaagagcaaatctccttttccccatattttctgggaagtggctgtaattgggatgtaaccgctctcattaggattccatgagtgcatttctttttctctttttcttggagagagatgtgacatttggcccttagctccattctcttctgatgtttccgttctttctagaactcttcagagcacatcgttgtttgccaggtcctggtggcaaacacccgctctcagtgtttctcaaggctgccaaccccatctagttcctgcactttgtggctctgcccactccaagcctttcctctgtgtggagagggaagatccatgcgtggcatttcctagtgggcttctcaacctctgatcctcagctcggtggtctccttaagaccacactgtgacagttccctgccacacatccccttcctcctacctacctgcctctgagattcatatttagcctttaacactatgcaattttgtactttgcgtagcgggggaaagaaactattatctgacacactggtgctattaattatttgaaatttatattttttgtgtgaatggattttgtttatcatgattatagagtaaggaatttatgtaaatatccccggtcctcctagaacggcactgtctgctcacgtctctgctcagttgtccctctcactggcacaggaacctgtaccatgcctggtcacgtcgtgcctagtccccagtgttttgctccacctctgccttgtgtttgcagcaccttcactgtctgacgggaagcctgctcacctccacaacctgaccgaagagggccctcttccccgtggctctgaccatctgagctgcagctcctcaaggttctcatgcctgccccggagcagtagccaagctgacagggtaaagggattaggaacgtttgtttgtggaaccttcccacacgggtcagttttctaagggagcatgtgatgactgaacacttgagggcatcagcaccgtgctactgatgacagaggggaggctctgttcagcctgtctccatctcggagattgccacaaaatctcagcttggcatcctccgaggccttttgtgccacggcagaggcgtggcctcaccaagttcagtgctgattggctagttcctctattccgagctcaccaccttaacattttggtcacagttgcaagaaaatggctgaaacagaccaccaccagcattctttgggtcaactccactccagcaggcccgaggcgctggtgggtggggtgttttggtttgttttctccagcttttgtggtatatttttaaacagaattttattttttaaaatgaaagttatttacaagatgataccttattacactccttcgacacagccattgctttattgtatagttccaataacctgtattttatgtaatgaaatggacagaatggctgctgtagaatgcggggtgccgcacagaacagattgttttatccctcccccgcccccgcccatggaattttcctttgattccaactgtggcccttttcaatgtgccttcactttagctgtttgccttaatctctacagccttcccccctcagggagggcaataaagcgcaacacttggcatttttttatgtttaaaaagaaaacagtattttatttataataaaatctgaatatttgtaaccctttatatcttgtgtggcctaaatgcggtgctagaacatgaaatgtttaaaaggtttaatgaatggatgtctacgtatagtgcctcggactggcttgagaaccactcagtgctatttgttatttgtactggggcttgaatttaggtccttcagcatgctaggtagatactctaccaactgagctacatccctggctctttattatcattattattattatcattatcatcatcgtcgtcgtcatcatcattatcatttgttgttttaccttcttcaaattgtggtcttcattgtcatccagaagttagcaaacttctctttacagaactagattgtgagtattaactccgctcttagcacaaaagtggctcaggagcaaagaga

SEQ ID NO: 18286 - DNA, 1190 bp, Mus musculus
atacttaattctttgttttaaagaaacatgcccagtccactgaggggctgattcgtgtgtgataaaaagaatcacaggcaatataaacaaggagggttggcaggcacactagctgggcgtgggagctttggtgtcagctggcctgtttacatccctgctccacgagttagcctcttcatttgtaagaagagtgtcatgctgcctgacacacagttgacactaaggcactggctacagtgtaacatgctgggactctgcttggagtggcttctcaaataggaccctctcagaaacagatgtgcattcctatgacttgagacctggaaaacctgcacggggctgtctgttttcttccttttctgagatttcacccccgttgttattttaaaaacaaaaccaagaaagacactgatttttatctattattaaacaaaatccaattgctgttttgtggaaggtttttcttctctgccgtttagttcaaatctgtctcttgcactccttttagattttgatagacgcgtgaacgataacaagacagccgcggaagaagctctaaggagaattcccgccatcaaccggaccatagctgaagccaatgagaagacaagggaggcccagctagcgctgggcaatgctgccgctgacgccacggaggccaagaacaaggcccatgaggcagagaggattgccagcgccgtgcagaaggtgagcacttccatcttctccagctcctgcttgcacatcgcacacagaactctctggaaccatccctgtctgtttcttttcttttcaatgctaatgagaataagtacaatgaccgaagaaagagaaccaggaagaggactttctactgtctgggtgttggattgagttgtgaagggggtggtttttacatcatagtccccgcccaccaaggttcctgctctctccctgcataaacgttctctagaccctccatagagctgctgtggccagcactacagaggctgtcttcactcacgctaaagaggcatttcttcaccgggtgtggtggcgcacgcctttgatcccagcacttgggaggcagaggtagcctggtctacaaagtgagttctaggacagccagagctataaaagaggcatttcttcaggccggcttttttatgttaccgaaagattagagcttgttttaaaattaagtgttttga

SEQ ID NO: 18287 - DNA, 1171 bp, Mus musculus
cagggagggggggttggggaaggtaggggacccagggagccagcttctcatggatagagcattctgcatcttgactagggtctgggctgcctaaagctgtgtagtcatcaaagtacagaaaacactggaaaatcactaacatatacctggttaaaaattgtttttttctttccacagatttttgccccctgtctttcactgtcacattttcatttaaatgtaatgaccttccatgcttgttacagaatgaagcaaataaaatcaagaaagaagctgcagacctggaccgtctgattgaccagaagctaaaggattacgaggacctcagggaagacatgagaggaaaggaacatgaagtgaagaaccttctagagaaggggaaagctgaacagcaggtcagtttgacttgccgctggctgcatttcttgaggcgacaatttaaactgctcaggtgggagcctagcgtgtctagcgcgtggcctctccgtacgcttcagtctctgggctgtgactgtgagggggcttgtctgttagtggcaaagtctgaccccggaaggtttgtcctctgacctgccttgcatttgcagaccgccgaccaactcctagctcgagccgatgctgccaaggcccttgctgaagaagctgctaagaagggacgcagtaccttacaagaagccaatgacattctcaacaacctgaaaggtacgggtccagtgacagcagcatcttctgcatgccctccaagaggcagtcactcttttgcttttccgttttgttttgagcaccattctctcagaacgaaagagtatggtaattcccatagactatttagatgcagtggttaaccatgctcttttaccgtctttacttcatcctctacactctgtgtgtgtgtttgcatgtatgcatatgtatgtatggttgtatgtgtggatatgtgcacatgtgtgtgcagacctgaaatcagacttcaggtattttctttgcaggctctccacttttatttattgaggcaggatctctcaacaaacctgaagctgaagtatttgaaagaaaaatcagggtgcctctgtcttctcattcctttgctcttcactgaagaccaaaagccacatgtgggagagtggcctccgattagatgaaaatgtcaccatagtctgcctgcttagct

SEQ ID NO: 18288 - DNA, 1159 bp, Mus musculus
ggcccaaggtttatgttgctgactacacacatggttttgtaaattacttgtgttccaaagttagttgcctgcttccttctatcccctccctgtgctctgagatatctttacttcctacctcatctggcctggaactccaatcctcctgcctcggtgctagggttatgggcagaagctaccacagcacacccaatcaaaaatcagtttttctaagaaaatacacatttgtccctgtagagttttgtgccactgattttcttagaaaatactcttttctcagttacagatgctttttgtaaatggagctgcccaaaatgattgtgaagctccaaatgggactttgcagtgttcctagatctctgtccatattaggatgtgtaaatataacaaagtgttacctaaacgttgcttctttccctactgaacagtctgtttcatgtctattgtttatctttcctcctacatgtacagtcataaacaggaagccgatgacattgtacgagtggcaaagacagccaacgagacttcagctgaggcatataatctgcttttgaggaccctggcaggagaaaatcaaactgcgctggagattgaagaacttaaccggaagtgagtgtaattggaaagtggctcgcggtcctgttctgcgaagaatcaagtgctgtggatttgggggatatcctcttgcatatgaggtttctcagcgctgtggatttggggttacgctcatgtgcatgaggtccatcgtgctttcagagtggtagtgtgattggggaggggatgtccagccacaccaagctccgtagctgctcaggatggtaaccagcctagccatgcacttaagagtcttcatttatggaaactggagagaggaaattccagtgcagtggagaaagtgtgctgagctgccaacctttacctgggcctaaagggagaatgtgcagactgaataaccctatctagaagcttagggaccagaagtgtttgggacttgagagacatagtttttgaacatttgaatacataatgagattatggattagatccagtctcaacacaaagttcacgtgtgttccctaacacatagcctaaaatgtagcatcgtatttgtagtgcatctgcagtttgatagcggccgtcaaatgggagcaggtgtgaa

SEQ ID NO: 18289 - DNA, 1219 bp, Mus musculus
gaggcaggtagatccctggagctcactggccagcagctcgggttgagatgcaagtctcaaaatataagggagatctaggcacagtggcacacacctttaatgctgacacagcagctctttagagacctggacctaattccaggtaaaggtaggcagagctcttgtgagtttgaagccatcccggtctccatagtgagttccaggccaaccagggctgcataatgagactctgtctcaaaaatacacacacacaaaaataaacaacagaaattaggtaaacggtggtagagatgaacagatacccagtgttgacctctgacctttgtaagcatatacatgcacatgtatgcacacatgccacatgctgcccatattacttcacaacctagttttccttttaaaatgtctatcttgcctgctacatggacttagctatttaaaagtctcataagtgaatttttcataagtacacatgatgatggtacagtcagtccgagttaaaatgggaattgtctcctcattccttagcttgtgactgtcaccatgaaggatccctttcactccagtgtaaagaggacggccgttgtgaatgcagggaaggctttgtgggcaatcgctgtgaccagtgtgaagagaactatttctacaatcggtcctggcctggctgccaggagtgtccggcttgttaccgactggtgaaggataaggtaagctgtcagtagggcattcactcattcattcattcatttgttcgttcattcactcattccttcagcagacatgaagtagaaactcaagtctactctaagctccagagaagaaatggtagacaccttgaacttgctctctcttctcagaggtgtatgttctagtgaggggggagtggccagaaccgcatacataggagaactactgagaaaagtgcctgaagggaaggaataggtactaacaaaccatgggaaactgcagagcctctgtaaggaaactctcgtgattcgagatccgaaggataaagaggcgggagccgtgtgagggggagtgaggcaggcaagcgcctggaacctggaagctgcccagaccctgccctgggaggaactttgtctgtggcaggtcatataggactatgttgactttaagtggggagtttcggggactatttccaaattcagtagagatgtacagaagtcctttacgaggagtgttgtgactgctgtgtgaa

SEQ ID NO: 18290 - DNA, 1340 bp, Mus musculus
gcatgacttgtggcttaatggctttgggcgggctgcacactcgtcagagctatacaatcctctttgtgtgtttgtgtgtgtgtgtgtgtgtgtgtgtgtgtgtttgcgcgtgtgccatacttcaactccatgagtatcctgtaccacatggttgtcttggatgtctttttctggttgccattcccatgaataacctaagctgatagttttgcctgcactcttggggctggcttctcacgagctacccagtggtgatgagcctctggaagctgggaggcccctcagtggctctcttttccacaccacaaacaggcgctgggtacttggatgatgtcaccttgcaaagtgctcgccctgggcccggagtccctgcaacgtgggtggagtcctgcacctgtccagtgggatacgggggacagttctgtgagacgtgcctcccagggtacagaagagaaactccaagccttggaccttatagcccgtgtgtgctctgtacctgtaatgggcacagtgagacctgtgacccggagacaggtaagaaggcctgtggccagtgctggacctgccagtccttttgccattagcagtggcatccattgtcttcttgttactgtactgatagtgtatctccactctcgcaataggtgtctgtgactgcagagacaatacagccggcccccactgtgagaaatgtagcgatgggtactatggggactcaaccctgggcacctcctctgactgccagccttgtccctgccccggtggctcaagttgtgccattgtcccaaagacaaaggaagtggtgtgcacgcactgtccgactggcactgccggtgagtctgccttgctcctcatccctcagagttctctatggttgtgagcattgacacagcctttttccctcgggtgacctcacaaccccaagatggaactgcggctgttgttttgctgtgactaagagagcagaaactgagtgctctgttcaaggctgtgtggcaaggcacaggtgagctgggactgcaacacagctttgtgattccagatagaactgtcaccacatataatgtaatttctcataaagtaagaacccaaactgggctttctgctggcttgtctggaattgctcatgtgaaatggcaatcttaaaattctgtctctgaatcacccttccagcatctcagagtcagtcactttacattgggaacatctatctatctatctatctatctatctatctatctatctatctatctatctatctatttttaaagattttgtttatttattttatatatatgacaagtatactgtagttatctttagacataccagaagagggc

SEQ ID NO: 18291 - DNA, 1196 bp, Mus musculus
ctggctcccgcccctcccatctcgcttctctggcccaccgccctccaggccgcccccgccgccgccgggagtcgctggggaggacgcgtagggcggggagcagctcctggcccgcgtgagctgccgaggaggccggccttgggttttctccaccgccagatcccaccccgccgggcagaccccacccccttctccttcctcctggggcgcgctctcgagtgcgcgctcggaagtcgggggtcggcgcacagtgcaggctgcgcaccgggaggtagcggaggcagcgcgatcttggctcggacgcccacccatcggctctgcgtccggctctcggcctccagcccggtccacagcccggcctcggcccgcagcggaggatcggcctcgggatacgccgctaggcgagtgcagcgcggcaccccagcctttgccgagggcccgcgcgcagcgggatgacgggcggcgggcgggccgcgctggccctgcagccccgggggcggctgtggccgctgttggctgtgctggcggctgtggcgggctgtgtccgggcggccatggacgagtgcgcggatgagggcgggcggccgcagcgctgcatgccggagtttgttaatgccgccttcaatgtgaccgtggtggctaccaacacgtgtgggactccgcccgaggagtactgcgtgcagactggggtgaccggagtcactaagtcctgtcacctgtgcgacgccggccagcagcacctgcaacacggggcagccttcctgaccgactacaacaaccaggccgacaccacctggtggcaaagccagactatgctggccggggtgcagtaccccaactccatcaacctcacgctgcacctgggtaagcgatgacagccccgtccccactactcgctcacggtccagctccggggccgcatccatggagccgctggtccggcctgaggggcctgtccagccgcgtgctgacggtctgttctccagcgtgggccacacacagaaattcctttctccaacttctaaaattcatctcgctttgaacatccggtgagggccaccatgtcccacgctagcatctctctctttttttcttactctttctagtccaaccggattctcgttccgttgattcttttctatttcagcagttaggattttggaccaacacccccccacccccttttgcaccctgag

SEQ ID NO: 18292 - DNA, 1201 bp, Mus musculus
catttttctggcaattgagtgtactacgttatcaaagatgtattccttccaactcatccatttcaccctctgcttgttggcttccaccccctttcactccttagcaatgtgcagctgagtccttttcctcagggaagaaaattctaggttttgcctatgctggtaacaaaaatgttggaaagctgtggcaaagccattggcattggcatttttcacatgggcaacgtgtgaccaccagttcttcccaagccagtacctctggtcacacataggttactagctccaaaacttattaaatcaattatcttgtaagctggaccagatggttgttcttcagtgacagatcttgagagaggggaccagaggatcagaaggtaaggagacagataagtttgggacctggaggtcttgcacaaactatgccttattccaagtaagcttattaaaaagaaaacatctaccagaagctatatttgtggggaaggttttattaaattaccttaaccaatgcaggctatttggtagaatgagtaagaccacactctgcagtgggatataccacttagtatggttcattactatattgtggcctacattggggaaaaaaaaaaagagtatagcatcttatatactctttccaaggtagaaatggggcaaagtcaacagaaactgtcacaataggataaagtcagaaggaggttaatcaagcaatgtcacacaaaggaaacacaggggcctcaggagctttgtggactgagcacagaggccttgggactgacactcccatctcctcaggaggaagagcaggaaccttggttcctttgaggccccagccccagccccagccccaactggtcttgctcagtctcatcctttgtcctttcttcagatccctgcaggcctctgagaaatccttgggtcagtctggctctcaacaaccttgccagtctgcagataaatgagtggtggtattgaccacgataagcagtcagggagagatgctgtatgttctgtggggcctcagatgagggcttccttttttatactttgaacaacttggaagtggccttctcgggtacaaaactgtgcacagtaaagtgacctgtggtgtcatgtgtagacatttctccagtcttgtcaatgctgatgaattgtgatcacccaccagggttagcacattcgtgttgtgactttgtgcatg

SEQ ID NO: 18293 - DNA, 1167 bp, Mus musculus
tagtaaatattagttttgttattaatttttttccaattttttattagatactttcttcatttacatttcaaatgctatctgaaagtcccctgctcccttccccacccactcccacttcttggccccggcgttcctccctactgaggcatatacagtttgcaataccaaggggcctctcttcccaatgatggcggactggaccatcttctgctacatatgcagctagagacacgagctctgggggtactggttagttcatattgttgttccacctatagggttgcagacccctgcagctccttgggtactttatctagctcctccattgggggccctaatattagtttttattttggagttctttgatgagttcagggatagaggcagtatcctagccaacagaagattcagtccacatttgaaggtcttctagcaagaagacttaaactgttatactactcttgtttcagtgtgggagatgctgtctgtaccatctctgctgctacctgcttcccagaaccctttatcagcgaaggaaaacgcctgggatacatacaccggaattttgctggaaacagattttctgatcacgtggctcttttatcagtattccaagcctgggatgatgctaggtaggagtttataggcaactctgtaagctatttgagtatgtaattcagcttgctgagcctttgagagtgaatgctttttctcttttgtttaggatgagtggagaagaagcagaaatacgtttttgtgagcagaagagactcaatatggctacactgagaatgacttgggaggccaaagtacagcttaaagagattctgattaactctggatttcccgaaggtatttataaactggtcattgtgtctcatgttggtaactctagatctagggggctaaaagcagaataaaatcagtgataattcaaagatagtctgaattagttgtaatacccattctcaattatatagaaagaaactcccctaaaaagataatttgtgagtcatggcaataaactacaggtacaggagaatatttatgattctcacctatttgaacatacatatttttatatgatggatgagacacttattcaactttgtttatagcaagttgagttccaactggattaaactttgtgaactggagtgggcttaa

SEQ ID NO: 18294 - DNA, 1124 bp, Mus musculus
agttaccatcaaatgctcataaccgtggttgttcataataacttcccagtaaatagtattaataacttgtacgattttttttggttgtttccaaaatggttggcactgggacctgttggaaatgatggcttcgttttattatatttatgtcttgccttttgctgagtttggggccgttttgttgttgtccgtgcttgttaataggtaggatcggtaggtagtagccatagttagaagtgttagcattaacttttttccttactcctctacttatcagttaaaagataccctggctgtgaaagtaaagtcaggagccagttttcagtcaactagtctagttttgtagtcaataggaaaagttgtgtggtatagactaggaaagggccactataatacccagtttttttatgcaaagatttttgttatgttgtcatgtttgacttttctacttctaaattttagactagagacccacatgacaccagagatgtttagaacaccattgcatgaaattgctctgagcataaaacttctgcgtctaggaggaattggccaattccttgcaaaggcaatcgaacctccacctttggatgctgtaattgaagcagagcatactctaagaggtaagtgctactttcttggtctgtctttacctgacaaatcctatttaatgagtgagtcagatacagactgggtggggagaactttgttaagcattatgcagctatgcatcataatttccatgaggaacttgatggctgaaggggtgtaaataagtctcattcagtaaacatttaatgaactagagaacactaaccagaacatggattactcctcacctgtagttaatattttaagtgtgtgtgtcttagaggttgggctttttggtttttgtttttatctcaaatttgttataaaagtggtgtgtaaaaaataagggtattgagttcagatggctctgcatttaacttggaatcttgtactcaactacttataggatatgtgggtacttaattgctgatgctgctactgtatcaatggctatagtccagtttgcatagaacatacttttatagcatcttttgtgttaggtaatccagggtttgtttttgttttttgacttg

SEQ ID NO: 18295 - DNA, 1273 bp, Mus musculus
ctaaagaattttaattatgagaatatctgatggagaacagttgtttaagttgaagcacagcatgaataattgacattgcagggttgtttaattatttgtgatatcttagtgactattcaaataattccataatcaatgatggaactgttgaggttatatactccagtatatgaagtctttgtgttgtgttgctgtatgtcagagtacctggaaaattattagtctaaatggaatattctccatcacatttacatgagatcctttaattcagttcaggaccgttaatgttgggtattttatttgaacccagactttgcaaacacattactaacttttaaaacttttaacttaaaatttgttcatttaaaggaaagtttcatatttatttgggatatttactgggggagacataagacagttatgagctgcctgacatagatggaagtaactgatgtcaatctctgacagcatatgactgtcacttgtgtagaaaaagacatttagatgtcacttgtgtagaaaaagacatttaagagccgtaataaatgaccaaaaaatcatgttcatttttcttctaggcaaattgcaacctaatatgtggtgacgaatatgggccagaaacaaagttgagcatgtctcagttgaatgaaaaggaaactccttttgaacttattgaggcgcttcttaaatacattgaaacccttaatgttcctggagctgtgttggtatttttacctggctggaacttgatttatactatgcaaaagcatttagaaaataattcgcatttcggtatgagtattttttttttagattgcctttgagtattttttgcttttgtcctggatgataatgtctgttgattaaaaccatttgtaaagaacatttgttttaaacttgcttaggttttgtccttaacctttgtgtttcataggaagtcaccggtatcagattctacctctccattctcagattcctcgtgaggaacagcgcaaagtgtttgatccagtaccagatggagtaaccaaggtaaatatggcatcacaaggagatcagatgtgatatagatgttaactattaataaatgttccaagagctactagggaaatgctaaagtatcaaaaattatagaaaagtctttccatatttgatcatttttttctttttaatcctgttgctgtattgttataagcagaaagtttttagtgtaaatttataccatttttttttcaggttattttgtccacaaacattgctgaaacaagcattacca

SEQ ID NO: 18296 - DNA, 1124 bp, Mus musculus
ccttattttgtgtgcatttacaaagggtatttctgcattggtagtatatatcatgcacttagttgctttatttgtaagtgcacacaaatttggatttagcaggaaacttgtagggcagtgttactctgcatttaactatgaatgcacattttatttaaagtatattaacagcttaaagtgtaaataaagcagtcttcattcagccatcaaaatggtatgtgggaattgtttagcaacacttgagttcatcttaggcttagactatgaagtataaatgtgggcttgcagaaagaacattagatagccagacatgttttgcctgtgaaagagaagacattaaatccaagaatgtaaaagagaacaacttctttacagtaagataaatgaatattacgcctacatttctgcataaacacctgtatgtgtgtgcaaggttgacattcttgagcatgctcacttagagatttattttaaaacattcaaaaatgttgggctggaacatcttaggggaagaaattgactgttagaatggtcagaattttaagtagattattagaggggctgataaatcttaactatagttagttgctgtagggaagttttatgaaacggatttttagtagcataatttaaagtttcttaatattctcaagatatatgtggtttaacctatctgttgacagctaacctttttttttttgtatatttgagacaaggtttctctgtgtagccctggctgtccttgaactcactctgtaaacaccaggcttgcctcaaactgggaaatcctgcctctgcctcccaagtgctgggattaaaggcatgcaccaccatggccccacgaggcagctactcttaactaaaaataaattgcctatgtatataatggaaatagttatatattcttcctttattaaaatttcaaacttgataaaggtcatttctatcattttactattaactgagttaattgagacttgaatatataaacagaccctttaaaaaaactgctgtggctgggtggtggtggtggtgcatgcctttaatccaagcatgtgggaggcagaggcaggcggatttctgaatttgaggccagcctggtctacaaagtgagtttccagtac

SEQ ID NO: 18297 - DNA, 1184 bp, Mus musculus
ctcagaaatctgcctgcctctgcctcccaagtgctgggattaaaggcatgcgccactactgcccggctgcctgcagcattttgatgaagcagaaatacttcagtccttgtattttaacatacagcacccataaatacattgctttggcatattttaaagtggctattctgataaactctgaaaggattaatcctgtaacactgcccttacgtaagataaactatcaaaaaggagatccatggtggcatgtctctaaattttgccttcagaggtggaggcaagtggactgcgttaagtggtgggctagcttgctctacaaagacaaaggcaaggagacataacttccagaaaccaagctggttagcgactgacaggaaattatgggcctaggccagcagatctcgcgcgacctcaggtttggcgcccggaagtggttcaagccccgccccctcggggcgtgctggctccggagttggcctaccgcgcaggcgcgagtcgccgactccgccccctgggtcctgcagtcggagccatttcgccgctgcttccatgcgggtgaggtgtgttctttcgccgttctcgtggaaggttggcgctgcgaactcgcctaagaaggctgtgctctcgggcacggaaaagcggaggagggtaagaaagggggcgttgcggccccggacgcgggctcattgctgcgggccgacgccggcctccgcggctcagccgtggctttgttgtgaggcgcgggcgggcgagcgtgtgggggaggggcagcgcggcgggtacccggatttacgggccgtgggcgcctcgcgcagcggagctcccgtggccctaggccctggggttccttgcacagactggccgctctcggaggcctcttcctcactcggcctgacgggcggcgggtgtctgtaatcagttgcgtgtaggggtagcggctcgacgccacccggcgcgtggtggtggggggtcgtccgcggttctaatccgggacacccgggccccgtgggggtgcccgctttggggtccggggcttcgctgcaggtcctcccgctccgcactggtgacggggcatggctgggtggggcgggatgaggagcaggtggtaggaaaatgaatgcatgatttagtaagtgatggcggaattacaccgcgcaacgggatagccccgctgtagataacgg

SEQ ID NO: 18298 - DNA, 1207 bp, Mus musculus
tgtgaacagggctaactgagaagtcttactgggccctgcgctccttggaagatggggtctaaggagggaggtgggaggaaggagacttccggcacaggggccagcactcatgtccagcaggtgagctaagggagagaagtcattgaaaaatccatctaggagcccaaaagactagctgaagtcaaaccagttctctttgtgggtatgaaaatggggaaaagtgtctcctacccctcaccctggtggaaggggagccttgtgcttctttcctgttgacatgagatgcccactgtagttaggggagaagcccgtcaaggaccaagaaagctctggaacagaagttagctcagccaagggagtattgcagatgtgcggggagggctgcctggaaggatggggccgggggaaaccaacttgcctgcctatcacttctgagtcttaccgaacaaactttccaagttgggacttccagcaccagccaccgagacggagacctaggttgtttccctctgcacttgaggtttctccgggagagaactcttttaagtataatattgtgttctgttgtgttgtgccgattgtctcgctgctattgttatttattgtggtttgtttgcctgtactgaagagcctcagctggagctgctgcctgatcacgcctcctccctaccagactctacctctgcaagccttgggaatcactgagggctgggggggggggggaacgggacacgggactccccactgtgttaatatttatttattgttaacaaagggagctgggttcctttatcagcagtgtatgtgatcactgtttttctgtttgagcatgttatattcttgtaaaaaaacctgaaaataaaactcaaaaataatatcccaatatttcccaggacagtatggatgatatgagggtccaggggagtatggagggcctgtggtatcacagctctggtgattctgtgggatggggatacaggacggggtgggtggctgaaggcacgaaagggttgagctgggtttgaaaggcttttgcagggtagtccacaaggagccgggcttctcctctgcctggtgccttctgggtcacatcagtcctgaaatcctgctctttgagatttcactgcctgaaaagagcctggcccaggcacatagtagtgaatgcctgcaagccctagcttttaggagtttgagaatggccttagat

SEQ ID NO: 18299 - DNA, 1987 bp, Mus musculus
ttccctttcccagttgtccccactgtaactcaaaaggatggaataccaaggtctttttattcctcgtgcccagttaatcttgcttttgttggtcagaatagaggggtcaggttcttaatctctacacaccaaccctttctttcctatctagctttctagtagggagcgggaggggggaggggaagggtaacccactgcttcatctcatcgggtatgcatgtccggtaggcatagctgtcacaaagcgggtgtacttatggtgaaagaggacattttttttttcttcaggatagttgaaagggcaggcccaacggctgagattgacatttccactgttggtagagagctgttatttctaaaggggaaaccagctttctgttccaaatggaagttaggtgaggagttgaaggttggtttcttgcgctgtgcttccttggcttgggggagggggcatccgtccccctctgtgtgaacacagctcaccgcgtcacctgatggatggccctactgtgaaggaagaaaaaagttggcatttcttggtcctccgttcataacacaaagcagagtagtatttttatatttaaatgttaaaaacaaaaaagttatatatatatggatgtgtggatgtatgtctttctaattgagagaaccatcctattcactgggtgccaagtttgagtgatgaggggcttggcttagaagtgaggctcccttgaggtaggggtgaggatgcagtaccgggaaagttggttatcttggggtctcagcttcattactgcttagggtttccctgcccactctgcaggagcagatgttggacaggtagccagtgggatgccactgcttgccaccacctgtccccaggcttaggtttaggggatgcgtatacttactccacacacgagttagaagtatgagttggctggtcaacttgaacactgttactgatgggtgggtgggtgggggtttactggggttatttttttggtgggattagcatgtcactaaagcgggccttttgatatattaagttttttaaaagcaaaacaagtttagattttaatcagatttgtagggtttctaactttacagaattgcctgtttgtttcaatgtctccctccacttggctcttaggggaattaaggacaggcctagagttaaaacacttgtctcctagtgtcacctctgccagcagactgttactttccttctgaaaaagccaatagtctttttttttttcttttatagtaaacacacccccacctccatcccagcctgttgcccttcagttttctggttgtttgtgtcggcagcgggccaactgtggtttctctcttgccatgatgacttctaattgccatgtatagtatgttcggttagataactcactgtaaacagactgtaactgccaggcagcgcttataaatcaacctaacatttataagatttcctctgacttgtttctttgtggttcccaaaaaaaaaaaaaaaacctcaaaaattaagtgctatttcattccttctttctctatcaaaagaaagggaaggggggtggttcttgtttacggacaaaatgtgcttatctgtacttatgcttttaagatgaagtcacgttgacgagatattttgagacggggtcctagtgtccggcctttaacttgaaagttcttgctccagagtaggcaattcccagtttcatgttaggtcttacattttgaaagcagtgttgtctaacagttcagactcaaggatcatgctatcaagtgacacaaaataagacacagatactttaaggtcttgcgttgggcctggccactttcacggctgccctcagctctgggtgactaggctgctagaatttcctggcaaatgggaacctctgtttcacttccggtgccagggcttggtttatcgaacactgacagtcctggcttatcaggatatttaatacagcgtggtacagtgtattagctgcccctgttcttg

SEQ ID NO: 18300 - DNA, 1232 bp, Mus musculus
aggatagtgtgtggtgatgctgtgaaaatagtgtgtggtgatgctgtgaaaatagtgtgtggtgatgctgtgaggatgcatgtggtggtgctgtgaggatgtgtgtggtggtgctgtgaggatgtgtgtggtgatgctgtgaggatgtgtagtgtggtgctgtgaggatgtgtgtggtgatgctgtgaggatgcatgtggtggtgctgtgaggatgtgtgtggtggtgctgtgaggatgtgtgtggtgatgctgtgaggatgtgtagtgtggtgctgtgagggtggcatgtggtgatgctgtgaggatagtgagtggtgatgctgtgaggatagtgtgtggtgatactgtgagaatagtatgtggtgatgctgtaaggatccatgtgaaggtgctgtgaggatggtgtgtgatgatgctgtgaggatgtgtgtggtgatgttgcctcgagtcctacttttattcatcaatgagtcatgtgtgacttctcctttccctttaccttgactacagagaggtacagaaagcagtcaacactgcccaaggattgtttcagagatggacagagctccttcagggcccctctgcagcaacaagggaagaaatcgactggaccaccaacgagctgaggaacaatctccgcagcatagagtgggatctggaggacctcgatgaaaccatcaatatccttctctgtcgtctgggggtctagggacttgggagcatgggcaagagacagacaaggttttatctagatgtcttgagccatagatgagagagaggctggtttttatagtgattgagctggcttttgttggtcactgccgggtgatctcagggaggctagccctattcttccgtctatagcaaaccctccagatctagactgtatagggcagtgatcatcactttggaccctggagtcagtctgctggtgtcccgtttctcattccaccattgtagaagtgaaagtaaacttttcctctcaaatagtaaaatagtaatacttctgatatctgtgggggatttttcttcacataccaaacggttctccagcagacaccaactgagtgtcctatggttttgagactatgtacctggagatagcatgggatcctgtagtgctcatagcccccccatatcagatgccaggtgcaaaccccagattctaacttgttagtcaaactcacttcctgtttgtttaatttttttcaagagcagcttgtagagttc

SEQ ID NO: 18301 - DNA, 1173 bp, Mus musculus
acttaaactttgaatttaagttctgatttgtgtgtttttcttgtttgcttgggtttgttttgttgttttcattgttcttacttatctcccccctctcattctttttttttttttttttttttgagctatagttgggaaaagctatcggccagcttatcccatctgccttgaacccttcaaagaagccagcaagtggctaaggtggcctttaccccaagggcctttggtacccacttaaacaaaccttagccagcccgccctaactctgctctccactgctccctctcatcttcccccagccattctccttaggagtagcatcgatctgtgagactcatcgggagatcttgaatataccttgctggtgttcctcaaaccatctaccaggcaccatcctgcatgcccatatcagagcctgatccaggttcgagggctgcttggcttggtcagtagtggctcctggtgttcctcctgattggttgtccctgctcacacaggcactcctaggagacagcagcagccagagctggaatgctggagtggcagatcgctatgggcgccttgaccgggagctgcagctagccaactcccacttcatcgaggagcagcaggcacagcagcaggtacctgagaacagctggtcaagcaaggaggtggcaggagggcgcctcccctgactctctgatagccacaagcttattacctaaagacaagcagcttagacccagctgccgtatgctgggttgtcaggtgtgtaatgattgtatacaccatttaaaatcttgaaagcatggtgtcccaaagaaccacttgatcagacttcaggaaaagcagagctgacatctaaaccaacaaggccaaggatttgtgcaggctttggttttgttgctgttgttctgagatgggttcttgagctgtgtagctgtggttggttggctgacctccaactcctggagattagcctgcttgtgccttctgcatgcagccgtgccccagctaaagccaaggatttttaaaaggaaaacattccttcttccccagtttcttatttgtacatttagccttttgtccattttaacaaagatactttcagaaacactcgagttcttgtttcatccattgaaagttgttaatttgctgagcgtggtggtgcacgcctttaatcccagcact

SEQ ID NO: 18302 - DNA, 1151 bp, Mus musculus
cagttgtctttgaggtaacttactgtcctggaagaagaaaaggactctatgcagtcctcccacatccagagatctgctaggctgtctttcactgacactgtgaccatctgttgtggacggagaccttgatcttggcggtgggcttcctcttcctaaccagcccctgatgtggtggtcatatgcttgtgtgcattggccgttttccgttccctcgttggacctcagccaagcagagtaaatctctcttggtggtttcaagccccgctgacggctcactgttggatcagcaggggatagcagtagcttgacagtccaggctttggagcagtgtgttctcagaggcagtggtctgctgctttgatttctgggctttgcttttgaatgtgaattgtcccaagctggcaaagaaactagcagctgctggagtgccgggcttggaaccaggtaagatggattttaattgcttatttccgttcctctggcaccagttgattgtggaacagcaggatgagcagttggagctggtctctggcagcatcggggtgctgaagaacatgtcgcagcgcatcggaggggagctggaggaacaggccgtgtgagtagtgagatgccctgagcagcagtgacgctgactgagaccctgaaagcctagcagtgaagtacgtggctgctaaagagagaagctgcataatgtgtggttgcagtttggactttgttgcacggagtagctcccccaaagaagcaaatcccagataaaattcacaactgtggtttaggcaaagctgttagttttaaaaccctttaaacgacacactaagttctctgagcagactcttgaggcatagttaggaatgggaagcagatagagccatgccctctggagacagtgccctgaagaggaggatgggcctgaaggtggtgttaggactcccagctgtcatccatcccagtacccactacattaacataagtcctgtcttacaaaagaacattcaaatttaattgtaattagcaaaaacaatcttccctctcaaaacaaaggaataaaaaaaagcaaaacatggactagagagatggctctgaggttaagatcactggctgctcttccagaggtcctgagttcaatgcccagcaaccacatggtggctcaa

SEQ ID NO: 18303 - DNA, 1553 bp, Mus musculus
ctctaccccgcctcctctgtgactccagctttgagacagccctctctcccagcgctcaaagggcaagcttcgaagagggaagaggtgaccatgtgcccggccggatagcagaagccccggctgcccactcttgctgaggacagcaagccactgctttgccttactggacctcgctccttgaggaaggaaggacagagtcctcagaagaactgacagccccacttactccgttgctcattctgctggtctctggcagcctttccttctactcagacccttttccctgcttagatgggttgccactctcccttcagaagaagcctggcaagaacgagggcatctggggatgtacgtttccattgctgttatgtttcttagcccctgagagcttgctgtttctgagaacagaaggctcagaaacacttcgtgacagaaatgcagtgtctcattttgctgggtaagagttgagattaaactgcttttccgggtgtttttgtggcagggataagcaacaggaagtagtgaaatcccttggggctgggggtgcagatgatgaaaggctttaataaactggggcagttgagaacagcagcacctgtgtcggtctagcctattgaaggactgatggtatctccctgggcctggccagagctgctgacctgctctgtcccagggctgtctcctcagaggtgcagcttgcagacgtagagccccgaacagcacagcaatgctcagccaggtgggacacaccttcttctctgatgcttttatgctgatggcactcagagatgaggtaggagggccagcacatctattacgcttatgcagaagctgtcctgacacagaaaggctgcttctgagccagaggccccttactctgtgagtaatagcatagatggggaagagaacttggtactctgctctctaagaacaacttgacttcatcatccatgggagttactgagggagtccaaattccctgacagatggtttattgggttgaagtggctgaaactgctgacactacgcttcaggcttcgggtgacggttcccatacctcagatgtgctcatgaatgtgggatttcttataatgtcccaaatgcatagcctggtattaacatagccgtcagggccagagccagccttccacgttggaggctgccgctcagttgtcctccgtgctggaagagcagcacctggacagcctgacctttgacctctcttgctctgcctctctgtgcattccttagcatgccaactttcaaaaaacaaatcctgggttattcatattccttgggattttgacttttgggtcccctttttgttttgttttattattcccaatgatgtgcttgcccagctaactttcaaattgcacttttaaataaatatttgtaacaatttttaaaagaagggtattttatcttgtttaggatcatgataggtaaggaaatctacctgttggtaaaagctaaaagattagtaagaccaaaagggggtcggcaccgtgtctgcgtgaagctctggtgttagatacagtgatgttagttct

SEQ ID NO: 18304 - DNA, 4632 bp, Mus musculus
ttcaggcccctcacactttattagacatttccccttctggtctcaccttcttcagccagaatttgatcaaattaaaagtcttttgtggggactgtatttctgagcatctagaacaaatcctttatattcatcgacacaaaagatcttggtggctatttttaaacccagctgtattaaaaggtgatgttgaattttacgacacccctaccatggcctgcttttaaattcggggcttctaaacctggttgtactttttaaattatatttcttagaaaattcaggatataaatacctactttattctctatctcaccccctttcttcataaattctctagagaagcctaaaaacatacagcgcttgactgtcttgaaaatggttggtttcatatctggtactcatcagcttgtcactgggaatctagatcgttggtagtagtgactgcccagcattcttgagacccttgattttctctccagcatgggtcagggtagagaaacagccattattcagtaaaattaatataaataccaggaaaaggtaaataaatggccccacccttcagatctagataaaagtcccacgtaggagggccatgaacgtgtgcccttgtcagatgaactttagactaagaaaccggtgactagggaaacagcagtaacacttacattgttttaaaacttggctactgccccttagctcgtgcttgtcattagctcctcctgcatatcaaacccttactcactaaagttacagcactgctaaaatcctactgattaactcaccagcttccgtttacaaagtttcttccatttttattctgacaaagttccatttttttcctcctttctcgattgagatttttaacaacaccttgcccccatcccccaccccaaaaaagctcactcaatgttgtaggttctgttgctttttgtgttttgccaagcatgtcccttgccccaaaactaaagagcaaatgtttatttaaagtaaaaacaaaactataaataaattgtatactttataataatcagtggtaacaatttagagaccctggcagattaaaggttgcattatttttatttagatttttttcccttactattttgtactttaaagctggggatagatttcactggtttctgaggtaacagcagtaacgattaggaatatatagaaaagttcagtgaccagtcatttcttgtacaaataaaatcagtggtactgtgtatccagagccctgtgaattgtcagcttctttctctggtagtgagctgagtggcggcacacactcctcacagttgactcctgatgttccagctctctgatgtctttatgtcaggtaacacagagccagtttggtctttctccccctgccaggatcccaggccctaatcagtattatttctttcataaacagtaagtgatggagtatattccttttctgatatctgtcctgttgaccactcagacgtaagtttacaagctgtgcggcttacatggcagacgctccaacgtgtattcagatgctctggctgcatcccttcccagctctaaagagatttctccatcaaaagactttaggaaacgacatatgcattaattattttcctttgaaaaaggcaatgtgcatttttctttcctcagtttcatctgccccaggcactgtgagcagtgtcctgctaatgtgctcttggataatcctgtaccctgaaactctcgatggaacacaccaatgtcatgtcacataaaccagaggtaacacttatctgattgcagccttagaactcttaattttagttttatttgaaaaggaccccatttttaatagcgcttgaaatacccccaaaagaaatgaaaaagagactaaagtccacttttcactttatactcatgcagaaagcagtgtagttggaagagatagccgtttgttgttggcaaattagcctataccgcagctgcctcgacagtggggtgttgacatgccctcccacaccgaggcagtggcgggatcagcgatgaagtcagccccatagttgggtgtaatggccacgtgcaggctttctgtctccagccccctgtattacactccttaaacagactgtttagattcaggggacacagtgagtgccagtggctcagcaagaacccaggtgacctcttagaggaggccctccctcctgggagccatgactccccatgtgctagatgagctctcatgggcggtgtctttccaccatgcttccctgttgtctgagcaggtgaacctaaggcaaggcaagagcagagctgagggaggcacactgacagggagtcagagtgtagttgatggagaggactgggtggggctgtggcagcaggagcagggcactggtaaatcctgtgactcgggctgtgacttcctgtcacttgctttatttacggatagttctttactcccaaattcaattttccaagcagtaactgcagagatttcttattctaagaaaaggggtttagaaataacactatctgtgacattatattaaaaccatgggattctctagtgattatactattgcgtaaatgttttaggttgttgttttttacataaaaataaaatttgcctccctctcaataggaactttttactgtaaacaatatgtttcggtatctagaattaaggtaactgcttagactaaacgttgattgtgtggaatcctgagctacagaagccacacttttctctattctaatgagctgtgtcattactgaccaagggaaaatagaaattcaggttgaattttgaaaatggtgatctgttttctattttttttttttggtggtcattcacttaaacatgaatttttgcatttcaggcatcagtcacaatacctgatgttaaagctcccagcctgcctatttcaagtttatacaatgccagaacacatggtcgtgtgggatagagttgattatattgtagtttgtggtattcagtgttaggagccagccctctagccagcgtcaaccacactctactcaatgaatattttttaaaaagcaaaaacatttcatgagccctgcaagagctgcagttagagagtacagagtctgcctgacagagaagaggcactgacgggcgtggcccctgtgcctttcttacatgaactttcaaaactgataacgagttgcctgccccctagaaacaaccttcagaatatattttcttatcgtggatgaggaagtgagggggacaagatgagtttcccctgaagtggggaaaaccatatcaatttacaactgaatatgttttcttatagcaaaccttcggtttattttattaaaccaatgccagcttcaatttttttatacggtgccatccacctacggaggacaatcaagtgacctactgtttgccttggattcagtgtctattgattgaatctcatcttgtgtacctttgaacttaattcccacttgactcctgtccatctgaaccaccacaaggcagagggcagcggcggcgctgctggacagatgtggatgtgtgagaaagggcggggtcccgcctcactgtctctccaacactctctaaagttcttgcctgcacttctcctgttgtccctggcaacactagtatgctgtagacagggagaaggactgcttgtgaccttagtgtttattttcaactgttaagataaaattgtaaaccactcctatttcagttgcaaaaacaaaaacaaaaaacaaaacccttgaggctttcttacattgtgaagattccttatgttgggtttctaggttagcacggaagcttgtatcaatgaagaggatttaggagggaaatagggtaaaacttgttacttttctttcaaaccctctccctctgctgtatacacacacacacacacacacacacacacacacacacacacacacaccccgtgttggttaggtgatgctgtccggtgactccctgaactatagttgtcaagagtaactatgattgtgattagtcctctgtgggtgacccttgccccatgtgcacccttgctttctttcctactctccactctggtaaatggaaaaggtgacatcaaagaatcaatgcttgcttggactcacgtcgtatctgtgactatgctattagctgtctccttttcccttcttatatgggtagaattcttatgacatgtggagtttccttctggataagtaggttaaatgcacaatgtggtactgttctatagattctagatggtgtaaaaagcaaaaaaaaaaaagttaatgtgcttatgtgtttttaaaagaaaataagtgattggttacaaatctctggcctttttcattattacaagctgtgttttccaacagtgtgctgactcgtcactggtgagtggtatgtgttcctgtgtgctttctctctgtgtgtcttggattcctgaccatcattccccttagtattaacatatatatgggtctaacacaaactgctcacaacagggaattagaaaaacataatttaccaaattcaaaagcaattaaaaaaaaaagcaggcatagtgggatatacctgtgagcctcagactgaggcaggagaattgctgtgagtttgagacaggccctggctacatagttctggaccacctgggc

SEQ ID NO: 18305 - DNA, 1147 bp, Mus musculus
accctgtctcaaaaaatcaaaaaaaaaaaattttaaagaatcaattcattatttgtgaaatttacccagcatcatcacagaaagacttgagcaagctgaagctaccttatgaagtccataactaggattcttacctgccactgactttgtgtcccaaagctaacagtaaacataaagcatatggtgactgcactcggtgttgagagaatagagagagagacagcagagtaggttacgatgaaaaacgtaagttggacatttttctgaaggtaagggagtgcttggacaaggtaaagactgtgcctgtggaaatggagagtaggaaggaaacacatgtgctcagacagtagtgagaaaatgtaattggatgggctcatctgaactgacccacacctgtaagcccagcattttgacagtggaagcaggaggatcatagctacacagcaagcccaggccagcctggtttacactagatcctatctcaaaaacaaacaaatagccaaagactaaaaactgcaggcttcatcttgtagggaaagaaaaagaacaaaacaaaacatgttcttccaaagaggagtgacaggaaaggagactgtgtcactgcacagtgcagtaggaaagggaaatcgggacagtaaaggcctggatcgggttgtaaagtcgggtacaggagcatagaggagatgagcagaaggggctacagtccggtgagtacagaagcccaggcctaccaaagctttagctagagagtgggaattttctggaaagaaagtagagaaggaaaaagcagaaaagaggagagtgagtcttagggcagaggaaagtagcagaagtcacagtgggaaatgagcgggaagagcactgactcagctgcactctgtccagggaggcacggcaacctggggtgcaggagcgctgtgggtaagagggtgctgaggaggtggctagcctcaaggcctggagaaaaggctgacagaccagagctcctcaccgtgaaggtctcatagctaccagcagagggcagtctaaacatggtttctgatcaagagggaggctcttggtgctagtctgttcatttcaggggtttacagggaaacgctgggaaactagatggcagccagaggaaggcagttagaagaacaggctt

SEQ ID NO: 18306 - DNA, 1242 bp, Mus musculus
cacctgcctctgcctcccaagtgctgggattaaaggcatgcgccaacactgcccagcttaaatgtttaattcttttagatactgttataattaaaattgctttcctaattttattttcagattgcttattgcttttatatatatatatatatatatatatatatatatatatataatacacacacaccactgaattttgtgtgttgattgactttgtgttctgcaactttgctgaagctactaactctcacaggtttattgtggattctttggaatcatctatattttgtaatatatctggtgtcttaggattcataatataaagctacaaatgtgtttttctacttttctaattttttaactaatcttgactctgctggctctctaaattaaataatttatcctactaagatttgatatctggtttatatgtttgattgcaaagcaagcactttctctaccctgttgcttttaagttattaaatatttttataaataataaatggttgtttaaattaagtaagtataacttggtagagatgaaatgaaagaaacacagtaggtgctggggaaactcacttttataaaaatgtgatgtatcatgccggttactgggagtgttgtaggatggggttgggaaaagtaagttgcaaattagtaagagctgagatctcagagctgaaggatttgaacatcataactctaagaaagctgtagagtagagatggtactgagtgttggaatgggcatgtgagcaacacagtacttgagagcaccagctttgtacaaagttataaagattgcagttataaaggtgtggtggtagaggcaagtgggctccttcaagttcaaggccaggccaaccaaaggctacatttacatatacatcaataatccagagcaaattacgcaacctatctgtgctccagttttctcagtcaacatagacatagtaatttaaattcacaaaacaattatactgattcagactaactattacatagaatagcaccaggaataagactaagtcctcaccttattaagcattctatacatgttgactatgatttatttatatggcatttaaattttctcattgtcttcttgtgttttgtgtcttttcattttgcaacaaatctgtgagataggagttaatgtagccagtgaaagcaatgttgaagaggatgtaccatacaagaagctcccattgacaaaactagtcttatactaggcatggtggtg

SEQ ID NO: 18307 - DNA, 1121 bp, Mus musculus
cctggttagaaggggagagttgactggggcaaactgagcagacctgtcctgggagcctggtagttaatttgtaagataggaggtattctgctggtctgtaaatgatacagtctcagtaggggtaatgctagacttagggagatttaaatagtggattaccatagtttgtgatatttcaaaatttaccaggtatatctgtcttctaaaatgtcatgagagagggcaaatagggagaaagtatttccaaaaggccccaagatagggtaatatgttttatacttctctatcaaaacataattggagtgcttctcctctgcacagttatctttatgtccttagatcaatgaaatatatgtaaaataataataggagatatgctagctggatgtgatgttgtgagtttaaggtcagcctgggctgcacactgggatcctatttaagagatatgctgtttgtgctctttgcatcattaatgaaggccttcttggctgttctgtgctgtagggaggcatggaaagccctcggtgactcaagccctagccaagcaatgcaggaatatatcgcggcagttaaaaaactagatccaggatggaatcctcaggtaagacttctagctgtatactttctgaaaacttactttctccaaacaaatgtctctaactaagctttggtgtaacgcgtcttaagcttcagttcatcaaaaactataaggtaattgtaatatttatctgtgaaaataactacttaaatattaccatgagcagtaactgatacagaaacctctgggtagtagtttgtagaagtatggtttaatcttgtaagatctgaaattatgtcagaatttggagattatcattttgggaataagaaaacttctttcaattaaaacaattgggtggtctggagagatggctcagtgtttaagggcatccactgctcttccagaggtcctgagttcagttcctagcacccatatcgggtagctcacaaccacctggaaagacaacttcaggggatccaactcctggcttccatgtcatctgcagaaacccatacaacagatatacgtacataacgagaaaataattatacagctcttgagagtcagatgcgagttggag

SEQ ID NO: 18308 - DNA, 1148 bp, Mus musculus
cagcactagttgttcttccacaggacctgaattcaattctagtgtgtgttataaaggcaaagtgtgacctcttgttgccttctcagctcatcttccatgaagtgagcaattcattatttatagcatgtttaacagtcttcatctgctgttttctctgtacccagatcctgtggccaggtactttgtgccaaagccaaaaaagtcagtcaaactggttttccttcaaatagtttattttcctttaatcttgtttaacttttattattatatgaagaggtttgtctgtacagaaggtgtgaaggaaatttgggtctatcaagctaaagtatgccatagtccttgctttcagagagcagaagttgacctacaatcacaaaaaaaatacaagaaaaagatggaggagatcagggagagttttagtgcagaatggaaaaagctcaagattctcttgtattttctaaaaagagagttgcagatgtaatgtactgtaggtgcaatgttttgtgagtgtactatggtgtagtttctataaatgtactataggtgcaatgttctataagtgtactataggtgtgcagagttctataagtgtattatgggtatagtgttctctaagtatcctataggtgcagagttctataagtaagtgtactataggtgcagagttctataagtgtactactattattgtgttatataagtgaactatgggtatagtgttctataagcatactataggtgtagtgttctataggtgcattgttctagaagagagggcagccagataaaaaggggcttccatgattctgcggcattttaaaagtgatggtaaataagaattgtgcacatgatgactgcatctctctctctatttgggagtgtgggtgtgcacagaccgtactttactgcgtcgctcacctctgtcctgtgtgtgtagagtggggaacctgtgcttttctacctttatagtttccattttaggcattgatggcttttgattcattttaacattactctgttatttttgtttacttttaattcaactgagtagttttattttaccctaatgtatcatctgttacaaagatttcaaacacatgaccgattctaatgtattggaatagatttggctgttctttataatataa

SEQ ID NO: 18309 - DNA, 4125 bp, Mus musculus
gtgctagagtcacaggaggtatgcgccagccaccattgctagctgtcactgagttccagtactctaggatgatatggtacttctgttggatgagtagagttttcctttgcagggctccatctaaacttgctgcttctctttcctgtaagctcctgtgtgcactcactcgtgttaacacagacatgggttataatcagtctatctctcttatctacaaaatgctggaataccagcatgttcaaatggagctattttagtttcgatgctaattttaaaggtgtattgacatgatttctttgggacacattgtacatgggaggtgtaagttcctagctcttgggtgacaggcttgctaacgtattgccttctaacatccaggtccaggagctgcacgaggaggaggcacagtgggtgaactatgatgaggatgagttgtgtgtgaagatgcagctggctgatgggatctttgagaccttgatcaaagatactattgatgttctcaatcagatcagtgaaaagcaggggagaatgctacttgtgtgacatcttgcaaataaatcgaacactgagtgctaacatgagtcctgggcctttctgccttctgatatacaccccatctccaccatagcaagaatgcttctggaccttgaacctgttcttatggactgctggtttggagttcatgggacaatgtggtatatctggtattacagcctttgcctttacagactgtccactggattacgtggttttttcccgtgggcagggctatactctgatgctgagacttggtatcacctcattagcacccatacctactaggtctcagatgagggctgagaacaccagactgacctctgagcttagacaaagcttgagtgtcctcatgagacttgcgtctccgcaggaaagagaggtacatagattcttcttttaactttcaaaacataatcctggtctatacaatgaaactcacaaatggacatgctagtctctgaacagtattaaacccataaccactttaaaataggcaaacgcaagattgtctgcctattttacattctggagtttatttcttcttgaagaccattttcttccattcttgaagttaagcagcaccaagtggatgtcagaaataagtgggagctttgctttgggcaccacctaaaaactataacccattgcactgtgtttaattttcctgtctgggcagaacccagtgaagacgaggctccaggactgctgcgggctgttcctccgccctggtcccacccctgctctctcctcatctgtcctaacctctaccagctgctctcagaatcgtagatactcaggaccatctcaggcatccaggcatggcaaaagtggaaagacctcattttggccttcaaacgttgacttcccatctctcccgcagaagtcagtgctgttacttgaatgagttagaaaatgagtggcgcaccaaagacaagaagatcctgtccagagtctgcctgcttgtttggctctgtggaatatttttaatttattttaaggtaaattattaagttgaaaatgtgtgtccctattgagaagtgaaagattctcatcattgtaaacctccgtctcgaagcttctacagtttaatcttcgcacaggaaagctgcagttttaataaatctatacacacactgaagaagtcagttcagttcatcaaaaagacaacagacgtttacaccgtcacccgggcagcaggacaggacaggactcgaaagactaaagtttatcctgcctttcttgcagcattgcatcttacaaccattacctgcatctgaggaacatctccagactccagctgctacctttgagcacctggtgctctcctgggcccttagcacctgccttcttgactggtttctcttcatcagtcctgtccttcctaatcccagggaatgaggatgatctgaggcgtgtgtgtaaatgccttaaccctaacagtcgcggctagaacagcatggtaagacatccgctggggtcacacttacagacaccctggacattatggcttcaaaacacattagaaaacccaaagacagcgtaacccttaagtatgcacgtttgttcttttctgcatcttccttccctacttgccattgcatctctgatgtctcactctgcacacgtcactcctcttgcgtttcatcctgtcattacacaacatttgctgaaaccatcattggatatttgcattttgcacagtgactggtgtgctagctcttgacaataagaaagcactgaactgttccaattgggtctcctgaatgctcaggtgggtgtctcatcagcatctcttctgtgcttttgctgttgagctgtcgtctttagccataatgagcaggttgacgaagagaagaaaggtttctcgaggttcttagtagtgtggaaatagttttcatgtggccaatgaaagcaaagatagttctcctcagtttgtgttccttaggagacaggagacatctgtgtccatcccttgactgtttgtaggatcatattgtctttatgaaactgaactttacagctgctataagtttttttataaatgaaaatcaaattataataggaatataggttgttttccatgtcttcattatttggacctgaggttaattttttaataagacagtgtatcttttactctctacattatcatgccagaaaaggaaaaacttactgctgtaagtccataggctcagcgacctggacagtgccgagatcgtggcagtggccgtcctaacctccgctagctgtcttcactatccaagaaccctgcattccagatgcgaggcgggagtaagccagtctcctcctttgctagcaattacagctccagtttggtagcaaaaacaagtgagtctatagagttaacaggtttcttcctattttaactatttggatctaactgggtgggtttactgttagggtcaggaatgatggatgtggctgcccagccactcactcggtccacactggggtctttttaatgaagctctgcctcataaccaagaacctaagaatgccctcttcctaactttgcccctcccctacacccgcgccctcctgtctgtctgcattgattcctctaaacgatctttgcatctgcagtaataccttttagtatagcactgtcagtacctggtagtaaaccaccatggaggcttcagattgacatctgagtccaaacaatttgtgctatccagggcagttaactctgggttaaactagtacagggtatcgattccctcttcaggtctaaacaggaatttttactctagggaaaagtggaaagagctcaaaagtagtttataaggaaggtgacttccttctgtgactacaggtctctgagaaattgtctttcaaaagagattgcattgctcataagagtgttgtggcctattgataaaaacaattttgttcactttcttgtcttgaaaaaaaagtggccttagctttttgcaatacttgaataaagtgtgtacttgcaaaagaatttctgtagcacagcattagagactcataacttttctgcaagaaattcaaacttacatcttccttttactaccttaagaatactagtgaataaaacattaattcaaagagcaagtgatagaaactacaatgccgtttaatgcaaattgtaggaatttacatgtttacaaatcatcttaaactggttgtgcagcaattcaataaaatctttgtattataaaaatgtgaagaaagtgtaaaccggtgtaaaggaagcaccgttgttgtaactaagctgtggaaaagcttttccttctggactttgcaacgccttcttggttacacattgcaaagcattctctagggggctcagcctcctcgtgtgtactgtactgtgcagacatgaaaaataaacccgtttactgtgtgtgtgtaaatagcctgatcatcaggccatcttcagccaatagtcaccccctgcagcccttagacgtctgcacagaagccctagggtgtggtttgtaagtacgctctgtaaaataactgggatgaagtcccatgtatacccatgtacatagatttgttaactaaaatgtactttaagatgaaatctgtaaataa

SEQ ID NO: 18310 - DNA, 1183 bp, Mus musculus
agaggatcagtccaatcacagtacagatgaccgcagtccagacatccagtcagcaggaggcatccctgagcaaggatgcagagagagtggggactccacatgctcaggacagctttctgttcctaaagagtcgtcctactctgaagattttgaagtgtcttctttcaggaaagggatttctgctgacgagattagtaaagatgactctgaggggtcctcaccatcgtcgctcaggaaggactctcagtctcacagagataggtcacagctcacaaggagctccagaagcagagccaccgggtctggaagcgatgaggagatcagcgagtgtctcggtgagaaaagcctctctgttcatagtggcgtccactcggaaaggctgctggagctcaggtcacccacagagctaatgaagagtaaggagcgcagcgacgtggggcacgagcagggggggactgagccccttcccctggctgccacagaggagctactagatttccacattggggatagggtgttgatcggcagtgttcagccaggtactcttcggttcaaaggtgagactgactttgctaaagggttctgggctggagtggagctggacaagcctgaaggaaacaacaatgggacctatgatgggattgtgtattttgtgtgcaaagacaagcatggtatttttgctcctcctcaaaaaatatctcaccttctagaaaactttgatgatacagacataaatgaagatgaagagtcttactcagatgaacagtaccaaccctataatcaagagcagaaagatataaaatgtctaaaagacagagaaaacaatatagctgaatatttttgtgagaagtcacttcctagtatgcataatacagatgcctcagtggataaagatagaagccttaacatagaaacagatacttctgaggtcctagaggtccatggtcaccaacagccttcagtagatcctctgatttcttataaggagaacaaagtccttgtttctgatgccacagagagtgttcctgctgctgcgggtgctgctacttcagacaacacgttttctggagaatcaaagcaacagcagcttgcagagaaggaagagaacttttattctcaagttttggaaaagccctctacccctcttctggatcttttaacaagagaaaaaaaccaattagaa

SEQ ID NO: 18311 - DNA, 1179 bp, Mus musculus
gtgttttttttcttttcttttatatacccccggagtttggctttgtttctttattgtctatttaaaaaaacatttagttatttttattttatgtgtctgattgttttgtctgagagtatgtgtctactgtgtgtttggctggtgcccataggcagctgtaagccactctgtgggtgcagggaactgaagctggaccccccaagagtagcaagcgctccgaactgcggagccagctcttcagatggggattgattattttgtggaattttctatgttctaatctttggaaagcaaatcagctagttttatttatttatttgtattttttgtattctgtagagaaggtctgttctctgtgtcttgagaagcatagcctttcataatggtagggagaaaaattgtattttgagtaaatataataaagatttagctttgtaacaaatgattatgcggtctctctccatgagctttaaatgtatgtaatgcaggaatgaatagtaattggattatttcaggattaatttatgtgttttcatggtattcaaattttagctgagacacattgagaacaaattagaagtaactcctacaagcacagctgtaatcgattctgtgatggatactaagaagtctgcaagtgctacccgaaaaataagtaggaaaggtatgtgtgaagtcccttctaagaatttaactatactgaatacagattcataaattactattattgcttgtggggatagatgcacatacgccacgcctgcatttgtggaggccagactttggttctccttttctacctttatgtgggttctggggttgccccattaatacagattttagttgtctcagtttagtgcgtcttggtagtctgcagtgcatgtcttaggctgagtacttatgcagagtacttgtgacacagcctcatgcttagtgatgctgatggtatttttaccagtgcatcatgcgttttctttgtttgtgggaatgagaattgtgtttgggtgtctgaggttatagatacttattttgttagttcttaggtatagtctttgaaggtaaaatttagctgacttaacacgaatgtgtttcttttgtgggggggccaaatttttagtcatgaatatctttcatatagaaactatataatacattgacactatgcagatgcatatagat

SEQ ID NO: 18312 - DNA, 1211 bp, Mus musculus
gtgtgtatgtgtgtgcatgtataaataaatgtaacatgttcagtccatttagtggtgcttatatgtgtatgtatttaggactgatcacgtggaatcagataacttattagggcacttgtcctagaagaaggctagttctacctctcttaacaacctgtagctcttcatctataggagtgtaaataaagcaatgtcttacccgtgtcaaagcctgtaaattacaacaataacggccaagatacgctcacaggtagacttgcggcctgtttggtagatgggaattcatccttgttccagtaaatatagccctgcctgtgggtggtgaggtcatgaactccagaggataaccaacactgccacattcctaaacctgtaaaatttccaaccacattctaaatatctattcagagccccagaaggatttaggcaagttacaatagcatttgggaaatagctgagattatgaaaagtgtattgaggggttagggagctggctcagttattgaactgtttgctatgtaagcgtgaagacctgagttcagatctctagaacccacactaaaagccaggcattatgctatatgcctgtaatcctggctgtagtgagatggaagcaggatccctggggattgctggccgtgtactccaggtcagtaggtgagctctaggttcagtgagagactttgtctgagaaaggaagacaggccccacctttgacttttgcccttcatgtgcacatgcacacacacataacacgcacacacgtacatacacatacccactcacacatgtgtactcggacatgtatacacataccttaaaatgtgttgaattttcttggtaagaagaagctagaaaagaggtctagtgttaggaaatgtaaccattgaagtactgggctgaggtagagggccttcatcactcagttaatgtatgtgctgttaaggaaaaaggagagctgtgcttacattattaatctaggagaagtgggagtttcaagattaaagttcgaaattgtatatgttaataaaatattgctttaataccatcaaatggaaagttatactgtgcatatgggttttttatttttagatttttaaagacataattttaaacaatgtttaaataagtctttaaactttatttattttatgtttatgagtggttgctttcatttatgtcagtgcactgcatgtgtgcctagtgctggc

SEQ ID NO: 18313 - DNA, 1237 bp, Mus musculus
atacctgacagtttttgtcctaaagaaaatatagtttctggtacatcctcaacttgatggtttgggattttttaaattattattattattactattattatttaatttttttactttttgccgatactaggaattgaacctgagatcccacaccagctggtcacgtgttctcctggtgaccatcccctagcagtagaaacacattttgaagtcaggtaactcatgtctacaatgccagcacttgggaagttgaagaagaagccattgttagctgtatagtgagtttcaagccagcttgcctgggctgtaggatgaagtactgcctctacacccactatccccctccctgccccccaatacacaaccacccccactaccccccttcccacccctctgacccctacccctgtctccacacctactacctccctcccccccatctccacagccaatacccacccccccaatacacaacacagagatagcttcaaaattggtaaacagttctctgctgggctgttgaagagaacttcattttctctgtacatgagtactggaagtctgggagtggtggtccataacaaatagagatatactatgcacatgatcattttgtcgagtgagtacctcaagccaaaagagtgaaccttaccacacgtgaagaacagcggacctaggtctctattgctcgagtattttagagttttttgcatttataactaggtattctcatctgtccgctgctgttttgttttctactcttaacaattctagatgcaccttgagttcttctccatagacatctaaatgagaatactactttagagtcctagtcaactgttctttacccactgggagtctcatggtgggtggtaagatttgtattactatctgtttcggtcaggtcagactgataagattctcattttgtaaagaattataaaaaagtttttgaaagtctttattttttacatacatatcataaggaaatagaaatgtcttatattccactgacttaaataaatttcttttatctttcagaaaaaaaacaattgtagcagttaatgtgtaaaaagcttttaaaagctattttagtaatttaaataaatttactttttgggtttgtattctgtatgttataaacttaatgatttacaagcctggttttttgttttttgtttttgtttttgtttttgttttttctggtttttcgagatagggtttctctgtgtagccc

SEQ ID NO: 18314 - DNA, 1123 bp, Mus musculus
gtccagataaaggtcctttcaagactgacttcagtggatctactccaccaggtcttcccgaccttactacatcactgccaagtgctattggcgagactgcctgcaccagcagaagactcaccggatccatcagagcgtcggttttaccagagcaaagcaagagcctgtgtggttctgcctcccgctaatactggacaggaaacagcaactggcttggactagaggcctggctttcctttgaaggagctattctgtgatctgtgttgctagtaagtgactgacagtattctagactggactggtccctgagtacagagactgagttgcaattaagtgaagaataaacttcaagatcttgaagaactgcactaaggtgcaagccaggttcagcactccagtgttgttgaactgacaagttgctaaaggaaactgtaactggactgactgttgcttattgcttccctctctctgtcattgttgctttttgttgttacattgctttgtgttgtctttctaagcccagatgttctccgataattcacactgccctgattgtgggcagcagtggttccctagtttagaactagggcactggttgtaccaaactgaacttgttgaaaatgaatgttaccaagtgttcttagaccgtattaacagggctgactactgccctgagtgttaccctgacaatcctgctaatagaagccttgttctgccttggtctttcccacttgagtgggcacctcaaaatcttaccaggtggacctttgaaaaagcttgccatccatttcttctgggtcctccactggttagaaaaaagatacatgactccagggtagctggctttaatcctgcattacaattaattttgtccagaacagacaaaaccttaaacaagaaacttggccaaagcaaatgacttctgtaacagaatcatggagactctcaagggctttgcgttcgtagcctaggggagaagaggaattaacgtgtttctgttttccttctctttttctttcttataattttttaaggtgctggggattgaatctgggtgccttgtgcatgctaggcaagtgctcttccactaagttaaaccaaggctccccctttctaagactga

SEQ ID NO: 18315 - DNA, 1365 bp, Mus musculus
gcagccagagtatttacctagaaccagactaacctatagcccctataaatgctttagaactacctggcccctcttgaaaatcaccacaacctaagtattgacaagataatgtagtcctggaggggaggccccatgttgtatgccccataaactgtttttctatcagtacctgttatgagaacatgttcttgtagctggattctagattctaataaattttaatacactacattgttctaattttctcctcttatattgatcaataatgagagatgtgtgtatgtacatgtaaatttttttcatatatatataaccattctttgacacttttatcctcagtgtaagtattacagtgttttaactggtcctgtcacatactatttggcaatacctacaccggttaccaaaaaatgtgttaatgctgccagtttacacttacttatctctatataaccaaagactgtcttgtcttgtggtgagtgaactcagtgtcctcccatggaaatggaaaaataacccatgctatggagtttatgacaaatgataaagcttgactccatataactttagagtggtctagtggatgctctgtcttagccgtaagaatgtgctgctgaacattggccacgttctaggattctggtcatggaaatcatggaatcagatttggagttaagcagcttagaaaaggctcctgggaacatctgagaagccactggacattgttaaattttcacttaagattctaggtgatccagtgcctgtgtagaagcagaaatgtcaaggacccaggtggttctctttcctctctagggtctttatggtctttgttctcatgatagtttttaaatgggttcagtatggttcgttgtgccgataattcaatcacaaccagaagcagggggcacctggcttgctttcttacaagtcttaatttggaaataaaatctttttgaaatgactcagcaggttttattgtttttgttttactctcatgagcaggtactgattcatgcactagtctgagaaagacttggcaaaggaggaggaagattgggctttcccttatggcacctcacctccgctgataaaactgacatccatcccttaagtggggaagtggaggactagttgttgatacgcaataaatcttgctttccacatgtgaaacctggcttttgtctctttaaaggatggattctagtgagccactcctgtgtctgccatatgtctgtcatggcggaggttctcacttggtacctgaagtacactgtgtggaccgccagattgagtgaagttagttgttaattgtcaatgaggtacttactcccatattgttgatcctaaagctcttcccaaaacata

SEQ ID NO: 18316 - DNA, 3303 bp, Mus musculus
ctctcaccagcctctagggcagtgcttggacctggacgaggtgtcatgtaaatgattttagagaactcttctactacatattaagtgctttttaatattcacttttttttgttgtttttttctgaggcagggtttctctgtgtagctctggctgtcctggaactcactttgtagaccaggctggcctcgaactcagaaatctgcctgcctctgcctcctaagtgctggggttaaaggcgtgcagcatcactgcctggccttaatactcactttaataatacacttgtgggttgattgtgtcttacacagatttgcactttgagtaggtgaaaacagaaaactagaattcaaccctccaaacctacctaagagcctggtgtgtgtgtgcttctgttccgttagtgagctgaggccagaacagctgtgctcaaaaaagaaccttcccaagcattggactcaatgacgaaattgttagtaatcaccagaaatgaaaaaatcccccttggccatgtcacttgtctttgcctacccagcagcccctccttcctgtgaatcatgcctgctcttggctgctgggtttggggttctctgttaggatttcagtggagctgagtttcacagagaagtttgaaagccattgatgaagtgaaagtgcattctagagtaggaaggataggaagacatgaaagggttaaagctgaggagtaacaggaagttctgttgttcagggcgacagagacctgcagatgagctgctactggagggtgtagggcagggccgtgagcttttgtccctttctgtggatctttcctgtcctcccctgctggaatctcactgttgtctgtgttctttcagaaaagacttgaggtcctcagctagttagaaatgccgtcaggaaaggaacttgataaacacaaggggaaggtctcctgtagggaacagaaagaggaatcatggccaatatccgttgttaagctacatcccatgatttcagactggggccaataagctgttaatcagtacgtgaactctgaaagtaaaactctagtaaaatgatcttgacccacaaaaggtctgttcctttacatggatgggaaaagcccttggaatcttgcactcagttttgggtcatctgctgctaagagatcatgtatacacttaagacattaagcaacctgagtctaaagggattttaggaaacactaagaagatgtctattggtagttaaatggatcacagagacacgggtgagaggtgatctgaaaatatttcccacaagatggctttggccacaacctttggtgttaagtaagttaagtatgggggcacacatgaaacagtatgtatttgggattttgaaggaatcctgatatagatttcagaaaagaccctacacaaagtttaagcatagtgaatggaatttttctgtcaactcattgtaaaacacagggattgaagaaaaatccatttgccatttttgaattttttttcttctgtatttctagacttatttgttttgaatgctagtggcttgtcacatagccatgtctggcctggtgtttactctgtagcataggctgactttgaacttagagtaatttctcctacctccgtgtgctgagtgccgaggctacaggtgtgtgccatcatatccaactttcatgtaagctcttagccactagcattacatcgcgtaaaaccacatcaaatcgcgtcaaaaggtgccttgcagactgtcatgttggcctttgacccatgctacctcagactctagaggaatgtctacagtatttgtgcacagtctatgtcagtggctcagatcacaagtggaaagcaatcgtttcctcattaaaactatgtaaaacgacagccttacatagtttcctgtcaacacaaatttaggatataatacattttagaaatttattatttttcaattatttttggtttttttactacttaccttgtaaaaatacacttttccttttgtcataagtgcaatcagctgagtgagacttgtcagttgttgttgctttttttttttctatcctctgtttcaaaactcagggccttaacattcaaggaaagtgccctaccactaacctatatcccagacctcttaaaagtcattttgaaaagaagcagtatgttagtttggggtcagaacaagtaattttctggttttgataccgagtctctacacagtccaaagtaatgattctcaagcctcgggctcttacaggatgggattacggtagtgtgccgccacaccagcctattatcccgtgtactgtcttctagaccattgcttttcatattcagttttccagccttttatgtgtgttgtaattctttgtgataatttgcctgtgtgtgtatgttttttattggtggtggggttttttttgtttgtttttaactaggaatcccttcttgagtaataccaagtcttagaagcaagcaggggaaatagaaactgtctttagacttgggtctttctttccctttcaggtaaaatttagggttcttctgggcaccactcagagattgtcagaaaagctctagagagttcttaacactgaactaattttagtaacttttacctggaagtccgcaggcttagggggagtagtgaggctcagtacccttcccattggcttatgtgccccacccccacccccaatcactgtggctgatggtacagctttgtctcacagcctttggtccacagtcttgttaaagacaggagcactgtgagcacggatgttggctatgacagacagatgcagcctgtgaacacgagagtagtgcagcaaaaatgattttcaccaacactcttactttctctaacaaagatttcttaaccccatagagttttgcctttatatatttacaaatgtaatggcttgtcaaacttaccaaatcaccataactgctttttgcattcatttccatagtgatgatgttgaatgtgccttattcaaatcaattgtctgattactatacaataaatctcttcaatttttcctgactgattttttactaaaatttccaaaataaagaatttatgaaaatgggtgtgcggttgttagtggtgggaagagtcaaaaggattctgaagcatcgggtggtgttgcggctgtcagggacgaggggccatgcaggcggtgtgctggactcctccaccacccttggcagtggctgtggggcatttacccccacctggctctctcttgaccaggggaagagtgagcacagccttgggagtggtccaaacatgaggcttgctgactggggatgtat

SEQ ID NO: 18317 - DNA, 1454 bp, Mus musculus
agggcttcagagacatccaccccaaggagaaaggcctgggaacttacgcgccaggttccatgtccatgccctctggaaccgaatcaataatgttcaacagcgcttccagatgaaacttcatttcattaatcttttcatcaatttcaagccactcttcagtgggtacttgagaataatcaaggaagttttctaacttgaaaacacacatgtccaaagaaatgaccaagtttggaagaactttagagatacctaggaaaatggggaaaaaaaaaaaaaaaaagaacaaactctttgtgatatcattattccaatagagtataaaaatctaggcgagggcagatcctctcttgtctctcattcactagagaacctcaagagatgctcaaaacacccaaagatcaagttttcagcacaaagaagatgtatgtgccccagagggacaaaaggcagggaataagagacaaaaacaggtctcgaactaggctgcttcagccgtgaacaacgccgaaatggccaagattaaggctcgggacctgcgcggcaagaagaaggaggagctgttgaaacaactggacgatctgaaggtggaattgtcccagcttcgggtcgccaaagtgacaggcggtgccgcgtccaagctctccaagatacgagtcgttcgcaagtctatcgcccgagtcctcactgttattaaccagactcaaaaagaaaacctcaggaaattctacaagggcaagaaatacaagcccctagacctgcgacccaagaagactagagccatgcgccgccggctcaccaagcacgaggagaagctgaagaccaagaagcagcagcggaaggagcggctgtatcctctgcgcaagtatgcagtcaaggcctgagatgacaacgacaataaagtgcgagactgactggcaaaaaaaaaaaaaaaaaaaaacaaaaaaaaaacaaaaaaaaaaaaaaagagacaaaaacaggagacagtgggtgaggactaaggagaaaaggaacaaggagggagagggatatttgttgggggtgggaggggatgacaaagtattgcctctagatagataggagacagatgtggtacacaaaacaatggcagtttataaaggttaaagggaaagccagtgttagaatggggtgttagatttagagtgggtatgttaattaggtgagccaaaggtggcttttgattgctggacttcaatactttgatagctggaccttagtagtcagcctcaggagaaggaagtgggcaaataagggaacaaaccttgagggctagctttaggaatgtaatctaatggtttagcaacacagaagtgattttgagagacctaaaggagaaatagatatggcccaattaccatagttttaaatcttaatagttattaaacatttgaagttattaggggtcagggatgaggattgttggcagagcagttgcc

SEQ ID NO: 18318 - DNA, 1159 bp, Mus musculus
ttttttttttttttttcaaaccatgtctgaactctttaaagagaaaataaaaccaaacctcttgctagcagtgtgttccaagctggtttgtttattgtttattattccgtgttgtgccaatgggagaaagctgttttctcttgaggatacttcttatttgtctacaaagtaaggggtttagtgttttctataagaagtattaatgctgataactgattttaagtgacccaagaaaactactgtctctacagccatttcacgttgtatttggatgtctgcttcggccttgtgcgacttatgtgttggacatttttattctcagtctcagataagagggagagggagcaagtttagggtttttttttgttgatggatgaatgtattaaaattacctgggtaacattgcttgcctcgggttagactttattagaacactaagactggaatttctggtgctgtttgtttctgttgttctttgtttgtttttgaagcagggtgactcttcatatctctgtctatcctggaactcatgttgaccaggttgtcctcgaactcacagatctgcctcccaagtgcagggtttaaaggggtgcaccgccatgcctagctggggttgtttttaacttgtcagtaactgcagcatttggcagtgtggaaaatgtacctgtttcccttctattcaagggaaaagttgttgatgttggcaggttaagaaagaaagtacaatgtagaagtaattgtatttgtaaacattgttacagaactaattcatttatgatatgtaacttgttttgaaagttaaaaattattcttgtctaaaaattgaatatcacagctttgtttttagacaagtcatattatgtttgaaaagcactcacttggtctgtataacctaaaaagatggaatttagcctagtagtggtggtccatgcttttaattctagcacttgggaggcagagataggtggatctttatgagtttgaggttagcctggtctaccaagggagttccaggacagccacggttacacagagagactctgtctctggaaaagaaacaaaacaaaacaaaaaacagaaatggaatttattagttgtcaggagagcctattttaaaaaaaaatgactgttttacacaggtataagaaaatttgaggca

SEQ ID NO: 18319 - DNA, 1533 bp, Mus musculus
ggaagacatcatttctgtatctctgagcatagaagttttgttcatgcacattatcaagaggtatgctagtgcaattgagaagaaagaaattttgttatttttggtagagaaaaaaaaaaccctattttccaaagataatcttgttatgcattctgctcgtctcttttgttgctattctgctttgctttgcttctgtgctaggagtggaacccagggtctcgctcagggacagcaccctgagccacagcccaggccttccactgtatttttctgaaagttctggtctactgttttgttttccattttctgtataagttgtgattcttttaaatgattagtgttccccttgaactcaatgctagtacaaattcaagggtcagaagtagaaagggaaaaaagacatttccttttgaaatttcaaaagtcattttaatacagactcactgagctgcccatgtgtttttaattgtgctaccatagaagttctgtggaagattttattattgttggtttgattttggttttttagaggtggggtcttgctatgtagcccaggctggtcttgaacttgctatgtagcctgactggtcttgaacccctgacctcctgtgtcccaagtgctaggatcacagaagacatctccatgcctggccaagatttttttttttttttttttaacttttaggttataacttctttgaagttacttagaagtatcctttggtctaattgctttattgtctaatgcgtagtgactttccttgttatagactagcgagtccatagtggaagtattaatctttctctactaataatcccaaaatggctcctaaggctccagaagctggcttctgaaacatctgctcagtcattatactttatatttttagatgaaataaatgactatgtgatcatttgtaaggacatgtactcatatgtgacatttgcaaattgtgaggcgctcattcctcacctggtgtgtcagaaggacctgctgtgcttgtgtgcaagggtgagcctatgtgtgcgaggactgtgcatcagaaaggtaccacggaccacagagttcaaaccttctgcccaaagaaatgagccgtacaagttgctcacacacaaaatcccatggcacagtcactttggtggtttcctggcaaccatccgtacagttttgggaagtcttttcagagtggctttaaaaatcacttttgagtctcacgagatctggagggctcttttataatcactctccgctaggaccacaggtctccaggttccttacctacctattgaccactgctggggatgaatagtggctgtttctgtcagttctttgttcccaaacaatagtgttctgtgttgtcacagaaccatagccccttgataagtctgtaaaggcttgtgtgtgttgttttgttttgttttgtttttttgtttttcgagacggtttctctgtgtagccctgtctgtcctggaactcactttgtagaccaggctggcctcgaactcagaaatccacctgcctctgcctcccaa

SEQ ID NO: 18320 - DNA, 1240 bp, Mus musculus
cggcagcggaggctgcagcctcgctctggtccctgcggctggcggccgagccgtgtgtctcctcctccgccgccgccatattgtctgtgtgaagctaggggagcgcggctattgccgctgccgcttccaccgcagtgtgaagaaaaagggtctgaaacaaagtcttaccaacgtctgcttttgaacacagtgactgctggatctttaaacatcaagttcagctttgtctgtcaacctgtctgacatgtcgggacccgtgccaagcagggccagagtttacacagatgttaacacacacagaccccgagagtactgggattatgaatcacatgtggtggaatgggggaatcaagatgactaccagcttgttcgaaaattaggtaggggcaaatacagtgaagtgtttgaagccatcaacatcacaaataatgaaaaagttgttgttaaaattctcaagccagtaaaaaagaagaaaattaagcgtgaaataaagattttggagaatttgagaggtgggcccaacatcatcacacttgcagacattgtaaaagaccctgtgtcacgaacccctgccttggtttttgaacatgtaaacaacacagacttcaagcaattgtaccagacgttaacagactatgacattcgattttacatgtatgaaattctgaaagccctggattattgtcacagcatggggattatgcacagagatgtgaaaccccataatgtcatgattgatcatgagcacagaaagcttcggctaatagactggggtttagctgagttttaccatccaggccaagagtataatgtccgagttgcttctcgatatttcaaaggtccagagctacttgtagattatcagatgtacgattatagtttggatatgtggagcttgggttgtatgctggccagtatgatcttccggaaggagccatttttccatggacatgacaattatgatcagttggtgaggatagccaaggttctgggaacagaagatttatatgactatattgacaagtacaacattgaattagatccacgtttcaacgatatcttgggcagacactcccgtaagcgatgggaacgctttgtccacagtgaaaaccagcatcttgtcagccctgaggccttggattttctggacaagctgcttcgatatgaccaccagtcacggctcactgcaagagaggccatggagcacccttacttctacactgttgtgaaggaccaggct

SEQ ID NO: 18321 - DNA, 6172 bp, Mus musculus
tgagcagctacacatactctgcacttaatgagaataccaagcagatgtcgtacctttctgaaaggggctggccacatggctgcttgtacctttccctccttgcagccctctggctggctgtagggagccgtgtccactgagggctcgcctccacaggatctcgtgttctttgtctttgctcccagaccatccctaagcccttgttgcacttggagtttgtgttgggaatattctttatttattttctcctttcatctctatttcagtgtgcataatagaaggagtgggttattttcagggagcaccagttaggcccagagccctcagggtttaacctgagagttggttttgcctttgagaaatgccactcccctcccctgattacagtcatggaagctattagagtaacatgggatagaaccgtagcaggctgcacattacttatggttttggtgttgtgtctaattctagtttctgggtttttttttcaaagagagccaatacaaaatatggtgatgtttctttttccaaaggaatattaatgtaggaagatgagaattgcgcactaagcagtgttttcttcctggctcattgatccacgccgtcaagtcgctgccccgtcttctgatctcttaattgaaggcactagcccacattcccaagcgggttttgcagacttaatataccactcccgctgagaggctctctgggaagctcttaatgttaacttaatgttgttgggtcgcttttcattctctttgctgaatcacaaataagaaactttgaactgccagaatcgggccagaaccctaaggggaaactattttaagtcgcatttggcatccttaaccaagaaagaaattaaattttcaattagaaaaaggaaatttggatgcctgtcactgctgctttagtgaaagctcagggtgagccgaggcctggggtaaaggacccagccctgcagtggcagcatgttccctcagctgcagcctgacagccaggctccaggttcatgcccctggagtcacggaagaggattccctccaccttggtggccactgttctgcacatcggatgcacgcataaacttgaatttattctagcagttaacttagttagatggggcagaggaagtgaaaacttgagggcattattaatgctgcttttagcgtatgtcccttgccgtggtgggatgtcttaatggatggtggttgttttgggtttgggtctcgtttttgtttgtttgttattggttttcccttcagagttctgaaaacaagcaagtagtgttcttcaaaacactgctgagtctcttggctgcctgcttttctttctctgaggccctgagtcatgtctcactcaagcgtctgccctgctcacacagcatcactaaatccatgagctgaactgactgtcctctcctcatgacgcatgagcggtgtcctttacagggattgaggcctcgggccacagaggcactgtcaacttgctgtggaagaattatttacgtttgtcttgcatctacctgcaagggaccagcttaaaagggggggggggggacacaaaataaaaggttagaatctaaatcagagaaaactgcttttagaagcgaaaaatgtaattaattatgtagcctaaaaacaaagcagatggcgagagagaaggctctggcaactcctaaagccgtttgtcctgggcagacctttgcactgtgacagcttgcttactctcattacaagtcccgtgacttcagttggctctcctgccttcagatgcagtgctttgtattgaatatagccaaattctgctttacggggaacttggttgttgtcgtttaagctttgggtacaattatatttcacatttccaggtgatttccatcatgctgttcagaaagaaaggccttaaaattggccttttgtattttgcagtgagatggactaaattgaacataatataccaagctgtgatctggcatgtaagaaactgatttggtcattttcaagatgcccttcgtaaaaggtcatcatagtggattggagactagtttccggcctcattttaaggtttcatttataaatgttcctacttaaatcctccttagcagacaattggctggtaaaatcattttctgttaatgaagacagtggtttttaagttaggggtacagcattaccgatagtgtgaggccatgtttataggctgtagctcaggtgcctggggcagtgaccacctaggatgttaattgctagtatgagctcctaacctgggagcacacaaacatcctctagagatttttaaaggaaaactgatgaattagccccgctttgatggaatccctggtgggatgagagactagctagcatgcttcccaagatcttctccaggtttcaaacactccccgctctctgaacactgtgcacagcagaggagacgggagagtactgttgtcactagttcatatcttggagcagctaatggcaaagctggggctagaattcaggagtcctgacatttggcatctctccacagcctgctgccttgtgagatgccgagctagacaatcagtgtgcatggtgctgcacacttctaaagcacaggctctggcaggcctggccagggagggcttggatgtttggtaatggcagtgtagctggacaagcctttagtagaactccgctctgaagagaacttagcactgttcttctagacctcaggcacacatagagatctgcactttgtagttgaagaataccagcttgagttgtttaaaaacaagaaggaaaaaaaaaaacaaactagtcctacactcttttttgttcaaaaagcaatgtgttgttcagtgtcattttaatgcatgtgaggtagtgtatctgaaagcaccttgagaaatcaaatgcattcactgtaaagctgaattgcgaatgtgtgtagaggatgagctgacctggacctggagctagaggctcaccctctgctgtggtttgttgcagacataggtccgacactgctaaatgtgcatgggaagacacggcgctgtttgctaacagtttagagctgagcagcttcaggaaattaggggccaagtctttggtttaattctcatctttaagaagtagtcaagtggtggcgtgcaatccagcagtgaagaggctaaggcaagagagtctcaggttctagaccagcctcggcctcaggagatgcaaaggaggaatagattactcccggtggagccagcagcttttccaggcccttgactggaagatgaagacccccttcctcttgagcagtcctctgctacatgctcggcttttggtgtggtaggagcagactcatctcctgtttatgttgacactttcttttaaaaactaatgtcttggggtggggggaaagttgggggtagaagactgatgtacttggagaatttctagaattttctcccagttataaatgacagtgactcctttaaaagaagagtagctgagcttaactcacctgttagattatcatgtattccaaaaaatcatgtggaggtggcctgcgtagagcggcactctagtctcttcccctgccccgccttttctacctttgctagtgatgccctgttcattgggctgtatcttcaggggagttggtattgggttgacagagtcatctttatttctgttctcaatgatctgtgtcatcaccttgcatgcattaacttgcttcatttgaatctgacatacatctttatgccctcagcatctgctatggccagtactttctgtatttcttgtcagctgctttagcttggtcaagcctggtagcttagttctttggattttgtaggcatgcagaggcctagagcaaggcagttcctagggaacctgtgctcagactgccggaggcagcctaagggtgcctatggctcccatgctgccgtcacctctgaggcagagaggcgagaccttgggatggtcctaacacttggtctactcctaagtcttatgcatagagttccagttttccagcttaggactcaggagtgcttggagtggtggttgttcctgttacctgtgctgatgagcccagcacagtgacccaacttcagtgctgttgcctgtgatcctgttactacggaggctggctcagctcaccctgctccactgccatgtgtttgtgttccatcttgactaggtaatgataactcttcttttagactagctccccaggtgcctcaggaggaccctggatggagtctgggcagtttatcttgataagaaactgacagaagccttgattagaaactgacagaagccgtttaatcccagcacttgggaggcagaggcagaggcaggtggatttctgagttcgaggccagcctggtctacagaatgagttccaggacagccagggctacacagagaaaccctgtctcgggggggaaaaaaaaggaaaggaaaaggaaagaaactgacagaagtcatcttcagagatttgtaccatcaaagatgagttcctgagtattactgggagaaatacttgcctgctgggctgttcataactattgaactagagctcaaagtccgttgcttcagactctccattcatctctctgcacactggcagattgctgccgtgctttctccatcctatgtgatgtgctgagggaagaaggtccttctggaccagcctccgcctccactcacacttcctttgctccatgtatgcctataaatttgagactgtttacccctcctagataataataatctttatttccctggtgcggacaaacaagaacacagtagcagaaccctgcacactgagtggatctgcaaagttgccatctaaggataaaataggcccacttgtcctcggaccatagcatcttgagaagaatagggctgtgtggggtcctgagttattcacctgttttgagagcttggaccccagccctttagaacatggaggaggcacagtcagatgctagcaaggtggtgaaaggaaatacaaagagttctgtgggtggagcttgctcgcttgcttaggtttgtttctgagttcctgaatagcgctttaacatcttgtttttagcgaccttataatttaggactagtgggacttcataaaaatgtcacatacctgagttcccagttttcagcagatataaagtggcacatctcttgttgagtcaggggacactgcaggggctgtagtgctccaggatccttagttcccaagttgtctttggttgctttaagacccatgctgtgttgtgaatgacaagaatgctgatggtcagggccacgggaacctgcttgcttgatctcggtggccagcttcctttatgccacttgaactccatcctgagaagtgtttgctgagaccttgagaaatgaccttcaggaacatgaggattcagaaacctccctgtagctccttatcacctctctctgagggcagaggcagtggctggtgagcaccctgcacacacacacaccccttccttgtagaccctgcacttcttctcgtttgcaatctgattctgtaatgactatcagtggaattgcccgactttgtgtttgcttgataaaagtaaatttgaacattttgtgatggttgatagaactttgtcctaaaacttgctaattcagactctttaaaactctaatgtttataccaaaggttacactgcaggcgtaggtggtacacagagggtgactccctagagtgggcactgtgtgcattgctaaggggacacagtgcccagtgagaccatatgggattttactaaacacgtcagtcatgggtcacactaccactgttgtcaagtatttgttcttaattgttattgtaatatattttcgattgtttttctaatttaattctctctgttgtctgactgtgaactgctaacagtgttaaaaacttgatgtaaataaacgatgcccctggcagggactgtttcctgccatgtctcacaaggtttgcaagttgtgttttgttctaaataaaagctgaaatgatttataggcaaagtgggcttgagttggagtatttctcccaggatactaattgacagggaagcagagcagacctttacaggcaggcattcagtagagggctctaaagtccggaggatggttagtgagcatcctctgatatactctttccggagtgtgagctg

SEQ ID NO: 18322 - DNA, 1202 bp, Mus musculus
ccccctcttattcaaagtcctgctcagcactctcacctttagttcttgtaaaaatggaccatttctgcaacccccacttaccagtacatgtgtactcactcacctgccttaaggctagggaccacctagcccagccatattcaaataactgaaataaaggagtgtggtttggaagtgggatctcaattagcaaaggcagtcacaaagttcaaaagcttaggagttctgctgccacaaaccccagggacagaaatttaacaattaaggtttcttataaagcaagaccacatggtaattaataagcataaaatgcccaatgagacttagattcttgttcaagccaggtgcttccatgctgtccttgaatattcaggaggacagagcgggatgggcacaaagtgagaaccaagtgaactgtaacaggaatactagtgaatccctcccatccaagagccagacacaccgttctccctctcgacaggggatgctggagcgctgagcaggtcttacctgatctaacagaactgaaatccgagaataccctgtggtcacgagtattataggtaggaaagcagagcagggattataagcagaaacttacagttccagaacaaccagcaggtcagtggttagagtgaaatggaaaaatcttaattttgtgaggcaaagcccatgaggaaaacagctctgagaaactgcaacacacacacacatctcagacaggcactgtgcccaaaggactagaaaaacactaaactccaaattagtataataacgagcactacagtggtgaaaaagctccatgactcaagcactccgaagactgaggcaggaggctgtctagtgaatttgagactggctagggatatacagcaagactgtccctgtctttttgagacagtgtctcacacagctaaaaatggtcttgaactcagtacgtaaccctgaagtgactttgctttttcatctttcaagtgctataattacaggcatgtgccagtacacctggctttatctggtgctgggctcagatcctgggcttcttgctaggcaaggactttactgatgcccagccccaagaccctgtttctaagaatgacactggactggacaataaaaacaaggtcagtgcaagtgctgatggttcttcctttgtttttgtaaaataaacatgaccggtacagctaaggaaaagtgaaggg

SEQ ID NO: 18323 - DNA, 1151 bp, Mus musculus
tgagattatgaagccagaaagctcatcaataattgtggttaaaatgtcccttagggctggagagatggctcagtagttaggagccagcattacccttacagagggcttaagttcaattcccacaatccccattagccacctcaccgctggctacaactccacttccaggggatcggactcccttttctggcttctgcaggcagcagccctcagctacagacacccagaactacatacatatatctatatacataattatataaaaagaatttttaaaatggtatgttctagggtttgggagttagatcacttggcagggtgcctaagtgatctaggggaagcaagagtctgagttccaatcccagtacccacataaaagttgggcatagccgggcggtggtggcgcacgcctttaatcccaacacttgggaggcagagacaggcggatttctgagttcgaggccagcctggactacaaagtgagttccaggacagccaagactatacagagaaaccctgtctcgaaaaaaccaaaaaaaaaagttgggcatagctctgcacacctgtcactcactgcactgttggcagagactggtggctccctgaagcctgttagccacagccaaactgatgaacaacaggtccagggacacaccatatcacacacacacacacacacaaaaaaggcatgattaaggaagacacttaatgttgaccccttttgcatgtacacatgaacacccacatgaacacacacacaacacacacagtgttcctttctagtcaagtatggtgttctgtagtctagcacttgggaaacttaaaagatattgtctaggagctcagcctaggctacatagaaagacccagtctcaataaagaatcgtccgtctgtctccaggtttaaccagaaaaggtctgtggcatataacctggacccagcagcagcagtgagcggttaaggctggtggatggttttcctgagatgctccactgtcttttgcatggtctttgatggatgagctcttagaaacaagagacttcattccaagattgcttcttgctattcatatgcctttcctgtcattattaaattaatataacaatccctgggcattagcccaccctattaagcagatttcctgcagatc

SEQ ID NO: 18324 - DNA, 3604 bp, Mus musculus
aagaatggagtactaaagtctgccttaaaatctgccatggcccatgaccccatctcccctgtgctctccgatccacacttggacactgtggaccagcggcttctgaatgtcttggccaccatcaagcagtgtactgaccagtttgggacggatactgtgctggtggaagacaggatgccactctcccacttgtaattctcaacgcaaaacaagtggaactgattttacaaagatagagaaacagcacaatcaattccaaatggcatgcgatggtctgcaggtggccacagtgggtgctggtggcagaagacggtggcggccctgggagtgctcggtgttttctgcagtgcaagctacggaccacagttaggctgcctcacctctcaggcggccagcagcagctctgctcagtctttattcccacaccaaagggcgagcaggtgtgacattggctaaggaagtgtttccagagtgtgcgtctcgggtgacccttgctgtcttttctctacacccatggattctctgaaaatactttgcagttccttgtgtcttaaaaaaacacaaaaacaaaaaccagaactagtcagattgaaaccatactgttcctccagagcggcgttagacaggatagcggtccgcaccgggggccgtgtttaagggagattggaggaggggaaaggcggaaaggtcttgggactctaagctattgggtggcatggatttgacatctcagggaagagaagagggagggactcactctttagaaccaggaagataattgacttagtgaaagacagcttcccctctgtttaggttctcagatatgtccagagcaaattagtcatcccccggttgtgttcatattaaccacaatcatctctagaggaaagagtattacaacccaggcatgatcctctatggacactaacttaccccatgtccacctttgcccaaaaacactgaaactgtgctctctgccacctgccccccacgctttttctttttctctctttggcattgttcattttgaggtagaccatagactctagcccaggctgatctggagcttactgtatagcccaggctttgaactggccttagccttccacatgctaggattataggtatgaaccaacatgcccagctctctcttctctcgtgaagtcataccctgtgagtaactggcctgtaatggcgctcttcctaggacagtggtgaccttgtctgtgccggtgactgcaccctgcaggtaacagtgaaagcttttaagcctctgagcctcgagactggggagattgagtttataccccctagtctctcacattcaaatctagtagcctgtaaccacttttaaatggcttgaaattaggaaacttgtacatttaatgtacactttgcggtagattaaggaatatactgcatatttctttttttaaactcgggatattgaacttcagaaaacaaatattagcacaaaacactaaaatagtgttaacaaaaggagatattgagccaggcagtggtgacacgcacacctttaatcctggcatttgggaggtagaggcagtcagatctctgtgagttcaaggccagcctggtctacagagtaagttctaggaccaaacccaaaaaataaagcaaaaacaaaaggaggtattaagtccagtttccaggctacttgctgtgtacatcaagaaaattcagttgaattctgagattagcatggttattagcactttatgctgggagccagcagagtggtggacttccgtgctgactaagctgtggctcagcattccattgcacactggtgaagtgagtagggattgttcccaggcaagcagccgtactcgtcatgttttctgcggaaaagaacaggcaggaaagctgctccgagcagttagagaaaagccgcctcacactgtgtttcacactcgggcagtaagtattgtaacgccggcctctttttgggtcatttactagattaggactattacatccaaggcactgggggattctggtgggctccaaattagctttactgattgaacatccacagagatggaggcatttaatacaaaaccaggaactccgaatccattgctctttcctcctttgctttcacttcttaagtatatgtgttctgaagttgagatgggagagatttgaatatagaatttttattctcaaactgtttagtcatctaaggcttcattgtacttcggggagagctataagtaactcacctttaaaacaacaggctctgatttgctgaagaggtttggtattttttaaggtatgtctccctgtttgcactcagggttaaagtgtcagactaaatttttagaagaaaacagaaattcaggtgtgtgttcattataggttattcagcaaagtggaccctgacagtttctcggtttccccagtgctgaagacagcattgccatccaaagaaactcacattttctttaaagctatcacactttgtcttcttatcccctgcttcctgttccttcagcctcccttccctttccttcctggatctctgattatcttgtgatcatagcacctgctgtcggcacactcccgtgagtcctgtggtcagggtttcaggataggaggtggaggtttgggttaacgtgggaaaatgttcttgctttgacacaaggaagtactgagtggctgcaccgagaaaggacttggctagtaaggttagaatgtgcatcgcgcatagccgagcagcctgctagcaggtgacacactccgtgggggaggctcttctccccttctttctctagtctgggtggtgaacgggctgacactgctgtcactggttcttaggacctaaggtggtcctcataaactcctgggggaagctgggagcaacttcctgggaagctaatttatttgtctaaagggtggtgtgggcatcaccacccttgtttgatctgccttggatttcctcttggagcttatgtgcagatagaggttgtacttggtaagatttctaatgtgttctatgggtttcaattctgaaaaaaaaataaaagattttaatatatattattgtataatgtcttctggttaatctccccccacccccaaccccatgctttctatgccatttctattcctactgctgttttttagggagagaatgttacatcctttatttctgcttaaccttccatagggactgcttcctgtggttgagagccttagacttccttacgagcttttgaacggcccacatagattgtacctgttacctacaagtcgtcctaggactagtcataggactagtcgtcacgggactagtcacaggactagctgctagtgtttcctggatgttcagtagtttccttcttccttgtagcttcttggagatgaggaattatgagtcctaactaggacttggcagcgcactacactacagacaagaagaaaggaccagtttccctgattagaattcttagaatacccagaatttacatttttgaaatggaaatctagtatctaacccctcagccagacaagtatcgtttagatttcctctccatgtgctgcataagtgtgccagccttgtcattgtatttgaacaagg

SEQ ID NO: 18325 - DNA, 1099 bp, Mus musculus
cccactattgtgccaccttcttacaggctcttgatcctgacgttgagtcagtcacagtgttcataactgcagagtttgcagagtttgatttattagaagcccaacaagaacattgttatcccggaggaatgagccatgcttagcccctccatggttggagcaaagatggacacagcctcgtcagtctctggctgcatttcctctccaatgacctcagcagaaagtcttctcctgagattaaatctgtaaattacatacatctaaaactgaggcagtctattgattggaaatcagtactaatagatttaactcattggccttttaagagaacatacccttcctgtttattgaggcacattcctttctacctggattttaagccatcatgcaaaacctcctgcaaacaagagttactggtattgcttactggaagattggctttagtcagaagaaatcctctgcccgcaatgcttttgaaagacttggatccttttgaaatggatgctgagctgcactgtgcggggcaacagcagtgaggaccactgctgcttgtggggtgacagctagcggtggttggggtgtggctgacaagcctccttttagggcttgcattcattttcttttatattatttcttagaaacgtagtgccatcctggttttatagctgggggtttattgcttcttcaagcctctgaggtacaagaattgctattaaatagtattgatgataaattgcctatgaaccacttcaaaatgacttaagtaccttttggatttgcttctcaaaaatggcttgtgtctaaatttcagtttgagaatcttctgaagagatgtgtacacaccagctcttcagcccagtgaaagcaatttctttttccctatctccagccatagtgtggggaaattgggtcagtgtctcagcgatctgaaggtcagtgttagggcattgaggatgactgggatcacctgcccacctaaccccatgacttgagggccgtgcttgtccctctctccacccactaaatctggcagtcgtaaaggagactacagacatttggatgcttgcaggcctctcatcttagatcttagttctttttc

SEQ ID NO: 18326 - DNA, 1144 bp, Mus musculus
tctaggaattgaaaatataaaaccttttcttgtatgacttcacaaaatgtaccagaacattgtattcagaaagttactgtcggtccccagtgtgaaaaccatgtttgttagtaactgaccaagcattggagagagctctcctaggcaataacacatttaatttttaaaacgaatgttggacttgacatagcttagaattttaaccaaaaataacgcttgactgttgagggtccccacttttacagtggctccgtgtgcaaaggccttgactgacagacacctcctagcaaactgctctttgggtctcatgtaaaatgtctcacattgtgtccttcaagaattgtatactttatcagaagtattttatcaccaagcccattgagcttaactagaaaatactgtctatacagtaattacagtaattagctaaaaaaaagaaattagtccaagagaaaatgaagagccttttctgagtgtttctaatttgaataattcaaagacgtcatgtgacagaaataccttatttgagacttcctagacaagcagggaaaggcacatattgccgtgagagaatgatttttcagataacggtctaagctaacccgtgttgtgttgagtatacgcagacagatccgcagtggccagcggggctacagcgcaggctttccccgtgtgtcttacttttgtcttgcctcttttttttttttttttttaaagcaattccttagtttgttttgctccagaataatgttttaaatagtatgcatactgtttttgagatactgtgaatgagagccccgtggctgttgtagtactactctgtcatgaatatgctaaagccgttacaatgtaggtgaatcaggtctggggagatgggcagctcgcacaggccagcctcacagttttgccaaagagaaagggctgagatgggcgttgtatttggtacacccagctctggacacttacgggtgtgtagaggaagaaccggattcagatttgatcagccaggccctattagcaccatggctcctggctgaaagtaaaactatttttctaccttgagattgctctaaagatcagtcattgctttttaggatgattttagaaaccgtgagagatgcattagagtaggtgagttgttttt

SEQ ID NO: 18327 - DNA, 1220 bp, Mus musculus
ttttcttatacctggatttggaattgagtattcttgaaatgcctatatttgaggaagataaattaggagtttagagagccatagtaatacactgaacgtttcttgttaaaactgtaaccttgttatcaagaactgttatgtgtcataacaaatacaaataataaattaagccctaaaaatctactgtttatatttctaaatacaaaaggaaagaaagagggagggagggagaaaggggggagagagagaggagaagaggaaagaaagagaaaggaaagaaagaaaggaaaggaaaaagaaaagaaaaaaaaagagaaaagaaaagaaaggcaggcaaatcttgcttagcatcaataggtttgcactaatgattcctcaaggagggacgcattctcagtgggcatggttctgttccaaaacaaactctgcaaacaggttgattgtcttttatctcctgaactagaaacataggaagttataaagaaagtttctctttgtttctagtttcattcataagatgaacacagcagagtttaagagcgcaacgttcccaaacgcagggccacggcacctgctggatgatagtgtcatggagccgcacgcaccgtcgcgaggccaggctgagagctctacactttccagtggaatatccataggtgagagactcacccgcacttccagctgctgcaaaatacctcagctgcaaaaccattcatcaaccctagcacagtggttctcaacctcctaacgctgtgaccctttaatacagttccttatgtcatgggaatcctccgctatagaaataattttgttgctgcttttgctagttaatgaattttaatatggatatctgatatgtgacccctgcaaagggttgttagacacccccaccaagggcttgagaccactgccctagtataaacaaaaaattttggtttaaaacaaaggtacaattaaatataagatgatgataattttaaaactattaatggttttgactctaaagaagacttttgaggactttgagaaaagaccagagactactttaattggttggttaactgcatgcaatttggatatggaagagaagaaaggaaagagtcaaatgggattccaagtgccttgacttcagcacccagttggctggtggtgatcttagcacacaaaagactgggagagaatcgatgctgactgctgacatacatattgaagaggtggat

SEQ ID NO: 18328 - DNA, 1186 bp, Mus musculus
gtctgccaaaaggctataatgttagcagcatataaaatttttaacaaatatttttctgttttagtaaaaacaatgcattaaaatgtaagcaggtcatggacttagtgagagagtggaagctgtcaaaagtatgttagaataacataggcactctgttagaagcacaatgcagctgcctgtcagtgtgtgtctgttgttctcatcttgagtatcttaggacgtcgtaaggtcaggtttccattgggaccagggaaggcaaagaggaaagttgttttggcatttgcttctatggaagcagaaaatagcttctgtctttatccctaatctcattagaggtggtcatcagggaggagggaaggaaggcttgaatacattagagaagagggccttaccctgttaggttgtatagtttcaggggtttatttttgtttttaataaaaatgcagacatgatggaatcccatccatggtggcgacttctgtatagccttatagttgggtacaatggatgccctatctctttctagctttcactttgaacacagagctacctcactaacagtcagccttctcacagacaccctctgtcctgtcgcttccctccctcaatctttaggatcccactgttttctgtcctcccttggtctctgtctacatgctggtctatattggccttttctctgcttctgtctataggtatccctacatcatcacccttagaacagtccttttaagagtgttggaacctacaagacgtaagagaagctgtgactcctgtgaattgagtcattctctcatagggtaggtggtcatcagctgtggggtttgccctccttgtgcttctgaaataaatgcaactggaaattgatcttgataggtaatgattcacagtgagtccatgcctgttctgaaattcattttagcaaagattacgattgttttatatatttgaagattgtctttcctggatgtgcttaaaatggcaagtgagcatattagagcaaatattaatggttcagggctgaggtgagtacttacacggcacacccagccggccctgtctgttcttacgctagaccctcccaaagggttgtttgagtggctgactcacttgagcttggggtgtttgtgtgagattcattagtgcaggattctgtgtgaccaaggcgtcagtataaataagacag

SEQ ID NO: 18329 - DNA, 1139 bp, Mus musculus
ttcaacattggctttcatatttctggctttatattagcatttctccacctaagcagcctgctctactcagcttttctacatcttttattacatagtgttcttagttcctcagtttgtgtgtgtgtgtgtgcgcgagaggaagcatgctcatgtggtgtgcccatgtgcgtgtggacaccagtggttgatacaggtgtgtctttcttcattttccagcttatttttgagagattctaccactgaatctggaattgattaaaatgtagctactctgattggccagcaaactatgaatcctcttatctctgtgcactgcccagccctggggttgtaggagtgtacactctacctagattttacatggatgttgagactcctagttagatctgtatgtttctatagcagacatttgaccagccaactatcctgtcaaccccagagttcctctgtctttaaaggcttatctactttgtgtggcccgggctgtgaaacgatgtttaaaggctgtgttttcttccatcttgtcagaagagtagcagctctgagtcactaagcgagaagggctctgaattgaagaaaagctttgatgctgtggtgtttgatgttcttaaggttacgccagaagaatacgcggtgagctttctgtctcttgctttccagttttgcatttaatttatatacagcatctttattgaattagaatttgtggcctcacagatctcctcagaagaggagatgggtttttaaggctggatctaggaattgttagagaataacacaagaatggagcattaggggtgaggggtgaggggtgaggggtgagggggcgagggcagctttcttctgaagggcagctgcctgttacccggtcaatgtggagcagagagatgataacttgatcactgctgtgctgactcaccaaacaaatatgaacatgctcactatttttttttaatgatttgaaatttaaaaattgagaactctgatttaccaaccattggaatatgagtgatataaaattatctagagaatctttttaactgacataagtgttcattgattacattgcttttttggtcttacaccatcttacattctaagagtaaaatattcttgcttggagtacgtggtacctttcc

SEQ ID NO: 18330 - DNA, 1177 bp, Mus musculus
tcaaagcctcatatctggggtcaggcagaacatcccctggcctttggctggcctagaggctatggtcagtctagtctgcctctgcctgtgctctagtctcatcatgagatggaggtggaaggtgactgtcagggacatgctgcattcaccacctcagccaagtctagagaggactcttaaagtctgaggcagaagtggcttggagggaggagggatctccacgcccttcagaagagggagggatggcttctagccttgggttttctcttgaaggaaatgcagcaggatatggacgaaaagatggatgttttaattaataatcagaagaacaacaagctgtaagtatcctcctcctccctaaagactcctcccttcactttgctcagtgcacaggggtcttagagagggcacccctcaaggaactatcttggcttctgccattaacaatggctggaagctaagatcttctgtgcccatgtgtactggtagaaacagtctccccaaatttctgcctcccccctcccaacccaccagtccctttcaaaaccaagccaaggagcagcagaaattctggcagctaggaaagatggacaaaggctcccaagccatgatcacagaagaacccgatggagcaccattggcttgtgacaagaatgtggtgccaccaaaaccaacgaggaatccactggagtccctccatccatgtcagagttgctgcgtaagtgaactcctgcccaccttcagcacgggttctggagccctgggctgctcctgccctgacttcatctcaagagcccttgcctcaccctattgccagcccttgggatgcagcccttagtctagaaaccgtctgtagttgcctcaccctctaggctatggtgagtcttaagccacaattgttcagtcaacccttggaagtgcctgctcccaagttctgctcagttactctgtgctttcctctagcaaagcctgatgaggtaccctgcaggctggctaacttgaaccaggaaaaaaaaatgatctttcttgtgccgtttctgtcctctgcaggagaaatgtttgttgtgtgccctaaagaccaaccgcaatcaggggtaggtagatccataggagaagtgccttctctcagttgggtgtcttgttatcatcccaaagggagtgtgcttcaacttccttt

SEQ ID NO: 18331 - DNA, 1684 bp, Mus musculus
tagactagccatgtcactaactcaattcagcaactctccagcccatctcacggctttctcagccgtgttacttattctcagcaacgttggggactgtcttctgaagacagatcaagcaagttcaaaggacattctgctctatagcacttgacttttcctagtcagtaacttgaactttcctgcttgcctcagcagtaaaagtcaccttcctaccccatacctggcatacctttttaaattattattattattattattattattaatttaaaggacttttttctttctttcttttttttttggttggtttggtttggtttgggggattttttttttggttttttggtttttttgagacaggatttctctgtgtagcccaggctgttctagaactattctgtagaccaggttggcctcgaactcaagagttccacctgcctctgcctccagagtcctgggattaaaggtgtgtgctgccactgcctgaccatacatgtttcttaaagcaagtaatgtttaggcccattttctgtttgaataattgttatcagttcttctagaacattctcctgtcactgatccatctaggaaagcacttgagctttgaaaggacaagggtggtgaaatttgcatgagagagaataaatttctttcagaaagatcctgaggaagacacatgatccaatcgcttgttgctcagaagttcaaggaaacaagtggagtggcgtcccctggctctttctaggatgagtgtgtgtgtgtgtgtgtgtgtgtgtgtgtgtgtgtgtgtgtgtgtgtgtgaaggcagctcctgagacaacatgtaacatgcctacagaaataccactcttaggacactcctttaaaaaaaatgttaatctactttgtaaaccagtaactcccagactttcttgaggctttgtttttgtttggttggtttttagattttaaaacattctattcactttgaaatgtactatatgtgttatatgtatatataagttatagtgacttgaactctgtttggcataggctgagaactattgttggtagcatagagtgtacagagcagccgctgactgtcaccatctgagagcaggatacagaagggagtttggttcctcagcagtgaatgcccaggtgcttgagcaatggcccagccagcctcagtgaggacggcaagccacccaaggagaggagaagagaaactgacccgctgtcccagcacacaggtttaattttgtactctttcatttctttatcaaatgacctcattattccctaaaaagtcttggaactgaaaaccagactgaactgtcggtgcagtggcatttccacagctgtgcttcgggggttctgtcctctgtgtgtggtgcaagtatttagaattaatagcatggatatgtcatgtccaaaccctcaagggaaaattaccaatttccacttaaccaacagatgaaatgctagttaactcaatgcccactatcctgcagaaaagctacagtcagtagtaaagggtggggttggctggtgctgatactccttagtcgtatagaccaactcaagcaacagcagcattatttactgggtcacacctgggaggaacttagcttccaaatttggtttttgcttttcatctccagggccttaataagagtgtgttaatacacatgactattttaca

SEQ ID NO: 18332 - DNA, 2248 bp, Mus musculus
tgatggccttggtgacacagactgtgggaggaggcagaaggaagttgcccagctctcctatcccagccctttaaccctccaggtttacagaatgttatttcaaatggcagtgtggtgagaaactcctaaatgaagaaaggaaccttgtctttcagggcttaaagcaaagacttgaagtttgatgcttttcccagtgtctctatgtacatagggaacttagttctgggccgtgtacagaaataccactgtaatataccaaaaggaagttaataatgtagattacctttttaattattactattttattattgtttttctcttattgaaagcactgcagttgttagtggaggaaaagtaggagccaagtgtgagtgaggaataagcctattggttcagtaggtagagttcatgtattagataggagcacatggagtacgataggaccttgtcggaatggatttttttcagggattcatctgccagtttaaaagccccaccatagtccttaccattaggaaaacttgcaaataccaagatacatacaaaacagtaatttatgccactgatcaaccaagatgcttctaacagactgtaacctgctttggagagccgccgtttcagaagacacagataaaagtggttgactgtaccaaaactagactaggaatgatttctcttgaactcctgtcaatatttatttcctccatctataatggacagttagatgtgggattttttgattttactccaactttttttaaagtgctctttagagctgacagatttgtaagtaccgtgtctctatctactgtcttcatgttcacttgtccactgccctttcctcccaggctgggagcggtcagcaccaacaggactcactctcccctggagagtggccattcaagtagaccactcataagccatctgactaaataccctttttccacacagaaaagggctaactatacagcagagcaggaatctctgaatatcccactaaacgttctcttcctatttgtcagttgtatttttccttaggataaaggttttatccactatattagcaaatctgtgggcagggtaacccgtcaccacttaacatgaattgcttcctctttctatttatcctctccataaaattttggaagctatctaaaactgagacatgccccttaaaaatgatgattaatcttgctagagaaaggatgacacattctggttgtcattccacactcatggtagactcagcaagactgacctagattatcattaatgactttgatataggacagaaaatctgtggttttctccagagtgtgacatgtcatctggaaatctggaatgcaggcttgattaccagagatatggaaagttagatgcaggttaagcaaatattttatatatatataaatatatatatatacatatattcacacatgtacatacaatgtgcacatcaaaaatggtcatatcttctgtgctgtcagatatacagagataaatgtttaaaagggtcttgaatctctttaagcaagatctacacagttttacaagggaaaaaaacatttctcgaataagtcaaagtttcattttgttttttaagttataaacttcaagaatttttttctaagtaaaggacgaggggggagacataacggagccatatgcatggagtatgtgtttctacataacagaaaacttacgaggaaacgagagaacatgtatagttccctcctatttgaagcccaggtgtagataccaaggcctccttccccccaagtcccaggggtgcattccaagcctcacttgctcctcagttgacctttgggtctgaccttgtacttcagccacctcaccagagccctcagcctacaacctgtgaaagggtttcttcataactcttaaaagcaggagaatcccactatgcttagaacttcaggctccacgcccacttgagccttctcctgaccctcagcagttcttttacatcttatctcttccctccaagctaaggtcacagtgtggttaaaattacttcccaagaaagaaggttattgattcttcagtaatgccctgtattggagcggggggggggggggggggtaaacatagatcttttcatgtttgtagcctagcagtgtttccttcattcttcaaaatccttcagtactaccacacaaaacctagtcaaatatcagtgttggtggccagaagtatataatgtggataatgtcttgctttgaggtag

SEQ ID NO: 18333 - DNA, 1172 bp, Mus musculus
tcaagtgttagatggctaagtattaaaagcacccagattaaatccttagcaatcagaacacttgcctcactagattttgccaactgcaaatcatgttggactgagtacctgttcttctttctgagactgttaaggtaaataattaacaataaagcctccttaaaaaggaaaaaaagaagaaagaaatgagatctcagtatattgccaacattggcttttaactactcaggctcaacagaccctcccgcttaagcttcccaagtagctgagacttagggtgtgtgcccctttgcctgggtcatcattatgatttggtagcaattgctttctttcttttcttttcttttttaacattatgaaaaagacctctaaaagtattccattttgttatttaaaattaataatctaatttactttttaaaagaataacattttcttcccttcattttaatattctgtgtggacaagcctaaaattttgttgtttgatgtgtaggtttttgtttgaacaaatatcttttttcttgtacaaatctttaaggagttctgaattactggattatgcgataattcagttttcttagacttaacaggactgtgaaaccgaagcagaaaaaaaacaaaacaaaacggtgaagtctttgttctattacttagttatttttcaattcctttaaaaatatatagggctgtgtgaagttatactttaggataattaacatcctgaggaatttaagaaggcattctagaacagtagagattattgctcacaaattataccatcatggagagagatcatattaccaatagactgattcttgagtttctaacaaaacgtgttgctagggtttatattgataaagatgattatgactaatagcttatgtgaactgtgttttcagccactcagagtttattgctcttagtttttacaataccacatgctgttatttctggtttgcacttgagaaaagagaggtatataaaaggttactaaactagtgaaacttagatttaaaccctggtttgcctccagagcctcccttattcttgtttcccgtattctgtactaggaggtagaagatgtgattcgtggctccaacagttgtctagttgagatgttgggtctcaaggtttttgtgtgtgtgtgtgtgtgtgtgtgtgtgtgtgtgt

SEQ ID NO: 18334 - DNA, 1192 bp, Mus musculus
ctttttctcagataatcccaggggtgccaagataacagctttgatgatattacatgtgcatatttgtagaatgagaatattgctataaaaacaattgtaaataaatttctcttaatatttaaaagtgaaaaagagctttattatgaaagacatcctttttttttgtagagcaaagggccacctctgttctgattttggattttctgaattaatgtggcagatttctgacttaatcaggcagattctggactaggcagtcgttctgtcttctgaagttgtctagttcatccagtctccttttggttttggctgtctttgtgatatctcaggtcaggctatggggacccctatcagaggtaccacactccgacaccgagggatgagtatgcttatggaaattactactaccacggacatccacagctgctgccggaagaaagaggtatgaagtaacctccagaagaagcctttggggactagagacgcacgggcagccggctgccagggccactagcaccatgtttggagaccctgccctttgataatactgagactacccctatgatgcttgttctgtggatagtgcatacttcatccatattttcctctgattctttcctgtggcaaaggttctatttactgtttatgtaactgaaaagtcagttcttaagccattcaggtgtgctgagctgtaatgtgaatgcagcagtcacttcattctgggcacagcagatgaacagcaatgggatgctcatgcctaagacctccacaggatagggtatcgtgctatgacagtttatgactagctaccatagagaatctgtttcatcatggaaagcacacacacacacacacacacacacacacacacacacacacacacagctgttgtgaaactatttaaagccaagtaaactagttcagagcatcttgggggctctcattgttagcccttgcccatcaaccaactcaatgtggcaaatacattctcatacctactgtattgcagtagcccagcttcacagctcgctaatacccatcttaaaggacttgcagaggcagcaagtgacctgcctctgttttgctttctctgagggtgcagtggcaaggcaagggagtccttatatctggcatgaagatcatggagaccagaggtacttcggcgagcatcatcgggagaagcacaatggta

SEQ ID NO: 18335 - DNA, 1282 bp, Mus musculus
actaatttttcatacaatgctttaattgaaagaaggaatgaacatctggtttcttccagttcttttgcattataccagatagtaggtatttgtgtttggtttttcagtagtacatacagaaaagcaccattaaattctttgttttaaagcaactctgtaaaagtcttccttttggtttccccattaggtgctagaattggtataaagagtttcctgaagtcaaactgtgtttgatcctcccaaaagccatctgcagctgatgatgagaagaaaaagaaatggcatgtaatgtctcccccaacatcatttggatttgttttaagtaccttttccctcctttatgcctttgggacactgggaatatccagagaattcgccaccatcagtgtaactatgaactttgctgttggcagtgtggctaatttttgtgatagggaaacaaattcttttaaataaaaataataaacaacaacaacaaaaagtttattgagccacagctgagctaggaacacctttttgtcagatggggtgagagtcttttgaagaagttgcacttatgggttatacagaatgttctggctggggctggagagaggctcagagaataagagcactggtcgctcctacagaggatctgggttcagtccccagcacctacgtagcagctcactgctgcttatgattccagtaggagatctgacgtcctcttctgggctccttaagcaccaggcatgcatgtggtgcacattcaaagatccagatacaacgctcacacataaatgaaaataaatcttattttaaaaggaagaaaaatgtactggtgagtaattttatcgttgtgtttctcaacccttttggaatatcaacataaacaaaagataaaatgtgtagattccttccagggaccttaatgtttacaatttaaaaaaaataataagaattcctttttctataccctgattagatgatcaccatcagaccttatctggtcagagatctaagagtttgacttgagatcaagtaaacaggaaaggactgtccttacaactctggttctctttgcaccaagaatccctcagttatactggccaagactgatcactgactgagaagaggtcaaccaaccttttctataaaagaacatataggaaatacttcaggctttgctggccatatggtctcttataactgttagagaactgttagctctgccagggtatcagggatgtagctactatcgttagtagacaaatgggcatggctagaaaataggtggaatttc

SEQ ID NO: 18336 - DNA, 1212 bp, Mus musculus
cctgctgctcttgtagagaacccaagtttgcttcctaggacccacagatgagctcacaactacttagaaccccaattccaaagaatctgacattctattttaacatccaaggcccaaggcatggatgtggtacacagacatatgtgcaggagaaacacctatacatataaataaatccttaaaaaaatcagaagttaccatctgtcaccagtgaatgttaaaatcagtaaatgtccatttgtgaagatgtaggaagtatactccaacagagatgctggtgttagggatgagtgccctgaacatcttcaagataggaagcagttagtgccaccttggatgcctttaaatagaagtgatgtttttgctcattaatactgtttttacatgcctacacttttaatctcaagctctctatattatatgagttgatcatgttagtttccatgtttagaaaatatagaactgtttggttatcaaagggatatggctttttagaaataaattattttaagatagtgctttttttttttttttaaagaaagtttaccatgtagcacaaaccaaactcagttttactctgtagtcacaagtagccctgagcttctgatcatcctgtcgccccaccccggggctgctgggatataatcatgtgtcccccctcccagttttaagtggtgctaaagtgctagggaagaaaacctagggctctgtgcatgctaggcaagacacttatcaactgaactacatctgtaaccccttagttagattttttttttcctttttcttgaaaatcatagctttctaaagttgacttagtctctgcaggacattgagatcaaattaataatgctattccttgtaaaaatataacacttaaattatgttttaccttaatctttatttcaggggttttgtagggtttcttacacaacttgtctttattcccatttgtcaactaatgtgaataaaaaattgaagtttgtattactttgtagaattattgtaaattgacctgatattaaaaacaaattaagaaagcaaagctagatatggtggcacacttctgtcatcttggtgcttgggaagtaggaggcagggagtcatgaattcaggctcattctcaacagcagagtgcagtctagaccacccacactacctgaaatgaaatatggaacccagctacagcttttagaaagaagaaagaacacagga

SEQ ID NO: 18337 - DNA, 1745 bp, Mus musculus
taataagacctatttcaagaaataaatgtaaggacgattggctgcttagacattccttgactagatctgcttaccacattaattaaagaccttagcactagacccagatccatgaatctaaagtttactaatttaatttttttctaactaaaatgttctcctttcattatgtatccataccataacttgcaggggtttgtagaatttttaaatgtgaagaaaaatacttttaaaaaaaatcaacaatctggaaaacttaactactcaaattgatcattttctctggaaatctcactgccatgttagtccttgccatttggcagaccctcctttgtgtaccatggtagttttatcaggatgtgcctgggcatgctatttgggttgtatactctagcatcccttctctctgctcaacttcctaccacttacaacccaagaatgtctttccatgcctcagtttttccattgtagcgtgttttctttttcacagaaagccttcctacgacacggaggcagaccctagtgagggattaatgaatgttctaaagaaaatttatgaagacggagacgatgatatgaagcgaaccattaataaagcgtgggtggaatccagagagaagcaagccagagaagacacggaattttgaggcttttaaaagtccgtatgggaactgtgatgtggaatgctcgtgttccagtaaggggatgttgttgaactgcacatatttgttcatgtgggtatgtagttttgacagataaatatttacaccgccttttaagtaaagatagcagattctccatttcttactggaggatttgatttaaataaataagcttattaaactgtttccttcattagcaccccagacatttcgtttcagaaaaggctatatggcactcttactgaaaatgtaaaaaggaagtcttgcataatgaaaatgttatgtcacagacttttgttctggctgggagatagaatacagaagtgtttgtctgtagttgacattagatcccagtaatgtaaacaataaagcaaaatttttgcataaaattcaaatttgtgcaaagttactacagagctgttccattattaccatgtgttaccatatactgctaattgatttaagtatacttatgaatataaaattaaacaaaatacaaaggacaaaaatagacaaacatcgtgttgataagtactatcatggttcagatggcttaaaaataaccatgacgcgaaaacttgaaaacgcccatttattcctttgttcaataaagttggagttttacttaaaagatgagttctgcaatctgttttgagtgtattcaaagttaagctttgtcactgtactcgagtaagtttcagaaagccgtaagggcttagcaatggcttagctgttaaatgataggctcaccatcaaaaagaaagcaattagatgcctagaaaaaaagccagtcgatcacaacaactaccattaaggattaggtaaaagtcagaacttacaattaatgtatagaaagggtagctggaagtgtattgagctgtgaagtaagcagactggtaaacacatgaacttattgcatgcaggagatttggcgtttgtagggagatgaagcattaatgatagcagtgtaataagacagccatatgctcacacttacagcatctaagatctcactgtcaaaaataaagttatgcaagtacttaaagagatggaattccattatgacctaggactggggaagaa

SEQ ID NO: 18338 - DNA, 1201 bp, Mus musculus
cgcctccagaaacccaaggcccacttaaagccattgttctacttaggagccttcctcccttaacaaatccgtccttttttgatggtagttgtgcttctttgggggcgctcctttgttctttcccgatacctcagagctgccgaagacaagatggcggcctggcaactccgcatcgcaccagcggaagcagcccttctcgagacacttcctatcgggtccccaaacctttgaaggttagttccggggctaggtctggccgcggttgcgagctgcgactgcgcagcccggttctgccggcgcggaacgacgtctcaatcgctggggcggaaggaagtggctggacgcctcctgagcattcgatcgctcgcgagaattgagcgttgctaggcaaccagcctgggggcgggactagactcggaggggcggggccttgggaggctccggtggagccttgcgaaggttccagagccgtctcgtgcggagggcgggccgccgtgtcgcgccgggtctgtggagctcgctgccggcgctgcgacgctcgtgggtggcgtgttcggcttttcctgtctgcttcggtgcaccgctgcagctccggcctcgggtctgacgcgcgacggcatggcttccgttttggaagaggtaggggtcggcctggacccaccggctcgcgccgccgggcggcggctgctttcccggggctgatgtcctcggctctgcccccgtcgcgggcccgcggcctctacgccgccgcctgcctgggcctgagtgtcccggccgcggctggaaggtcgggggtgtgtctggatcccaatttttggcgcggttcgtggtaggctcgcgggtggcggtcccctctctccattgcctgaggtcttctcggctcccggttcctggccagggatcagaaaccttcctgcaaagctctgagctccgggccgggggccatgggaaggaattcccatgcccgcatgactagtcatggtcaccgctttcattttataggtggttatacatacattctctgtattatttctaaacgccctggacagtgcttatggtttcagtttttatttagcagtgccagtggcggacctgcaggccttacacacgctaggcaagctctctaccgttccggtatacccccagtctttatgtataaaagcaatttttaaaaagttactgggaattgagcagtaggtac

SEQ ID NO: 18339 - DNA, 1114 bp, Mus musculus
cttcagatgaaacagtgatgaggcaatgggtaatgacaaacttgttaaggccaacacctatgctctgtacctttttaaaggatgtgatgttgccaaggaagttgaggagatcttcccagcaccttagtgttgggcaactttcttaacttactccttaactcccaaacggtgtctcacacctgggaataaagagaaacaagtacatttttcacattttggattgactaaacctttatagaaattcttaactcatggactggaagggtagctgttaaaaaaatggtgcaaatatttttttcaattatatttgacatatctgtataaatagcccttgcaagaaattctttggaaagaacaaaactaatttttccattttctaagctactctaatccctttatagcaaccaaacaactgtcaatcatgtacagtaacatttgtttatattcatctttagcttcattgttattcatactgtttccaaagtatcttcaagtatggagtgccaccatggttctcctctgtgccatatattgtagtaacccactctgagagagacctctcaacccctgccttcatgttgctcatgaccaatccttcctctaagatcatttctgagttctagtaagtgtaatttctttattctctagatatctgtatcatctacaggtcataaaactgatgctgttttttgatatgtcacacttaccacacaatgctttccatatagaaatttgtttttctctgatagctttcttcagaagattcgtttcttcttaccaaaagggcaataagccagcactcctgatatctctgttgactttaacattccctacatagtggtttagataagctatttttttcatgtaaaatataatggcttgaacattaaatcatttctgtcaatcatttagtgcagctacttagctttattggtactgtgtgttttgagaccagaaagcctggccagctaaattaaggtgcatttttgtggacttctaaataccacccacagatctttttaacttctgaaaataaatacattccacagaataccgaagttgcaaattttccataagtggtaaatgagagaaacagaatggctctagatcaagt

SEQ ID NO: 18340 - DNA, 1240 bp, Mus musculus
tgaaactgttctctgaggatcctacactattaatatatagttttaaatctcaatcactggactgttttcctcctcccatttaaataatgaaaatttaataaaactaatttatttcctctgtcttcattactaatttggttcatagaaaaaattcttaacatcctattgtttgtgttttagaatcttaaactacttttcattgtttttctcctgacattgcttattgttacccccatttgctgttttcctttaccctagaaactaggttccttatgagttacatgagatccccgatgctctctgccctccctgcccaattccaagccagggtaggatgattttagtgtatgtatagatacattggctgagcagtcctgcctactaagacttattacccaaattctgaagggaaaaatatctctggttaggaagtggtccttgtagcaattttcatcctttattcactttgtcctcctgatgagaagagtgaatctctcagaagcttctaactgccatgaaatatatacccagcagcctagttttaaaggctttgttgaatgtttgtcatagtccacggagtctatatgtcctgtgagggtttgacggagactgcctccctctgagagatgtggttcctgatatcacgttgttctttcattgagttccccaagtttatgggattgaagaagtaagtcagagagtaatgctttgcttagttatggtgctgagtacagtgccaggaatttacaacagtgaacttttgttccttttgttgcaggtcatccttgggattgttgatgttcattatttcaaaactaggatatgtacagcctctattacaggagtcaattataaatccttggttctttattctgttttattttctataatgaattatagtgtgaaatatatttttaaatacagaaacaaaaatatgaaataatatagttatacataagtttcctccccattttctcctctttatttcccacactccacagtactattttctagctctgtgtatggaaaggatacataattcacacttatatacattccttcttcatatgatttttctatctataggggctaaactgccccattcttttatcacctctttaaaaacatattctgttggtagacataccaattcctaatcttgtgacaacaaataataataatggcaatagccctgaccacataccattttacagacattctgagcttgttagagcaaatt

SEQ ID NO: 18341 - DNA, 1215 bp, Mus musculus
tattcagtttcactgagctgtgttattgtgaccaaccaaagatgctttctctccaaaatgaatagaagacaatactatggtgttggactttttaaaattaaaatttttattaggaaaactgattgctgaaaaaggcaaattcattttctctagggatgagacccttggtaggttatgcaatcccaagtggtcaaccctaaacacatgtatataagcaacagtaaatgcactcagtagcttctatgaatgtgtacgtgtgggttggaaggaggagagacaggggtgggaatgataccaacatagcacttacatttgatattctaggaaaaaaaacccttaaaaaacgtaaagtagaagtagagtggagataatatctatcttatagtgttgtttagttgttaactcatttagtcattcgacaaacattaaatgcttcttcagtgacataaattgatttaggctctgtcctaagtgtaggtttaatgttaaattatcataatattttcttgatatctctataaaattgctgccatattggctgagggttttttggctcaacttaatttagaaatgatgagaagggagagaagtagtgtagctctgaccattggctctcagcagctggtgggtgttaacagttttccaagctgctcttggcaggacctctgagcaaacagtagctggaggcagtggttgccagaagcttttggcagccctccactgcttgagtagtaaccgctggcagctctggatcttctccagcagctttgctggaacactcccaggcagcacagagtttgatagtctctggatgctaggcattctgtaggcctgtacctcttggtagtaatattgtcagataagctcattctgctcaaggtacaaaggatgaatggtggatccgatgtagcttgataggtagagtgcttgatagcatgcaggaagccatgggtttgagccatgttgaccaagcatgttgtcatctatccatcattccagcactcagaaggtagatgtacgagaaccatgagttcaaggtcattcttgtttatatagcaggttccagatcatcctgggctacatggaaccctggcacaaacaaagagttggcaagaaaaccactccagcaaggctttattagggcctatgctgatgggacagagcagggatacattttctagactggtctgaaaaggatataaagaaaataaaatt

SEQ ID NO: 18342 - DNA, 1208 bp, Mus musculus
tttttttaccttgttaaacttctgggcttaaaggctttccctgtcttaaacctgggaggctgagaagctgagattacagggatctcttctcctccccctcccctccctgtccccctcccctctccttcttttccctccctctcccctcccctccccctccccctcctactctccttttccctctcccttgtccatctctgtcctgtgtatgtgtgtgtgttaatttgtttctagtcatacatttacttttctccctctctatattgaaacaaaaacttgtagtatttcttaacaaaatagagagttgagtcgaggtaaatctgtctggttgaggtacagctgggttgtgtttttcaggtaacagtattctgttagtctgaaagttaagagcagagagagtgcatttctttgagtggcctagtccaagaagatagccttccacatttggagataatttgcttgccgggattctttttcatatgaaccatttaaaaaagattcttagtttagttttagtttgtttttaatcaggttctactttttcttttgttactctttagttgttccaggtggatgtgggcagagaggtttgcagaactgaaatggaggtcagagcttcgttccagaaggttagtgggtcatctgattctgtggccacactgaacagtgaagaatttgttttggtttctcagcacacagatgccacttctataaaggatgatgggaagccacagctgaaggtattgtttcttcttttttctaatatggcactgtttttcatgaatttctttctcccttctaactatttggagctcatctggggataagcactgaaggatttcttaaagtactgacctggataataaaagtcagggtttggttgactctttcagacgaccttgtagtaataaaaatacttaatgttttattaatccagaggctaattatttggcttgatttttaaaaagtttttttccctcaattatcttttggttatttaccttctgataaattcttggaggaagaaatagttgggaaatagagaaaaagtaatatgtgaattaaacttactgattaattcttacataaatttatttgactgtttctttttcttctgggttttaattgaaagatttttctgttatgtagttttagctttaaattatgtgtaagagtctggtagacagtttaacagttgactaattagt

SEQ ID NO: 18343 - DNA, 1202 bp, Mus musculus
cagccagggctgcacagttgagcgagaccctgtctcggggtaataaagggataaggttctttttggggggagggggcagagtgatgaagaaaattttcaatttagttgctatagttattcaactgtaaatttactaatactgtagatcattgaattatatatgcaatctagttaattatatagtatttgaattcttttaataaggcttttatggaaataataatggataatatatgcaagtaaaagtttgaaaacatttagcaaatttagtagttttaatgttgtaagcacctatactataagtgggtaagttgtactcagcaaaatgtttaatataaataagtggaacattcaaatatttcttttgttctccagatccctgagcaacagcccattactttgtgtagtggggttgaagatacaaagcattatgaggaagccaagaaatgtgtagaagaattagcattgtacctgaagccactcagcagtgcgagaggtaaatgtagttataaaacccatgctaaacaagtagctgtttgctaatttgttttttgagacaggatttcactatgtagccctggttggcccagaactctatgtagaccaggctggcctcattcacagagatctacctgcctctactttcaagtgctagaattaaaggtgtgccccattcatacttggctgaatacctgttatagatacttgtagtaccaaaataattgagctacaaatgaatacaaatgtatgaaacctttttctctgtctcgtccctttctctctcttctcttccatttctactttttcccctacttagttttcagtgctaggcaagtgttctactactatacagtagtagatttaggatttatatagtactactatctatgcagcttgtcctagtgaatgctaatagaatttattcattataagctgtactggctagctttgtgtcaatttgacacaggctgagttatcacagagaaaggagcttcagttgaggaaatgcctccatgagatacaactgtaaggcgttttctcaattagtgatcaaggcgggaggtccctttgtgggtagtgccatctctgggctggtagtcttgggttctttaagaaagcaagctgagcaagccagtaagaaacacccctccatggcccctgcatcagctcctgcttcctgatctgcttaagttccagtcctg

SEQ ID NO: 18344 - DNA, 1195 bp, Mus musculus
tagtgttctgaatgccataatgagtgatatttatctatatatgtttgctttactttttaaatgttattgttatatggttttatttacctaattacttgtttgttaattttgatgttttgagacaaggtttctctgtgttgctctgactgccctggaactcactctgtagaccaggctggccttgaactcagagatctagctacccttgcctctcaagtgctaggtgtggatatccaaactgttggtttattatttactttaaatatgctaatgagaccgagaactagcccataaagaagccactccagaggaagtgctcctggatcataaaattgcactgtaaacctagaaatagcttccttgttctctcctccaggtgtgggtctaaatagcactactcagagtgttctgagtcgcccaatgcagaggaaacttgtgactctggttcattgccagctagtggaagaagaaggcaggatccgtgctatgagggctgctcgatctttaggtgaacgcacagttacagagctcattctccagcaccagaatcctcagcaactctcttctaatctctgggcagcagtcagagctaggggctgccagttccttggaccaggtatgtaattaaagtttgttgctttggctgcttacttactcttgctgggtattctaaaagtatagagaaaaatccttagaaatatacaaaccctcatcttttgttaaattctgtttcaagcattgttctacttgacaaccttggcttcatactttttcagagaattcacagtcttttctcttgatgaccaaagtttattccttttattagtcattaaaagtgtttttctctgtattaattatttatcgacttaatatatgacagaattgcccacaaatatggctttaaaatgtaattataaatatgttatattgtttggggttttgttgttattgttggtttggttttggtttgtttgtctgtctgtttttgaaacagggttttgttgtgtagccctggctatcctggaattcaatctgtacatcaggctggcctctagttcagagtgctgggattaaagatgtgcactaccatgtctggttcatggtattgcttgttaatggcatagtattatgttgctcttcagacaatgtgtttagttcatctttgttcaccatacattttgattgtaccattttt

SEQ ID NO: 18345 - DNA, 1194 bp, Mus musculus
caaatattttaagctacgggtcttttgggatgttaggggctgtaggggggaggagtctcactacctgtcccttcctcccaagtgcttgtctctaccatgcctgtttgttttaactcttagttcagttttctaatatgtatatgcaggttgtgttctgctataacctatacgtatagagtaggaagcttgtcagttttagtttatcatctatgctacagtgtggatgaggagttagaatcaatatttggaagctatttatgtagttatttttattttggctgtttgagacagtctcattgtgtagctagccttggttggcctggaaccaatctaacctaaaactgataaagaccagctgcttctgccttctgcttgaactaaaggcatgtgctctactccagcctcatgtttttctacagtgctaaataataagccctattgattggattttatttagagtaattgcttttctctttctataaattccaactattttttcatgtaatttacagtgatgtaccaaatggatcagccttgacacaagagaatctcagcctcctatcaaacaagaccagctctttgaatctgtcagaagactctgagggaggaggagataacaatgattcccagagatcaggagttgtttccaattctgctccctagaatatgggcacctgcttctaccttctgctcctaatcagttcatggggcatagggatagaaaaatggataacttctaaactttttctctgagtggtcagtgaagtccaggaaaagcaccggaggcaatgtgcacaaacaccactactaaacaaacctgcacatagttcacattgatgcatttttttaattttaagaaaaaaaaattagcagtatctgcaagcaattcagattaaatttgtttttgttctgtgaatgaactttattttaataactttggacgccttggatccggggctttaaaaaaaaagaagatattatatatacactctgtttgattaattgtatgatcttaatgaagtaggtttttcttgtattttggtattattacatacccagtgtataattccttttccccagtcctttccaactctcacaaccctgtaaactaaaatagacaaaaatgcaccgtttccaagaattctgtggtaatagattgggttattagaaactgtgcagcaaactaattttatt

SEQ ID NO: 18346 - DNA, 5260 bp, Mus musculus
accctagaatagaaaaaccaggacagtgaaccatactctaaagctgggagccggctcagcagaagagcaccggctgctctcccgggttcttggcagcacctgcagggtgtctcccagttccactttcagggacatgacacccttttctggcccttgtggacaccagacacaatgaagaaaattttttaattaaaataaaacttaacactcgataggagcttcagtaaacaaggacatattatttcaatggaatttttgttttcctttcaaaagcgttaaagatttggcagatagaaactgactgagtcttcagggtagttcatgctttggtcacttgtcagtaatcagaattactagaataactataaataacttgaagtgagtttttatagacctggctttctgacattaaaaatgtttatgaaaaagttgaagagtgaggaagaatttttatttagttctgctgcacatattctaatgctaaccactgtttgcttaatttactaagcccctctaaaatgagttcagcaaggcaatgtttcgtagaatcactccatccctctgattgcctgacgtcagtttccctttctagatgatgctacaaaacaagaaagcactggttatgtaataagttactgcattgctttggttgggtaaaagcaaacgtttatatttttcttatttctatttcctgaacccttaactctgctgaggtctgcgtcacctcagtctaagctctgtgtccatcatcttgttaattgaaacaagtgggtgggggtgggataagagtgggaggggtgggaagggaaaaatagtcctgccattgcctaccagtaggaaatccaaacagaacactcatttgagtagcgattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatggctatatctgtatatatatcgggtatgttttaaagatttcttcgcatgagcgcagctgttgcaataagatgactgattgggaggtagaggcaccgaatgacggtgaggcatttctcagttgatgcatacattttccttttaattttaaatacacatttgtacatttgctttttttggacttttttttttaagataaaatgactcttacatttatactttactcattatttattgagatgaggagagaaatgttatgcctgacaggatttttatttttctgcatatctataaaacgccacattattggcctcttgccttcagtagacagatttgggtgggtcttacctcctttggacatttcaagataattcctaagtcttagaagcagatgggtttttgttgttgttgtttttaaaattggaataactagggggaaatctgcatattggttttcttggagttaagaataaaagtaaattttcattgtagtgtgtatgagacccccaaaatgtactctgctgcggtgcactagtatccttttaggtatatttttatttagggagaaaattagtcttttaaatggtagtatgagttccccaagcccctctctatagccagtctgggttgggtagaaagtgaaagactgtgcctacaattttgctatttagtcattttcccttaccaatttttaggtggggttttttggggagcagggggtaggcagtattgtttgtgcccactggcaggtttagggattcaataaaaactctcataactttgaggggtttttctccccttaacaaagtcaatgttatgagacaacaataaattgaagcataacttcatgactcttaactgctgtttttattaaaatatgaaaaccattgatttttatttgtgtctttagagacattaaaaaaaggaagcccatcaaataggaagcagagcttctgcaccaccagccctgcccttttaagacagtcttagcagatagcccatactggttctgactcgagaccctgcgccagccttgtgagcgagcactggaagaatgtcaagcatgtgccgccatgctcagcatactcagcaatgggtatggcttttcactgaaatggtttcttctgaaggtgattactttttactgtatccaagagcaagaatcatctcagatgaaacagacaattctggaagggttatgcagcagcatattcatacttgttcagaaacaacgccagtatgttagctgtcgtgaataaaaagtacttaggctcagtctgttttccgtgagtctctggaacatgatggaggaactgagaatggggtatctagactcagtttcctgttgatagtaggagtctgaatgtgaccaaagagccattccttactacttttctacttaaacagaacttgtaccataggtttctggtagtgatgttcaaatgacgtcaatgtttaagacactattattagtaattacaaatattcacctactcagaatgtgtaagagcttgtttggcacgtacggcattaatgtgggtcattccttctctcatcttccttcccttgtggttttcccatgtatttattcttttgcctaacagcagaagatggatacaattctcacgtgctacttggatacatgatcccatcagactcccatgagcttgagtgtgggagcttgaaatttagttcctaagtttcccatgattgtcttttttcttttcttcctgaccccttgccattctgcagtttccccttgacttacccaatctgtaacagtgacagtttgctgcttctaaacagagcattcaaatgaattcgcttagccaataacttctgtgaagttgccttttctaatggcgttattactcagtgatgcacagatgtggtatttgccctactggcaggcaagcaaaggtctggcaaagaatgataacctgctatttctttaaggagcgccaaagacttgtgctttactctgttttggttttaggggaaatagtagccattttgattatgaaatctggtagtatttgtaagttgattgtactgtgtaaatgtctaaagttaactgttaaggttagctggccttacaaaatgtaaaagtaatgaaaatttatcagtttctctaaaccagtaaatatcacccttgacaatatttgtttaagcaactcactctccctttgggggcttatcttgatgtactactctcttctgtgcgtctctgtactttcacttgtgcctacaggacaatgtactttcactatggtcaagtcctgggtctgggaattcttcttgaacttgacgcttgtgagaaacagttaacggtagttacttagtacctgttcgacttaagttcagggacatcttatttttactaaatgggattcatttgctattgtttttatgtacaaatgatggtagaatgaaatttcaatatatttttcatttgggcttttaaagaatcaagtaaagagttcaatatgtaaaatctttgtgtaaaaaccatccgtaacgatttattacatcctaatttgttctcaagaggaagtaatgaccttgcaaattaactgcagtattacactattgccctataaaaggttcaagtgtgttaaactcttaattgttaatatatgcttatagtgttgcaaagggatgtcatccctgaagatagagctcagatacagcgtcactgagacaacgggcagtctacactgacaccatttcatctgaaacatatcgatgtctaccttagacagctatggcttttttttttttttttaacagctcagctttttaaaatttcctgctgaaatgactggctgggagtttttggtaaattgtgctaacattctttttaacgttctcaatcagctttcctgagccactcacttcaaagagctggttttgttttgttttgttcaaaagatacaggaaataacatttgagattttaagattctatttctgtaattgctagaggtgttttcacaagtaacagattttaattaattagtaattctagtcacactaataaagaataggaaactgctacccccaggagcaaatgacaccttctaataagtgttctcagtaggtaggtttcaatactacactgaataagtgggtaaagagcccttggaatcccattgtgataaagggacttcccttagcactggaattgttcttagagcctctggatttcagacaaacactgaatttccctgaacttaaccttgagcagaataaccttcattttcacaagaaagtaaggcattgtaacccaaggtggaaaacttaaactttaagacaatactgtgtcagaaaaatgtgtatttagaagagtgaaaccctgtggagtctgttgtcctagtgtatattatattatatagtagataaggtggcttttttttttttattttttattgaagactcattctggttcttcatttggttttgtgttttgtcttttaatgctacatatgtagacagagctcacaagtctttggctcccatattaggttgtacactcagagtcatcttataactggaaactgtcaggtggtcccagctccagtgaacacaggaaaagtcaaggaaaggatgcaagactgggtgaatagcgctctggggttttggttttgttttggtcctccttttaaaaattgtcatttttataatttattggtgtagcctctctctctgttcattggctgacatttcacagtaatatccaaaccaccccataaaattgtattcttacaagcctttaaagctatgattcctgtttagctaagacagtcctgagaggttttggggtttgttttgttttggtttgtttttgcctcactttccccttacccttttttatcctttgtcttcccaactttctggatataaaagaaaaaaaaacttcactggtcttaggcctcagtaatgagtctgactttccaggagtgatacaggaagtgaactaaggtaatgagcaaacttctcacccacctaactgctttccagttgtgaggttcctcttcgtgtgtggtcttttcccttttacccctgaaacccttccctgcctatggtcagttggtctcacggctcacaccagtctcctgagacattctgcactcattatcacctttttgggtggatttttcttagtttttttgttttgtttttaaaaaataactttaacattgattcatatttgct

SEQ ID NO: 18347 - DNA, 1173 bp, Mus musculus
gtaatttaccaatcgtattgattgtatgtgattgtgccctgcagaggtatacttaacatgagtaatcttaagttagtaaaggagctatgagatttgagtcagaatagagatggctttatggggagtgtgaagtcccttctcagaatcagtgctacggaagaccccctttgaaaggttttcctccattcctgtgtttttccattgcctcggctccctattgttttctgacattttctccccacctgctcacaaggttttttaaattgagtcttaaaataagagataacttttaactgaatgaattttgtgaaattttacattttccaaatgttttcaattgaggacaaaggatgggctggacttggccagcctgtgaccatctccttcccatctggcctggccaacagtgagatttgcatttagaggcattatcttctgaaagttgtttttgtataggaaaaaaaagaaccttgcttgaaatggaacattccctttctttaatctgtttaatatttccgtttttaaacagctttcaaaacaaatgaggtggggaaaaaagaactaggagtgtgtttagggctgccgacctctggatctgaacgagtacatggaccatgtgttgcatattcttgagaagattaaggccttctctcttaattttgtattctttgtgtgcatgttgtttatattaaagatggcacattttgttaaaatgctatttcctttattaccttggaaactgactcagcctcttgttgctcctaattagggtttaaggctcttgtaagttgcagataaaaggattcattttaacaatagaaggaggtggttcaccttttggattgtaaatatatgaaagtgtctaaaggtctttatctgctttctgtcagcatttatattaaatgataaattaatgaggaggaacagtgtgtagtctttttcttgtcaatgagtctgccacctcgttctcgtcttgggattgttgataaaaaaaaaaaaacaaaaaacaaaaaacttttaaaagctaatttatgcaagtaagcacactgggcgtcagttttctctacccagaattgctgtagacttgagtatgctgcaattgagaggcaggcctggttcagaggctgcgagacccatagtcagtgagctgtaacattattttatgacgtctta

SEQ ID NO: 18348 - DNA, 1130 bp, Mus musculus
gctgaggacctgagtttggttcctagcacccacatgacagctcacaactgtcttgttattcctgtcccaggatccaaatccctcttcaggtaccaggcactgtgcaaagacacattcaggcaaaatacccatagatatataaataagtaaaattttgtttattattagcagattctttcaaaggatgatgtagttggtctctgcagatttgaataggaatattgcccacttattcagaattacccaatttggttggtttaattgtgagtaagctgaatgagttactgcttaaaagtgaaactgttttctggttacttagctgctgtaacaaactgctctaaagtttaaaagggcttgactttgtagaaagttagaagttgaggtgctggttgaattggtctgaaaggttcaagatgatgtcacgtgtcctggtgtacagggacctgaaaagctgggcctggctttttcattgagtttcaaggattctccatggtagttggacttctttttgtttggtttttgtttttgttttttgagaaagggtttctctgtgtagccctggctgtcctgaaactcgatctgtagattagcctggcctcccactctgcctcccaaattctgggattaaagatgtgggcctccaccactcagcaggtagttgggacttttgacatggcagcttaggctgggcagaagatgccagtcttcttaaaggccaggcctccaatcatcacggggtcactgccatactttagtaagcgctgagcccagaccctaggggagaggaagtaccctaacctttatgaaagacatgcggagagtggagaccatgttaaattgtttacaggtaaccgttaggctgttcttttgtcctaaaccttttgcagtcagttttgttttgttttgtttgtttgtttgtttgttttgtctctaatatttaggaaaaatttccccatgtttggtttgacttttcttattttacaaaatcaaaagacccctaagtttttcattaaaatacccaggtagctctcaggtttctagaccatttcccacagcccttctaagacaaattcaactaagcttgttgttttaaaaggtttctaatctcaggagacccacatagtcaactt

SEQ ID NO: 18349 - DNA, 1203 bp, Mus musculus
tgcagttgctgggaattgaactcaggacctctggaagagcattcagtgctcttaaccacttaaccatttctccaacccggttttgttctttggaggcatgtctcatgtagtccaggctgagcttcaactccctatgtagccaaaggtaatcttgaactcctaatcctgatgtttgcaccccgccccagaggcttagtaagtatgcagccagaacttcgctttgtagtgtttatagcagtgaaatagtactctcagaattctttttacattattatgttaatagctttactttttggtagtattaacttccctcttggctctccattacacgtaagtgaatatgggctaggaatgtaactaaggctcagagcatttgcctagcttgcacaaggccctgtatctgtattccttacatcacgcagacacagaaacatgcacttcttagtaatgggcacaagcacattgggttgcttttcacatctgcacttaacattaggtaatactcactctttcttctgactcaggtagaagagtcagcaatgatgggagtaagcgcctatgtggagtatctccgagaacaagaagtgtccgaacgatggttccggtataatccccgtctcacctgcatctactgtgccaaatctttcaaccaaaagggaagtctggaccgccacatgcgcctgcatatgggaatcacaccgtttgtctgccgcatgtgtggaaaaaagtatacccggaaagaccagctggaatatcacatccgcaagcacacaggcaacaagccctttcactgtcacgtttgtggcaaaagtttccccttccaggccatcttgaatcagcactttcgaaaaaaccaccctggttgtatacccctggaagggcctcatagcatttctcctgagactactgtcacttcccggcaagctgaagaagggtcaccttcacacgaagaaatagttgctcctggagaatctgcccagggctcagtttctactactgggccagattgaaacattgagggggagggggcaaaccctcttcccctttgggccgtaaccagcccctgtcaggaccatggattggtacttagattcacaaaatgccacgtcactcaactagaagatgttcccatggttttgccaaattagaagaccaacatgcggaaggcactaaaggctcttctcctcgttcccacctcatact

SEQ ID NO: 18350 - DNA, 1218 bp, Mus musculus
gcaatccccggtgagttcagaagagacatcaggagtcctggagtgaacctagcttccctcaggctcgagcaagacctgcgacttcccccgggagagacagctcggcttcccaagctgcccggctctatgatcctcgctcttcggaagctggcgccggcccacgaaaaacagggagtccccaaagacccttctccggagctctccggggatcaaaggtagacttgaaagttccgctcgtctaggcgcttttccacacacgccacgccctccagtttaaaatcatttcccgacttgccctgcggccgactcggaaagcctcgcctgtggccctccgatttcacgtaactgaaagcaactgaagtcgtcattttaactgagggcaaggcttggaaggcttcaatcaatagcctcaaattcccaatcccctattgcgccgcgttgttcttccgttttccaaccggtgcgaaactttcccgcatactgccgcccacaataaacatggcggaggcgccctcgtcctgattggccggaatccttgcgtaactttggcgctcgccgggcgtcagagggactggcttgtggatgtggtttgtgtctgggtttgaacctcagagctgtttggatttgttcgtcttcacctttcaggaaaatccaggatgggccgccaggtttgggaaagttgaaacacgaggctgcacctccttatatttctgcttatgccctggtcaccttcgagatacgtgggaataaagggaggacgcgcgcctggtggccggccttccggctggggcgctctggcactggcgctgctgttgaggcatcttcggggctcagccttgtttaattaaagtgggaactgatgcactgaaggaagcaaaggctttccccctacccactcacctaaggtctctggagaccttgcaggtcaatctactttgtagatactagaacgttcagcggagcagggtctggatgcatttgcgtgggaactagaattttaagggttcccaggtattccgaaaaccgagttttgagcaccaccacacctgcagcgtgggattcgtgattgtctctccggatcccgggacttcaacatgtatcttggtttttggttaagtcgtctatgcaggggtttatccagacccatcgggaagaccatgcggccaatctggggttctctttccagaaatctggcgttgagttcacaaagaattccag

SEQ ID NO: 18351 - DNA, 1104 bp, Mus musculus
ttggccactttcttcttcttaaaaaaccaaaacctttcgtctcgacgtagtcttggagcaaaacttgaaggatgattcgtgaatccggagtggatgacagtgtctttacgacatagttttggtaagagcttttgggtcctcgactggccgtgtactgcatttctttctgttgtgtgactgttgtctttgcaatgcttttgtgtatttaagatgtgtacaaacggaagctaacgtcaacgtgagcgttagtatgggagcagtgggttgacttttgtggcaatattgcagtgactaactcagggactttcttcatggactaaccacaagaaaaactactgagttttagttgtgtgttaggaactgagtacaagagaatttgatgagagatatagttccgtggatactagaaagaggctgataggaccctttgccacgggcataagagtcaaaggaggcgaagaattgagaaattcgtagaacctttccctccagtcacctggcaacatagcagcgtacttactaatagggtcgtttgaggagtgaacagtagtaccagatatgtcccaggactagggaggctgaggcaagagaattgccgtgagttctaggccaacctgggctacacagagagactgtcactcgatataaacaaaacacccccaaacaaaagaatattcgttaaaggcttaatctttgttaagtgcttacaaacatgcctgaaaagtaatgtatacttagcagttattgtactagttagcctactttaaagaaagattctgtataaacagaactgatgaagactcctatctaaatagcaaacaagtggggagaagaacgggaggaggtggtggcagagggaagacgctgccttctgaaggaaagttcagttgatggaagatttttaacagaggggttcggataagtgggacctgcatggctgctatggacaggaagaatttgtaaagtcaaaaataataaaaaagactaggagctctcctgccaaacccaatactgctctgatgagaaggccaagggtgtctgtaaagataaagatgtcttccagaagttggcctgggacctccacaggcataagagccgaaggaa

SEQ ID NO: 18352 - DNA, 1209 bp, Mus musculus
atttttggctttaatttatcatggagttttgatggggatttttgtttttgttttgttggtttgggtcctttgggcttttgttgttgttattgttgtgttgtttttaattttttttttttaacttatccttcctaccatgaaaaaaaaggaggggggaaaaaggcaaaaattccaagctgcaaaattttctttgctttataggttttggattggttttaaagatcctggtaagcgcagaagacctatgtgtgacctgatgttattccttttagacatatctatacatctgcagagattgccagtgatgaaggtaaaacgctagtatatgcgctcgttaccactttgcactaaatagtagagcactccaaatgtaaagctggttcagtgagagtgcgtgctgcttctgcagaggacccgagttcagttcccagcacttatatctggcagctcacaactgtgtgtaattccatgaacaacggtggctctcagccttcctgatgctgtagccctttaacacagttcctcacgtcgtgctgacccccaaccataacattatttttgttgctacttcataacagtcattttgctgctgttatgaatcatgatgtagacatctgattacagtatatctgatatgtaactcatgtgaaagggccctttgacccccctacccacgcgccccacccccgaagaggtcacgacccacaggttaaaaactgctgaacttgcttatccagggctcactttcgtcctttgtaggtacccgcattcctacgcattcatatacatacaaacacacatccacccatcaaatataagtaattaaaaatgaaatttcttttaaatgtaaaagaaaaactgaataagaagacatctcactaaacaggaaaattaggaaggactattaagtctataaaagcaggactcagatgctacactttgcattcactggtgggcattttcatctggctagctcaactttattcttaccccagttcccttttttctcctgtaatattttcatagtttctgccacatgtatctaggtctcttataaaagcaatgtgaggctcattggttgtcatcttgagaattccagtgaaggcgagtgtggctgtggaagagttgtgccgactgtcaccacctgcagctttctttcctgtctcctcttggccaccaaggagcagtgaactttctccagccgtgaat

SEQ ID NO: 18353 - DNA, 1705 bp, Mus musculus
tattgggttttgatttttctgtctggcaagtcatctacattttcggcaactaggggtaggggatgggaggtgagaggcaatttagcctgatacaatccaatagtatctgtaaactgggggattttgagggcagtagattttgagttaaactttaaaggagtagtggccagctatgatggaatttaaaacaagactgttcctacttacgatggagaaatactctcctaacatgtcaaaagtcaatttgtaaaacgagttcctcaaagaagagagagtaaagaatatgttcatttaccacttttccatagttaattcttcgagaccttttaccattactgtaaggttgaattgcaccattcttaatgtctcccaacagaagggagagagcgtgatggtagttcccaccctctccgaagaggaagccaaacaatgtttccctaaaggagtcttcaccaaagagctcccgtctggcaaaaaatacctccgttatacaccccagccttaagtctttgcggaaattggggctgcatctgcacatccagtactggggcctgaggatgtcagctggcagccgtgggtccttgcagcaggtccgtagaaagatcgtggcatgatcacagccggtcctgtagatcgctcgctatactactgggtcattaaatggaaatggcaccaaaaccttctcgggattctttactctgtgccttcgccagcattctgcccctctgcctgtcacagtgccctactgactggctctctttgaaacgaattatgtattgaagattccttaggtctctgtagggtctttgatcagcaaacaaggtagtgtcagtgtgggctctgtgctagaatgatgaaacaccttttgtatctttccgaactgaatcttctgttacccattttggagagcactgacatagggagaagctttcgattctgtatttttagtaaataaaaagtggggacagccgggagaattcttacagggaatctattgtaagtttctatcgaagtgggctcagaaagcctttcgcctcccaagagtgcgcatgtacctcctagagtttccacatctgctctctggtgatgtctgcctgtgaacgcaccttataaaagacgggcggtgacagtgttttaccactcagtgtcctagtagtgggtggccatttctgaattctgctttttgaggttcaacaaataaaatcctgatcagaaaaccgttgtcatgttttaaagtactactatcttagactctagcatgtctattgcacaggcatgcttccttcttgctgggaatagcatgggtatgtttctccaacaacatgagtctccgcatgaactggaagccactgaaggatgaattcctacatgtatgttaggctaattccttggttcctgttctcctaagtcttgtgaacaggtgtgcaccttctcagaggttctcaacttgtggctcataacctctttggtcaccaaggaccaatggaaaatatttacattacagttcataacgatagcgaatttacagttaggaagcagaaacaaaaataattttatgtttaggggtcaccgcaacattaggaaggttgagaaccactaatggttaggtagtctggcctcattagtgtaagctctgagatagtggtatattttgtttttctactctgaactgaatggtttcattccaacttagatacagtgctac

SEQ ID NO: 18354 - DNA, 1245 bp, Mus musculus
aagctcttatacagactaagtcggggtcattgccgagcctgcatgacataatcaaaggaaacaaggagatcaccgtgggagcatttggggttacagcagtctcgggacatatctaaaaggagctgaacatttatactgaaaacttttttgttctttgaagaacagcctgtggtatttgaagggttcagggggagggataaaatattggggaaagtattcagaaattatgggtttttttattttgccttttaaaaaagtagacaggattgtgtcaatcttggctgatgagctacagttttacaaggctgatctcttcctagaaggatggtgataggcattttataaagatgtgttttcacagataattactgggacaaaagtaatttggaagcccagttccttgggtggataggaacgaaagcctaaacctctccttcagcttggttcccgtttcttgcaccttcccatatttatgtgccttttgtctatttataatgccactggaagaggagggagaactttttctgtcatttgatttgttttgtaactttattaggtttttgaagctgcaaacactacaaagctttaaggtggtccatgcctgaagctcagcaatgtgggtcatttgcataaagatcctaaagacttccaacttagaaccgctcagtagtctcactgaaataaacactttctcaagttttctaaaggcctttcagataaaaaggtgatgatttcacccttggtttcatttaatttagttggattgggttttttttccccctgagttattattaactcagtaaaatggtaagatattttcttggaaatgacaggtatttggaataaatttattataaattcacctttaaacacacttaactatttgtgatgatttctctacattgctctcaatgttcacagtaaacactaatcctccaaattttcacatcaccaagaccaggttttccatggtcctgtcactgcctttgtacatagtcacagaaccagccagtgagcacgtcaggcctgattcagtctaattggtaaagtctaatgggattgtgattccttcatgtttgctttcgttggctacaatgtgcagatatgtatgtatgtgatgtcagcatctgtcttcacttgtttttttgttttgttttggttttttccttaagtaattggcagtgtctgagtaaattgatttcttgatgtgtgattgtacagggatgagtgaaagtgatatgtgtt

SEQ ID NO: 18355 - DNA, 1231 bp, Mus musculus
tgctgagaattagctgtttaaggacaagagcagaaacaagaaggaaacttcttaggaggaggcagttgcagtaacttgggtgaagttaactaagattttagaagtagaaaatagtaggatgttaattgaattaagtatatatttaaagaggtagaaaataagccttaatgaaataccaggtatgtgaggataagaaatttaggttgaatctgaggggtttgataattgagtagttgagttgtatatgtgttagcatactatctctaagggagagagtgcagatggaaagacagactagatatcaacagaatgttaagtggtgagcttaagtctaaggcataaatgtacttactgtactgcttttatatttcaagaaagagttaaatggggagagaacagaaaaagagcaaatgtctgtagtttgttttcaagcaccatgctctgtatttatgatttcagagcaccttgactgtttaaaaataacttgtttgaattttaggtcccacggtccattctttaaagtagtttataattatgtttatcttttcaggtttcagatcgtcagagttaccttgtcatgtctttggttttatgtgttgtcttgggactgatgctctgtatgcaacgctgtcgaactacttctcaatttgatggagattacatttcaaaacttcccaaaagtaatcagtatccaagccctaaaaggtaaggttaacaatatactccacaattttcttctttttgtttttctcaaagaaatgctgagcagataaagggacatgaaactaaaatactaaaaatatcattgtagcaagatggtaactgtacatggagataatgctattgaataatcgagagaaactaataatatatatattaagcctttgaattattttggttgagaaagatgttaaaatgtggcattcaagggtggaagagaagtaagataagatctttggagaagatttgttttatattagcaataatggttttgctaatttaggcttgttccatatgttatgcaggtctcaaatcctccatttaaataggctacacagtaagttagatcccgtataatcactcatgtgtgtaatgttttcttaatatattaggtgtttctcttcctatgatgacatgaatttgaaaagaagaacatcatttcccctcatcagatccaaatctctgcagtttactggcaaagaaggtagatttttatggatatgatctacat

SEQ ID NO: 18356 - DNA, 1174 bp, Mus musculus
gcctgtgttagacagctgtgttgttgatgacattttttgcattcttcttatttcatagttgttgttttagctccgagtctggccctcatttctcctttagtggccaacgcgtgcgcttagggctgtgcttctgcctcagtgtgacccggttctgattctcatgcattctttttcttttttgttcttttctctctttctctctcttttttttgttttgttttacttttttctcttacagttcttatagttgtgaaattccgtacttgatttgatgacagagaccctcattaaacaagatctgggacaataatatttaaagattgctgcataatgtaaatgaaacctatgtatagaactttcaaatttcctttttcaagaaactaaaaggcaagtaccaattcaaattggagcattgagaatatcgaatgatcacctttccaactaacaaaatgcattttgaataattatatttgatgtagaaatatctctattttgctttattccaaggatctaatttgaaactagatacttgccagtctgttatttgtatatatagttgaaccctgataacaatgccccatacttgtgtttcagttgcattaaagacattattgcatctaagtgagagtcagtctggtgaccaggaagcctatgtagagtcctgactctttgctgcaagagatgcataaccatcctatcagtatttgcaagaatgccattcttttcatattgtagttgctttgcaggcaatttccacacttatggattaacaaaagctaagtgttgtaaatgtttctgccttcagctctacccgaaaacattccagtaaacctattctgactgtataagaaaatacgtggtaattttttggtctttggattttgaaaatgggaaatttaaacagtgtgaaaatcataatatggtcctataaaactggagataataaaatttttgaagaatgtcattggagtgtttgaaaacgagcactatgtagctcccagtcttggtccagttggttgtcagttaaactacaataaaaagggactaattctgacgtgagtaagtgaaggctgcaggtaatttttttcttgacttcatttttttagtggttttctctttttaattttaactaaccctgtgccagaggtgctgaagttagcgcagtcatgtgcct

SEQ ID NO: 18357 - DNA, 1101 bp, Mus musculus
cttgtaaagagtactggcctcttaatattgattaaataagtcaaagtgaaggtgcttcctgctgtgcagggggaaggcagagaccacaggaactgttcacatggacatctcaagctggaaagagagctcacaggggcggccaggattgggggcaatggtcctgtataacagatattagtttttgtgatcattttaattcaaaatgtgtaaaacaatttggatttttctttgtttaattctacaatggttaatactaacagacaaaatgtttagactggaaagaaacttgaaaaggtggaaacaagattaagtggtagccgagccgggcatggtggcacacacctttaatcccagcactcgggaggcagaggcagacacagacggatttctgagttcgaggccagcctggtctacaaagtgagttccaggacagccacggctacacagagaaaccctgtctcgaaaaaccaaaaaaaaaaaaaaaaaaaaaaaagattaagtggtagcctaggtatctaagtataattgctggagtttacagtttgttgcacactgtggaaaatcgactctggccttttcaccatgctcgtcaattcctgtgcgcagcatctgaactgagaatacatcatttggagaaggagtgctctgcattccagcagctggtggctcagggatggaggtgtttcctccatcagcacagctgatcccagtgtgtgtgtcttgtacctcaggtcacaagttccactgcttggtgtggaagacactgtcactcagtgtctgttagcgaagatgaagtgttgggtgtttttctttagaagactccaaatttcaatcttcttttaattaagtatgccacttttaaacaaacaattataaaacatagaattgtaaagttaattttaaaacattaattataaaacatattacttaactacctatatatgtagttgtttatatttaaatttctcgaatctgaggaaatcctattgtcatgggactgaggattttacaacagtgatggcttcaatcccagtttatcactttgtcccttttggtcttatgtaatcctgagacctaacaatgacattagggtgaaatact

SEQ ID NO: 18358 - DNA, 2667 bp, Mus musculus
ataaagtctggtattagtgagctgttcccaaaagagagagaatcggcagcaatgtgtattttattgtttataagagggcagacgctagaaagatggtggggggtggccttgtttcaggtgttttgttttttttaaatcacatagaatattttcagagctaggagaaacctatgcattaaaaactgaaagatcgatggggcacaaacttagggaaaactgatttttgtgattggtacaaaaatttgaactgagattgatttgacaggctttggtaatgttaggtaatgttgcagtgctttcagtttttgttttcttatttttaaaggcaaagcagagagcagaggttcttcagtccacgcagcggttcttctctgaacagcaacagaacaaacagataggaggcaaaacccagagagtggacagtgatacaagtaaccctgaaacgctgagtgaccctcctggcacctgtccggaaaaagtagaagaaaagccaccccctgcacccaccataaccaccaaacctgttagaactggaccaatcaaacctcaggccatcaaaaccgaagaaacaaaatcgtaaaggctgtggtttattggggatgggtgggtagggaaagtgaagtcaaataatgccagccagcagccacaggggtaaagtggtctgtgacatcatcctgtgagacacaaggggcatagagcatttacagtgacagagctgctgcacagtgaggctccacaggctcgcacctccggtgtaacatttgcatcttcagttggtttgtatacaagtacgtaaacagtctgtaagtgcatacagtttagtcctaaggagcatgaaacaccagaagtaggaggaggagagcgatagataccacagagtagctcagctggacactgggtggtcccatgaatccatcagctgtggctcttctgctcccttgtgttctttggatgtgtctatggctcttctaggcttgaaagtaaaatgatgctaactggtgctggatagaggagccttatcttttattacggcagcttgctatttttgtaacatggtgatttggttgaacacaataaagtacagtagtaactgatctcccctcttcctggatgagtgagcagatgattgaatattgatgtcagcatccttgaacacactcagatgagcaacatagagcttctgcttctatttaaaatgatgctgggtttgattgtggtccgaagctttgaagcactacttggcgtctccttccttggaggtctcaccatttaaacataacatttgataacgtgttggtaaggtgaggtctagcttgtctccactaggtcatcttcatatgaatccagtgggtatacggttttgttttagggatagttcattttttaatgacggtttttagctgacattcatggagagaatgaatccttagaactgtgccgctagtgaaaggaaatcctgtctaagagtgtttctttacagagcagtgtcacaccatcctttgggccctctgctggaaacatagaatcaagtctcaaataatgccttttaaattgtctcctctagtattatagatgtaggacagtactgtatcatacctctgtgaatgtaacatagcttgtacctgctttatgatacgtagtagtgaccgtgctttatcagagctgttttttaatgatgttgctcagaatgttttctttccagatgatgattgagaagctaattaaaaaaaaaaacagaaacaaaaaatggtgccaggtaccacaagagtaacagaactgtgctgttttctgggattttgttttttactttttttttttttttttttttttgataagagtgtgctggatgtctctacaattttgttcaaatgactgcagaacctggaaaagctgttgctgctattgatgcataacatactgctattattggtctttttatataaatataaatatatatacatatatataatttgaattttttggaaactttagctgtgctgtcaactttggaaaaacgtatcccagtttactgtgttgagttggcattgtacagaaattaacagccatattggtctagaaatgttgaacttaatttttttttccatttgtacaggggtaacgcactgtattaaatatgtaaggtcttatctacgtgggtttgattacaaaaactaataaagtattctctaaataatgagtcttggaacttctaatctattccaaagtcggaagcaaggcttgttagtgtaccaaaggtcctagccgttatccaaagagttagggactgccctgaggtcaagaagcttaaagctcactcagtcagaggtggtgttgagggtaatagttacagtttctgttcttgggatgatcaaactttgatggcaagatggcagcaggatgatcaggagttaaaggccattctcatctaggtagtaagtttgaggcccatctgtatgtgtgtgagaccttgtcttggagaaaacctagggagacacgtgtggtagtgcacggctgtaatcccagcactcgggaggcaggggcaggcagctctgtaatcccagcactcgggaggcagaggcaggcagctctcttgagttccaggccattcagtgaactccaggacagccaggcctacacacagaaatcggggtcgggggcagcctagaa

SEQ ID NO: 18359 - DNA, 2580 bp, Mus musculus
ggggggaagctcacacacctctatgtgttacacatcataagggaaaaataattctactggaactggtaccacatgtgtataatcctgacacttgacaggtaggggcaggatctggatagagttcaaggccagcctcggctacacaagtttgaggctggtatttgctacttgagaccctgtttcaaaaccaaaagggtctatcaatcaaaccatgccattttaggttttctaatctatgaaactttttcagaaagataaaatactttcttacagggtaggaaataagttatactctcaaattaaaaaatatttttctgtcgggcacagtctttaactccagcacttgggaagcagaggcaggtggatttctgagttcaaggccagcctggtctatggtgtgagttccaggacagccagggctatacagagggaaaaacaaaacaaaacaaaacaaaaaaatcttttccacatctgcaggtgttgttatcattgatgatcatcctgaagtaactgtaattgaagacccccagtcaaatctgaatgatgatggctttactgaagttgtatctaaaaaacagcaaaagcggttacaggatgaggaacgccgaaagaaggaagagcaagtcgtacaggtttgagctcagcattttattgctagctttgtctgttgatatccagaacttgttaacaaatggtcaggttactcaggtctgctcagtcttagaagatggctgagtagcttcacacctgaccttaagcaattaattttaaaatgagctacgactatagcttgctattgtccttataacagaccatagttaattcaacatatatttttactaatttgttctatggtagaattcaatttgttttaaattatgttggaaattgaatgaacacaagtgccctgatccagaagtaacttttgtctttctcatttgtttgtttgtttgtttgtttggtgaaggtgtcaaatgtacttcaaattttgttagtttatttcatattttagagggaagagtaacctaatatataaaattatattttgtctatattctccaaactatcttgacttctaatactttgtaaactcattactaccctaagggtgtccaacttagaaaaatgaaatagctaagttagcagtaggaagttctaaaatcactaggaagtacaaattacatgtatacactgtttctttgggtaaattagtgacaaaatgatctgtttgtttaaggtatggagcaaaaaaaatataggtgaaaaaggaagaagtcagacttctaagcttcctccaaggtttgccaaaaaacaagctactgggactcagcaaatccaagctccaccctccgcgccagttccagtgtcttcctcagctccaggcctaacagccccagcagctgcagctcctgcctccaccccagctccagttcccattttggcatcagccaccgctctagttccagtgtcaaccccagctccggttctaacttcatgcccagctccagttccaacctcagcctcggctcctgttccagcatccacttcatctccagtcacagcctcttcctcatcccaaccatcagttccagctccgactcctgtcttggcctcagcctcaactacagtctctgtccctattctcacctcggcttccattcctatccttgcttcagccctagcaccagctactgtttcttctccaaccccagtggtctcagctacagctgtgccatccatttcaacaccagccgtcccagcctcagccccaacagcctcagttccccttgccccagcctcagctgcatccactgtcccacccccggcctcgacagtgcagacccagacccagacccagacccacaaaccagtccagagtccacttccaccttcagcgccatcttcaaagcagccaccaccctcgattagattaccctcagctcagacgtctaatggcacagacttcgtagccgctgggaagtccatgcccacttcacagtcccatggctctctaacagctgagttatgggacagcaaagtggctgctccagctgtgctgaatgacatttctaaaaaacgtaagtatgcaacagggacgtgtgcggtgggaaaagacagaagtactaaaatttcttttatatcttaattaggaagtcttagcttcctttattttagtagcttagtttcctttcctttttatttctctaaaacagttaacaggatacttttctccattgaggtttcatatcaccctaactaggatagttatcgggaacaccaacaaatgccaattggggggggaaagagaaagaaacccttatatacaactggtaaattagctcagccaatgtgaaaatcagcaaggaagtttttcaacaacaacaaaaacccctagaattaccatagaatctacctagtccctttctggatgtatatccaaagggatttagattagcagagaaacttgtacattgatgataacagtggggacagtgaccaagataagtaatcatgatctagtagaacacagtggggtcctactcagccaggaagaatgattctgtcatctatagggaaatg

SEQ ID NO: 18360 - DNA, 1133 bp, Mus musculus
gtcctgccaccttaagaagacctgcttatcgagacaatcagtggaacacaaggcaggcagaacctcctaaacctgaagatggagagccaccaagaagacatgagcagtttatgcctataccggcagataaacgacctccaaaatttgagcgaaaatttgacccggctagagagaggccccgaaggcagcgacctacccgaccaccaaggcaagataagccacctcgatttagacggctgagagagagagaggccgcttccaagacaagtgaggtgttggtaccctcaaatggcacagctaataatgttgttcaagaaccagttaatccacctgcggacatttctggaaataagacaccagatttgtctaatcagaattcttcagatcaggcaaatgaagagtgggaaacagcctctgaaagcagtgattttaatgagaggcgagagagggacgagaagaaaaatgctgataagagttcacaagcagttgtaaaggctggtgaaagtgttttgcctccaaaaagggaaatagcgaagagaagtttttctagtcagagacctggagttgatcgccagaatcgtcgtggcaacaatggcccacccaaatcaggaaggaatttttcaggtcctaggaatgaaagaagaaatggcccaccatcaaaaggtgggaagagagggtgagtactgtaatttagaacatgcctggaaagaaggtacacaggatgccaggctagataaaagaccctgtattgctgactgctgttaatctgttatgctaagacacttcttctaaaagggttttcttggaaattatgtatagagctttagaagtacttgtacatccagaaatgaacgtacagtttctgtagttgctttgtgctaatgagtagctctctgtccttagtttctccaggtgtgttttaagacttgatgtgttaaaaccacattactctggcactctgtgctgttatctcagaaatccttggtgaattgtcataaattgtattcccttctggagttataatagtcccagaaagacaatccctgcatgtctactatgctctagtggccaacatgagtcctctggcaatgggtattaattaatttttaaaacttcatgtctgagggtgtagt

SEQ ID NO: 18361 - DNA, 1532 bp, Mus musculus
gtattagaacttcagtatacaagtccatattactatctgcagttacagatacagagcttcatattgtgtgactgaaagtttaccccatcatttataacagcatctccacgtttctgactgccctaagccctctagtaatcttcattctatattctgcttgaatgaggttggttgttatatttgcaccctgatacaattggtgcccttgctaccagcaaaactcttatctgcattagtgtttcacagttatcttttcttattttccctgagtaacatcgtcataatttcttcattcactcaatgatatagatactctgtgttcttctctttgttaagatatttttaattggggaatgtcaatgttctttatacttaggattcattattttgtattcaggggtggggttgtaggggtaatgctgcagtgaaggggtatatgtacacatgggtaaggttgttatgttggtaatacctttgaattctcatcatcacaggcctgaaactgcaatggaccatgagcatatgactgctgcttatcctgtagaacatagtcagttggaaactcattcaaaaacggacgttgctagagactcaactgaaaccgaagaacaaaagtttttaagcagatcactggaagatgtaaaacctcgccatgttgatacaaatactcagtctgcttgttttgatgtaattgatcagaagagcttacctacttctgcagaagagcggatctcagcgctagaaagtcaacctgcccgaaaaagaagtgtttctcatggatctaaccatgctcagaatgcagaggaacaaagaaatgagccgtctgttagcatacctaaggttatcaacagatgtatggattccaaagaaactgtagaaaagccagaggagaagccaagaaaagatggctttctgcgatcttctgaagggcctaaaccagagaaagtctataaatctaaatcagaaactcggtggggtccaagaccaagctccaacagaagagaagaaggtaatgataggcctgtgagaaggtcgggtcccattaaaaaacctgtacttagagatatgaaagaggagcgagagcagaggaaggagaaagaaggtgagaagcttgagaaggtcactgaaaaagttgttaaagcagaaaagccagaaaagaaagatcttcctcttcctctcccccctccagcaccagctcaacctcagccacagccattggtttcaccaccagtacagccagaaccagagaaaccaccatcaacagaaacatcaactttgactcagaagccatctcaagatgagaaacctttggaacctgttggtagtgtccaggtagaacctgtagttaaaactgtaaaccagcaaagcgttgcagcaccgacagtcaaagaagaaaagccacctgagaaagtcattaacaaagatgttggaatagaaagatctcgcccagattctagactagcagttaagaaagactcatctttacccactaggacctattggaaagaagctagagatagggattggtttcc

SEQ ID NO: 18362 - DNA, 1169 bp, Mus musculus
ttttgggaatccatttagaattaagccagataatctgtcatcagaatgatactatggaagatttaggaatgattaaaaagctattcacaaattatagctcattcaaagcagtggcatgtgctcataatcccaggacccaggaggctcagaagtttagagccatcttgaaggttggttggttggttggtttgtaaatctcactatttgaatgcagagttaactattttaacagcaaagatgaataaaatttgctgtaagaaataatttttcccaaaacttagccttgttggtatgattctaatctcagtttttctgttagctgttttttctatgcacatttttttttcttttaaaataaagtgaactcctattgtatgtcccctcttaatttcttagcactcatttttgtatatgtttatcttggttttgtttctttcactttacctaattctcttgtgtgtgtgaacttttctttttcttacaggaatgattcctcctaagccgttaatcagaagagaccagatggaagggtcacctaatagctctgagtcatttgagcatatagctagatctgcaagagatcatggaatttcactttctgaacctcgaatgatgtgggggtcagatccctatcatgctgagcctcagcaggcagctactcccaagtctgctgaagaaactggggatgcaaggtaataaattacttacatcattgaaagataagtagaatattgcatccctaaagatcattctgggtgccaacagtatcactcatggacaaaggtgtttgccattaagccagatggccagaatttgatgtttggaacccatatggtggaaggagagaactaactcccaaaagttgtcctctgatctccacagatggttgataataacaaaagctcttcccactctatcaacacacacacacacattaacatttttaaaggattagattctgatttaataccaagccataaatgtgcttcattttatctttgtgcatattttttctttttcttgtataataattttaaatcaacgagggcaaattagtaaaaacaggaatttgcctttttttttttttatagtctagccaatgggctgataagaatctagtagtgatgagaaatgatactttcaatccttagagaaactatgtaaaccac

SEQ ID NO: 18363 - DNA, 1363 bp, Mus musculus
tatgctttaacagaatctcttccttctttctttttccttctttttgacccttcccatctctccatatttatggcacacaatatcagtcccagaaagtgatcagggtgatgatggctcaggtgttaggggtgcttgctgccaagcttgacaacctgagttcactctaatgagattccatataatggaatgataagagagctgactcctacaggttgttctctgattttcacatgtgcacacatgcacacacacatagacataaaaacaaattatttcgaataccaagttcttatcttcatctggtctcttactccttcagcatcccccacctccagatcgacaaatacctggaagacaaggcccctttccctccaagcctccagtacctgataacgatgaaatatggaagcaaagacgaaaacaacagtctgaaatatctgcagcagtagagcgtgctcgtaaacgccgtgaggaggaagagcgaaggatggaggaacagaggaaggcagcgtgcgcagagaaattgaagcagctggatgagaagctcgggatcatagaaaagcagccatctccagaggaacttagagaaagggagagagagaaggagcgggagagagaacttgaaaaagagaaagagcgggagcttgagaaagagcaggaaaagcagagggaaatggagagggcaagacagcaagagaaagagttagaacaacagagagaaaaggagcaggaactacaaaggctgagagaacaggaaaaggagggcgagccaaaggaacaggaaaaagaggaaaaagttgaaccccaagagcctgttgtagagcctgcgacagaaaaccaagaaagtgaaaacaactgcaagaaaggtatggtgccccacccacatttcatagttaattatgcattctccttagttgttaatggtggagaggtgaaggcagggccttgcatgtatacttgtgatgcatcatcctctaggacagatggacagatggaacaagttttcctcaggataaaaacagtaaacaggtccttgacatagccctgactggcctgaaattgcactgtagagcaggccggcctcaaactcagaaatctgactgcctctgcctcccgaggtgctggggttaaaggcgtgtgcagctacacttgattgtcctcttcccaggtatagatcatatcatgtaaatactgagtgttaacataaatatttattgaaataaatgagaagtattaggaccttgggtttttgtcaagtaaatacatatgtgtgtaagtgaaggatttggatctgtgttctccttagagtccaggtttataagaatctgttgatagtttagtgatatgttattgatgtttttca

SEQ ID NO: 18364 - DNA, 1232 bp, Mus musculus
ggaaggggacattccaatctacaagggaattgtattgtattgtattgtaattttttttcatacaatatattctgattatggttagctctcctgtcctggctagttgacataagctagagggaacctcaattgagaaaatgcctccataagatctaactgtaaggcattttcttaatgggggagggcccagctcattgtaggtggactcacccctgagctggtagtcttgggttctataagaaagcaggctgagcaggtcatgggaagcaggccagtaagcagcacccctccatgaccagtgtatcagctcctgcctccaggttcctgccctgtttgagtcctatcatgacttccttcagtgatgaatatgggtatgaaagtctaagccaaataaacccagtcttctcccagttgctttggtcatggcggttcatcaaagcaatagtaagcctaactgaaacaccttccccaactcctcccagatcctccttacggttccacccacccaagcccatatccttccttcctctcagaaaataagcaagaatctgatagcagtagtaataagaaaataaaaacatgccgggcggtggtggcgcacgcctttaatcccagcacttgggaggcagaggcaggtggatttctgagctcgaggccagcctggtctacagagtgagttccaggacagccagggctacacagagaaaccctgtctcaaacaaacaaacaaaaaaacaaaaaataaaaaataaaaacaaaccagaacaggacaaatgggtgtggggggggcacacatacagacacaaagagacacacattatgcacacagaaatctcataaaacataaaactggaaaccataatatataagcagaagagttgtaaggttaaaataaaatgcccatataaagcatgagacgaaaacctccaaaaatacattgagttcattttgtgttagccatctaccagggggcatggggcctgcttttaagtgtggcaagtatacgcagcgagactccattggaaataactaatttttccattttgagcagttatcaattagtgttagattataggttaggggtgggttatgggttgggtaggtatcatggttaaatgtaaagtaatgtgtagcattattttattagttgctacattgagatctccaagttaaaagcttcatatagggaccagtgtgacagcttggtaggtaaaggcacttgtcatgtgaac

SEQ ID NO: 18365 - DNA, 1531 bp, Mus musculus
tgtgtgtgagtgttttgtgagtgtcttttagtgcttgtgtgagtgtatttccctatcgaagttcacacgtaagaggaaatctagcacagcctcatggcgactgctgcccagtgagtgcatctctctctgtttctggaaggaaatcccaaggggaatttgagaaagaccactcttgttagcttgaagcaatcatcatagaaacttattttaaaaagaggcattggcctgacactcaatgggagaatcagcagaacctgtacagttttatttggagttgacattctgttgtaactttaatttttttctttttttcttttcttttttttttttttttttgtttttcactggaaggaaaaagatgctcattttaaatgttgaagtgtacaagttgctttgttacaatgaaatcagtgtgtacataaaggacctgatgcttttctgtcagaacagatgctcaacagaccttccaagtttcactgcataatgacatcacgtcaaactttgtctccccaacttcgtattttttgatacgcactttgcaggatgacctcagggctgtgcagattgagaaagggatttgaatcatgtcttaacgtctccgtactgagttgtgggcacagcttgctgctgtggacttgtacccttgatttttatctcaatttggcattttctttttaaagtgggcctttacccggacctcacggcagcacctacctgctcccaccgttactgacctgttgctctgtgccatctatgagggacagccgctggtgtgtcctcattggcagtgtgaactgtcagggtcagcagtcagtgaggtggttggtagtgtctgtcacaggtatgtagcagaagctctcagatgtgagactgacgtaggtggatgaagagctgtctgctcagcgccatcgggcagaggataatgttggggaagctacctgatgagtaagctttttaatgctgtaaaatagagctaaaattcaatgccactttttcagagatgattaatggacagcgtggtcaaattcaaagctttctgatgtataaaactttataaatggaactactccatcaataggcaaagcgtaaccaaaatctgtctagatggatagtgtgtaatttctgcccaggactctgtttagtaaatacatcactgtatacgccaggaatcttgctccaataaaggaacataaagattttttttggaaaaaaaaaaaaaagaggcattgggctggagagctatatcagctcttaaagactcaccacccaaacaccaagaatgggctcttaaactgttgctctcaggcttggtttttttggcttttgttttttcattatagaaagctgggagaaaaagtgcttactcctaagataatttaaattactcaatgagaagcttaaaatgtggaagagggaaaccttttaaagaagggttaaaatctgccattacttaaacagttaatataaaatgaaacaatgttcactcctagtattgctttcaagtatattcttaaatcaaatagccgacaca

SEQ ID NO: 18366 - DNA, 1115 bp, Mus musculus
tagagctcgtgtttgttcttccatgccttacccagtaaactgagacatgcactgcagctaagacaaagtgtgcttcagtgatactgacacttttttttttttaagtaatgcatcacttgggtgtcagctgcaggtgaatggttggcctcagtgttaaccgtctgttaacatgcagtcacggggcagcagaagtaggtattggtgtgcatgagcgagcagcaaacgcaggttttcatttggatgtgttagcatcaggcatgtagagggacaagcgcagtctggggcagccaacactgttggaaaccttgcttgcatttcttacatcatttactgtgtttcactggtgcctgggcggccaccatctgccctgtgtgaggtttgattttatctcttctcatgtgctatgccatactgccccagctgcagcattccccgtggaagccgttcttcccagcagcctctgctgccttcctgtgctttgcctgttacttcctattctcctgtgtccttaaggtgtgtcagtgaagtagtgattgaactgaattcgagcaaatattcatgacattttgcttttaaagtcctccagaaaggagtggtggaacctaccttctctgccagcattcccaatagggaattcccaaacaggaagattgtttgaagtttaaggtcaacctaggctgcacatggatacagcaataccctgtgttaaactggtgttgcttgaggcttgagttgatgtaagggcagaaatggtgagagggagatgtgtagataactcagagagaggaacatttggtaaagatttttttttcccttctagaacaacttctcatgaagcataataaagatacaactcacaggctggcttatatttcaagcataataaagatacaactcacaggctggcttatatttcaagaaaagaacgaaattaataataccatctttttccctacaagtaattatactttttaaagaattctcttagtctttactaagagtagagactgtttattggggattttacaaatgaatgtaggtgtattcaacttgctgtagtggtacatacctataatcctggtacttagaaggtagaggcaaaaaagtgtgagtgc

SEQ ID NO: 18367 - DNA, 1732 bp, Mus musculus
caaatagattttaaaagctggttgggtgcatattacttttagcttcagaagatatcgtgtatatttaagaggcatttaactattataaattattctgatgacttaaaaatgtcaatactgagctgtatattttaaaacaagttttattcatttaataacaaattttaaaaaatgcagctacacatagaaaaacctggttctatgttacccagtctaattaactaaggtttccagataaaataaatccaggagataagattaacttggatgctttttccgcactacccagggaccagtccataaggcgttgttcttgattcccatcgtaacttaaatggaaacttaacacaatgttcggagctcttgacgccctgcagatgaaggaggaggatgtcctcaaattccttgctgcgggaacccacttaggtggcaccaaccttgactttcaaatggagcagtgtatctacaaaaggaaaagtaatggtatcttcattataaacctgaagaggacctgggagaagctgctgctcacagctcaagctattgttgccatcgagaatcctgctgacgtcagcgtcatctcctccaagaacacaggccagcgagctgtgctgaagtttgctgctgccacgggagccactccaatcgctggcctcttcacacctgggaccttcactgaccagatccaagcagccttcagggagccacggcttctagtggtgaccaatcccagggctgaccaccaggcccctcacagaggcctcttatgtcaacctgcccaccattgctctgtgtaacacagattctcccctgcgctatgtggacattgccatcccatgcaacaacaagggagctcactcagtgggtctgatgtggtggatgctggccagggaagtactccgcatgcgaggtactatctcccgtgagcacccctgggaggtcatgcctgatctttatctctacagagacccagaggagaatgagaaggaggagcaggcggctgctgagaaggctgtgaccaaggaggaattccagggtgaatggaccgcaccagctcctgagttcactgctgctcagcctgaggtggccgactggtctgggggtgtgcaggttccctctgtgcccatccagcagttccccacggaagactggagtgcacagccagtcactgaggattggtcagcagctcccacagtgcaggccactgagtgggttggagccaccactgagtggtcctgagctgctgtgcagacgcctgagcaaagggaaaaaaagatggaaggaaaataaaggcgctaaaagctgaaaaaaaagattaacttggataaaaaaaataataatttcagaacatcatgttctttgtggtacctcaacctcgtgacattagtacaaggtctctccctaatccagatctctcacagagctaatctttgcaaaaatgaacaggaggagcaggaggagggggaggggggagggggagggggaggagaaggagggggaggagaaggaggagagttaagattgatacaaaatctcatctagttcttttcgtgcctcctattttctcctctttactccatatttctcttaacacttcatcacaaaaattccataatctaaacaagcaaatcgggagtgcagttgcagagtaggcacagaaaacagcctaaagaagataagacagagtcttggtgttaggaaagggaaaagttggaaatatccattccttgat

SEQ ID NO: 18368 - DNA, 1184 bp, Mus musculus
ggtgtccatgacccctctgacttgctcacttctatctcccactcttccacaacagctccacctgaagtttagctgtgggtctttgcatctacttccatctgatggatgaagcctctcaggagacagttgttacaatgttcctgtctgcaggcatagcagagtatcattaatagtgtcagggttggctctctgacatgggatgggtctcaagttgaggcagacattggttggctgttccctcagtcagctccatcttaatccctccacatcttgtaggcaagacaaattttaggttaaaggttttgccgagagattaatgtcctaaaattgctatctacaaaaagatggctattatctgttctttgcttgttgctatgataagtaatatattgatcacaaaataccatccatctgatagcaattctgtccatgagagctgctgagcgcttcctacctctgtttcagattgacgaagtggccaacattaatgacatggacgaatacattgagctcttgtatgaagacattccagataaggttcggggttctgccttgatcctacagcttgctcgaaatcctgataacctggaagagctattattaaatggtgatttctctttctaaatattaaaagtagaaaatcatgtaaaacaaacctactcttgaagtttatactgagatcttaaatattttatgtttgcaagtgcacatatgcatgcttttcatgtcttaaatatttaattttgtatttttttcttcaatgtattatgaatattttcaatctatcacttatcttcctctccttttttctttacatggtaggtctattttccattctcttcaccctgcttgtgtgtttgaatctcaagaatttctgttagaactagattatgactggattactgtaggttccttaatccatttctgtttattaatgtgtttagtctgtttaacattgaatgcttataaggtagtcttgatattttgtatttgctatgaatgacaaagcctttaacatgtctatatattttttaattaggaacagttttatcatgattcttaaccttttttactctctgttttcttctattattgttttttttatgctaggtattttctagtttaccacttgaagctagttttctataattatggttccctgaggtattatcttagtgatgtct

SEQ ID NO: 18369 - DNA, 1099 bp, Mus musculus
tccctctcctgtttatttttctatttttaccatatgtttattgataagtgtccccacccccatgtatacagaaagatgtggaagcacaaacacaaaattctttgaaacattgacaagagtcttttattgtctgtttttgttatctttcagttgtattttcaaatatatatttacaccttctattgtctcaccaagtcaataggccatcatgaataaaaacaaaaaacaaaacaaaacaaacggagaagaaaagaaaagaaaaaaaaaaagacaagtttataagcatgtcaaagattggtagatccatagggatggatttgaatctttcagtattttttttctgtgcactcacatttgatagaacaaatgagcttgctccaaccacgtcaacaacaaccttccatgccttgatcccgccaggtgccgcagaggatgaccttgttttagaagtggttatcatgattgggacggtgtctatggatgactcttgtgctgccctactggccaaatctgggataatcccagccctcatcgagctgctgaacggtaactctcatgctctgccaacgcatacaagatactattatacattttaacacataaaatacagtctgcaatgttatataatatctgttttctttcattaatcataggattaactaaattatgtaattacaaaagataaactaaactaagctgctgagttggattggatagagtgatatgaaaggcctggaggttgctgtcgggaacgttactgtgaagcagctctgggctgacttcatgtgctcctccctcctctaacctccaacactgcctcacttctttctgtctagcctcatctcggtttgagttaagtcttctctatcttgcaatccttgcttcttatatcttcacttctaggtaagaatgttaacttcaaaactgatcctaaacatcatattctcttgtagatgtacaggatttttgtcctgtgaacttgccaggaaaataaatgtcacatgcctgccctggcccacggatgtgtccattgaacacttgagatgtggtggtcaggactaagaacctgaattttctatttaatttaaattgaattagc

SEQ ID NO: 18370 - DNA, 2240 bp, Mus musculus
tgttgggagttcgctgctgacactcagattgcgtatcttattaatcggggcttagtctattccacaagacagagaccatgtaatagtcagcaaactctagccagtgtcgccatttcctagtggagtaacgctgctcattgcttgaatgtgattttttttcctattctttcataaagccatgtttgtggataatgtgttaattcaaattgttttcatttgagtccagaccctcctggtgggcttctgatatttaagcatagattgtcagaggtatatattttgttatgtacattttaatgagaatataaaaggttaataatatctctgaaaattatgtcgctgtcagggaatctgaaatgtgacattccatggccctgacaatgaggtgaaaaacaaagcagcttctaacctgcctttctctttccagcctcgggatggatggcttcgggcagccactggggatccttggacgtcctgccaccgcgtatggattccgccctgacgaaccttactactacagctttgggtctcgataaaatcacccctcccatgtggacactcagcttaggagagatctgtgtgctgtgggttaaccttgaatcttgacttaataatgcatgttatactcctatggggctgtgttgcttatttctccacgttgttagcttcaggttaactctaaccctcatgtcttttgttaaatacggttgatgctccactgttcactcgtccagccacatctcgaggtgaataacatttcccgtgagtctgttgcaaaactgctagactggaaaagcagatactacattatgtactttaagtgactaatttctattggaaaaaaaaagtggcatacatgcaaaggaatgagccgaagtcatgtgttcatacttactgtggttcataggaaacactcatgtacatgggagaaacatacttttttttttaactttctctttctacttataaacttcttagtgtttcatgtgagccatgctatctttaaactttaagtgaacctcaagctttttatcccatgctgtgtctggaagtttctttcacaaagttagtaactgtacaagctttttaactagcagtgagcatatgctgtaagtaatgttatgcattagcatagtctactgagcgacccacgctcatgccatgttaactgcagcagaacaccgggcagcggaaccctctgtagatggagcacgagcatcactgagcttctaagtccgggtcttccaaaatgtgcaatatcaaatgtgaggatgctgattatttttgccttacctaagaaaattaaggaaaggactctctgtttgttcacttaagatagaagtgggtagtgggaaattgaaagggataggatgattaataatgagttttggaaataattcattgattgtaagatattgaaaactttacttgagaaaccaagcaaatgaattcagtatgggcaaagattgttgcttgatcatctcctactgaaggaaacctaagcttccgaacactgcagatcaaagggaagacttctgctcttaactttaggagcccactgatctaagtgtactagttacctcagttcacacgtttagcacaaagtactggagctcgggaggtcctttggacaatacagtccatctgctggagaaatgtaaatctagccaacaggtatgttcttacctgatacataaatgacctgagacattgtttatgtttgtgaattcacaatctgaaagcatgcagttattgtctttgtttcccttttacccataaaatattaaagccagaaaggtttgaaccagcactgtccaactctcatttttatgattaaaaagaaaaatctatgatgagagccagtgggatgtaggtaagtaaagtcactggtcaccaagcttgaagaccggagttcaagtcccagtacctacatggtcaaaggagctagccaatggctgcacattgtcctccaaccctcacctactcactgtgatatatatgcaccctacacaatgtcctctaagctgcacccacacactgtgatatagatgaatccctacacatgcacaaagacaaataagtgtaaaatatgtatttcctgtaaaattgagatgagatactaaatgacttgcccatgtttctgtattcagtcagtaacattgcccgtctctttgttttcagtgtagcaggccttgtacagacgctttcctgctgtttatcacatacgcagtctaagtata

SEQ ID NO: 18371 - DNA, 1183 bp, Mus musculus
gtgagtcctgaagaaatgtttgagactcatgagcatatgccacacagaaagccataagacaggtacctgctgtagcagttgttttaacccctggtggtgtgataacttaaatccagtctaggccccctgaagcagttgacaacaaagtccagatacatgaaatgtttagtggtgatgagtgctatgaaaaaaaaaaattaagcagaagtggggccagtgtgggggcatagttcccaatggggataaagttgagaagcccttactacagtgacagtaagtataagcctgaagcggaaggagaaagccatgtactctctgaaagagttttgagcaggggacagataacaagtgcaaagcctcgtaggcaggagcatgcccagttgctcagggtatctagtatagcaatgggcagggatgctttgcagcccattgtaaacctggttatactctgaaggaaattggaagttattaggatttgagcaaggaaataggacataatgtgtcccaagagttgacaatatcctgtattgaagttgttttttctccagccaagtttggttctcttcataggacaaggtgctgcccagcttgtcttgtattcttacttcactgatcgtcaacaagaattggttgctagagcaacatactttggaggcatttactcagtttgctgaggtaagatcaatttatcatattgatctttatattttaatatttctaatacaacattcaaaaacattgatgtgcttctctgtctcaggtgtgacatttcctgctgaggaggtttagtaatcatgtttacaaggccttgtcacgaggcctagggaaataaactcaattctcaaggctctttgctcagcaaggattaagtgttcagcgtcggctacccgactcagacactgccttcagcagcactgggggattaggactttaagtgaaaaccctcagctccgttctagagaggtgacctcccccttgtgaggtcaaatcctttaaaaaaccaaaaattggaaatgcttctgtgctgtcctagttttgtgcagccatgcctttggtttaagagtgactcgggtaattaaaccttgctttactaagtatataggagctgaaattacattgcatgtcaaggctctgttgaactatgagtgtactgcctttgagaacccttggttactactttata

SEQ ID NO: 18372 - DNA, 1240 bp, Mus musculus
gagaggaagacaggaaaagggatagagagacacacaggaagtagaagggagggtcattcagtttgaggggttttttcagcctgtcagggagaagaaggtcggtcatctggatgctttctctccctctgagctagcaggctttcccccagcatctggctccagagtttttgttggcaaaattgaatatttatgattttgataaaacaaacaaacaagcaaacaaacaaacaaaaaccagcatacaagtgtcaagtactccccttgatgctgcctgctgctcagcctacttgttaaggatactgcttcctatcatcttttgtctcctcaggtccccatggtcctctccactgccctcattcttaagtgatgaccctgtttcctgtatctctgagaaaacagatacatcaaaacatactcatatccctggagccaccagctgctaggtcctctgtccctgatgtcatccaggcagctcaaggccagcccagtgcgtgcccctcccatatcactgcttccttaggcatccacacctgaccaccagaatccctgctggagacccagctttgcaatcatgtgattggtctgaatcattgtttctgccacctgacttcccagctagtgtctggagccctcggaactccagtgtaatcactagggtgctcaccatcaagaccccactccccccagtggtttacatgcaaaaataaaagccgcagaagtccaaaaaaaaaaaaaaaaaccatactccttctggtccaaacgggacttccttatccgccccataccatgcactttgtaattactcttctgaggctggctctcccacttaagctctggatacaatcaactctttgctgctccaaaccatggctctggccgtttacctctctccattttcctctgaccttgtcctttctgcaggaatgtccatcagcaggtgacatcctatgttttattttctcttacattttattaaatgctacttattttcaaggaaaaatacctcattctagtaagttacatgtgtttcctacttcttggttccccactctcagattcttttgaacataatccctttatgcttccattcttcaacattccccttgatctctcccttgccaaatccagtggtatttgtgtagcttggctagcttacagcatttgctaccatctctctctcctttcatttatcagccttcttacccatttcttccacacactcattaatcccaggctcttt

SEQ ID NO: 18373 - DNA, 1099 bp, Mus musculus
cgtgcgagactaagcaagatgggccgcagcccacgtgcatgtgtgtttcaggccgtatgtggataacccggttctgcccggacaagtcctgtgggagctgctggggaccggggacagtgcgtggataaagaaaacagtaaactcgactttcagtagaatatgtacatatgagtgtttgtatgtatatatggatggatgttatttggctttgtttttgtgagagggtccccctttccttcccctccttgactttgtttacccctgacaagatagatacgcgctattacagaaggacaatacaggacagtagtacgccatccgaatatgggtgcttgattaggtaagactgtgtccaaagatttactgcaccctctgaagtccgtctctgggatgaaaacagacggtgtcatataattggtacttagcttttctcggatggtgaagtgttgcttcacctacaggttttatcctccgtacaggtgtttttgagggctgtgatgcacatgggccatgaccaagaactcctgcgcagacatttattcaagatacaaacttgtacgcacagcaccacagaagtgcatagtatacttcagaaatgtgcctaactcctgtgattaaagctcattatcccggcacttggttttgtcagaggagcttgtagatggagattgctgctccaggaccctttccttgagtatccaaaagagtgaaagctcaggtccgatgtcttttccctactgtcagatgagtggatgctgaataattgccaccttcttcctatacccggtttccttccttaccgcgctgcttccctgcccaggtggctgtagaatatgactcccatttaagcctccctgtcatttcctgtcagtcatcacttctgaggagcaactaactcaataacttggcatgccaggtcagagcaagaggtgacactaccagacccatttcagactggcaggatataattactcagagtccagtttgttgtgcctttattcaaggtcacctgggaaagaattgagagtcagtgtggaatcccggatccactgacatttagcaagtacagctgacttctgccgtaatgttacaccctgct

SEQ ID NO: 18374 - DNA, 2452 bp, Mus musculus
accatgggaagtttggtccctagatctagagttacagatgcttgcggttgccatgtaggagctggggcttgaactcaggccccccggaagaacagccatgttcttagctgcagagctgtctctccagcccctcattcttcatctataaccctgaagtactgtattagatgccctgcttcgtggcccctcagagccctttaagtccccttcctcctctttataaagccagtcttcatccaaatacaaagtagttaaggtcgataagtattacgattctcaacatgtgacccatcgagaaagcagtagtgcagatgctcccagaatggccactttcatccactctggagtcctcgggtagagtctgtgtgcgtacaacccatctccagataatttcatgaacgactacttttctctcttgcagttcctgatttacgccagttacttcgcagccatctctgtggttttcctggcgaatggcatagtcagtattataaagaaatgcagaaagcaggaagatcccagctccagcccccaagcctccacgtcctaacgggctcccgaagtgctgctgcttccaagcaaggattttgcaccgcagctgcttggatgtatttaaactcctcatggttcagatagctatttctgaatgtatatttcatggcttcaaagcagctactcaactaacaccttgcagtcttggagttagtataatactgctaagagaagccggaagcttttttttcttggattgcttatgagcagtaatttaagaaaacccacaaaacttgattgtgaaaaaccgaataaccaagcagcgcgtctgctctttccctgattcgcatgtgactgtgatgctttccagtcacattcatcacgcactcagacctgtggcctggtgggaccagggcttcaggagccacaggatggtacaagcctcgacagacacgttctgtcagcacttgccccggccacctcattctggtttcagtgttacttgtgcgcatgtgtgtgtgtgtctgcagatggaaatcattccccactggcagtatctgctcgggttcaacgctctgtcctctgaggagtgttgtgtctgattttattttaaaagttcacggtatgagagttagtgcttcttcccaatttgaccgttgtatatttttggaaacgttctttagaatacatttctgcattatttgtatgcttcccagagaagctcatttcattacaaaaggcacattttaaagcctgctgataactgaggagggctaatgagataggtttgctcgtctgtaatagttatgtatgaaggactcttaattgcaactgaaaaggtcgtgtataggttagagatacagggagcccattttatatttgcatacccttttatttccaaaacaaaatgagctcttttcccttgagacaatatcattcccatatacctctcattgtcttggctttcttatccaagacgagaagatatcagtcggaactggattattccacagcctttttataaactgagcctcttcttaatgattgttctgggcttggcagtaggatagacttgatgcctgcgttttggaccttagacctgcccgccttcgttcctacagttagatcatcttgagagatacttaaaagtatctcctccttacttgaaagaatgatgttctacatgctaatatttgtgagacatgaaaactatttcaaagccaactttgttgtcttgttgtataagaaatctaggtaggtgctttcaactagagtgttgaccttgttaagacggacgtagctgcacggtattctcaatactgagattgcaaaactgaagcttgacaagtgtgtggaagaccctggctcaagttccagcactggaaagaccaaagtgcaaacgtgcatgggaggagtgagggtaacagaggccatggcgtacgtcttcctttgcagctagggaaagagaagaacactaaggagatggagaactaaggtcagagtagcagtctccagtcttacattttggtctctttcctcctatacttccttgttgctctataagaagttggttgcccagaaacaagaagaaacattgtgattgcgaagtgtcattttgttttttttttaaataacatgtattatggtacaatcaaattgttcacattaccaaagcaatatttctttgggattcagttcagtgtttgtggcatctaatctgatccttctttacgtgtctaaatcaagactgtatccacattttaccacgcggccatacttgcagaatgcagaccctagtgggctgtactgtatgcactttgatgaagacgtgaaaagaatctgttgtactttttattcaatctgtatagactataaaactatttttattaaataaatattttacagtaaattttcccttttcactcagaattattttgagttcatcttcaaagggaggttt

SEQ ID NO: 18375 - DNA, 1176 bp, Mus musculus
gacaattgagtaataagggaggagacaggcagggagtggtttttggctaaaactgaaaattggtatatgaagtagaattcataaaacttcatttttctgttttccttatatagatatatctgtaagagtattagtttacaattactaaaacataatgttataactaggcatcattgctgaatttatagcattttgggagaaagggtgaattcaaattcattgaggtgttattttttatgatagctccataaaactctatggaactatgtaggtagttgtgtactgatgaaacccaaggcctttacagcacatgctacgtacatctgacatgacctctcatctgtcttaggttctgcggattttggatccagttgcctgtacagagagctctccggacaaccaatttgctgaatcttcaccaaccacattactcactacaaagaaaaatattggacgtttccatccctataccagatatgaaaatataactttcaattgctgcaatcactgccagggggagctcattgctctttagtgtgtagtctgttggagccatgctcagtacccagagtcattatttgggagcccggattagtaagttgctagaaataaaatcaattcatcgtgatataatacatacccatgaagctatttcatgtactggattccagattattttttaacaaatatctcagggtaagaaagtgaagctttgtagatatatttaaagaacagaatacttcccagtacatagtatttatgctaaaaaactaaaaagattttataactttcttttaggccctatattattattctgttatatatttatataaactataagcaggtttcattttggtgcataaagcaaaaccaggcaaactccaaccatgcattgtaaaggggtgtggccatatccatcctttaccgctgtctggctgctttactgtagggcagcagagtcggtgtgtggctagcaaagtccatccctttatagagcaagtctggtagaagagctggggtgcatgaaaaagggatttgcagtccctttatggtcacattgtgggtacacaagaggccttcagaaacactggggtaaggggctaatccttctaaacatataataggaaaacaaaagagtattttagagctacaacaaatacttcaataagtgttcat

SEQ ID NO: 18376 - DNA, 2064 bp, Mus musculus
tcgttcgttagagcaagacgagacccatgatgcgtgtatgcccttaaaattaaatttcatgtccttttggtttccagagagatgaagataaggataaagtcgggaacatagagtactttgggatgggcggatactacggcttccctctgcagtattatccctactacggcaaactcctgcagcccaagtacctgcagcccctgctggccgtgcagttcaccaacctcaccgtggacactgaaatccgcgtcgagtgtaaggcgtatggtgagaacattgggtacagtgagaaagaccgttttcagggacgctttgatgtaaaaattgaaattaagagctgatcacaagcacaaatctttcccactagccatttaataagttaaaaaaagatacacaaacctactagtcttgaacaaactgtcatacgtatgggacctacacttaatctctatgctttacactagcttctgcatttaataggttagaatgtaaatttaaagtgtagcaatagcaacaaaatatttattctactgtaaatgacaaaagaaaaataaaaattgagccttgggacgtgcccatttttactgtaaattagattccgtaactgacttgtagtgagcagtgttctggcccctaagtattgccgccttgtctattttatttagtgtacagtactataggtgcgcactctggtcatttttcaagccatgttttatcatatctgttttctactttacgtgagcaaggtttgctgtccaaggtgtaaatactcaacgggaataaaactggcatggtactttttcctttctttcttattttcttggctctgaaatttcaaaggtaacggcccatcgatgagcatttttaacacactccatagtctcttcctgtggtatcaggtctttattattattttttttttttctttatttcctggggctggggggtgggctgtcatgggggaactgccctttaaattttaagtgacagtacagaaaaatcaaggtgatgggttgtgttgtgctccgtgctgaatgctgtctcgccatctctccccgtgtcctccagtgtgttctgcagctgtgtctgagactgggatctgcctgtcactgtggctagtgatgggctgggtagtttgcttattcgtccatttcctttccttctttcctttctctggaggcatcatgcgctggtgctgcgtccttatgaatgttttgaccattttcatggtggaagaattttatatttatgcagttgtacaattttatttttttctgcaagaaaaagtgtaatgtatgaaataaaaccaaagtcacttgtttgaaaataaaaatctttattttgaactttataaaaagcaatgcagtaccccatagactggtgttaagtgttgtctacagtgcaaatccatgttctagcatatgtaataattgccaggagtacagtgctcttgttgatcttgtgtcagtcaggttaacacaacggacaataaaagaatgaacacattcctcacgtgtgtgactcgattgtctgggcgtctcagtctgtgtcgtctttactctggagagctaattatccaagatcttgaagaaatactggacctgaaaggcaagcacagtctgtcattagctacaggcaggtctgggctctcccacctgccacctgctgagaggatggaggacccaagggacctggatacacaccttgtccccaagagatgaccgagttaacaagaggcagaaaggaaggctgtggcttgtttttagaagtgttctacagtgctgttccactcagtgaacacaggaaatcttgactcctgtgtcaatacatagctcaacaaagtgttcgctgagtgtgtgtgtgtgtgtgtgtgtgtaaatgtttctattggttaaattaaattttaggtttgagactcagggaattaaatgtgtgcatctccctctggttcaggatgtactttcttggccatatttaataaatggccttagtgtcagaaaagataaaaaaattacactttctggtataatggacttgaagatttggtattgccaacatggggat

SEQ ID NO: 18377 - DNA, 3510 bp, Mus musculus
cctgcatggcaccgtcttgctattctgaactcagctggctatgaaatacacttttagtgttcaatgtggattctttctcttgcccttacctcctacgtcttgttttgtcttgtgacaccggttaattgcgagtgaagtagtgacctaaaaagctatttcctttcggacaagagccattagaaagtgaaacatcttcatgttccttgctttgtttatttgccctcattatttataaatgtttactttctgtcctttgctggagttgagataaggaaagtacatggaagaaagatccctcgtgggccagcaagaaggcatgcctgccaagcaacctaaatgctccagcgttgactctcagcctgcactggacactagtagtcagcctgtaggtgggcatgctgcagcctagtgcctaaccacacacagcgttcttgtgttggggacctcatctggtcctcatgagagccatatgagttgtctcaactgcagtcaaggaaccggggctcaggttggtttctgtgtcacagctccagctgtggcttggctctcagcctctgttttgacactgagtctcctggcatggctctcctcagagcgtctgtcgtctctcataactgttcctttcatcctcctggcctgtaccttttctgatttcagcatctatgtcaattgtgccaccttctacccgctcccccgttttgctttttggcagctacgtctgcatctgtaggatggccagcatcccgtggtccctttcagctgctcagtgcatcccttgcatcattagtaccctgtcttgacagcttgaggtcctggcagtctatgtttgccctttgctcagggccagccttgacctctgttttttcaccaccagaccacaggaggtgagagcactcatctctgcggttgttgccagttgctgaactgtggctaatgactgtcttttcttctgagatggagaactgtggataggctgatcagaattagggcagaagggagctcagtctttccagattccagccatgctgttgaaggcatcgatgaggtcttcagtcaggaagcaaagttacatgctaccctctggctgtgtgaggcacattcatgtcccagaagccttgggaatcagttcagggctcagaagggctcagatgtgagaacggccattgggaaatttagggaaacccatggatcctagctgacaggaggagtagggtcattgctgcaagctccaaccgccttgtagttatgtacctaaaaagctgacctctccgtgcccttgtcagggactgggcttgagcccaggtatcttttaaagatggtatagcaaggatgaagagcataacagtgtgaacatgggcttagaaaataagcagatccagatgtggtccagtcccatgctggtgatccagatgtggtccagtcccatgctggtgatccagatgtggtccagtcccatgctggtggaggccttggaagttacctaatgtttggttcctcagtttcactgtttcctaatagtgggctgacaagtcctgctggctcactggaggatgccggtggaagagaatgcatcaagggcttggggcgcatgtggcacagcaagttgggtctccatgaactaactgatgagtgctaaaggtgacaggatgggtgcctgcctgtcagtttgtctagcatattctgtgtccatcactgtagactgtcatgcattgtctcactgaatggtcacagtgactgtcaggcaacggataactgccttcatcataaagtagtagtggtctcagaaactcccaggagcaggggcctcagtgagggtggtctaggttgagatcaagtctggataaaaggctttggcctaattcctacagcctgtggccagtttgcttcaacagtttgtgtctggacacatttaagcagtttttggatgactgtcttccagaatcttccagactctcagattttttttttcagttgccttaaccctaggttgtttctgaccctgcttttgctggactatagaaggaagaaagccacttcatatctgctaaagtctcctaccaagccagtagtattgattaaaagcaacttagtgagtgaggctgaagtggagaactagcctctgactgtggctgttggtgttatctgtttctcctccctaccctcaattcttccccattcacacccatggagcagggcatccctgtgttgccaaccaatggggactgttgagtgatcactgtagaggcagtgtggtcctcagccaggctggtttccaggtgtgggcctgatgctgccttccctgggctgcagtctggagtgcttcactgagaacaccattgtgccttctggaccaggagagtagcttcggatccccttggctggtccaacctctactccaggctgactgttgggatgctgtggggtgggggcctgtccactgaatcctgtctctcactgtcccttttcacagatcaagcctaaggcagcttttgtctctcctgctcctctgtgtggctgctgctcagaccccagctcttaggcatcttgtcttggggaagggtgagatgcatccccagcttggccttttcagtgcttgggtgtctgtttctctcatggtgactttgtggattatgccttaattgccaccccccttccacatagtcaccgtaggctgagagaacaagaaatgaaatcatgaattgcattccatatacgattactctttaatactttggttagaataaataattagcatcggggcagtatctgaaatggatgtgaagggcggggctggtttggcttttgttgttgggatccccgtgagtgacaggttttgccgtgcacgggatgagacttggtggaatgaattggtcagtcgaggtgcacccatggctgtggatttcctttcctttgtgcaccctctgcctacttcctgactttactcttcctctggtaacttctcagtagagtcaattacaaccaagcctaaaacttatttttagttaattaaaaataaaataaaatcagtgtttaaagcagtataaagatgcctgctagactttgtggcagtttggtttttactgttcaagtatttttttttttaataagtttaataatgtgcttatagataacatccttttaaaagtgaatgaaccttagctgaagttcattgcaaatatacattttcccctagaaatctaagctgcttaggaagttttattaaaaggattgcttagggggtgatcttaaagtacctgccagttcacgttttgctttgagatcttgtgtgtttttcggctagcgaagggggaacgcagtggagtttgtttaatcccagtttgctcggggtggagtgttctgctttgagtatttccagccctgctgtgactgtgggagacatttgaaattagctggtggcagagccttccttcatataagctgacaatatcaagtcagatacattctgtcaggagctggtaactgacaaggtagactcgggatgcacagagt

SEQ ID NO: 18378 - DNA, 1233 bp, Mus musculus
tcaaacacagggcgtcggcggtttgcacggtaagaaagtggggctcttccactgggattcaaggtggaggagctactatttgtcattggctccaaagtcgctgttggtgctgggcttcctgagcgatagggacattgggcatgtcctcttcaccacgactcataagcacaagaggtgatgacactgcttggagcggtctgtaaggaggaggtaaggcagtgaagcacggggctctggatccagaaagacaaattcccacattcactctggggtgacgtcacccggagacttcagggcggcgcgccagagcgacacccccgcgctcaagtcccgcccctcagcgtctccacgtaagacgtgtgtcaccctgagctagtggtcccggaagtaaaaccaggaggggcggaagagacggcggaagggcgggcctacggcgcggcggcagggggcggggccgagatggtaacggacgcgcccaggagccgcgctgcagagagggccatcgtgcgaccgctgccgcaggcgcttgctccgagtaaccctgcggctccgcttctgccatgatgatccacggctttcagagcagccaccaggacttctccttcgggccttggaagctgacggcgtccaagacccacatcatgaagtctgcggatgtggaaaagtgaggctgtggggcggggccgggccgagccgagccgagccgagccgagccgggccaggtccggttggtgtccgggctgggggtctgacggtctcggtgcagcctcacgcggtacttggggccgcaggctcggtccctctgaccgaccgttgattgacaacttcagtaaatggtcctgttccctgctcgcggcgacctctgcttgctggaactgtagcttctcagggttgaactgagcgcggctgttttggtggacttcacctaaacctcgccgctcctttttttcctacctaagcctgcgcaacctttctgggcgcgatgacctgttcccttgcgggcaatgacggaaatggtatttatgtttagttttgagcttctttggttctgtggtgtgctcttgaggttctgaacatgaaccattgagtaccacagacttcagaggacgtgagaccgtgtgacgttactgtgtgactgtttaggatgaagatttcaggtttttttttttttttctttccttcttttagcaaatcaggtgctgtgataagcacttgagataggacagatgaaag

SEQ ID NO: 18379 - DNA, 1146 bp, Mus musculus
ccagaggagaggacagcctcagggaagacaggatttcttctgactgatggcctcatctaggtgccggctacaagtcctatccctatcctaccaagggttcctggacacatgtgccctaaggtaacaggaaacagaagccaaggcagaggtggttgtgtgcaggagggacaacctcgggtgacttgggtgctgctcctcaggtgctgtccactagattatctggtcagccgatggtgtggcagctcctcccgtctgtgaaacccagggatggatgacacagccacgctgtttgtagggcatctgcttcaggacaggcagctggacatgcttttggtattgaaggctcggggccagggtcatcagttatgacagagggaagaagaggccttggtgctgtagatacatgtgcatcctctgcctgccttagggacggatgtgatgctgttggaagatggcacttctgaggacaaccctccccagcactgcacttgcccacccaagaggaggagctccgtgacatttgaggacgaagtggaacagatcaaaggttggcttatgggagtgtctcagtagacacgtgggcaaggaggggatcctagcctcattcttaccacagaacgtgccaagacttcatcgcctctgcctccttcccatcactgcagccccactagggatacttgaggcatctgactcatagcaagcagcatccaaggtgggacaaatgcagctgtagacacacacacacacacacacacacacacacgtacacacgtatacagtcacacatacagacacacacacacacacacacacacgtacacacgtatacagtcacacatacagacacatacaaacacacacagtcacatacacaggtacacatacacaaacacacacagatacactcacagcagataccatgaacacacacacagcacagacacattgcacacatacatacacagatacacacagagacatatacacacaaccatgcacagtcgcatacatatatacacgcacagacacatacatgtagtcacacactcacacacatagacacacagtctcacacacaaacacactcagacacactgtcttagggtttctattcctgcacaaacatcataaccaagaagcagttgg

SEQ ID NO: 18380 - DNA, 1174 bp, Mus musculus
gccaagaacaggcatgtattaggtcccactgtgtgcctcacttaaaaaatggctaagagcccattaggtgctaggcactaattgaagttttcaaatgcaccatctccctttgcagatgggatacagtagggatggtgctggtgtgtgatgactgagttaagatttcaggttgccaattaactagctaggtgtccaggggcaaattattcttgcatctgaaaatgaagttttgtaatctatttatatacagggacacagaatccaaggataccgcctgcacagggtgcttggcagactacagaaatgctcatggtacatccagcacaggacataggtgcagggagacctgagacactggccttgcttttcagtgtatctgatggggccaactcattcctgttttacagggatctctagtacggggaaccttcaaaagacatgttatccaattcaggatacttaatcatgttgagggttgttgcttggggacttatttcctattcggtacaaaagggcttaatggaaatgaaggaattctgacaagaagcagacaatagagaggatgttggagaagctgagtaggatctggaatgcaagaggttagtaggaacagaaacaggcagtcttcattccacacgaatggcctgattgcacacaaaacaaatagttctacttagccctgaattaaagatgatctatagaatcccaaaggacatcaattcaacattgaccttccttatacccagaaagaacatcctgccccaccccaatgccgttaggtgctgaggactgctctgtccagcagtgacaagtgtctggctcccagttcccagagctcttgtcttccaagccctgatggaagatgtagaggagggataggtgtccatgccattccccagagtgttcagaaccagataaagcctggggatgaaggaagtgagttataacatgaactacaggaccatggttgtgaccagctatgaacggctacgaggagggacaggcgggcactgttctgtgagttggggagagagacaatgaggatccaggaaggccatagaaaacctgtgtctcaaaatgagatcagggccaaatcactatgtcttggtcatgaggctgagagaagatcaagcctgtagcccaaggagagtgatgcacaggtaggttaaaggtc

SEQ ID NO: 18381 - DNA, 1144 bp, Mus musculus
gaaatttttgtttagattttttaaattaatattttataactattctgtgttatttttctgtacaaagaagaaaaatggtgactatttgaatgtttaatttagattcttaatggctaagtgtgtagtgcagtgagtgatatgtacttaggccctatatgcagttcgaagtaccataatataaaaaactataaaataaatttaaaatagtgttttgcttttatgatattttattttcatttgtttggttacttaaatatttatagaaattatgtgtctaattcgtgataattaaagagaaacatctgattgcatatgcatagactgtctcataatttaatgactttttatcagtatttctttttagtatttctctttaaagcatgtcttatttaatctttccctttttaagtgtataatcaactttatactattttttgttgtgttactgtctcctttcttttcctatctgtgtcagaatttttaagggggcctgagatagctttgctccgtaagcgcctgcagcagctgaggcttaagaaggctgagcagcagaggcagcaagagctagcacaggcccagcatcagcctcccacttccacttctgatcctcctcctcacgagggctcttcacgggaccctcgagcttcaggttattgatgtcaagtgtgcttaagcagcttctgcagttgctttctaaccctgctctgtggagccagtgttccccagccgttcaaatgagaagcttgtgtgtgcggctcttcttcccttcctggccaaggagtgttcagtacctagtgcagagggcggggctctcaggagcatttcccagagggcaaagacacagcgatcctttagtttactgcaaaactgtttggaaagaggtagatgtttatttttaaagtttttgaactactttctactaaatccactgactttcatgcctgcattgatctttttgtagaaatttcctgtgtgtgtatagacccttagcttttcctctttgttaggtgtgtactatagttaatcagtattttatatagatctagtaattcttttagccatactagcatgcactcaatcatttccttctgttatttgattttattcagtattgtttttctcatcactgctatagtcaacttct

SEQ ID NO: 18382 - DNA, 1187 bp, Mus musculus
cactcactcactcacacttacacacatatatatgtgccaggaattgtatagctgggtcgtatggtaattctggttttttgttttgttttaagtaggagaaaaagttacttggtaagaacagtggcagaaaatggagaaagtttgaagcaatggtgaatgggtggaatagatactggggagacctagagaattgttttagaaaggttaaaaaagggggggggctagagcgatggcttagcagttaagagcactgactcctattccaaaggtcctgagttcaaatcccagcaaccacatggtggctcacaaccatccgtaatgagatctgacgccctcttctggtgtgtctgaaggcagctacagtgtatttacatataataataaataaataaatctttaaaaaaagaaagaaaggtaaaaaatgttatctttatggtgtggtaggtccaggtgattgactgtcctgctgtcagctggacagtgattagaagtcattatatgtggtttattcatttcttcttccttctctcttagtttacacccttctctcccttcctggggattaaattgaaggacatgccctaccacagaactgtatctcatctggacagccaccccaccaccaaccctcccttcctcttcctcttcctcttcctctttttctatttaattttgagacaagatgctagtaagtttcttaggctgttgttattcatagcttaaataggtaatgaatttatgatcttcctgcctcacctgggattgcagactggcactagtaaacctagctttcgtgtatacagtttccaattgtatttgtatttgtgattttccagttggaaatagcaagtatggactgtagctccagtgctcatcatcacaagcacggtggaagactgagacagcattgagcaatgtttcatgtaacattccatctaacatctcatttctgtacttaaagacaatttggggatggaaatgctccattaaagtatgctgtaagaattgaggactagagattaattcagtggtacagtatttaccttggatgcacagggattcaaaccctatcaccagaataaaaactgaaagcaaacccattcttcttcttttttaaattttgaaatggcaacttttttttctattttaaaattttttattagatattttcttcatttatatttcaa

SEQ ID NO: 18383 - DNA, 1321 bp, Mus musculus
tcccgactgctgggattgcatgcatgggtcatcacgcccggttttttcctttgactcgagaggcgtgagcaagacaacctcagcggcttccgtcatgcctctccaatccattaaggagtaggctagagcgccctcaagctcctctcctagggtgagggcaatcgtgacgcacagcggcttctgttgcccgtgtgcatcctctcgcgagaagggccgggagggggcgtggtctagggaggagagggaggagctcgcggccgcctccgccttcgcctccgcctcccgcgggaggggggtcgagggaggggactgttgccgatctctagatgttctgggtagtctgaggagagtatgaggcgagccgtggcccgggtacctctccgctcccggggagaaggcgcggccgtggctgccgccctctgagtcgcggcgccggcgaggccccggggcgcgcgcatggtgctggtgccgctcgggtgttgatcggcctgtcccctccctctcttcccctccccaccccccgcggtggtctcccctttcccaccccagcccctgcggagccatggctcggagtggctcctgcccgcacctgttgtgggacgtgaggaaaaggtcccttgggctggaggacccgtcccggctgaggagccgctacctgggtgagcgggggccccggggcggcggcgctgaggtcgccgcccagaggtgggggagggggcgccgccggggctgttggcgaccggaccgagccccgaccggggcgccccgcaggctaggtctcaggtgggatgacggcgatccgcgcccgctcctcctaaggtcggggtcccctttgcaagctgccaggcgcggctcaagctgggcttccctcggagagccgggccgtggggaggcggcactaagcccggaaaggtgttggggtcgctcgtgggctgggactccggagaagactccgcgagccttacggagatgccacgttgaacgccaaagttggcgcttttgcttttctccggagctgtccccgctcagccgaagacctcaaggtgttgcttgtccaccttcttcttcggcttccgcaaggggttagatgtcgcccgagagagacgctgttgaccaccctcagggacttgacaccccagccgggctcgctgtaaaccgtggcgcttagcccaaacctaaaagagatcgcggagccctccccacccccgcgccttcccaggtccagcctgctgtcagtcccgtagacctcttttaggtggtgtaaggtttcacgttcctgttcccacccctggaaaacacacttggcattttctgtttctta

SEQ ID NO: 18384 - DNA, 2102 bp, Mus musculus
ctgattttaagatcaattctcaacatgacatatggaatcttaactcttcaggggagcagagtccttgctctggaggcctaacatatgtctgtaatgattgcttctgttcctgtggctcagggaccatcagttcttccaaacctctaattggtttctcttctccagggcccagtcatttacgcacagttagaccactctggcggacaccacagcggcaagattaataagtcagagtcggttgtgtatgcggacatccggaaagactaagagaacacccaaacatttccaaactggacgcttgtgcagaaaatgtccataaccgcatgtggccttgaggactcgggcaaggacaagcacatgtatactcggagagagcagaaaatatgtatagaggatatgtatattctatttaatcttcctgatgtgagaggccaacgttgcatggtgaagtggtatgagtctacgtatgtgtaaattgtcttgctgtttctgtatattctttcagagtcatttctagctggaaagttttagaagcatcccgtggtcccatgcgtgggatggtttgccttattgaagactctgcagaaccgttagtctttccgacagacgtggcctttttcatctaagggctcaaccagtctaagcatttcttgtagttagagagtgaggtgttcagtggaagtgtgtctctcacagtatcaggaccgttttgttctgtgcccgtgctagctgatagacaccgtcggttaaccacgccacccgaggacagtctgagaagttagtgttgatgcttttctttatatgagggaattctgagctgagattgtccttgtcaccatcctgctattagctacgatctcacaatgagttcttgtcagcgtgcagacagcagagctggctgaggctgtggtcgtggttaaaagggtacagattacagagccccagcatgacaatagcgtgtggaaggcagcatcttcctttctcctcctcttagggacgctatcaatgaactgcacactctagatacctcctgacaccaggttctttaccatctccttgtggtgctgagaccgtgtatatggtgctagtgctctgtgggctttgttcaaatgacacctcttcttaagggctttctacatctggctccatgatctccctgcccagtcagaaccaaatcctctgttggccaagccaaccttcttccctaggcagaaaccgttggctgctggccggccttcctggactgagcctgcagcctggttccagctgctcgcaggacagtgtgcaggcctcatggcctaactccacacaccacctcccttggagtattcggtctctttcctgcaactctgcgttctgggcctggctacagataacagtgaggccacgtccagatggcagacctgtgcttcctgtgtcttctgagcagaagaatgcattcgaattgagaagagacacctaaaagggatggcttttagaattcctgcctgtattttctcctggaaatgtgtccagctggagagataccaagttcattgttactttttgatattttcatttgtacgtctgtgaatattttaatacatctttttcgatttctgaatggtgttgtctgcttgtttttaaccaaatggaaaaagagataaagccctttcatctgaaccattgcagctgcacaagcctccatccttgaaacacactacctgtgaacctacttcagagcctaaaatgggactactgctgatgtttgtgtgagatctgttctctagcttaagtgtgcgttcagatgtccccttagaccttctgcaacatataaaagccacctcaggacagtaagatggctcattgggcctgacaacctaagttaggtccccaaatccgcatgataaagtgtacatgtacgcgcacacgcacacgcacatttaaaatgatttgaaataaaacagcaactccctagcccgtcagctctgctcttgactagtctcccccacaagagcatgaatagcaagactttgctgtttgttcctggcttctcccagtgtagaaaagcacacggcacagcacagctgctttctgcatgcttgctgggcaggtgttcctat

SEQ ID NO: 18385 - DNA, 1294 bp, Mus musculus
ctgagcttctggttcctcatttatgaaatttaaggcaggcgtgggtagatcaagctttatgaaatcagataggacttgaagagaaaacagaacttgggttgtatgtgaaatagttaactgttgggatgtgcattgaacgggaatggcgcgagcagaaggacggattggtacaaggcttatggtgaacaagaggtttctaagcccattttttgtgctgtaataaaatggcaaggactgggtaatttataaggaacatagatttattttttacagatccggagtctggaaagctaaagcccaacggacccagcatttggcaaggactttcttgtcgtgtcatcccatagtggaagccagaaagactagagaggaaaaggctctttgccaaacccttgtgtgatttgcatgtctttctgtggtaatctttttagaaagaagctgacagcgtagcgtggctgttaccagacgactagaatctgcctctgagggtagctcaccagttcttgttttctcattgcagtttttccactactcacaaggacaggtgtacattggggattatccaccatttaaagaccgagtcacctgggctggggaccttgacaagaaagatgcatcaatcaatatagaaaatattcaggctgttcacaatggcacctatatctgcgatgtcaaaaatcctcctgacattgttgtgcggcctggacacattaggctccacgtggtggaaataggtaacttcccacagtgcctgatgggtggacggatggatggatggacagtggctgatgtgatggatggatggatggatggatggatggtctgctttgtttggttagctggagaataaaatttgtgtttcagggtacatttggaaggaagttttttgttttttttttttttttaattttcatggatgtttcaaactccagccttacaaatgctagccacatccgcaagtcctgcagggaaggttttgcccttccagctatgcctcccatctctggacactcggggctcagcctggcggagctgctgcttgggaactgctcagtcagtacacagcaggtggcttcctttcccacacacctctatctggagcctgtgactgactttagatgtattagtgttcagtgttaagaccaagaaagacctgatttgctcaggctagatgaggtgggctgtgggggaaggagattagggttattttgatactgtttgaggtgatattcagtgtctttcatagcaatacagagttttcttctcttgtttgaaagtgtgcggggaatgcagg

SEQ ID NO: 18386 - DNA, 1231 bp, Mus musculus
ggctctgtatttggcaggaatgtcactgctctccgtgcaggtcaccagaaggtgccgcctcctctttccattcaggcgccgtgctgctccacagtacagtaaccatcctttcttgctgctccacagtacagtaaccatcctttcttgctttgtaaggaaccatcttgtgaggagtatgaaactgagtaaatgttaggtaagattcccatcaaagtggtggtggtggtgtttgaaaataaagctttaagagcttttgataaatgtattttattcatttcttccccttttttggagacagggttttactatggaggggactcatgtatattaggctgaccttgagtagagatttggttgtctcactatgctctagaatttcttattgctagttatttcaaagaaattcggcatgtgtcgttcttttttcttttaaaaaaaaaaggaagaaaaaaatccccttgtgctacggaaatggtttagctgttaagagcactggctgctcttgcagaagaccttagtttggttcctagtgtgcatgtagtggctgacagcagtctgccactcaaatttcaagggatctgatgccatcttctgacctctctgagtaccagacagacatgtagttcacaagcacacatggatgtaagcactcatataaactaaaaaataaatctgaattaggaaaaacgaaaacaaaacagataacccaccctggggttggagagataactcagcagttaagagcactgactgctcttccagaggtcctgagttcaattcccatcaaccacatggtggctcacaaccatctgtaatgggatccaataccctcttccagtgtgtctgatgatagctatggtatactcagatacataaaaataaataaataaataaataaataaataaacaaataaatatttaaaaaagaaaacctcacctatctaaagtatttgaattttataacttgattttcttagtagcatcatttttagataattaagatcagcttctgcctctggtagttttgtattttttgatattgagtgtagaattgacattttaaagaatcctttgggaaagttttgttctgagtctctcttttttctatgtcacatccaatctcatccaataagcccactgtgatgctattgtcctgttgaaaacccttcgtcttagttcagaccctttggacctgcacactcccgagcattaaacaggacttcttgtttct

SEQ ID NO: 18387 - DNA, 1177 bp, Mus musculus
ctttttttatttggtaatctatattgggaatcattttatatcagtattaaagaacgttctgactagactagggagatggctcagccagtcaagtccttgtcactcaagtaaaacagtgatgtggattgtacaggcagctccttcctaagagccagcactgaagtgtccaggtaaaaaattagaactggggacacagaggcaggagaatcactggggcccttctggccagctggtttagctgagtctggcaagctccaggtaaaatgaaagaccctgcttatacacacatacacacacacacacacacacacacacacacacagaaagagagagagagagagagagagagaggcagaattcccttatttcttatgatgctatggtatcctcttagccaagacttacttaaacatttctctttgaaaattcacacaaacattggatttgaaaattatttttaaaatggtggtgcaacttagaaagtttcctgttagcttccttgaaggtccttgcgctatcttactggttacgtgatccttctgtaagagactgtttactcttattttgttcattggtcaaataactttggcatcacagttggtgacttgatggacttggttgttctgggctcttcttgccatctggagtctggtaagtgctcacctccagggagacagaccctgaggagctgagggctttcattccattcaacatttattgtgtgtcaggaagcaaaagacacagttatctaaagtgtctgggaaagtcttagatgcgtgaggtgtcctaagcatctgtcactcaggtaacagtttgtgttcttctcccttggttgtgttgtaagttgtgttgtagtctctctgtgtatacaactcacagggtaatgagctaccctttgatcaatagagccagccacaccggaggtggtaaactgtccagagactctgaaacaatgagaacgtgggtttctctgctaagtagggaggaagttatatgaaaatcctgaaatacagcacattgcacatcctcaggcactggatcggaataagcaacaaagcccacaggaagcggaaactagtttgacatagtccatttcttcacgttgctaaagtttttaaaatgtagtatgtgcgtgcatgtgcatgcatgcactagtgctgtggcatgcactagtgct

SEQ ID NO: 18388 - DNA, 1180 bp, Mus musculus
cctaggaaattaaaggagcctgtagtgttttgttttttttcccagaatacatagccctccacctggccttttaaattttttttatatttttttattaggtattttcctcatttacatttccaatgctatcccaaaagtcccccataccctcccccccactcccctacccatccactcccactttttggccctggcgttcccctgtactggggcatataaagtttgcaagtccaatgggcctctctttccgttgatggccaactaggccatcttttgatacatatgcagctagagtcaagagctccggggtacctttttaatttttaagataatgttccttcatatcttcttccaggtgcggactagaggctcaataaaaagacgtcctccctcgcggcgattccgaaggtctcagtcggactgtggggattttagagattacagggctgtggagccatctcaggaaaacggtgccagggaagagaatggggatgacgtgtttgctagcaagagcaaggaccccgggtcccctcaactcaaccaggaggctatggcagacggggtggagggaactccgtggtctgcagaaaagccacggagaaggaacacgtgtaacagcacagagaagccagaggagctggtcaggaccccagaggaggcgaatgctggagagaaggttggacagaatccagacacagctagtcagggtcatccagaggtccaggcgccatcgcaaaccggcagcccagaggctgagaatgggtgcggaagcccacgggaagagacaaccccgggagagcatacagacactgggaaggccactgaagggacagcctctgaggagagggtagcagatgaagataggctcggacagaaaagcccagacgcaaatatgcctgaggaggagggagtggtcagggagaaagccccacaaacctcttctggaaaagcagaaggtactactatcgcagagccggatacaaagcaaaaggaggaggcgcctctggagccaagctgtagcccaggggctgaccatgctgcgggagagatcaccagtgagatccagaatgagaaagcagtctccatggtaggtggccctgatggtttatgctgtatcaggaccagagctgcccctatcagctctgtatgcagaagcaaagtcaacagcgccctctaccca

SEQ ID NO: 18389 - DNA, 1099 bp, Mus musculus
cggggctgtgtttctctcgtcttctcggagaatgaatgaccctttaagtctggccagtccagctcatgagataacggtctctctttccctctctaggtgaagcaggatatggtggactgagtcacaccagagaagtgtcttcggaggctcatgcacacttgaagggttggccctgcttgggacgtctccagctgtcagcttactctgccacctcttgttttaatcttgtttgcttgtgttaacagagagttgtccgtcagaagatgtggttgctggatttttaaaaaagaaaaaaaaatgtattttgaagccattttcagagaaaaatgccattcattataaccaaggaagttttctttcagccattcccggtggcttttcctcagtggtgcccacagaagggcaacatagaccagctgtagatcgcccattggctctggaggaagagaggtgcaggtgctttgtgcccgacggccactgtgcctgaggggtgctgtcctcacacagctgcctcaggagtctgtcagaggggcctagagtcgggaggcctgggcagggcgtgggtcccggatacagagtgcttgaatgaatccttcagtcgaggacagcaatggccacacacggagcttcccactcacgtccacccgtacagctgatccatcacaaggcaaaactgggtcctctataaaactccataaacatcatacatcctaaagtcatagttacccaggacaaaataagacaaaaagattttcctgtattcattttccacccaagtagactgtatatttatttctcatccttcaaaacacacacacacacaggagctggggtgcagctttcttggtagagcgattgtctagtatgagaccatagctctcttccccagcattgaaacaaaaacaaccagcaataacatttttatttgcatgagaaaggaaccgcaggaattttacatatgttgggttcctttttttgacccaacaccaaccataaccccagcccttctcgggcactctgtatctccaggctcctggcactgcagcccggagtcctccatgggagataaccacggtaccacggcatagaaacaaactac

SEQ ID NO: 18390 - DNA, 10966 bp, Mus musculus
aaatgacacctgtcattggcttcctcccaccatgttgtgaggaggaagaagacatggagagaagaaaaaattacacataccagaaaaaggaaagaatggagacaggacagcatttgcctaattttataataaaacaatgtcttttcaggattgcttcatggattggagaactttctaaccaaaaattttaaaagaaaaaaaaaaaaaaagaaacaaaaacagacagacaaaactaagtgaaaggcctacttaccatgtccagcagtcatgacgacaagctaaggtgggtcaccagttccaggagaggaaggggtctttttctttttctttctttcttttatgttattgttttggtttggtttttttggtttttttttttcttttaaaaaaaaaatcatttttataggtctgttgtacagaccattaagtcataacaaggtgtttataatcatatcaattgtgttgggggttcctttcttaactggtacaatttaggcaggcctgtattactgtatctctgatattgtttgtttatacatatatatatatatatatatctatatatatatattgaacatgtttatctcttgctcctggatcctgtttcagtgagcgcccacactgtggggagggagggtttgggatcaagggagacttaggtccttaactcctgggaatgttcgtgctggtttccttatccttggtgactcttacagaggtgctagaaaacgattttcttttgccacttatgcaagaggcttggtgcagaagctgaaggcagtgtgtgcaaacacttctgccttacacacgcccctccccatcaggcggtgcctttggagcacttgtgtgtaggaaggaattcctgctgagccgtggctctcactcaccccgaatcattgagcagcctgaggcccagaccctgtggtgcaacagtgacgcttccttctacttcccatgggaacagctgtgcctgttgcagggcagggtttggttccgaagagcaaagactactgcagacacctgacttggtggctctcctgatttcttatctcttaaaaaaatgctcctactgttagtgtttgtttgtttgcttgtttgttttttcattttatgaaaaattttcatccaaacttccttttatttacttggtcagaatcgaattggcatactgaagttgtgcgacagttctctcccttgttttctaaagcaattctgttgaactgttttctactaacgaggtatcccagagaggtcagtatgaagagcctgagcgagtgtaccaccgttctctagagagtcacagacttcctgtccactgagtgggtcacaagtttctccaagcctgagagtctcctcagtcccctgactgacagaggccctttcctggctgggcaagggatctgtggaacttcagagagatgctgagcaagaacttctcagcctcaagtgtctcttggttggttaggcccctgctaagtagatctgatgacgacatgcatctcctatttgatgtaaaaagtgatttcctcctgtaattgctttcagggtgtttctagactacataaatgagcccattgaaaaggaagaacttgtgaaaatggatgaagatggatgagggcaatttagagactaaattcccccatttgtcaatatcctattattatactatctgtaccagaatttttacaaatgacggaatcactgcagtgaagctctgagttgcccttactggagttaaaggttcccatttggcgtctgagggcacttgcttcagttcctggtggtctgcactttgagctgggagtgactctccttctgattgctttgctttgccgcaggaaactgtgcatttgtttctctgcagagaaaaagttcagcgaggcagtagcagacacagatgtgtaccttttttgttgttgtttctcagttgggagaaggtcatactaatattaaaggtcaaaaacattttgatccctttaattttttttagttccttttggttatttcccagagtatttaattttcacccctgaataatttcttttacctttaacttttcctaaaatccctccaaaaatcagtgaactgcaagcagggaaactcacagatgctcatccacctattttgtatggtgtgggtgttttgtttgttttgttttgttttttaaactaagcttgaaccaaagtcaattcttagcaagctgctgtactaatggactaatggttataatgtgcagttcaaacacagtgaggagatagatgctactgacaattcttactcatttttcttgattaattttatgtgaaagttgctgcttgtttttatcttttatgttggtaaattgtaatatcctctgggcagacattaccttgattttagctagtttgtttaagtcagtgtgtaaataggatggcgtgccagttactacttctcccctccccaccagcctttctctcttgttaatttaatgttttctcttgacttaacactctaatcttagtctgcatgtggttttaggcctgtcaatactgtttctgccctagcagagagtccctcccttgggagtgaggaggttaggaagaattcagggagagaaatgctgattacctaccagacagattagcagttatagcattaatttccagaattgctaccaaaggaagtagagagtcccaagaggctctggcccggggactaaggaggacagagggactgttttgtcatacgtggttaaaaggatctttttcccaaataagagtcccctacagactttgattttaaaaatgatactaagttttatgtttttgtcaatccttcctctgtagtctctagtgggtttgagaaaggattgctgcctttttatgtagttaattttttgaggatagactttaaaaccagcataaatactgtattgagaagaaaaggatctttagataaagataactttaattttttcctaccctttttcatgtgtttaaaattaaattgtaaaatgaaaggtactttatacatatgtatacatgaaacactactaaagttttctggtgggtgttcaggctaaaataccttccgtgaccatccctaaatggtcgttaacctactatacacaaacccttgggtagtttttacttgataccattttttttaatgatctcaaatgctttttaaactgacaactgtcttctaaggtaaagtactcagacttaaaggttcagctgccttttatgaaagaatgtagaaaccaaagaggttatttgactaaaagacacatacagttgagtttctacagttcctgagtaaacaggttgttaaacctgttagttcattctccttttcttccccttgatatttatgcttgctttatttcatccctaaatttagttaacacatagtaagccaaagactaattctaaatacatttaggggatactatatttgcctgtgataatgggccctccctggagagtagtgaatgtaattgtttaatcctgtttaagcaatgcagtttggcataaactttatttatttcctgtgtaaatctaaatgacaacagaaaaatctataaggtttctcacaagagcagtcttactgttgtaggaatagtaagtgctctgttaccttgaatgtctctgaagccctataggcagctccataaaatgaggaaacattattcctagccatttgcttccttaatgtgttgtcagaaaggtcagccccgtcctgtgtctgtaacttgttactccaaaatggaaccaaaggaatccggctttcagcttgtggaggaccagcctgtttatattctcataagctttattagaaattgttaaagggatatcagtgaaaaggttttaggtgtgatcatcttgccaacatgttctatatcatcatccatttgttttagggaaaaagcacaattatacctctctaatattattgtgtctattatctattcttcaattatttgaaaaataggggaaataatctcttcactatccagaagcacaggtttttgcttgacaatatttcagttcagctcagtcattattaacatttaacttgctggaaatgccaggtacatttataaatatagggatgttatgtaaggaaaaaatactatagttcctagtctgaagttcttcttaagccatgtcatcctcacaaatctttcttgaccaaaacaaagagacatctattttctgttcttccccaagaggggagaaatgctgccctagtgtgcaggagacagtgtcctgctggcagcctgggttggccctggccctgaggaactcacggaccagtctataacctgagcatgtggtgaggcagaaagaagggcctcagcagctcagcaagagagcttgagcagaaactttacgttggcttctgaagctgatgaacataaagtgtacttattcctcaaactctattagaactgtaaacatttaagactaccagtactaatgtaaggaaaatacttaaaagacctgaaacccatagttatacaagtgggcagaaattgatgtagtaatttatttataactgttatgagttcactttcatttgtggatatgaacagtatttaccatgttatattgtccatataaagagatccatgactattttgaagtcattttcagatacttgtaaaaataagacttccctaatattttgattttgaagaagaaaagcaattcttctttgccattcctctgagaataaaacactgttccacaggtttgcatggattgcacacacaagcataaatagaaaaggcggaaataaggtcctttgattattaaaggttgatggaataatctttgcctcatcctctaattcaccaatggaaagtaagtgtaaggttctagcagggtggtcaggaaacctcttcctcagcattcgtccagttcatacccggtgtatggtaggatttgtgaactgggtttcttccaaccatcattctcttcatgaaccaattccttagtttgacccttctgctcttggcctttgctggaagcagtaaacttgagtatatcacgtgtcgattcagtgatctggatctctctgtctcttttccttctcttattcatttgagtggtggtaccttattctgtgagaataatgctcatggggaacagcttctggcaccttcataaaatacctcagcatagcttagcattgttacagaactggttttagactgaaaaaccaaataagtataagaaaaaatctttataaatagtggaaataattctagctgtagtatttagttgaactaatgtttattatgattgttaaacatgattgatgctgtatgtatttggggtcctgtttatagagttagggagggttgggttgggagaaaggagaaattgattatgttagaaggaaaatattgcttgtgtgtatttgtttttctttatatctgtcttgccaaaggaaacttgatattccctatgaatgggttgggggtttgaggcctctctgtgatctgatatgcagcacagtatgcagaaccatgcaggtgatgtgtggggtgtccagtgggttcaggatgcccaggcacaggttacaaccctccctgtctgtggctgtcatgcccttgccccaagacctgccaggctctcctgacgatccattacctctgtgcatagctaaagcttaggcaaaggaagagtgtgcacgtgtccaggtgtgcagatgaaaagacagatatgaacgtgaacccgaggaatggagcggtgagtgatgtatcttgagctcggaaaattaacatgaaatgagtcatcttttgtcatgttagtgattgctgtgctagtagtagcccaacatttttaaaactttatttccttttcttataccaaggataattttgtctagaccaaaacacaaaagaaaaccaagccaagaagttgaaagctaacacaagtcaaaagctaaccctaccctgtactaaggtggggcatttaaggactgggtgatgagatggaagaagagttgttcttccttttgggaaatgtgaataagaaattatgttggtttaggaaaaaattaaaaacctttctgcccttgttctgtctgggacagactttcttagctccctgagttctaatgtaaactatatctcaagaactaattttttatctcacagaacttgagtgggatttgattttgataccaaagacaactgctaaaccattgcttctcaagttttccagacactcaaaggccatagagcaaacactgaggttggaaagcttcgtctcgtctctgttctccccatcggcctcaccccttcctcacttttggaagatgtctttttggttactctagctttgggaagagattggttttgttcctccctgctgctcggttgagattggtagagtttgctcagcataacactgatactctgactgagaaagaaacttggagtgcaaaaaatagtagtagaacttttacttacctttatctagttcatacaaataaaactaggccatccaacctgttggagtaccagtcaggatttagttaggaagagcagactacagccgaatgacatctccttcctctcctgtagagctgtttttgctgcacagtgtgttaggatacggctgctgggaggctaagaggcttcttatgtcggcaggctttagataaacagacagtgagagaggaaagaccaacaaccatgatcaggttgctaaatttcatgaaagctttacttgttatcattctgacattatgtaagtagtgttagtgctgtgtggttttttctaagcgttaggtaggtttgtatggtatagggatattgaagataagagcacggaaacaaatgctgtgagaagcagtgtgtgggtcgtgaacaccatttcagctgtgaaagggacgctcccaggttcagggagggaaacagtttgtgatctttctgcatccctcagtctgcccacgctgcacagagctctaccacccttgccacgtcctggttcaaatccagaaccctgtcagaaagttaagaaactttccaaactaatgtaccggaggagggaggagctgaggtccgctgcaaagttgttcatcactgcaacagccacaacctcacaaaagcagctagaagcttctttgctaaattggcaatgctattgatcactacatcccaaggtctgcaggcagctggtgacagtgcagttccaacagtgcagcatctgcatgggagatctttatgtgatcttgttagagaaaaagtagacagccaatgcccatccatcccagagagtgtctaagaactacaggaggaaacaaaatgttctcacacgggtgtgacagtgtctctgaggagcactgtgataggctgggtgggttccattcctacatgagtctgcagaaggcacgtgttgtttgtaagagtgacatgaactagttagtgctagcctggttagatttaaagttgcaaactgtgggagtgggggtagtgtgttcaacaagactgaccatattacaacattgactttctacaatatagatggtaaatggtgagaggaagacttcttcccactgcttacctctgcttccatgggaatgtgtgcattactcagtccacaggagggctcactgagggaagtgtcctgcccctagagtggccctcagccattgctctcctctgtggtagtgaaggctaggtgagtaagagtgggggtttctgcccaccacctgtccaggagctgtcgtatacctcatttctaactctaactcgctttaacttcctctcaaccctacagagttgccaagtctgccctccctcttctcagcaacattaaactctggcctatagcatcataagacctgtcgcctggggtgggactgtcccgccccaccccaccccaaagcctctgaatgtctctgcttttaagctactagaaactgagggcaaattgcaatctcctgtttgtctttgttgctaggggtcctcacaggttttttaccatgtccccaccaccttgccttcaaggatggccagctctcctctccccatccaccctgtatttcaaagtgctggatagacagcagcttctgtccttgcttttccaagtggtctcaaggctgacctttcccttctgaagccttggggctctgctcattgccaggacttggtagaaaggacacgaaggttcatttaagctgacctaagctacacatttcacttgtttcccgtgtgacatgaccaaaaagaattccaaatatttaagtttattattaatatattataataatagttattattatttgacaatcttatatccgacgggctttctggaagctgcttctccggccctttcaacgttttctttgaatgtagttcttaacttgcaatttccacccccaaagttggagggggggaaagctcagccaggtcaggtcataatactgctgctataagccaggggagggtggtttctttgatttgttttgtttttccatttccagccaaaaccaaagatttcttaatgattgtataaactcaaaacaaacaaaaaaaccaaagaaaagggaagtcttcggccccaatgcagtctgtggcgtcctggcacttggaggcatgccaaagggtaggtggggacacctggccagctcagaggggcaggcaagtcttttctaagttgagagattcattcagatgcatgcccaggagttttggcccttgctcacttctgagtagagcatgcatgaaagaaattggaacatcagatttttcaaaagtcccatcctcaccacaactcatgtgacagcagccagggtcatcaccagagctgagcacagggccttagagctgggagctgctactgggtggccatggactccacagagtggggatgctgaagacgctggcacaggattggctactctgctgggtgctttcacctttggggcgggctcttaacccaagggtccttgtgagttctgaaccttctctctctcttctgttcccgaactgcactgcttggaagtggctgtcctgtttgtgaggaaacatgcagaacaattgtcaaacttttttttaatcttgtttctagttttgtttccttttgcagcaccactgtgcaactatgcattgtatttcataacctttgtgctaggtagacgcctgtgactttttaacttgggggtgggtgggttgcgggttgcaaatgaaggaaatttttacatggatctttttaatctcagttgattgggggaggggggttttggttctagggtcatacaagctctatcccaaagcaaaatccaaatgttaataatactagcctgatgcagataccaaagacaatttctttcctgcagaaccttagacttgtgtactaagtacgattatccggcacttgcattagtctaacctcagtaattccaaagcttagatgtatattttggtatatttccaggatattaaaaaaaatgtcgtttaacttcttgtttgtttcagtgtaatgctcttaaagtcatcgcatgaaataactgcgctgtcctattcttggtagtttgaaataatagtatttttgtatgttttgggtgtgtctgtatgtattaacataacagttttcactgcctaggtgttcatataaaagtgagaggttctgagtgtacatactattaaataacaatctctaccagtgtccacggagtgtctggaggcactgatgactgcccagctgggatctggttttaaagagacggtgattgtgttttctaaagatgtttgcttctgtctttaaatatcttaacttccccacttgttttttcctacttttttaattactattgattcaggggtgtttttccactgttgtcaagggaggaacacaagggaactggcaccttggcctcccaaaatatgttattttatgtattttaaaatgtgagttttgagttcttctttgtggaaacttacaacatgatgtacatgattctttccggagttgcccagcagctttaatgaggcagcagcagcagccgttcctgggtagtttattgggtgtcctctgacatttctccttaagatgaatttgcagtctgggtggctattgtgtagcctcactgccccagaacgtctgtagccatttccccttcaatggggatattttataagattcagctgatagctcggagcactggccctgttatctgtgcccatgggaaatgtgtttttcttgatttggaaaacctgaaacccaaacacttctactaactgggcatagcagatagctcctgaggcctggggaagtggtgactgtgagaggtgctgtctctttaaaaaaaaaagtgccctttttgtgagcccctccggggatcaccagagggcggggcttgggagagattgtgtgggcgccagtgaatcagagtgaaatgctgggttttatgtagatgcatttgtctgctgtaattttttatatatattaaacttactgtaactgtacagttcccatttctgttgtaaaacattaaaccattttccaagtgttttcacattgtctgtgtctctgtgaggtcactgcctgggcgttctggtgctctccacaagcatttgcacggatatttacacaggcctccgaaacatttctccccacggttctccctgggaatctcggagtctgagcaagcacctctcctggcttccttagtgagcggtggccactgtgtttcccttctctagacccgccactggatttagtggaaccctgagttgagtagcaatagtctccttcagagctgactgctttgtatggtcaaacacaaaggcccttgactgatcctgcagtgtgtatgtgtgtctgtctgtctgtctgtctgtctgtctgtctctgctgggattgaacttgactctccaggctcagttgtttgtctgacaggcccaagaacctccagcatttcttaccaggccctgaaccaagagtggtggagtggtgggagaggatcc

SEQ ID NO: 18391 - DNA, 1427 bp, Mus musculus
gggggaggtataccaggtcttctctgctccgggaaacagagtctaaatcctgcagttacaagttctccaaatctaggtcacaggagcaggacacctccttccacgaagccaatggtgacactgtgcgaaacacctcacggttctcatcttccaccaccaaggaggccagagagatgcacaagttctctcggtccacattcagcgagacctcgagctcccgagaggagagcccagaaccctatttcttccgccggacccctgaaccctctgatggggaggagtccccagagccaaggcgtccaaactggaccaggcccagggactgggaagatgtagaagagtcatctaaatcagacttcgctgagtttggggccaagaggaaattcacccagagcttcatgaggtctgaagaggagggagagaaggagaggacagaaaaccgagaggaagggaggtttgcatctgggcgtcagtcccagtatcggagaagcacaaaccagcaagaggaagaagaaatggatgatgaagccatcattgccgcctggagaaagcggcaagaggaaaccagaaccaaactgcaaaggaggagggaggactgagcggaatgaggccctccttggagacactgggaacacggaaagaagccatttaacactgggcttgggaacagcttaccatgacctgccaagggttatgcaggctcttccatatgggcaaaaatgcaagcatccaagtagaaagggcctggacagtagggtggagaagagacaagagccattcatgcgagccccaaattctggaccagcttacactttctatcaccaaaggccctctaagctttcctgtttcccttctaagctttcctgtttcccttctgcatttggtagtgtccaccacagagtggagaagtgagtctacaaagccactgagaaagacctgacttgcaggctgtggttctcttcattgaggtttcgcaatgagacccaggtgatccattctgttgtgattctggcctctccctgccaatgcttgactatcatggcttcttttcaattaaattgatatgctgtcaaatatttcttcattctggtcatttccaactctggttgctagaggaacctcatgttaaaaagacacagctaggttttcgtcagccagccacactcgtgtgccaggctccgtgaaagccgtgtatttaaacaaccatggttgtctccttgctaaagagaatgatgaaggatttaggatatgatacagccaatcagaggccattgctcacatgaggtagagagggtcccctaagaatggcagtaaaataagcatggaagagacggaaagatgctcaagtcaaagtgataaggatgtggtttgttaatgagagccagtggccattcttgcttttaatgtaagggagagtcacttagtaa

SEQ ID NO: 18392 - DNA, 1176 bp, Mus musculus
caagataaaaaggagtagaaccaagctgttccctgggcggagtttcctcagaaaaaaagagacacttcccttgtgttcatagtccaccagctggaactctgcaaggtcctacttccttgcaaaggacaatagatcccaggtttcagggcccagggagaaggggaagtaagtttgttgatacatagcagcattggccatgttgtactcctccaggcagtctacccacgtcagcctttgtgcccacacagaacacttttattctcagacccaaatgtatcagctcacagtctcaccaggatgatgggtaggaaagtttccatcctatgaaaggagaggaagatggagccgtcctgctactggtgaacatggctactctagaaatgaggaaatctagtctaaccaggacatgtctcttgagaggatcgctcttatttgccacttcccttggcctctcggtctgcagaggcctgtgttcattgtcttctactgccacttgtaaagtgggtgggaaagtgggacttccctgaaggttgaacggcctctgcaggttgtatcttgctcatggaaaatcggagcacataccacccaaagttcactcttcaaaaacttagtagactgtgatctcagtatgcaggacagccagcaccccatgtcaaccctgtttgtgtctttcttcctcggcaacctaatgatcattatctgaatgactgcctgaaactagactttaaggcaggaagtctagaacgtgttgtagtttgcagcgtaactactggaaactgctgcaaaagaatccgtaactagtgtatcgctaaagagggaaaaccggtagtgtgaaatataatcagcaaggcgggagaaagcaaaagaagaaagaaagaaccaaaaaatacagaaaaggtacaacaaataggaaggaaaggtaaaatgtgtgtttaattagagacataattgcgttaaatatgaatagatcaaatattccaattaaaagagcaaaattatcaaactctcttttaaaaagtcggcatgctgtttgcaccataaggatacacaaaggctaacaagagaaaatttgtattttactgattgttcagaaaccagtgacataaaacgacagtgaattatgttgataattaggtacctggaaaggcccaccggggtgagcgcgcctttggttag

SEQ ID NO: 18393 - DNA, 1151 bp, Mus musculus
ctcccctgccctcttgcctctttccaggctacaagcctgctagccctgcactgtctcctgtgcctctccgagcctagcttttctaagtttactctgtcctctccacaactgactcttgtacctgtctgatgtgtgagagggaagaagagtggctgaggtctcttccttccccggtccctgccctttagctggagtctctcccctctacccagtgtaggaattccggtgttcagacacatgatttacagagacatactgaccttggaggtgagggcaatgaccctcaagctgtctcacattggcaacgctcaactccattcccctgctgtcttctccctccctcccatgcgcccagctccctctgtcctcagagcaggcccctgcacagggcaccagctactgcccttggaaacggccttccctcccgagatgcatcctcttcgccacccactgacctttgggccacttccttttcttctgcgctggtgagtcaggcatgccacagacatctgacgcgggcagcacagacacgactttagacagacacttccggttaggacagccgcccagttcattggagaagaataaagtgtcacttggtgtcccaaagctccctgcccttcacttgcccaccagcttgctaatacgtgccctgcgagggagtgggtaacacaccgcgagtgagctttatcctcctatgacgcgatccattcccgtgttcctgccccttcccaagatgctcttcttctctgttctctcctctgtcttctatctcttcctctttagaagctcgttcactgtaacctggaggcttcccaagcctctctatcctgtctggaggggactagagaaacctccagagtctttgtctggtttcagctccttcatcatactgtgtcaggcaagctgcgggacacagtgggttggttgcttgtgccgcctccgcctcttggctttgcagctggaacagggctgctgcccattgcggggaaacttagacgaatgtatccggaggcaaaaccctaaactgccctttgatacccaaagtccaaagatagctgttattgatgctgtctttctggtttgttgtcttttagaattcaccctgtgtctgtggtcatgcgggactgtgggttgtgcagacacaaccc

SEQ ID NO: 18394 - DNA, 1219 bp, Mus musculus
agattgagtcagggcaggtctacaccaggtcctgacagacatttcctctttctctcaggaaagagtggtcacctggaattttgtgacaaagaaatacatctatgggaaccgttatgagaatcgagtgagagtatctaacgatgctgagttgtcaaatgcctctatcaccatcgaccagctgaccatggacgacaatggcacctacgagtgctccgtgtcactgatgtcggaccaggatgtcaacgccaagtctcgagtccgcctcttggtccttggtgagtgtctctgtcttttcctgtgggaggagggtgggcagagaggcgctgtcagcagcagagccatggttctgtctctccctctgtctctcaaatgctctccgggggttctcggtggctagcagggtgtttctgagggcagaggtgtggctttggagtcaccccttgctcccgttgctcgttgccctccataccaactcttctttccccttccaaactcattactgaaaagaagtgaaggggatcccccaagcaatacacgggttctcatcttgtgtggcactcacagggccaatcgtgacccccataggtgactctttccctgctctcaactctgttccacaccagtttttccacccttcctctaacaaaggcacagtcgccaaccaatgggaagtatgtcccaggatagcatccttttcacaggagaatttgttggaatttatagttttggagaggcgaggaaactcatctgctttaatttctgagtaggtgaggcccacaggaagtaattgcctcaaaccagttactgggattgctttaatgagaatctagtctatgtgcagtgtgagcaaggccccacttctgggaggtagcatctctgtgcatcaaaacagaggatcctttttcctctttttcctttacactacttggcagaagctcttttaaattgtatgtggtagttgttggactcatagaaagccttatagcgtgtcagactacactgcggttatcaactaatgctgcctaaagaataggcaagacctcttccaccccgccaccatgtggcaaccagtggtaatgcaggcaggcgtcttagacttcgcccggcgttctcccaacgcacaccacacactcagacactttgctctttcctgtgaagacgtgagatattataaagcacttagcaagttgcttcttgacagcgcaccgtgaacacctca

SEQ ID NO: 18395 - DNA, 1507 bp, Mus musculus
cccttctccccagccccatagtcctgctcctccccccaggcattggtggagcacttctttctgtgtatctgcctcaggggcgcatcactggcctggctactgacgtcctacctgatgaccactgaaaggacccttcctcattgctaaatctgactcagggtctggccttctccctagaccagacagcatcctctgcctctcttacggctggcagggcctcctagaatctcggcacgatgcagggctgcttctgttccaagctcgccatacaggcaagcgccagcttcagcaccagtttcagaaggtgggagtctgccctgcctcaccatgcccgacactcagaggagaaccagtgatgggcctgcacgcaatattttgttgaatgaagggaagaaatcaacgataaggtgtagtttctgtgatttacccagcttaattgcgccccccccccccccatgctgaggggccacggtggcctccagcgtccccctctgctccatctcccaccatggcgtttctgttcctggacacacaccttcttaggacttctccaaacacagttccatctctgcctgtcaagggcctgcctgtccttagaactcactagtcttggatccccaaatctttcttaatcctgtgactgctaacacaccaggaggcaatgaagtcactttgtcccacacctagacctgggctgcatgcaaggccatcagagctacacttcctgctgtgttagagtaggtgccctggagcaaggtctggatcttggagcctggcagcctcaactggggacttgctctcatggacagtgctttgcctcctgggtgtgacttgggacacctggtgactccacccaagccccgtgttagtctggctaggtgggcagactgatttacaatgaacacagacaaaagcttacttccctcgcacctgccagctgccctgcctgccgcagcctcccctttccattactatccaggactcaggccagatgggctgctccaaatgtgttttactactggataaacctttctggatcaccagaaaagcaactgtatcaatcccttccctcctctgattttatgtacacatatattttatatacttggctaaattctttgtttcaatcaaaatgtttctttatcaataaagttactggtggaaattcacttttctttgttcacccatcttgtctttccttcctgccgagtacacctgtgcctggcgggtcggtgaggcaaggtgaccagctagagaatcttggggttctattacttgtggccaaggtaagggtaggcagtgactctcaaagttgttggggacaggacagaggtcagcctgatggtggaggtatattccgagagcctacagtgtcagaagacctggcaggcgtggtagtcatccatgtgcttccaagatggtgacagacactcccttgcctgtgatacctaccctacagtgccccttctgaggagatgggcagatcatcctgttacagagaaccatg

SEQ ID NO: 18396 - DNA, 4243 bp, Mus musculus
tctttgcctctgcttcctgcgtgcccgtccatacccatagactgtcctcacagccccgcccgtgtgcccttgccgcatccccgctgtccctaacactgccggtctctgtctcacagtggccatcaacctcatcgtgcaacacatccaggacatcctcaacggggggctctccaagcggcagacgaacggctatctcaacggctacaccccttcccgcaagaggcaggcgtcagagtccagcagccgaccacattgactcccgtgcccctgactccaaaccccagccccccagctccaagacacaggaggggtcgagaggctctggtcacctgtacatacgcctcctcagaaaattactgtatttaagaaaacaccacggagatgaaatgccttgatttccctttctgcctttttgtactttggaacagcaaatcttgatggaacttgaccctgagcttaagtgacaaactgtgccaactagtactggtgatgcctaattatgaacccaacgtgtaaccagttataaatacacacatacatacgtctatataaaaagaaaggatctatttttgtgtaactgtacagatactgtaaagctgtttgccataagtatcctgtaggaacctgtgcgtgggtgtcgggcctggagccccgctcagcagtcagtgttctgtgctctggccaccggggagccacgggagtcgggtggttgattggttgatgtcccttgttctcagcaccctgggcctcagtggggatgggactcaaccctcaagggctcccctgtcagatgccacctccttgaaactggagctgagggagatacttctatttttttttttttcctgttttgttttggagttgaaattaagtgtgatctcaactcacctcaatctcagggaagaggcccactgaggaagatcagtctgtctgcgttgtctgccgttccttcttgcctcgctctggttgcctgggcacctccatgactcctttcttcctgtgctatctttgttccccaggaagccagagctgtctccaatttccaggtggggattttttagggtctcatcctgtgcgaaaagagagaagggggtgggaggggactctgtctcctggagagtgtaaggaactagctggccaattgcctgacaaattattggataagaatatttatcttaatgagctttggttaacgacatctggtatggaccactgacatttatttgaggttgccccaggagttctacccatggagctggcaatagttttttgtctcgtctgagctggggctgtattgggaggtgacagccaatgcctcacccccagagattctcttgaagcagcagcatcaggatgatttcctgaaccacactgtcactgtgttaataaggtggctgcctagcaggaaggggccgggagaagagaagttatttcttagaagatgttaagggagggtagttaaatcatgggtacctaagctggggttttagattgaagatgcccaaggtagagatcttcagctcctctgagcacttcctcttggtgctgactcctgcctagaggaggttgatggatggcttgctgagaagacagctggagggaatgggaccaagcaagaagggacaggtgtgaggtagaggcctcagtctgtgctggctgcagaagagccgtggattgtcacgttggtggtcaccatcctgcgctttgtgggtcacatgcttagtccctcaacccatgggagagcctcatgtctgagtagcacttggagcccactgaggctcttactctgatactccacaaaccgcaccgaggttccctcgagctgtcccgtctgattccccaatcaggattcaaatttgccttcaattccgtttttctatttaggtgtcattaacccagtcctcagcagagctttgtcacttttctgaggcagtagggggccgaggtgcaggctctgtagcaagttcatatgctggtagctgcctttggagcagggagctctcagctcaggagcctgtggggaaggcgcactcaccaaggcagatccatctagagtatttggggaagcagtctttatcacatcaacttcgtgaaatcctgagattagaaaacggtaggttaggacctggcctcagatcccaagaacaaggacctcggtgttgcatgttgcatgtgctcatgggaaaaacttattcctgtgtacaagagccttggcagctcagtgggtagcacgctcaactttacttgaagcttccaggtgccaaaccacttcgtgccttggctgtctatcccactgccgtggaaaagggattcttcccatctctgagcctttattagctgctccctcatctacccatggtgttgggaccaagcctccgaaacctctgagcagcccacttgttgcagcttggacaccgctgtaggaccaccttacccctatctccgtgggaagttctggattggctagaagcagtatttgctgggtatagggaagggctggacgctgtactgtttccagaccgccgcccagctttttggccaattgtgcatttgaaccttctctacgggaaacattgtggtctgagccttgaggttttggttttgccattccattgtcgagtagggaggtaaagggatcttgaagccatggcatttgtcatctggggactcagagctgttctagagaggaagccgagctgggcagagctgcacaaccttgaacacaggtgcatagatccttccacttcagagccacccaatggtgcttgcttcccccacccgttcacagacgtctttggcctgagtgtttaggaaacgaaaattctgagtcttgtgtcacaggaaggtccagccttacacctcatcatggtaatacaaccccccccccccccgcccccctgacttctctttggataacccgaggctgaaaaagataggcatctgatctagcttgggtagagtaggcctggggaagggagtgaagcaggttcatgccttggggctagggcagtggccaagtcacctgtctccgaacgaacacttagcggtgactactcagaccgtgggggaagttggctccagctcgctctctccagggtgagtctcttgggaggccgctgggtcagtgcccctgagtagtcaaaagtggagaccggatcaaccttggcctcaaagcccccactgctgcagaggaatgcagtctctggcagggaaatgtttttcactgcccttggaacctgtgttgttcatgtccaagagtccaaagaaagggctgatttcctgaggctggggtcagcccctggtacatgcaggcccttgctttcttcgaaggaccagctggccttctctgtctcctttgccgttcatattttcctctgggccattgctgtatgctctttgtgtcaggacaaggaagagggcaggttggaaaggcacaattggatgcatctagtagtgtatacaagtcccttttaagattctggctctggtcctgctgtgttctcacggtgccagccacaggtgaccgagtttcagcagcggagtcctgtttctctcgggcagtgagttcctacccagccctgcctccagagcaaggttgggtggctagagacctaggctgttctttccctggaagatgctgcctcttcccgtctttgctttttactgccctgcctttgttcgtgctatgaaatgaccacaccctatgtacttggctgtaaataaagacaaataaaaacaatgaattcaactcttcactcctttgtgggtgcctggttagcagcagtctccgaagcctgctgtgagaattgggcggagggagggctgggccttgcatttctggaggaagcaggggtgcttagcctgcctcctgtcctggtcttgggatgtgtgtgggacagactcccagggctctcccagggttagttaccttgcactccctatcacatggtttctgggaggctgaggttctaggaacgctgacactgttctcactgatgtcctttgtgtagcctctgccgccttccagacctacccacttctctctgttgaaaaggagaactaaacctaggtggagtgagctaggggtggggtcgggggagggaaggtagcggggtggggcatgtgtaaggaagcttacattaatgacaactcactatgatgtgaatgaaggtatatgtgtgtacttttaaaacatacatgtgcatgtatgtatgtatgtgtactatatatgtgcatgcaacgc

SEQ ID NO: 18397 - DNA, 1145 bp, Mus musculus
catataaatatggtaatcatccaaaggaggccatacaaaatgacacacagctttataaagtgtgtttttaaagtctctgatctagtgaaggcatgcctgattgcctagcaacacactaaacttagaagataaaatattaccagttttagtggagcacacctttaatcccatcaataaggaggcagaaagaagcaggtatctctgtgactttgggccagcctggtctacctagtgagtaccgggacacccagggctacataatagatccagtcccaacaacccttctccccacacaaatggacttgtgatcctattggtaatgcctacttctgactaggactcagagctcagggttggaactgggggctgcatgtggcctgcagcatgtgtgggggcttcacaagcccatttctgctaggtgtgctgggggcagcatcacacagaagcagtgtggccgttctgtctcaggagagagcccacgacgcttatgtgttccatatttggttgtctgaggaagtcccattttggagactggtcctggagctgtgccatagctctcacgacttattgatctctggaggtcaaacatggtgttttgattagccaccgactgcatttcccctactctgtcgcttctgtggggaaagccaacatttgagagcagaacattatggagcaatacgccctatttgaatgagggaggcatgaacaccattctggaggaagagcaagccgcaggaccttcctggtctgctgtccccagtccccagagcactgcagctgggttgaccctttgtttccccagatggatgcacccgcactgaggacaccaccaggccttccaggggattgtgttcactgtgagatttgaggtcttccattgtaatccaatggaagcttttatggcatcggtcactgtgcccagttagggtggagacctcgcaggcttgtggcaaaagtgttttcaggtgagttggggacagggaacataggccttgtactctgtcaggctccagttcctggcctgtcttggcctgtttttaatctggttcttttgacctcatccctacatctgtgaaaaggagataaggtctggcttgtgagaacaccggccccagtgtatacacagtggtgtctaaaccggg

SEQ ID NO: 18398 - DNA, 1182 bp, Mus musculus
cccagaacccctttctccatgaacccctgtaagagtgggaggggctacctgtgcctgccaccctagtacttgggggtggagactggcaagtgctgggcaactagcaagacagcaagacagcttcagtgtctatgggaggcattgtctaaaaaacaggccaagagtgacaggtcaggagtgatggcggagaatacacttccttgacctctggcttccagacacaggtgcacatgcatgcacacacacctcaacacaattgttttgtgttttgaggtaggcctttctgtatagttctggatgaccttgaactcagatctccttgcctcctctgcctccagtgaatgctgcctttaaaggcctttgcatccaggcatgccaagggcctctagggctgtaaatggctcctctgtgttgacttgtttctccaggatgtattctccctagctaggaggagataactgttatctcagtcctaattgccttagcagttgagtctttatggcagctctcacttccttgactgccctgagtgtttgctcttggctttcactactgctccagtcagaagtgtacgctgtacatgtgctcatcggctgggagagagcgcggctgaagacacactgcttccctgcccagttaagtcttctgtttttttgtggtgctgaggttcaacacacaggacatcatgctgagcttgtacacccacccccccgccccccaactgccctggagccctcagacactggttgagcatttcagcctgtttgtctcattgactgctgggagatatggatagtgctgttcgtacttgggctttctcttggggactgggggtagggcggggtgggggagggggagcgtgagaggttcccttcccccgtagtcacgtagctttgtgtgactgcgcttgcttggtggccaggtgccatctgatgttccggttagtgagatgatgaactcagctgaaggagaggcttgagcgcctcttggctttgaaccacagttttcatctattttgtttaagtgaatgtttatcaatagggacggcatcttcaacctaagagatgacttacagattttgtaaacccaaagatctcggaaaaggtaggtctgccttgcctgggaaaaacccacctgcttcggtcagctcagagagtctcagcaggggctttttctaacagg

SEQ ID NO: 18399 - DNA, 1207 bp, Mus musculus
gcgccctgctcgcacggcgggcggcgcatgtggccggcgcccgcgggccgtgtcagttgcagcctgccaccgcgtggcccgcgggatcctcgttccgggccgccgcgctccggcgccgccagaccccgcgcaggctcggtgcgcggcgttggggaccagcggggggacccgggcgaccgagggtccaggatgcgggttcctcctacaagtcccccgcagggatggtgcgctccctcgctggttcccggcggcggctgtgactcgtggtcagggtcttgtgggggaggggcggaaagcggatgcttattgttttgcaagtcgggtgtaaggacccggctttcggggcttccctcggagccccggtacgctcctccgcccggcttggccctggccccggcccaagcctgtgggctgcgaggctggccgggatgcgcgaggtggcgcgcccgctgccgggagcccacctgggggttgcagggctttccgggagagccgaagctcgatgggcacagtcacggatgggatgacagcaggggctgctgtcttttatgcttagaagagaaaaccgcatcagtctcagtgagaaagttgtacaggctccatgctcttcggtgtccgggtcgctcgctccttggatcgcagggaaggggttaccgagtctgactttgcgaggaacctctttcctttgtattttctcctgcacggcagcgaggggcgacttgacttaacctcgggtctttactgcaggtggagaagggtggagccctcccagatggttctttctttactccccctcgctcccttttaggatgtggctgcttgttcgcctgccgtttaacagccgccaagttcagtgggcgctcgggctccatgaggggcgcccgagggagctgggcgccgcgtgcggccgctggtgaggccggatggtgagtccccaaggctgggcagcgtggagcaggaaggctggatggcgccatgagacgcgcgccacgcgccacgaggttttagcttccagcccatttctccttggcccctcctccattttgatttttacgtattttccctccaggtctggagtactttagctcagcagcccagattcggcgttgtgtgccgcagactccagtattgatgaatttcgcctctagtttagcttccatggctaggattctgaaatgctgtttaggtatcggaacttagggtcccc

SEQ ID NO: 18400 - DNA, 1243 bp, Mus musculus
actgcctggcatatgtacaggtcttattgttgtgatcttcattatattaaaaaatgacaccatcagcccattgcaggtagctatagttttagtttatatgcattctctttgctgatgtatgtaaaacactctttatagcttatattaaaattggtttttactgtgcttgctatgttgtttctttacagaacatccagaagattcttggcctcgccccttcacgagctgccaccaagcaggctggtggatttcttggcccaccacctccgtctgggaagttttcctgaaggaaagcagaattctgaatttcctgtcatactttttagacattcacatcagacttacagagcacctggccacattctaggtttgtgttatttctcagctatggatatgatcaaatgagaacactgcttaactaatgggatagtgctatggtcacggatggcttctttagtaataagtgcactcactggttacatttggatggcttatgtaaccacaaacatcatctttcttgtctcacttgagtatttcagtgtatgtgccatatacacagaagcagactgtccatgaacattaggagaaaaatagtttatgtaacaacttcactgtaattagttgttgtgttttttaaaaagccaaatatgtcactttgtgttcgacaatgagccaaatttttagatgtttcagttagagaaatgtttgatttttttgcatattaaaaagagtattttctgtaatctgaacataaggataagcattggcccaaaaagctaaaataaagttttgtcatgttcttttaccagccttgtctcctgttcaaaatgtgggattgtcccagtgtacactttgaacgtgttccagttggctttctggtgttttgtcaaacactggccagaaccagaagcagcttaggggaggaaaggggttttcagcctatgcttccgggtcatagttcaccattgggggaaaagaggttagaactccagcaagacccaaggcggaagctgtggaggatggctaccagctagctaactctgccttgctctcagttcgcctcctcttagcagccgggcccacccacctagaaaagctcacatactgtaactgtgcagggttggagcaggccctcctccatcactcaccaatccagagactctcacagacatggctacaggccagtctgacctagggaacttcttagttgatagtccctcttgccaggtgactctgggttcca

SEQ ID NO: 18401 - DNA, 1310 bp, Mus musculus
actctttaaaaaaaaaaaaaaaaaaaaaatatatatatatatatatatatatataatgtatatctgacactgtatctgtcttcaaacacatcagaagtgggcatcagatccctttacagatggttgtgagccaccatgtggtttctgggaattcaactcagaacctctgaaagaatagtcagtgctcttaaccgctgagccatctctccaggtgccaaacagaactcttaaaaaaagtccgatggggacgctgagttaactccacagccaatggcttctggcagaggtgtgggaggtgaaggactcagttctatttaaggggcaggccactgagagtttagccatgctccagtgagtatatagatagcacaaatttgactttttttttaattcttgtttttatttttactttcggggggtggggggtagatacgatacggcagcgccgaaggagcctccgttggccccggatagccgggtccccgtccgtccccgctcggcggggtccccgcgtcctccccgcagcggcgcggggtctccccccgccgggcgtcgggaccgggatccggtgcggagagccgttgtcttgggaaacggggtgcggccggaaagggggccgccctctcgcccgtcacgttgaacgcacgttcgtgtggaacctggcgctaaaccattcgtagacgacctgcttctgggtcggggttttgtatgtagcagagcagctccctcgctgccatctattgaaagtcagcccgaaatggggtggggagcaagcctgccggtccagccatgatgataagcctgtaagcagcacccctccatggccctcacatcagctcctgcctccaggttcctgccctgtttgagttccagtcctgacttcctttggtgatgaacagcaatatggaaatgtaagccaaataaacccttccctccgcaagtggctttggtcacagtgttttatttcaacaatagccatcctaactaagagaatgactgggtctggtttcatctttgctggataacaaaaaaatgtatctgactggaaattcttctgtccaagggcatgtgagtttctcttactcttcttgcagggaaacctttgtaaagaaataggaataaagacaagcaaatacaaagaaaacatatacaataaggactgccaactttagctgcaacatacatttttattttatatgtgtggcgtttgaataagagtgacctccacaggctcggagagtggtagtctatgagagggattgggaggaccggccttgtcagaggaagtgtgccactctgaggctttgagg

SEQ ID NO: 18402 - DNA, 1415 bp, Mus musculus
caggatttggcagagagaatggccgtgtgacgattgagtactactctcagctgaagacggtgtgtgtggagatgggcgacgtggagtcagccttttgaaacccagggaagcctgctggcgtagccaagctgtggaatgagttgactgccttgacaggcagcataactgaatagcttcttacatccaggctttgggtcattagtgtgataacgggtcagtgttgtcctctgtcttacagtcaccttcccagtttgaaaatgtgcacaagtgcctttcagatggtagccaggtaacctgttgtcccagcccctgagaaatatgtagaccccagaagcgcactcttcagacataggcaggccacagctctgctcctacacatttgtcccaccaacaatggcagctttctagtttgctttaaagcaggccttccttcctgggttcctggtgaatcagtacatatacattctttgttcattgacaactaaaaaacaaattcttaaagcttttatttggagctgggcagtactggtatgtgcctttaatcccggcacttgggaggcagagacaggtggatgtctgagtttagagccagcctggtctacagagtgaattccagtctaggaaggtctacatagagaaatcctgtctcaaacaaaacaaaacaaaaaaaaacccataaataaataaaaaaatgtaaaaagctgttattcttagtatttgtgggctatgtgactcattggcatttaaacagctgtgttctaactaactagcaagacagctcagtgggtaaggtcttatcacttaaacccagtgacttcaggtttatctctagaacccaccccttccccatatcatacactgcacaataataaaatctttctcaaacgctgtgtttttctgtcctttctttgagaaaccggaccacctggctagagagacaggtagttggtggagtcggattttacgcagataactgacttgcctcagtaaacactcatcctgtcttccacagcactttatctctgattcttgcagtacagcctatggccatagaaccgaagagaacctttagaatgtgtgagttatttgtacgctaccattacagtgaattaaaaacctattacactgctgatctttttgccgtcttaatttgagtctcatcttaaggctgggtaggagacaggagaaagcaccaggcaggggaaggtgagccctgccaagtacaaagggcagggtggggcatgacgactttttgtgccctgtccttccctgcagtgggcagaccttgtaactgcagaccgatgcagttaagcccagcccagtgctccttctggggaccagttacgtacagtgacggtggcatttagagataagggatgatggctgctaggcttctcagtctcttgcctttggat

SEQ ID NO: 18403 - DNA, 1222 bp, Mus musculus
agatggttctgccagccataaagatggcagctttgccagtagattaagtggcaagtggtcagatatctttggggcctcatgcacttcctctgtaaaatgggaattgttatccatggctcaccaagggtcttgtaagaggcccaagaaactgatcttgcttgtatttaatctccaggtctgatggtcagggaaggcagtctccctataatgaacatgtcatgctaggtcagaataatacatggttttcttgttctaatttctacttgttctcagtaccttgatgccatcaccatcatgagagtgtttcagaggctttctgctctgatttggttttggtctgtttgtcttcttaggatagagaagagattcaaaactagaggagtagaacctggttttattagtttcaacttgaatccagttatgagaccttgcaagtccttgtccctatgacaactcttctgcttcagggactcccaggaagaagtacaagagcttgagggctgagagacaagcccacagtgccaaacacattccacatgcagtgataaataggagacatgcttcatgtgtgtttggaggagttgggcctgtatacctggaacctgggggactgagtatttgaagataatgcagaacagaattgtttggcaaatgtaaatttgtccagctgaccccagtcactagaaagactgtcatctaacctctgccatgctcagaacgcgtgcctagaagggacaatacaagtgtgtgtgtgtgtgtgtgtgtgtgtgtgtgtgtgtgtgtgtggtagtgatgagaaccggtgatttttgtctttgtggcaggaatacattgaaaccactctcagaacaatggttggaccacatcattttccataaagcacattataagatttgctgaagggttctcttggaaacaagagtgaccccagctctggatggaacacatgaagggacatgagtggatcaggccacagcagtgccaccctcacagaatgcttctctctaggcagtggctgtgctgagaggcccacctacccagcacttcattaggcctcctgaaggttcaacatgtagccagcagtctgttctccatgcccactgtcacctccaatgtggcagccaccagatctctgtggtcaagcaaggctagggaaaactggcagcctccagatagaagtggaaagagtgtgcctctaaaaacttggctccctatgatttca

SEQ ID NO: 18404 - DNA, 1232 bp, Mus musculus
tgctcctttgtagatactcaagggtaaggagatgggagctggattgatggtcagggagcaagagagtttgctgcaggaacgtgagcttctgagtttggatcgcaaaactcaaggaaagagccagtgtggctgtgcaggcacctataaccacagcgccaagcaaggcagagacaagggagttgctaggcatgactggcttccagcgtggctctagctcaggagcaacccttctcaatggaataaggtaggcagtgacagaggggacagtccatttgagaatgtgcatagaggaactctgtgcacatagacacaggcaaacacatagatgtatgtgcgtatacagcacacatccagcatacacaccatacccctagacagaagggtaaatagactcctgagactgccaaatgacgaagcgaaaactgtccagaattcagctgaagtatgacttgccctttgatgtgactggaagatttgctgtgtcagtttaagatggagaaatgagcacagaggaaatgatgagaggtggagcaagaacccttgaagtgaagtaaaaagtaaaaaacaattataatatggagggcgttcttgtaaactgtatgggatttgtagagttcagttctgttgatgatcctattctgtctgtgatttgttatcattattcttcccattacatcatgttacgtctatgctgctgttggatacggagcacagacagtaggattttttttccagctagtaagcagagtatgagtttgtgagtgggtcaactttggattatggggttcatggtggtaggcttttgttaaaagaaaataaaatgagactcctcttgaggtatttgatgagagagagaaaactaagacaactctaattccaaggaagcctgatcttctctttgataagacaaggtagcaatgaatgtattggcagctttttctcggagtcgagaaatcacaggcatgcatataaaagagcttgtaaagccagtggctctgaaagacatgtcacatctgtaggacatcatagtgagtccttgtttccattactgggatacatccactgctgcagttaaacatctcaggactgagaagatgtttcacacactggtatctgttcggaaggtggggacatctgctgtctgtcatgtaattgggagatgtttttctcaacagtaggcaataataatatagtaagccaaacctcatattatcatgatgcattaaaactag

SEQ ID NO: 18405 - DNA, 1239 bp, Mus musculus
ttcggtctttaataacatctatactatagatgtattcattatgaacagcttattgtcatgatcatatttcactggaattaaacttagagcaaaagaaaatattcatgtttcaaaaaaaaaattttaaaaaccctgacaaactgctaggacgccatccggtacacagtagaagcagaagagttgacttttatgtgtcagatgatgagtttttcaaaccttttctccataaatcttaagagccatccctgagtatcagaacgctagagatggcaagacatttttatcataaaggcatcctatctctcgggataaaattctgaacaaaagtaagaaagtgatagatacataaatataatctccctacaacttgtggtatgaaaactttctggttagagtgtctctaattttgttgactacgttttcttttgtaaagatacagaggagaatgagtccacacccacgggcccctcctctgtctctgggaagcaaggggtggtttttcattcttcatcctgagtgagcccccacttggcaaaggctccatctcagggggaactcatgtttctcatctgcaaagcaaagctgtcacccccctgttctgttcttcgcggccttgcctgaggatccgtgttctgtgtgaaccatgagaattcctcattttggtagagaatcaggttccttagagatcaataagccagcatgctgaggcccagacactgcaggccaccgcccttctgaaggatggccccttctcttccccatgtgcttgtttccaggagacagtaccgagctctgcagtggtatggggaggattagggtccctgcggctgggtagtcataaccttaacttgccttgagagagtggattgagaaaaagcttgggttttgcttatttgtgagtttggagaaaacacccttttctggggttgtcaagttataaacatcaagttattcttagaagtctttattaactttttgctggcttcattgggaattccctctgttttattcctgatactagtatctgcccatggtcagcaaggcaggagcttttccagtttgctggtatttgcaaagaacctttgtttctgcctcatttttttcctagttatttacatattatccatatagattattagctctacttgttttaattatctttttgttttctttgacttaaagtaaaacttttctagttccttgagttaaaacttaggttccatatttggaaatctttct

SEQ ID NO: 18406 - DNA, 1219 bp, Mus musculus
tttcaataatgctcatccttccatggtctaaaatggccacagcaaacatggaaacaataggtgtaagttagacaatactaagtttcatctgatctttgacagaggggtgtgccatattggaaacatgttttccacacaggcaccccacaagaacagtgtgatgtgggcgtagaccatgtgttttaagtaaagaggaaatcagggggcgtgtcaggatgaagggaatgtgggaagatgttccgaagacatgcactagaaaacagaacggtgtctgttttcgtccagtactaaatgaaaagaattgcaatacattgcttattgcaatttttatcctaagttgaatccatgagcctggtgcttgcagcatagtttttttgttttgttttgaagcctatgtccttgggcactgtgtggggcaaggccctgatgttttggcaacatgcagattctggtctcctggaaaccttcatattctttcatattctagaaacagatgaatgtcattggcacttggtgaattaattagaatcctgagctaagagggaaggaagctgggtagtgacgaaggacttgagtaggctggcaggaaaggactggggagggaccatttagttgtcccgtgtttttcagaaatttctcattttgcaatgatctgagacttgaaagaagttacaaaagaatcagcaccttaccttggttctgttttccacacactgaaaatatttcagtctattttcatctatttggaccattttcaaaactaaaccctaggcccggcttggctttcaccagttttcctacattgtattcagttgctcactggatacttttagcctttgttggtttgtaatctggctttggtggcatacaggataaaggattctacctagatattactctacaaatgagagaaaacatcaaactgacaagctcttttatcagggaccagtactccagctgtttgctgaacccactttcgattacagctcatcattgctggacccagaacggccacagcgttacacgggagtcatatgtaatgatcagctctgctgtttggccacccaaacaatccaaggacaacttaagaaaagtaacaatataaaaggcttcaaagtggaagggaattgtaaacagaagaacgggacttttgttggtgaccagaggggtctatgataaagcggtactttggtcaagaattaagtggtactgaatggag

SEQ ID NO: 18407 - DNA, 1195 bp, Mus musculus
agagagggtggccagcggcaaagcatgaagttcttttctggctttgggattcacgagaactgatgcatgatcaagcaggagtcaccttagtgactaacttagtgaccctaagttttcatccttcacagactctaagattcagcagcaatctacactacaaaacccttaaatcctatagaggaaaccaagctgaggtaaaatagtggtgatctgcttctgtctatccagtcagcttgctccatggtctcttagaaacctgagagcttcttggttcagccttcagcatggctacaggacacagcagatgtataactctaagtcttgacattaatttcatagatcccattcgctcacagcacatttacctcctctcccatggcttttctaccattctcagcaagactaacttcgatcccagaggtaggagagaacattggattgggaactctggccctgtgctgcctcaagccaagtatgtcattttcccaagtcttgcttctctctgaatttgttttcttatctgtctcaaaggaaaaccgaatctatgatttaggaatctcttggagttttgctttgttttgtgcttgctggagaactagatttgtggttgatgtaggttcagttactgctcagacaattgtggccagtaatagtgatcccgagagacatcatttaagtaagagcaacacctgcattatatctgctttagagtgaccagtgctgcttcacgttatctcatttgatagttctagggccagacatgtttctttcacaactcttgactatatactcttcaggattctgcccccagttcactgtattcctttacaaatgaaatttccaggactttgctttatggaactaatctatcccagatggctatcaaatatgtatcttcatgtacaggcactttgtttttggtatgaagaaggttccaccttctggcactgaaacctttgtattacagacacaggtttagtttctagttacactagtagagtttagcagtacaggtctgagtagccaaccatggtagaaggtaaagacttactctgtagacaggtagctcaaatctaaactagggaaatgaaggtaggttttggaaaagaaagcagaaacagatgagaaactgtgggatcttgttatttccccaagtaactcgtgatcacgatatatgtgaaccatttatgtcaag

SEQ ID NO: 18408 - DNA, 1228 bp, Mus musculus
tcttcaagtacctctaactattacctccacaatcccttcaacaagacagaggatgtttaacctagtgagaggaaccttttatgcccttaatagaactgatccaagtgctactgaggactgctggctatgcctgtcctcaggtcctccttactatgaaggaattgccttcaatggagatttcaacagaaccagcagccatacgtcctgctcttggggaataggacaaaaactgaccctgactgaagtatccgcgaggagtacaggtctctgtataggcaccccaccttccacccacaaacacctatgcagacaaattcagtccgtgtccaggacggaagctaattactatcttgtaccttcccaggttggctggtgggcttgcaatataggacttactccctgtgtatcaactaaggtttttaattcatctcatgatttttgtgtcatgatccagctgttaccccgcgtatattatcaccctgcatccagtttagaagaaagctatgctggccagcagtcaaaaagagaaccaattactttaaccctggctacattcatgggaataggtatggcagtaggagtggggacaggagtgtcagctttgatagaagggagacagggaattcagtctttgagggatgctgtcaatgaagacctagcggcaatagagaagtccattgacgctttagaaaaatctttgacctccctgtctgaggtagttttgcagaacagtagaggtcttgatttgttgttcctaaaggaaggaggactgtgtgctgcccttaaagaagagtgctgcttctatgcagatcatacagggatagttagagattctatgcagaaactgagagaaagattagagcgaaggtaatgggaatgggatgctcaacgggggtgatttgagtcgtggtttgagtcacaaccatcttggatgacttctttgatttccactgtagctgaaccagtccttatgatatgcttagctttagttttcggcccttgtataataaataaagggatggctttcatccagagtagaatcgatgcagtaaaactcatggttcttcagagacaatatcaacctgtagttcaggtagttaggggacaccaatctctaaaattctatgattagaattagtctaaacagaagaagaggggaatgaaagaaaattaaacaaaataaaaggtttaaactaaaaaggcctgggactgagactacaaagaaaaa

SEQ ID NO: 18409 - DNA, 1241 bp, Mus musculus
gagaaagcggatagacttggagtcacatacatctgagttaaaaattcccgtctttctaggtactagtgatgtagccaaaggcaaattacataactcctctgagcttccttttctcattgattgtgaaagattatttgttaggcctcagccttggatgaaaattttattcccattgtagagacactgaggttgaaagtatttatgacttggtataggcaataagattaggaatgcccgtctgttcccacgtctgacatgtgatgggctcctggtgagcctccagggatgctgaggacaagaggaggctctgtgttgcagcatgatttgttttcttcacgtggaagtgcgggcgccctgagtctccaggatgtctgctacctactttctgtgtctgctacctacttgacgccttttgaagttttgtgtctggtgttgcagtgggtgagcctgcacatgctgcctttgctgcaagagccagagtgctgttctcacccttgccgtgatgggcacaaggtgcagaactccctctgcagtgtggaaacagtgtttgatgctgaatggttgtgatgaggtagaagctgtggggcatctcatcataggtgcgggacctgaggccagggacagctgagtgatgcatatggactgctgatgctctgtacccctggtcaccatgctgtgaccgcaggagaggttggtaccgccatccctttaactgccaaagctaagcagttggaatgcaggacaatggggatttttttatagtgagcctcaaagttaagttatccctttcattcagatccttgcagccagcctgggtcatacccatggggttttttgtttgtttgtttgtcttgtttctttcttccaatatttttctcttttagttagcatacaaagtaatggatttcattatagcatttttagacatatatcagacatagctcatatttgtttttcctgctgctttcttaaatagtctctcttctgcttttgtgtcacacatatgcatacatgggtatctctagtgaagtttagattctgcatataaagggaaacctatctctggtgtgttcattctccattctactccctggggcctttcccccttgtagtggctattcctggttgtcaacttgactatatttggaatgaactacaatccagaattggaaggctcaccagtcacccttatctggaggcttgggatagaagattctgatctggatcttggtatggagatc

SEQ ID NO: 18410 - DNA, 6407 bp, Mus musculus
aggtggcaggagagagctgatgtctgagagtttttctctgacctacacaacatacacaatcaatcaatcaatctctctctctctctctctctctctctctctgaattttaaaaagaatttagatactaaagctgtactttggacttaagaaaaatctgtgttttaacaaaatcctcagatgatacacagtcatgcatttaatatcatttaaactgataaacagcacacttaaacttacatgataaaacctacaaaactcctaggctgtgtgatgtagtctgatgtttctgggctacaaacctgggctattactgccctgaatactgttggcagctgtaatacactgaagcacagtaaaaacaccaggcagaatgagtgttcaaatctattataatcttaggcaaccagtgtcttccatggtctttgattgatattgttatgtggcctgtggctaggtctccattaaagttggtaaagcgctgatgtaactctgaagttatgtggtgaatgacgttgtcttctctaacctccttcaggtcttcgttgagtacgcgaacgctggtgattccaaagctgctcagaagttgctgactgggaggatgtttgacgggaagtttgttgtggctacattctacccgctgagtgcctacaagaggggatatctttatcaaaccttgctttaatcagtaacctaaggactacttcctgtttctcctcttccatttcttggattattatattccacagctgaatgcaggagcacccctttacccattttaaagggtaccttgtacatttatttaatcctactaatgtgcagccattgcccagacagtgactgcattgcaaacatggcactgagtaggacccgacctctcagctatacattgagggggttagagcacccatgtggccaccctttatttgtgcagtagggcaggtgctgctctttactatgtaacctaaaaagatgtcatttcatgtgatgatgaagcaaagatgagttgtttgtcatagtaaatactattaacaaatttgttagggttggtgacatcacagaatatttgtttgtattgtcaggtgtatctccttgttattctagctggcactggatgctctaataatgttaagtcattgtcaagcagcagttacctaccgtgttcttaacaatgagttgtgaatttttctaaaggagtactgtaggacttaatattcctccgaagaaactgcagtgagcctatcaatgtttttaaaattactattaaggcttttaaaatagaaagctgatgcttgatcttgcacaatttttatgtatagtgtgtatgcttgagtgggtgtgcaggtgtgaaagactatagagaatctgagtcagtgtattttacagtgtgagtcttgtgagctaacacactctataaccatttcttcctaccggtttcacacctgagagacttgggctataggtttcttgaaagttggtctgacagatagaatgtaattgacaagagagttcattactgtaaagtgcagaacaaagtggagtctagaccagggttccatgtagctcttcagagtgtaagttaccctgttctctgctctactgtagacccaagattggctcatctcttttgtactgaacctcttgtgataattgtaaagtttttccagatgtgattctttctgctataatgggaaattgaaatggatcagataaaagttagatgcacagtgacgggaaaagagaagagtgcagagaaggcagctcatcacagaccctcctcccccatctgccctgctgccctgccaccttcctcctttccccgtcgcctctgtctgcagcctgagggcagtgtcccgagtcatcggcttttgactgtaagggaaaagaaaggttgatgtattagaaggttgaagtagaaaggaagaaaattcagtttctaaaagaacaatagcaatctagtgtgtccttgatagaggatgcctgttgccacgagtttgtggacacagatggactgtggcttgagggatatgagtggggttcttcctgctctgtagtagtttgccttgaaaggtgtaaacgtaggaaacttttgtaaagcactgattatacaagataacccacagattgtacacttgtgacagagtttttcctatttccttacctgaatgaaagtgttatttatttatttttccttaggaaagagtgtttgtttctcttcctgctggcagcctgcttatatagtctcttgtccatgctgttcaagttcccaaaaactccattaaaacttgcattttagaggttgaattattttaccctgtttagacatttactgcccaacatttgtcagtataatcaaattgtcccgagctcccacttaggaagttacatttggtgtaaggggatttgctgctgagttacctctgctcgtctctcgtggtccctgatgagtgtcttgggaagaaggctttttcaggggttcattgtgtggttggttttcaagtcaaacttgaagaacatagaatcagggctgtgaagtcctaactaagctttcctaaaacataaatatttacatgaggagctgcttctgtggtcattagtagcaggtctctacgtttctactgatgaccacaagatacaagtgaattcttttgaagggcaagtatggttagcacatgttcccatatctcataaaaaagagatccttgcaaataaactgcaggtaggctgccaagctttaccgtgcagtatgctgctaacactgctgtactcacagcattctgtgaacctcatccatgcagatgtagctatgcacatgtgtagagttgacactgtagacttgttacagacgatgctagccagattttaagggagctgaggaagtaaatgagtgagcccgagtaattacattgagatcattgaattaaatagtttatattgaagtcacagacttgaagacaaaagataacctgctatgatttaaaccattgtgtgatagctcttagcccattttaccaaagaggacagctgcagattcctcctcctctgatactatcaggactttcattttaatatctttcttaaactgggaccaaataatactacaaaagatgcaattttcacaataaatatatgcacagggattttaattccttgaaattattaaaatcctagaattctcttactaaggggtaaagaagtgagcgctcatgttacttagtccctgtctttgggggcaaattttatctcaggtagtttttctctccctatgttaagatttgtgcttccttccttctctcttgcctccttcggttcgtctttattcttccaaagcactatacagtgcacattttgtccctgattaggcacagaaagcgattgcccgagggaaaacttggggttcttttgaagtatttggaggaggagacttgtagccattatcaaaactataactctgtagttggaagagaataatagtgctgggtaccccagaaaggtactgcctgcatttcaccataagtctacatttattatgactggatactcttcttcctttgtgaccattggcacagcgtctccctttgggaactcttcctctctgctaaactgatctaaatttatggctgcttttagaatcaaatgactaacatagttctactcatctgtctctgttttaattgagaggagtgtggtcttctcgtcgttatgtagctgctgaagatatgttaacctgccagcaactgtgctgccacccagagaaaggtgccgaagtatgaggggcataaggcttccttctgtcttagtctagactttccctcaggcaaggcaccacttagaggataacgtagaagcaggctgaggatcatgctgttttatggctcttctgaatgtggcaggtggctgacaacttggcatcattcttgttagttctcccgccagtttattaagcaattttatttttaacagtcgctgaaaatgagcatcatcgtgcctacctggtgggaattatagcagtacagtgggaggggacgcactggtgaccatgcactttacctagactctcacccaaagggtacgggctgggctctttgttcaggttagggtacagatcgtgatgtttcatctgttggatgatgtgtagctaaagttctgggcaagtcaaatattaaacctcacctggccgatgtcccaggggaactgcactgtcgcctttctcttggaataacttggattgattcgtgtgagtccagaattttcttggcatactttttaaaaaaatgtataaaatgatcccagtttgacttatttcagaattacatgttgatggaaaggccagttatctgtcacatctgattctgggatctagtttcatttatcaggttctttcttcagcacttactgatccagctctctctttcttgtaagttgtggacacttacacacccgtccttggtcacttctagttcaacagaatccccatttcttgaggtgctcggcaagttacctttctttgcctagggtttggcactcttcacttggcgttgcctgtctcctcaaatacacactgctcttgttgaggctgttgtgtggagctcatctggtatgtttagattcctgggaggttgggtgttcgagacaggggttctctgtgtagccttgtctgtcctggaactagattttagattcttaatcatggagaagcttggatattttagtttttagagtgtccccattttttttaagaatgaattttgatcctttctctaccttataacataggatggatcatgatttttatctttgccacctcccccagatggtggtcaccagtgactattgctttacactgtgacaagcagttggcaggtactaggtattgaagaaggtaaacaacttagagtatttttgctatgactttataggagaaatgagctgtcaaaagaaatatgtacaagccagggagcatttaggatagaaagtttttggagacagggttttgcagtgtagcctagacaagcccccagctcaggatcttcctgcttcagcttcccaagtgctgcttgtcacagatgtgcaccatcttgcccagctctgctaggaagctgttctatagatggtcataggtgtttttcaggatataagactaacacacaagtttacacaccttttgttgtcctgatagtgtctatagctcagcgcgttccctgattcttgtgctgcttacgggagtgattgttttaaacatgctgtttttgtgcctttcagagagtcatagtcatggtagctgtgtttgctggagttcatgggaacctcactaaaggatggccggagtgctagactggtagcagtcatgataatgccaagaaaaagtggtggctcttttgaaggctcagtgtgctttgtgaactgagttcttagtgtttagtggcaaggcaggcccgcttttgcttgccttacaaggtcatttcatctctgttgtacaaaacacggctgctcctgctctacctctctgttaaagcaaagcaagtcacattcttgaagactggaatgcttacttttttgtttgtttcttactgagaaccttgtataagcagctactactgccaccttcagctcctgatgatctgtgagcgggttctagccattctttaagatccttggtcagactcccttcccttcgctctgtcagcccctcttactattcctgatatcagacagcatgcagaaacattgtgcgcatgttgactcagatgctcctcagtgacttgaattctttcagctgtgttactctattagatgggtcatcagaaggctgtcagagataagaacagggaagacagagatggacatgagcagagaggaggaaaaatggctcccttactggtgtcgggaatcttccacatagaggtcatggtctaagaatctaaactttttacctgtagatttaaaacattgcctttctcatacattcctcatcctcgtttccccaaaagactcttgtcagggtttatgaggccgaccagattaaatacccatattcagtttctcttgattttcttaagaagtattttaattcccttgtgtatttggtgttcactactgttcttgtgactcaagtctcagagagaaactgcggtcagccacctcggtcctcctgttgcacgtgggtggcggcatccgtgtgtaccgatgcagttacggcaccttgtgaaaaggagtgtgagcggtgtctatccgaggataggaaacttcagtctgcacttctgtgagccagaagaatacaaagctgtcacatttccagcagtttagttttcattcttagctctttttgaaaaatcttaaaatactttaacattccttaagtagtgtcaaatctagggtagaaggcttttttccccccatcctaaaaagg

SEQ ID NO: 18411 - DNA, 1201 bp, Mus musculus
tggaaaccgtattccttacattcctgcttctactgatgctgtctgtaagaacctttctgagcctcgctctcagctgaccttgtttacggattgtgttccttgatttactctttgcttgactgctctcccctctcctccctcccacctaccctagccttctgcttcctaaaactgttttgtcattaactgttgggtcagctctctgggaaacggttctgttgctgtaagtgcacttacccttggatggtgtcactagttagtggcttttgctaaataaacctttctgatttctaaaagctttcccattgtctctgcttacttcttctatttaacctgtttcttctgtcccccttccttgtatccacttcctaagccaggtatcatcagctctgggacacaagatagaaagaattcacactgggcagtggtggtgcacacctttaatcctagcagtcaataggcaggggcaggtggatctctgtgaattcaaagccagcctggtctacagatccagccaaggatagaaaatcctgtctggagcatggggctggcatgcaggaagcgccctgtatctgcagcaggaggctctgggctgggacacggcttagagtgactttctgtcttagaaatcatggtatatcctcaggagaatgttccgtgtctcgcaacaactaattatattgcaaattattagggcttcattgtaatctactttattaatgaaaaatgacaaagcagtgtactgataagccaaggtgcttttgatctgtaatttcttctctaaaactgctgcatctggtacagtagactgtggaaggtgttgattatgtttcctctggggcctggtaggatgctaatccctagagcagtttaccagctatgtgtgaaattgaagcaggtaccatggatgacacgggactgcccaacaacacttggaaatgattgttaacatcacaggcatggcaccgaacactgtagagatgcacagtcagttgaacttagtagcaacgctggctttgtgtaataaaggaagcatttgtaacttaaaaaaaaaaaaaaaaaaaaagaaaatcctgtctgaggagaaagagagagagagaagaaagaaagaaagaaagaaagagagagagagagagagagagagagagagagagagagagagagagagagaaagaaagaaagaaagaaagaaagaaagaaa

SEQ ID NO: 18412 - DNA, 1243 bp, Mus musculus
actctggaagggacaaaatgaggccatgtcaggttctaagtccagaattggaacccttgcctctggcacctgtcttcaggtgacgattgcctcagaactggggtgacataggtgctatttctagagtaactgtgcatctgagaaatgttggatatttccacctctttccttttctggctgcctggatttctgatcaccttgcgcatcctcagccacagcagtccattgtgtccttgtggaatctgcatccttcactgtttccttcttccttcccagagtcaagctatgagaatcgtgcggacagtgggacaggccttcgaagtctgccacaagctgagcctgcagcacacacagcagaatgcagatggccaggaagatggggagagcgagaggaacagtgatggctcaggagacccaggtaggcaccatggctgcagaaggagaggacccaggatggaagagtagatcctcccctaagagccagcctattaagttacctaaaaactaattctaatcatttcaccattgcaaccatttatgtttttttcttttgttctctttttgtttgttttagttttgtgacaagtttttagtgtgtaccacagactgaccttaaatgtgaactcctcctgcctcagcttcctgcacgagagatggtgttaatgtgttccaataacaactagtgagaaataacacccactgtgactacttcgacaggaaaagaagttcattgacagtttaacaaagataaagtctttaagaatagattacatattctgcttgaaaaatggaaggctacagcatagtaatgaaaagaaaactcgaacatcataaacatgaattctgtgttttacatggcaaagatttctaacagcaaaggcgacatcatggtaaccttgggtacgcacatactacaccattccaaaagcctatggagtataattaaaatggtacccaagggaaaacacaaaggtcagttattggctttagcacatgagacatcctgattgtcagatgaattagcattcaagccaaaaagttagaaaacagagggggagaggcaggagaatcatgaattcaaggccaacttttttttatatatagactttgtcttaaaaacaaaacagctagaaaaatcacaaaaataaatcttatacttaaatagcaatattgccatgttggacagacagactcttggtttgcactgtagctaccaggctacatgtagtcatgggtatgttct

SEQ ID NO: 18413 - DNA, 1175 bp, Mus musculus
ttctgaacagtgggaattaaattttatcatatggagctttgagaggaacccaaattctgtctaagccatggaacacagctattgggaatcaagctggtcttggaacacaggctgtgtggctcccacaatctgtgtcttaatcgtcatgctgggtttgaaacatgataaattcagtagccattgctactatttattccttagaactactgaaaatgcaggaaggagaaaaattacaagtttttccctttagatattcccagaatgggggggggggtgggagtcctggaaactagtagctatcaagtagggcagaggacataaggtgctagatagtatgtcacatagtgcctccagggggggtcaaggcaggtttcagagtccatagtcctccagctaagaaggacagatgacaaaggagcgtctaaatagatggtacctactgggcctacagaagagaacacagggagactggagcaaggatgcacttgacatttgactttctagacaagaaggccacaaatcttgcctattgaatgctgagtttatcctgtggatggtagcaagctactgagatatttcttctgtcagagaagaaacggtggagagagttgcatacgctcagacagtgttgaggacagatgaggaaggcaaggctgtcagggctcaacctagagccccagagtagggatggagaagataatgtgagaggtgaggaccaatccaggatggtcctcagagactggatttctgatttatgatgtattttggaaagcagttgtggccccaacaactgcacagtcaacttctaagacagtcacttgtagaagtagccagtgcccctggtgtatcaggttcttagttgtgtgatgtaaaactccattttagcagacaggagtgagggctgctccctgcaggcagtgtagacctaaagagccaagttgtaagaagggtgtgtgggaggaactgcaggggccactaggagctgttcactgtagacttccagcaaggaagtgaggactttagttactatactacttttatattgctgtgacaaaataccagaatcaacttatgggagaaaggatgcattttgactgatggttgggagaccctaggtccattatagcctagaaagccataaagcatggcggagcttgtggtaggtggaacagctt

SEQ ID NO: 18414 - DNA, 4068 bp, Mus musculus
aagacatagggccttagtatttcttctttgttgggatgatgggataggtttcttcctcctcctcagttttcttgtgtatcagtctccacaggttgagggaagggtacagctcttactgaaccagtgaagactcttggagaactaagttgaggaaagggcagggcatattggcacgcagatgcagaagctgataaagctctgtagccttgcaagtgtattgactgctcccaccctgaaccctctgttgaatcctgtgtctgctcctctgcagataatgtgatcaatgggcaggactatgaagtaatgatgcagattgactgtcaggtgatggacaccaggatcctccacatcaaaagctcctcggttcccccttatctccgggatcatcagcggaaccaaaccagcaccttctttggttcccctccaacaaccacagagacgacccatgtggtcagcaccatccctgagtcgttgcagtagtgcccgagctgcgctggacagcagagactgaagagctggtgaagatgctgctctctgcctcttcggcaagcagagacttgccttgtacgcaactccaggggaagaggaagagagaacaggaagtgcgctgcttgtcaccgtccacccagtggggtggaacatgctagcgagcaattctctggtggcagtgcagccctgtgggcagtgtcgcctggtgttggttctgctgtgtcatctttagtgcttttctcaatgtgtgtttggttctcagttatcttccttcaggtcagacccacttcctcttctgtccactgcacttcctggtgcagtaaagagatttgtatttaaagctttagaacacatgctcatgtggtttccaccaattggctttctctctcctttggttcaaatccattctgaatgttatacttgagaaaacacatttcaaaaaaccgagcagccaaaaacatcccacaaagagtcaaaacagtttagagtttgggtaaagggattatctccagttggtaagagtttatttttacttgtgatttgtggttcagccctggacaaataactgttgtgggggtcacagagtgagccacacactggagacaagggaagggaaggccagtggtggaatgtaaggggaagtgactccattttcatatgtatttaaacacagagttcctgtggcctcggtaagctcagagctatagccaccctcagtgttggaactcggctaatcagcagagatcttcaaagatctcagggcacatgcttgcctctcattgtggaccctcagcccagagcatactcctgtgaaaccagactcagcaaagggacttggaggtcactaggcttaagcaagactagagagtttcccttaaggaccaacagtgcacagagcaagcatggcttcccagagaagctgcagcacagtatggtgaagttctcagtttttccagtggaaagatgataaaggaattaagctctctttgttgttgctatggctgtgaacatggctttaatcctagcaccatttggaaggaaaggcaggctttgtttgatatcagcctggcctacatttcaaattccaggacaggacagctaaagctatataaagaacccacctcaaaaaatagatgaatgaataaatgagtaaataaacaaatacaaacaaaaagcaaagttatgttcacatatattttattgtattttgcctgcttccttcaccatagcaagcagccacatttctattgcactgtacattgtacgttacaagttcacagaaatggatgccaggactcatgtcagtcatgtgctgcctcccttcccaggatttcagcaggttctcatagactcttcccagctggcttgccattgtcaggtggtcccattccagtaagcacaatggcggctaagtcctcttctctctacaaggagtgacacacagtcaggtcatcttttgcctgtggccccattatgcctggcactgttcaccaacaactgttccctggacagcactgctgccatctaagctaaggtgagatgttttcagggcagggccattcttgctgaattcagtgccgcagtccatcctgattggctctcgggtgattttcagacaagacctgtttgtcccgggggctggtcctctaatgggtgccaaggagaagataccaaatacatggagtacctttaggagtagccatttgtgggggaggtgggctaccctgtggccatgtccttcctgcctgtgaagcagctcaacacgaggatgtgactgtggctgtggacagaggcagcacacgcattcctgatgctgatctgctgagacacgaatagaatctgcagtgactccagtgtaccagtgcctcagatcaaagacctcaatagtgtcacgtttgctaaggctgatgcctctcctacaggtaacagtggggatgaccgttggaaggcacagccaaagagcagacagaagttaaggtggccacagcacaggtcagggatccaaggagctggggaggactgctcaaaactagtctggaagcttgccttctctgctcctgctgaccatcaggtcctgtcattaccactctcaggtccgtcttatgagatgaggaatggggccctcctcaggggagagtttcagaaatgagggaaaggcaattatagatagaaagaagtatcctgccatttaaattgctgaaagagctagaatccctgggctcggtagtttgtatcttaatgtttgtgcgctagcacaggcccattggagaggaaaagctgttgtcctgggagcaaagtaagcagccattcaggtctcattttttattttggtatgcttgcccttgggtgtttatagtccggaactgtaggagctatgtatgtacataatatatatattttttaatttattaagttttaaaatgtgatttttcaagattatgaaaaaattaaataaatttgagctagagaaatggctcagtggttaacttcgcttactgctcttccagaggacccaggttcagttcccagctttaagccatctctaactccattggggacaggctaggggatgggatcctctacctttttcaggcctctgcagacaccagacacacataatggtgcacatacatgtgttcaggcaaaacgctaatatacataaaaaataaaaacaaataaatctggtttttcaatcagataaattcccagaggaagtcactccacctgttactagataattttgtgccctgggctgatggtactgtgatgttgggaagtgttgctagaggctggcagtgtggtctttcctgtgtttgcaagccccccacttttaaattcagtgggagtaactgcatgttccctcctgttaacagaacagcttctctctgcagttagctcataaaacagcttccttagaatagaatggaaacccactttcaagttaggaggtgatgagaacggatgcttgagagatgaatgtcagcagcacaaagctgtcccctttgcctttctttctcattagcaagaagtagaccctgggctggccagatggctcaactgctgagagctcttgctgcatctccaggagacccaagttccattcctaacacccatgacacagcccataacccctaactccagttccaggagatctaatgccctcttctagtctcccttggcatctgtgcacacatggcattcactaacacagttacacataaataataatattaatcgtgaagcagacaaggaagtactcaaaaagttacataatgtgcgtcattcctgaattttcccaataactgtcacttgaaaacagagggaactgactttctctcgtatgtttaaagtgactgtcgtggttcaatcttgttggcccaaatctccatcctaggcaaatattccccagtcgttacagctgcccaatgctgttagtcatggctgccataactagaacatttaactcaagacaactcccacagttccactgtgagactgtaagactgggaatttatctaattaaaaagtcagtcttgctgttttactatgaaacttgacagaaatgtaccacagcaacaa

SEQ ID NO: 18415 - DNA, 1210 bp, Mus musculus
tttgagatgccagagccattggttatctgccgaggaaagcagctaacagggagtggaaccagcccaagagaaagaagtttgttgtagtcaacaaagatgaaaaaggagttggagatctgaagaatgcgttaacatcagccttggagatacagagtttggactttgcctagctggtttcctgtcttgctttgaggataacagttaagtgatttgatgaatctcagaagagactttgaactttggacttttaacattattgggactgctatagcctatggggactttggaaattggactaaatgtattttgcattatgctatgtttaggtatggtccccatatactcatatgtttgaacaagtctatggggaccagggagtagaatgtgatggtttgtatgtgcttagccagggagtgccactattagaaggtgtggccgtgtttgagtaggtgtgtcactgtgggtgtgggttataagtctcacattctagtttcctggaagccagcattctgctagcaaccttcatatgaagatgtagaactctcagctcctcctgcaccatgcctacctggaccctgccatgctcctaccttgataataatggactgaacctctgaacctgtaagccagccccaattaaatgttctttttaaaagttgctttagttatggtgtctgttcacagcagtaaaaccctaagacaatgaccaaaaagcaagttggggagagaaggatgtatttgccttacacttccatatgctgttcttcattgaaggaagttaggtcatgaattcaaacagggcaggaacctggaggcaggagctgatgcagaggccagggaggagtgctgtgtactgatttacttataggacccagaatctccagcccaggggtggccctacccaaaatgggctgggacctccccaaccaaccactaagaaaatgccttaaagctggatcttgtggaggtattttttcaataacttccagacaactctagctagtgtccctgaagctccatgcctgttggcatggttgtggcagcttcgagcagcctcatttgtttatactgcatgtgtggttttctctgagcactcagatgtgaagagggtcagaaaggtttgcacactgagttttctcagacccaaccatttcactgagatggcagatcaagacaatatcttttggaaaaactaccaagtgagaaagta

SEQ ID NO: 18416 - DNA, 1202 bp, Mus musculus
tcagggcaggaactcaagcaggaactgaagcaaaaactatggaaggacattgctcattgccttgctgtctggctcatgctcagctagttctctttgtagcttgcctgcctaggaatggtgttgcccgcagtgggctggcctctccacagccatcatctcagtttctcacagacacactgacttgggcaatgactcaactgaggtttcctcttccctggtgaccctaggttgtgttatattgacagtaaaatctaaccaaaatattgtctagaggaagtgaatggcatttctgaggatgacacccaaggttatcctctgatctccaaatgcaagcacacacaaacacacacacatataaacatacatacacactcacttatacccatacatagatacacaaatgcacgcatatacacacatgtgcatgagcacaaaagcacacacacacacatacacacacacacacttcatgtatataatttttaattaaaaaatattaaatacttacctggcaggagagataccatgatcacgaaggtggctttcccagggcgaggctcacccattgcactttggggtgtgctgacccctgcgatttccccaaatgcgggaaactcgactgcataatttgtggtagtgggggactgtgttcgtgctctcccctttaaaaaaaaaaaaattaagcccaggcctggggagattgctcagtggttaagagcactagctgctcttccagaggacctggatttgattcccagtcaattttaactccagttccagggaatctgacatcctttctctggcctctgtgggcaccaggcatgaagctagtgcaccaatataatgtgggcaaaatgcccatacacataaaatcaaaacaaaaatggttaaattaaaaatatctatattgagctggactgaaacgttgtttcttgggaggacagctgtgtgctccctgctgcttcactgttggtcctgaaaaccccaggctttcccttttccctgagatagtccacatcttttttttttttttttttttttttttttttggtttttcgagacagggtttctgtgtatagccctggctgtcctggaactcattttgtagaccaggctggcctcgaactcagaaatccacctgcctctgcctcccaagtgctgggatcaaaggcgtgcgccaccacgcccagcgatagtccaca

SEQ ID NO: 18417 - DNA, 1191 bp, Mus musculus
atactcacgccctacacgcagacccagataatccagccccgcacgatgtcctccagcaaagccgccccgggtcctcaaagccttttgctggccgctggcccagcgccctggcgcctgccaacacgctaccctcagccccccgccgcccctagcgagccctcccatcccaaccccaaccgcggtgagctccgggtgtgcccgaacaggtcagattgtcccacaacctggggttatcgctgcgttggtggtatagtggtgagcatagctgccttccaagcagttgacccgggttcgattcccggccaacgcataacattttttgttgaatactggatctttctggtgcctctcagcttgtatcgagactgcgtgacctaacagaggcttgagatattttgaggatgtggccagcgggaggagtcttttggaatcttctgtttacggttgcccatcaaaaagctaagttaatagtaatgaacttcagatcagatctaggtattcttcgcgagaggaacctcctatcactccctggtggtctagtggttaggattcggcgctctcaccgccgcggcccgggttcgattcccggtcagggaagtgctttttcttaaaacttactctgagatatttactccactagttcttagttttcctacctactagttttctaatggtccttatgctgcccagcaccacctcaccatgcgtatgtttagaatttctctatgactctgcactcctgtccatttaaacacatttgccctcaaatgcacacctcgttcctgctctttcttttcggagtattttacttttgcacatctcaggctttctgcttcccttggcgcccagccggaagtactgccaccatcacacgcccacacacacaagcctcgcagagcgcccagacttgtcaaacacatcaccggcccttaactcagaaagaagtcccctaggaatggttcttcctggttatcaacttgacactatctggaatgaactacaatccagaactggaaggctcacctgtgatccagatcttgaggctgggagatacaagtttctgatcttggcatggagatcttgaggcatagtgactatagatcccaggagactagggtaaggagatctccagagttcaaggtcatctgggacaaatcctggtggtacacacctttaatctgggccacacct

SEQ ID NO: 18418 - DNA, 1688 bp, Mus musculus
tacactaatctgaatcatataacaagatcttccccaccccagccgagagctgagcccagggccgttggcttcctagacagatactctcttccaagtcaaacccccagccccaataacaagattctatctcagaaaacaaaactatgttttgaaggaagacttttccagaaacactgatctcgatgtgctgtcagctagagagaggagattatgtctgtacagtctggaagcttttgtgtggagggcctttggcattctgaagagcagtcacccatcagtaccacatgagatgacttgattttcatcactggggctttcagaagtgtgaaactgggacatagggatatgctgcttttctcggaaccccaaaaagggaaggaagtacccgttcagtaggtagaacatttctgagacaggaattgtaagagtgactggaattctaattgctgaaaattaaaataaaaacttgtcttcccctcttttttctacagctatgggacctaggaaaaggcctggcaataccccaggtctggctgtctggagtggcggtcgtggttcttgctgtgttgtcctctggcgggctggccgccctgtgaagagctggagttcccagcacccctgtacatcatcaaactgatttatattcctgtttatcactatccccacccctcccccccagcctcccaggttctcctgatttgtttagatgccacatgctttcaatccccttggagtgcagtagagcggcttaaagacctgttgtagtaagaaagggtcatcctccctgggcctgggagcccttgctccggttccacatttgactgatttgtgctgagggtcagctttccgctgctttctgctgagacagtggaaacaatgccagttctgtgaccgccccgagtgccactgcctgtgggctgctggcttaaaggacacttctgtccattggtcagcttagggcctttagcacccacaccgcgtgactgagaggagagaggtggaggaggagggattgtcctgctcagctagagggagataaagagcagcctgggagcttggagctcgagcctgggaacagatacagcttttgatgtatgaggaagatcaaaaaaaattgtattaagtttctgttctgtttttcatttctaggaaaatacacctttaatgtcatattttctaatctaaattcttgtaccatcttctttggaaacgattaaagtactactcattttatgcttgactctttggaatctagtgacaggtgggtagaaagggtctaatctctgcccctccctttggatcttggacatttacaccctccagtatggagggaaatagtttgcccaacaactaccactgcgaaaaatgaggtaatcacaaccaagtagtggagagattttggtcaaggaaagaacataagaagtcagctaagcatgcggggagcttttggggtgttgtagggcccaggcctgtggatggccagcttggtacttaagcagaccatttggttatggacacctagcaccagtggaggtggaggctaagggctaaatagatttggggggaggtaggggaagtagaagagaattttttaaaagcagggcaggattggaggcatcagagttcttgaagatggatatacagtgggaaacgttgcttctttacccctactgaggccctggatcctt

SEQ ID NO: 18419 - DNA, 1208 bp, Mus musculus
aattggagttgcaggtgtgtgaacattgataccacttgggtgctggaaaatgaacccaggtcctcggaaagtgaagccagtgctcttaactattgcgcctacatgttttgtaaagtatatttttattatttttaactatgtgtatagatttgtcgggtatgtacacatgagtacaggtgctctcgaaggctggggggggttatgattcccctggagtgggagttacaggcggtgccagcttctcagtgtgggtttctgggaaccaaactcaggttctctacaacatcagtgtgcacctgtaactgctgagccacctccctggtccctcatgcatggttttatgtggccctagatttcaaaaccggggcttatatattttggcaaatgatctacatccctagatagcaacaaattttctcttatttcaaagtggtttaggattatatcaggtgtcaagagctgtcataaaacccagtttaatacattctgttctttgtaactgatagctgcgtgtcctctctcaggggtctctctttttggcctgtcggcactgctgcttcctgggaactttgagtcatatttgatgtttgtgaagtccctgtgtttggggccaacactgatctactcggctaagtttgtgcttgtcttcccgctcatgtaccactcactgaatgggatccgacacttggtaagtttcttgtgggcgaagagcgggagggctgggaggctctttccttcatttctgagcatagtgttcttgcaccttttcctaccctcccatccccctctttttaatgctaaggtcactgaaccaagagccttatcagtgctgtacctttgagctacacctctaaccttagagctagtctttgtttgcttctgagacagagtctatcactatgtatccctggtgggcctggaccattctatatagatcaggatggccttgaatttgggattttcctcctgactctgcatcccaggtgctggaattataagcatgagacaccacatatagcctaaccttatttgactatctgttttaattttacttatttatgttttattcagtgtgtgtgtgtgtgttttgtacatacgcctgtgcatgtgtgtcagtggtcctgggcttgccttttcctgagccgtcctaccagaaccattcttttttttttttcaggaccattcttaaggctaattgtactgggtct

SEQ ID NO: 18420 - DNA, 1208 bp, Mus musculus
ctctcaagtgctacaataacagacatgagctcttgtgcccagtttgaggattttgtagtggtggtgtttgatttgttttgttttgagacagaaacaaggtctgtggctggcttagaattctctatgtagactaggctggcttcaaactcatgaacgccttccccagtgctaaggttaaccgtgtatactcccacgccggccagcctttgggtgagatttttaagagctcttttctgcagacttgggtttacactgttgccacccccatttctgcaggctggtttggacaagatgtctaagggacacatgttggcagatgtcgtggccatcataggtatgagacctttttattatatagcaagatgtttaagacaaggggtttgggattctgtatgggagcaaaaaccaaacacttcctgttcagcatagactgtgtcctggcctctgggccggagtttcttggacatcataatgtcctctggacctctggtgataacatttcattctctaaccttttaggtacccaggatattgtgttcggagaaatagaccgatgagcgaaagcaccaccctcgagctgccttgcctgtcagctgctccttcgaggcctgtgtctggtgggagacaaggctgtgtgtctctgtgtgtgtaaacaaacgtgcacgtgctcgcacttagctgcgcaggctttctgtgcatgaactagaaaaggagacattatattaaattagccaccttttggcccctaagctcagcttgtaatgtgtctttcttggtgtcttgctgcctttcactttgtatttctctgacttagatcttaattttcccagctgatctccacccccctctctgagtcttactctttccacttctccattcctcatttcccctttcccctcacttcctcctgctccgaccctcttggtatctataaaactgctaactcaaatgacaaatgggtatataaagttctagataggaaggtaagggttatggtgggtgtctagcggagtctctaggggcagtttgctgcctacatagcatgcatctgagtggtgggtggttaaatatggcagatatagacaacctttccccagcatgaaagcctgctcattcagtggtttaggttggtccctgaaagggctgagtcttagaggccagatcgtccagctccccaaaatggcccttccgggagctgcctggtctgt

SEQ ID NO: 18421 - DNA, 1366 bp, Mus musculus
cctggactcaactgtgatgtttagattccagattctacccagaatgatctgtacgatgagccctcggctcccacatacttctttctttaaaagaaaaagaaaaaaaaaacacccatgataatatatatttgtttatttactgtgtgtgcgtaaatgtgaaacagtatacatcaaggcgtgtgtggggaggtcagaggtcagcttctggggagtcggttccttcctacctaccatgtgggctccagacttgttagcaaacgcctttctctgcagccgctgagccatctttccagccccttccatcactccccgtctttccgtctcacagtgctctttggagagatcacacggattttaaaccatatcatggctgtcaccacacatgccctggacatcggtgccatgactcctttcttctggatgtttgaagaaagagagaagatgttcgagttctatgagcgggtgtctggggcccggatgcacgcggcgtatatccgacctggaggagtgcaccaggtgagtgagctgctctctggcctctctcctctgccaccactggagggcagtgtgggctgccggagctctggccttttgagaagcggtgctgtgacaggatcaccacttggcttctaggacctacctcttgggcttctggatgacatttatgagttttccaagaacttctctcttcggattgatgaggtggaggaggtgagacagaactcgacgcgagaaagatacctttatctcccagaaaggctggtggggttttagtacccagcagagcgtaagtacagaggcgtttagagattgtcacgaagaatatcagcacactggacttgtccgtccatagatgctgaccaacaatagaatctggcgaaataggacagtcgacattggggttgtaacagcggaagacgcacttaactatggattcaggtaggagaggccgtagaggtacagcccggtgtacagcccagtgtcttgtttcaggtgtgtttggtgctgtcctctccatgcctggagtttctgttccatagccagatgtggggagggagatgggaggcatgcatgtcctctgttgtggggggtgggagggaggtgggaggcatgcgtgtcctttcttgcggaggacggtcctatgcccattatgccctatagtggggtgatgctccgaggctcaggcatccagtgggacttgcggaagacccagccctatgacgtttacgaccaggtggagtttgatgttcctatcggttctcgaggggactgctacgataggtaagattcgtatcatggctcagctcttcattcctgcctgacttctctgagctctgtttcctagtatctgtaggagcccgtggaa

SEQ ID NO: 18422 - DNA, 1198 bp, Mus musculus
gttttggagcagaaagaacccgtgggcacttttcctgagcccaggggctgttttctttttcatcttctctgaaagtccctagcccatttaaaaactttgcctcagattttggcacaagccccaaagcccttctggctttaacgaggagccttccacagttagggtgtggagcattttggtgccgcagatggcctcaatccatcccagctgcagcccgggtaccatgtcccagatgggcttgcatcccaggaggggcttgactgggcactggctgcaaagattccaaccctgcttgccgcttcacactgtgcagtggcggaggctgctgctgctggccttcctcctgtccttagcgtggcccgccagccccctcccccgggaggaggagatcgtgtttccagagaagctcaatggcagtagcatcctacctggatcaggcgttcctgccaggctgctgtaccgattgccagcctttggggagatgttgctactagaactagaacaggaccctggggtgcaggtagagggtttgactgtacagtacctgggccaggcacctgagatgctgggtggggcagagccaggtacctacctgactggcaccatcaatggagatccggagtcggtggcatctctgcactgggacgggggagccctattaggggtactgcagtaccgtggggccgaactccacctccagcctctggaaggaggcgcccttaactctgctgggggaccgggggctcacatcctacgccggaagagtcctgccagcagccaaggtcccatgtgcaccgtcaaggctccttctgggagcccgagtcccatttcccgcagaaccaaggtaggcaactctggagatcatgccccgtgcccgtatcattcctcccgccatgtctgccctactgacccctattcaccctctctcctcccacttccacttgcagctttccaacttctctccttctctctgcctttcccatctccactaccctttctttgaaaaatcctggctactccctgcttcggtcctttgctttgctctgaggattccctgaggtaggtcagattctctgggccggaatgacctctccccctctctcccccgccccttcctggccctggagtctcctgctgacacagttcccagcagtaaagctctcccaacagcctgttggcctaggctcttttctctgcc

SEQ ID NO: 18423 - DNA, 1302 bp, Mus musculus
ggaaaatccccacaggtaggaaagaaatgtttattggagtctcgggtttcctgtctctttaggacactctacatgtccctgaattctagactcttcctttgagatctcttaatcttacaacttctcaccctcagatttgacctcctggtccgtacccagaattcttggacacaagatggaatgaactcactaacgtaccgactgctggcaagagagctgggtcctctctataccaacatcaccgcagacatcgggactgaccctcggggtccccggtctccctctggtccccgatacccacctggttcctcccaggccttccgtcaagagatgctgcaacgccggcccccagctaggcctggccctctgcccactgccaaccacacagctccccgtggctcacactgattctctgcccactgtaatcatgagactgaattggaggggttgtgtccctcacacctctgctcctcactgctctcagagggatgtgagggaattaaccctagtgctgtgctagggggcagggacctcttctcactgctagattggagctgggctcctctagacctggaggttcctctttctaggggtcacctgtcagggcttatgactgtgaatctttgatgtcattttatgtgacgaatcctgggagtcctctgcccctggggtaggagcagggctggaccccaagtcccttcctcgtccatggacattactcttttccaagagtgacctggcttctcctgggacctctgtgaatatttattctatttatggttcctaagaagctgtctggtggaggaaacccctagccgggcatttcctgcgagtgctggaatggctgctcctcctctggtcttggccccggaggggcgggggctgggattttgatatcttttctaataaaggactttgtctcacctttgcttgtgatttctgcatctcaggccacttaatcctctcccaccaccctcacccctgacaagtctatagggtgatgaatagtaaagagcaaaccaagctctaccaacttttactttcatgagtaggaaagtgggggtggggacgggacagggggcttgtcagctgttagattctgtgcccaggacagcaactgctgcctggcgcccactctctatacagtcattgacagcaaccccctcataggaggctccagccaaagtcaggggcaacctctgggccgtcaggaattgcatagctgagtctgaaaggtaagggtgaaagcgttttagctgaggtctgacaccctcagcacagccgctcgtccgtccagcagct

SEQ ID NO: 18424 - DNA, 1209 bp, Mus musculus
  misc_feature (20)..(20): n is a, c, g, or t
gtgtaagttgggggtgtcangaaaaagcaacttaggtgagggcaccctgacctaacactatttgctgtttatttaggtgtgtgaccgatgtcggcagaaaacccgaagtaccaaaaagttgacagtacaaagattcccccgaatcctcgtgctccatatcctaatcttcacgttcttatttctcttagggtatctcccatacagtgtctcctcgccttcgtttgagtttcccttagggaaaacctgccaccctgactttctttgccacctttcaggatgtgttgggggaatggagggtactgaatttattactgcagtcccccctagagacccttagcctccccagtgctccttaaccagggcttagatctgaaccgattttccacctcccgaggctccatcaagaaaagttcagtaggtgtagacttcccactgcagagactaagcctaggggactttgccagcgacaaagcgggtgagtctggcagggaacctcctaaagaatcttcaggagggagacacaactgggtgtggaaactgatgttatttaacccgcaggaagccctgtctaccagctgtatgccctttgcaaccactcgggtagtgtccactatggccactacacagccctgtgccggtgccagactggttggcatgtctacaatgactcccggtgagaatagcctcttgttcaactcctgccccctcccaccgccccccccccagctccgaaaagataagttcctgacaaaggataggtggagagtctctcctgatctccacctggctactctgagtcttgtgggatggagggggaatctacaagaatgaccactgaccacagccgtgtcccgtttctcttctcagcgtttcccctgtcagtgaaaatcaggtggcatccagtgagggctacgtgctgttctaccaattgatgcaggaaccacttcggtgcctgtgacaccatcttgaagccctggcacctgtgaaaaccttcccaacacccttaagcccccagttacctcacagacgtctatttttgtgtctttttaatcggggaggggaggagggttggttgtagctcccgttattttttttattaagaagtacccttccgccttgttttcctgtcccatgtacagaaaccaccagacccttgaccatgtacagcccccagaacctctgcaatctcacttttttgtgaataaattt

SEQ ID NO: 18425 - DNA, 1180 bp, Mus musculus
tctcccccaaccccttcagttctatcctcccaattcccatggctcccagcccttcaagctggcagttacatccgttttccccagtttgttccttcctagagattttctagccacagaagctcctcccgcctgcctgctctcctagacattagcattgaatcccttccccactgtcaaaccaacagcctttgcagatgtgattggtgccctctggcaccctgactcctgtgaagctgtgaatcccacccgattccgggctgtcttccagaaatacgtcccttccttctctggatacaggtggggaaactgagagaatgggatttctctctggctccggttgggggcggggacaagctgaggctctggcagcagtgttgtaagccttgagatttcctacactgaggaaacgggaacccacatttgggcagggggtactgtgtggaccacgaggggatggatcagatgcccatattctgtctggctgtagccagcaggatgcccaagagttcctgaagctcctcatggagcggttgcaccttgagatcaaccgacgagggcgccgggcaccgccaatcttggccagcggaccagttccctctccaccttgccgaggaggaggggctctgcatgaagaacctgagttgaggtaagggttgttcccccttgctcctctccgcagtacttctatcagctttcagttatcacggaactgagctaaccgaaactgaaatgtagggcctaggagagaccctttagcacaggaaaaaaaaaaaaaaaaaaaaaaaaaaaagaaggaaggaaggaagggaggaagatgggaaagtacatatagaggcagaaaatagagtcagagatgcactgagctggggaaggagagaacgtctacaatcaaatatatcaaagagcttgtagaggaagatggccctgtgtatatgtgtgtgtgtttatatatatacatacatatatatgcatgtgtatatatacacatacatatataaatgtatatgtatgtgtgtcctttcatcttggatttccccagaaagttcccaggggcattgcttactcctttgactaggaatttagggaaggagctggtatgtggacagggaccagggttccgtggataatttccgtggttggggccgcccagtactatagctgtctcacaggttgctccctt

SEQ ID NO: 18426 - DNA, 1441 bp, Mus musculus
gagagagagcaaaggtagccttagggaagagcccaagagacaatggtttccccagagcctgctccagctgctccagagtctagggggagtccagctctcctctgtcaagcctgagcaaagtacttagctgaccttgttctccattctgagcactaacaatcttcctgtgttcccaagaggctgctctacgttaagactgtctcacgtgtcaatgctttcctctcgtctttctcacaggggtggcaaaatatgtctgactgatcatttcaaacctttgtgggccaggaatgtgcctaagtttggactagctcatctcatggccctgggggtgagtttgttaatttcggtgtatgagaggaagagggagggttcagggataagtaatatcctacacgtagctgagactagacattccttgggcatgtcctcctaggctctaggacctagagtctccggggaggagactcaggtggaacaagaggcatggactgtgacagtaacttcacagggtttcccttgcattgcagctgggtccttggctggcagtggaagtccccgatctgatccagaagggtgtgatccagcacaaagaaaaatgcagccaatgaaggactacgcccctgaggccggactgagggaccgtggctaggctccattcctgtttgctcctttttcaggattccttcaagggtcacctctggctgttacaaagtagctggagggacaaataagaaaacccaacaatagggcaaggtcacaaagtttctaaatgaaactgtacagagagatgaaagatttgggccttgaaataggcggtttgtatcccttctccaagtagagccctggaggcattttggaggcctggggtgtaacttacagcacatagctttttggtttctggagacaacctgtcaataaaagctgcttcccctggtagcctgtggttctcattgatggctgttaagaaggtgaacaagcaaaacgcggaggtacatgaacaactacactaggttgggaggagggtatgatagaagaaaatctggtttctttccttgctgttggggttcactttttccctttagcagtgaaccatgttttacttaactgcctgagcctacaaagaagcttgaagaatgagttttacaggtccagcgttctcttcccactagggatctccccacccttaggtggagttgctaaatgcttctctattggtttgctggctagacctggacctgcatgctgctttctcactgcatccctcttgcttccgaagaatctgtgttgtaagcccttccgttacttttcgactcttgggctcttcatctctatggaccatatatgactgggtgaggggccttggcctcagggacttgcagcaatggtttaaagaccaccatcaggcagggcctgaaactagtggttctaaagttggctgcgt

SEQ ID NO: 18427 - DNA, 1823 bp, Mus musculus
cagacctgtttctgccacaatcgcctcgcccacctaggatggagtcttaccacgtaggtaaattctactgtgtgccacatctgcagcttcctgcaagaaaccacctgctgagcagctgagcttgttttcctgagcagatcctggcatagtgggggatgggttcccccctttaaaagtcagaccctagaattaaaggtatgggatttcccagtgataggttaaataaaattttattgactttaaatgtttaaatgtcactaagacagatatcacagttgctgaaaaacactgaattttagaaagtattgatgaattaaatcagcctatatataccttaacttcagaatagcgggaaggaaataggttggcgaccttagctgcccagttgtaccccctaaccaaagaaggggaggtgtctgtgtggaccccagatcaccagaaagcctttaaagagattaaaaaggccctactgatggccagcctatgcctgacctaaccaagcctttcactctttatgtgaaagagagagcaggggtcaccagaggagtccttactcagactttgggactttgaaaaagcccagtgacttacctatccaagaagttacaccctgttgccagtaggtggttttcttgcctgaaagctattgctgccataatctgcttgtcaaggatgctgataagctcactctgggacaacaaataactgtagtggcatcccacactcttgaaagcattaccaacgctcctgtgacacatcagagctttttgttgtctaaatgagtgaccttcgcttcattccacctgctgtcccactgtgtgagactgcacctactcatcactgcgctgacattctggcagaagaaatgatctgaattatcagatcagccttggcctgagggtacgagctggtacactgatgacagtagcctcgaggttaaaggtaagcaaaaggtggggacagcagtatggtggtgaacagaaagcaagtgatctaggccagcagccttcctgagggacgtcggcccagaaagctgaacttgcgactttaagacaagctctataaatggcaaaagaaaagtctacactgacaacaggtatgcttttgccactgtacgggacaatatacaaagagggctgttgacatctgcagaaaaagacctaagatgctgtggctaaagaaaatcagatggcagatctaaccgtcaagcaggtggctcaaaaaacaatgatcctggcagtcaaggagtctaaagattattatgacatcagagagaccagctttagatacaccgctgagcactatcaagctatagacagtatttggcttggcctgggggccaagaaattcaaaggtgtggttaggtcctttgactactatgttacaggactctctgacttagcagaagaaatagtcaaaagcttcaaggcctgtgctataatgaggtagaatttctaaaagaaatcttcccaaggtaatggacctgcctttgttgcccaggtaaatcagagactggccaagatattagagatcggttaaaagttacattgtgcatgcaggccccaaagctcaggacaggtaaaaaaattaatagaaccattaagagacccttaccaaattgacagcggagactggcgctatgattagatagctctcctaccctttatgctcttcagggatagaaacacccctggacagtttagactgacccccctataaattactctacagggggcccccctccactggtaaaaatagcctttgtacatagtgctgacatgctgctttcccagcctttgttctctaggctcaaggtgctccag

SEQ ID NO: 18428 - DNA, 2084 bp, Mus musculus
tggcctgagcagagtcattgtagggcattgtagggcagctccagaattgaaaccagtgacacagtgaagaactagttctggggagaggtaaagaagctgtgagaagagggagggtctcagccttgcttgcttgcttttctagctttggttgtaaacacaatccattataaaccatgctccttaaaattctcccagatatcaggctccgagttcgggcggaatactgccagcatgagacggctctgcaaggcaatgtcttctccaataagcaggacccacttgagcgccagtttgagcgctttaaccaggccaacactatcctcaagtcccgggacctgggctccatcatctgtgacatcaagttctctgagctcacctacctcgacgcattctggcgagactacattaatggctcattattagaggcactgaaaggtgtcttcatcacagactctctcaagcaagctgtgggccatgaagccatcaagctgctggtgaacgtggatgaggaggactatgagctgggccgacagaaactcctgaggaacttgatgctgcaggcattaccctgacctttccccttctcacctttctggggactgttcgctccgtcacctctggagctgacatactgttctggggtttgttctctaccctttccaaccaatcacaccgcctttttttttttttttttttaaaaggaaaagacaaaggaaggtggaagtggtgtccctgccctccctgcacccatgtgcctgggcttccccgtttcctgttgccacttaccctattgtgtgtctacagccaccttaccactgagccgtaagacaagtgtatagggacagggtctctggaacacagcctttgtaagggattgaacactgctttcaggtgcattgaggggtaatcaatacttatggctttatgagggctcttaaattttgtctgaaaaaccaaagggctgtgagtaaaggagctatgtggaaggtgggactctgaagtgtattttggaaattaattaccaccttcttccaaattatagaattttttaaaaacagagaagctgtggccctttgcagtctctcctggccttggtgctgctcctctctgcctttccttcattccacagcgggaactgctgtcgtatggatccctccttgtccctgtcaaatgttcagcaaacttacagaggactgggccagcctgatcgatcaccctcccaactgcgatgtgtatgtgaacaccagtacacaggacagtggagtagaggctgctagttggagcacactttctctgaagaggaggagggggtggggggtatgacattttccttcccttttccagtgaaaataactcttaccccaccccaaggccctttccctttgcttccttcttgcttgagagaaagtggggtatttagtatcagctcctcctgttcctctgccctcccttctcccatcctttggagagcaggactagtacatgcactgagcaccgcactttcttaggtaaggaggcatgtttgaggcaggaggctgaggagtgaagtccagtcaagcaggtacaattccacctccccttctagcccccaaaagacatgtccagacattatgattattatatttttttttcaatgccagtgctgctcagccctcagcataacttcagttttcatgaaataaacagtgactatataaaatcccacttttctgaaactgaaatctgaggtcaggtcaaagtctcttctttcccatggacttgattaagcctgtgttccattaagagaggttaaagttctgcaagtgaagggaaccgtgcttgtgtcctgcctacaagtcacagtagcatcacctcccagttggctgtgtctgtgtcttaaccaacagaagttaaaagcattaagagagtggatgacccagactgccatagaggtcaggtctgcggtgctggaacacaggcaggtgttggcgcatctgttgtagaaagtggagatcaattcgagcaaggcagaggcctggtccctcggagcagcgggccaccactgtgccccacgggtcaaccaccatgctatggccataacttgc

SEQ ID NO: 18429 - DNA, 1200 bp, Mus musculus
atctcaaaagtacaaaacacaaacactcctcctttctacttgattttcttccttttcatctggtgaggaaattcatttcttagctaggtgtgagtcatgttaaagagttagttattaactctagttggttagtgagaagattgggcccacagtgcccgcttcttgtcacttgcctattaaacgctgtatgttctggagtcaacgcacgtctcatcctcaggtgctgctgcgggcccgcgccattgaatctcagtgctatgtaatagcagcagcgcagtgtggacgccaccatgaaacaagagcaagttatggccatagcatggtggttgacccgtggggcacagtggtggcccgctgctccgagggaccaggcctctgccttgctcgaattgatctccactttctacaacagatgcgccaacacctgcctgtgttccagcaccgcagacctgacctctatggcagtctgggtcatccactctcttaatgcttttaacttctgttggttaagacacagacacagccaactgggaggtgatgctactgtgacttgtaggcaggacacaagcacggttcccttcacttgcagaactttaacctctcttaatggaacacaggcttaatcaagtccatgggaaagaagagactttgacctgacctcagatttcagtttcagaaaagtgggattttatatagtcactgtttatttcatgaaaactgaagttatgctgagggctgagcagcactggcattgaaaaaaaaatataataatcataatgtctggacatgtcttttgggggctagaaggggaggtggaattgtacctgcttgactggacttcactcctcagcctcctgcctcaaacatgcctccttacctaagaaagtgcggtgctcagtgcatgtactagtcctgctctccaaaggatgggagaagggagggcagaggaacaggaggagctgatactaaataccccactttctctcaagcaagaaggaagcaaagggaaagggccttggggtggggtaagagttattttcactggaaaagggaaggaaaatgtcataccccccaccccctcctcctcttcagagaaagtgtgctccaactagcagcctctactccactgtcctgtgtactggtgttcacatacacatcgcagttgggagggtgatcgatcaggctggcccagtcctctgt

SEQ ID NO: 18430 - DNA, 1103 bp, Mus musculus
cagcttttataccattctaggtacttgcagagaatagggtcagttcttagatcaatgacaaagtagtcagacaaggctataaacaacgagaccaaacaaggcggtaaacaaagccccctggtcactgtttctaggggcttatcaggatgaccaagataaaaggaatgccacacattgagctttgtattagcccaaatgtaaatactcccatctgagtctacttccttgagcccagtgataagtgcttggcaaatttctacaaggttccaaaagctctccacaatctcaggttgaaagccagactggtaatctgtattcagagaccttgtctcaaaacaagcaagaaaccatgcacacaaacaaccacatctcccaacatatatatcaatagggaacaaattctatgtcacacttaaaaagaaatctggggctagagaaatggctcagtggttaagagctagagaatcctggggcagtggtggcgcacgcctttaatcccagcacttgggaggcagaggcaggcagatttattgagttcaaggccagcctggtctacaaagtgagttccaggacagccagggctacacagggaaaccctgtcttgaagaacaaacaaaaaaaagatctagaggatctgggtttaatttccagctcattactggtatggtagctcatgctttgggggatctgatgccttcttctagcctctttgggtcccaggcatgcacatagcagacctatacatacaggtaagtcacataaaaataaatcttgggggggaaatctttataaaaataagtttttgaaagatctcgtatgtgtaaataataagaatataaagagctctatgtagtaatacgaagtgatgttgatttagaaattaatttaattaatttctaaatcaacatccttcgtattattaattaattaattaattaatttaattaaatggggctatttcagaggggaactttacatacactatgatttaatagggtaaagagactctcaacattgactagtctatccctgtttacatgagactattgaggtttggtctgttgctgtgtattgcaatgcttaaatactggcccccaaggtct

SEQ ID NO: 18431 - DNA, 1187 bp, Mus musculus
cagaccccagagcagtattagcgatgcagaggttagaagcgagaggtggagactgtggccagatccaggtgtgcgggcacagctggagctagaatctgacctccaaagtgggggagctgtgttcccaccccttgggagcaagtgagaagcagacaccgcgggggtctgccagaggccagaactgttacagaagccctctgccctctggtggcctgtgggcctgctgcatgtacgtaccttctgtaaattaaactccaagggagctagcttcctgagttctgcttagactcccttaataagagaaaaagaaactttaaaagcagagaaagaaagaaagaagaaactttattgatgtgtgtgcatgttctttactgggcttgtttaagccaggccaggccacataggcattcaaccaaactgtctagcagaccacggcagggattagtgcctgtggttctggaaagttctcttcctaggatgccttcacccacagaggttctggggagggggctgacagctggaggagtctggaacctggggtatgaggtctgaacactggataagagactagggatgggggggcttggctcccatggcccctcgaatcttgtcctcgctgtgtctacagtggtttgtaccttcacggcgttgggacttgttgtcaaggactcctggttcagttgtgttgagggcagagggtaggtcgcggggaaggtggaagttcaggtgaagagaaaggggtgttgtgggtgagggtgagaacaggcccttccccaggggtttctgagtcattaatccggggctctctggcactttgtatgtgtggagcctggggtaagatgtttgtttttctttagcctgcccaaacttacgcagtcagaatactgggatttagtatccaacccttgtgtggcctgaaatctgctggtctaaaggagaaactctcatttcattcccaagcagcccaggacttatggaccccaaggatctggggtcttagtatgtatatttcatgtaaatatatgtatatttgtacataaaatgatattctgtttttaaataaacagataaaacctttttttgtctgattcctgtcttgccccttgaactgggtaagtcacaagtgctatggactgagtctctatgtgattccctcccagggaaagggcccagatacagctaagaaa

SEQ ID NO: 18432 - DNA, 1167 bp, Mus musculus
cacctgaaggcacagaggggtctgagcccaggagtcggcttagtctgccccctagagagcttcaccctgttgtccctcttgtggcccctcagcgccagacatatgcttttgaaacacagactaatcatgggaaagatgaaggggtatgattaggacaggacaagaggaaccaagaaatcatcaccaatctctggagcacttgcctagctgtctttgctgcctcggcagctgagatgtctaattccataggcttgggtcctccagcttcttgttttgaccatgagaggtacagacttggtggatttacttatgtttgtgttagacacaaagccacttatgtcttagcagagtcttaagaaacatagaacaatcttgtttccagggagttaacaaaaacatagggtaggtaaaagcttttttttttcttaaatttaaatacagtgggggaatttcagccaaacttttgccctattctgagctgtgaatatctcttcacagaagcctactgtagatgtgggagatataggaccagatatagaatagctcacccctgatttgttcctagatttttggctgtcttctgaccctctttagtttcagagtaggagaaacatccaagaagctctttaaagtcctcagtgtttgctgaaggaaatgggtggcatcctctaccttcaattattttgcagaagaggtcctcccattttaggaaaagggaatgttgggctgaagagatagctcagaggttaagagcacctactgttcttccagaggtcctgagttcaattcctagcaatcacatgatggctcacaaccatctgtaacggaatttgatgccttctacgggtgagtctgaagagagcaatggtgtactcattcatatacataaaataaataaagaaagaaaagaaaaaggaaaagaaaagtagagggaatgtcactcaatttggctctagcactgtctctgcacaggctggggctacaggccaccatttagcaatggtgggtatttgataataaaagctgaattttttttttaacatttaaacagtgtatgtactttgtcttattaaagttttgggtgaatggtatcacattccaaagttgccaaaatgtatatatcttgttttttcttatttagatattcttcctcagttgtcatgggaa

SEQ ID NO: 18433 - DNA, 1237 bp, Mus musculus
gaggatgggaaggctggcgggtcactctctactttgctctgccccacagtggagcgccgccgccgggacaagatcaacaactggattgtacagctgtccaaaatcatcccagactgctctatggagagcaccaagtctggccagagtaaaggtggaatcctgtccaaagcctgtgattatatccaggagctgcggcagagcaaccaccggctgtctgaagagctgcaggggttagatcagttgcagctggacaacgatgtgctccggcaacaggtcagactaactccaggatggcccccttggcagccccgtagccactgacccagtttggagtccctggaaaacacttgccattgtccctcttggctgtggctgtggggctgagttcatggcttagcggtgtcaatcttgtttttcctcatcatttcctctccgtgcaggtggaagatctcaagaacaagaacctgctcctgcgagctcagcttcggcaccacggactcgaggtcgtcatcaagaatgacagcaactaactctggggactcaggggctttgggccaaggactgcagccggcccaggagcaacaggctaaccccatgcccctctccttcactgcctcctctggcatgggactcgggggagtttggcaagtgtgtttttgaactgaggccctgtggcgtggcagtctgcagtgagtggtgtgaaacaaacagtgtgggcgtgcactgacagcccggcctgctccctctgtgcagtccccgggtctggtgcgccttcggcacactgcatgtgctgtctccttgctggacactggacacactgaatctgggcttgccgtgtgctcgcttggagtgcctgagagagggactgcgggcctagtacttccactggctcttcctttctctggagcagaagttaagatgcgtacctgagtactctgggaagcaggcttactcaagaggtgggaaaggatgctagctggctgctatcccaggagtagaagggggcccaatgagcagccgaggcccctacggaaggctctggagccagggagaactgtaggcaggggtgggttcactgagagccttccctgctccagggatgggtctttttatttctttccttttttttttttttttttttttaaagataaaattgtttagagccacagttgtctgtcttcctcctttttggggccctgggggaagggagagtgcatattactctttgaccagtaag

SEQ ID NO: 18434 - DNA, 1441 bp, Mus musculus
cagtactcgaagtgaggtgagtgtacctgccccgaggaggggaggccttgtgcttcaagtggccgtttctagcctctttgcgtgtttgtgagcaaaacgagactgtgaagttgactggatgttttatttcccagggggaattcaaacagacctcgtcgttcctggtgtgacctgctgcggctcctccgttgtccatttgccttactcaggtgctacaggttccagccccctgctggctgtagctgcacaggatgccttcaatgtcttctaggtcccacaggaccccttgcttttattctagctagggtataaatttaaaaacatcatctacttccccctcctctttcccaccctccctcctttccttaccaccattgggtggcccgagactaattacaaagttttcgttccccattcctatgtgggattgggcaagagtcctagactagacagtaatagtggctgggctgacaggaacccaaaccaatacctggctgtaaaggcctctgaataaggactttaagcctagctccctgctttctcctccccggatggggtgccagctactctagagggggagctgcagaaaggaggggctgaggatggtgacctcaggtctctagtcttcggagcctctcttctgtctccacaaaatgtgccactgggattctcctggattcaaagtaaactgacatggtgtccgtacgaggtgggagagctctgttagctcccaagagacttggagtaagaaagatttaaagtgatctaaagaaaaggctggaactggtggccattagtcactcttcatttggctggaactaccgcatggaccctttgaagatatgtgtggatggagaagatacgagctttatagtcttggctctttggtggcctcgtgtgtgtgtgtgtgtgtgtgtgtgtgtgtgtgtgtgtgtgtgtgtgtgtgtgtgtgtgtgtgagagagagagagagagttgtaaattgatattgttatatagaagggctttctagctctttggcaaggttgtgtttctgtgtgtttatatttgacagatgttgctggaaataaaaacttcatttgacagacttcttttttgttgaacatggaatattttagggattgtgagctactttgtataaacaagaaaagacacaaaagttctgcttcccagcaacccatggctgattcccaggactatattcttaactcaaggcaaagcttccgggcatcagagctgttccgtagcctcctgctgctgcgtgggcgaggaaggtgctgctgtgctggagggggatttcgtgaagtgggcggaggaagtgtctgtgcactctcctgcctggccttcatggtggacctccccaagtcgtcctctaagggagagttcctccatcatcaaatgtttgagaaagcagcaattagcaagataggtctgatggtcat

SEQ ID NO: 18435 - DNA, 1267 bp, Mus musculus
cctcgattcacccggcgctggttacggttcagcttaatgatgtcgtccaaagacatgtccatcttgtcggccatggcgggcgcggatccgggcctgactggcccggccctcgcggtgcagaccagaaagtactcaaattcaatgattcccccgccttgactccgcctctccgaccggtgctggaatcacaagcgcaccaaaatcacacttggaaattggaagtctgtgcgcttgtgaatctggctttcgctctgacccctggtggccgcccagcgcctagagacatctgggacaaattcgaggcacttccggaaaccgagcgggccacgcggcttctccgcgatatttgcatacccacaatgcagtgcacacagatggttgtataatttaaaagggtagcgtgttgttttcgttgttctgttttattccttttattccttaatgtgatagaaccttcaaagatttatctgatataataaagtagtcagtgtctttaggagtaaatagtcaccattagttgtctaggaaatacagtcggccgagaactgtacactaggacagctgggtatactctggtttctcttcagatcgtataaatctttcgccttttactaaagatttccgtggagaggaacaattctgagtcttacactaattttttgaggccttgctttagcaaggctattaataatgtttaaagttagaattaacagtctttattgtgtgctctatgtatttttttgtcttcagtgttaaccaaagttagaattaacagtctttattgtgtgctctatgtattttcttgtcttcagtgttaaccactgtaaggtaaaaatggcttgagcttaggctaaagagacagctcattggttaaaagggctcagtcgcatggcgttgtgtctcataaccgataaagtaaataagcctttaaaagcaaatactaagtttttgtgggaagtctgtagacatgttatttattaagctgttttttatctagctgcgttatgttgtggtctcagtgaacatatgtataaaccattatttttaatattttatttaagtgcaaggtggttatggacttaaggcacgtacaattttctagcaagatggctaacccagctctgtagctgaggaagaactagcgcccccttctgacttccatcagtgccaagcaacgctcagatacgcaggcaaaatattcatacaaataaaggcagatacattctaaaaaataaatgcagccactcgagcagaagggacaggttac

SEQ ID NO: 18436 - DNA, 1224 bp, Mus musculus
aggggttaggacttctgtgaagatgggggaagcagtcaccatcctggtctcagttcctttttgctgccttatggtgttccgggagccattttagatctaatgtggtgtatggctgatcaggactcttaaaggagctgcaggagcctgtggctctccatcccactctttcctttacaaggctgacctccacattccccacattacagatccatgagcatctaatgagatgatcgtgtgtgtgtgtgtgtgtgtgtgtgtgtgtgtgtgtgtttatttcagtttgttaatatggtgaatttcattgactgatttttgtacattgaaccatccttgcatctctgggatgaagcctttttgatcatggtggatgatctttttgatgtgttcttggattctgtttgtattttattgagtatttttgtgtctatgttcatgagggaaattgatttgtaattctctttctttgatggatctttgcatgatttgatatcagtgtgactgtggtctcgaaaaatgaatttggcagttgtagtctcccctcccccagcctgaaacctgcttgctcggggtggagcttcctgctcattcgttctgccatgcccactgctggaacccgaggagccacacacgtgcacctttctactggacccgagattattcggcgggaatcgggtcccctcccccttccttcataactagtgtcgcaacaataaaatttgagccttgatcagagtaactgtcttggctacattcttttctctcgccacctagcccctcttctcttccaggtttccaaaatgcctttccaggctagaacccaggttgtggtctgctggccggacacaacaattggcgaaccaacgtgggactgagaaacggcaaaggatttttggaagagacgctgctggttcggagctccataaaataaaggataagggaaattcataccggagaaggtatgggctaagctgagacagcattaaacccgagcgctggttcacttaggttcagcagtgaggagctgggtatcaggcggtaggccgtagctctccgaagctacatgaggtgtgagaaaagaaagggtttattaaaaggaataggcggattgccccagttaataaaaaatgcatcataagggaggaaaatgtcccaaaaagcagagagaaatatctctctgggccttatagcaggagtactctgttcccttttgtgtcttgtctaatg

SEQ ID NO: 18437 - DNA, 3425 bp, Mus musculus
agagtttctcttgggggcacagctctgaccctagaggaccatggtgccaaactcctgtgggacaacagctaatcctatcctcggtccctacgcttagccctgagtccctgggcaaggatgcacctgtgacataatcccagaattaggattctctctgcagtcttgctcgccagtgttacagctgtgcttcctggtacacacacacacacacacacacacacacggacacacacggacacggacacacacacacagcacctcacagatacacacactcacacacacacacacacacacacacacggacacacacacggacacggacacggacacggacacacacacacacacacggacacggacacacacacggacacacagcacctcacagatacacacacacacatacacacacacacacacacacacacacagaaacatagaagaaggggaagtgcagtcttctactcaggagtctttactgctgtttctgacttgtatggtcatgtgatcataggcaaacagaggtggaacctctctgaccactttaccagggctgtggggaaggtgtaatgtgtctttcttagacaactcccgagaggaagggcaggatagacccctgaggttggagagacccttgtcactgacctcacttgtccctctgaacccactgacctgttcttccccacccttccccatgaaggatacatgttgacttcttaaggactccatgacatgcagaccctgaccaaccttggggtcgaagacattttgtgttttgcgccagctaccacagtcctgctgaattcgggctccgagacctgtggcctcgtctcttatggggaggggccaggaactccttctcatcccctgccttaaatccagttctttgcctcaggggtctctttaccatggccttccagggtcccatcctcttttctcccgcctcgctttctgggctctttatcagggtgagggaccaggattactgccttttgtgggtattagctcctcgccccattctaactaacacagcctttgcagcaaatctgaacgaatctcagtagtcactttgagcaggattccctaaccctctaatggatatttttcagagtaaacttgagcctttaaattagacacctttaaattattttttaccacaaggactagaaatagggaacacccacatctttctttctgggatccatgcggatgactgtcctggtggcttcgatggagaaatgtccctgtgtcacttctttaaataaccctcaaagcccctgcacgggcccttcacgtccctgggtattctgctggtatttgctgtgcaaagcacgccctaagatggggtacctttgatctcaccgtgcggctgcaggattcaaagtggaagcctacctaccagttactaaagggcttgtccattagggcttactttgttctcatgggaatggtctttggagctgacttacgcagggcctcgaggttagcttagggctgtgatagaggtgcctgaataaattccagtgaaattacgatgtccttgggtaatgggaaggtatcttttctttaaaaaaaaaaaaaaagaaagaaagaaagaagaagaaggagaagaagaagaaagaaaattcaggtttcagaggagaaccttttgagtcacgtaaatacctcactatcctggaaagcagggcccggatggtgattggggtcattgcctttgtgggcaagagcgggttttgctgttgctttgaggagtgggtgggtggggtgggccgaaggaaaagatttgggatcttagttgatgccctaggttaggggcacaggagtgtttattttaagaacctgccatgttttttaatcactgtgatatttccattccttttatcctaaaacaaagagaagaagtttccctgactccctgtctaagcactaagggctgtgacttaagaatggtagcgttttggtccttcgtgtcagaactgtggtatcttcgtctgctttggttgttattattttttaagatgtcaggatgaattgtcaaatgtatggctctgtgtgtgcgaggtgtgtgtgtgtgtgtgtgtgtgtgtgtgtgtgtgtgtgtgtgtgtcttttgcttctccagaatgggaagttgtcttcatgctgtgaactgctatgggtgggcagctgacccagtctctctgagcagtttcctcaaccagcgctgtcccaccggtggctccgtggtttctcatgcttgcactgcgggcatgagactagcctgctcagctctctcaccataggggatgctgggctgggctactccagtgcactctgtgtgtgtgctccggctgggtggcatcctggctcatccccactacacaacttggcctttgttttcatgacctcagtgcgggcttaccgctcttccctctacaccaggacgccgtgcctccacaccaggacaccgtgcctccgtccatcacctacctcgccactgtcaccctccccattggtccctttccagtttctccttaaatgtatgtctttgttctctctgttgatctcccacttcctctgatccctgccattacgctctgtgctttcgctcctagctggctggccacagcattcccgttgtgaatcctgatttaataaagacaaggaggcaggattctcttagtccctgtttgtctgggtccctgctctccctgttggttgggcctagctctgccttgtcccttcctggtgtctgtctgtcggtcttttttctttcctctcttctccccgtggggcagcatctgctgatggattctgttctgattgtgtgattgttgtaatttgtccttctgtgcgcaaaaggaagggcttcttgaatctcttccaagtgagattgtaaatgtagaactttccattgttggatctagattttttaaaatcctttttcttctctctctttcttttcttcttttttattttcaaaatttttaaaacaaatttttggggctattttttttttgtttgttccagagctgagaccttgtgcatgcatgtagaaaattgtaaaatgtaaattttttttaatatataaaaagcttgtttttacatttgcagtggattaaacattatggcaattttagggacttttttttcttaaacataggaactaaaactgtacaaaaattttttttatatataaaataaagacatttgactttagtgggggttttctgttgcttttctttttttcaaagtgggagctaaaggtggtcagggaggagtccgggcggtagggggcagtgtgggccttgtcatgccactgcctccagccagtgtggagaatgaagggaaatgagaaactgcttgctgttaactggattctgaggtgagagagctgtgatggttaatcatctgggggtggggctcagggtgagtgtcagcct

SEQ ID NO: 18438 - DNA, 1574 bp, Mus musculus
gtagcagaaccagtgcagtgtgtgccggctctgcctgtgcttcccactagaagtctcctctacaccaatagcttgagagcatacttaggagagctctgttggacctaagaaggtcttctagtctctcactcctgcccagcctctactgtctggcacagctgggatgagtcagtcaaatagttattgagcccctgttataagtaagtcacaaacataagtaataagcacaactcaatgccagacaaccaaagccatgggtcctacaaagagcagagagagcccggtctgctaactgggaaggcgctgcctgtggttggtgcttgttccactttagtgccagaatcgtgatggcgtttcttcccgagttacctaaggctgtggccttctgagaacgcttttcttccctgcccacaccctcacccttacagttcatcacgctgatcgtgggcttcagcacccttgtcttctccctcatcgtcacctactgcatcaatgccaaagccgacgtccttttcgttgctccccgagagccaggagctgtgtcttactgaagaggactctagctctccctgcctgctctgaactttacttcccagaccaggtgtccggctgggaacaaaccactaatttgtcactggactgtctctgggcctgcttagacggggattgacacacagaatggaactgtgagtggagagatgaataagttgcccccccagccccccttcccatttgtttctccttctctaatcccagggactatggtagagacttgctgctcctaactccccagttacccaccctcctctgccctttctcgggataccttctgtccttccatcctgccctgtactgccctctgactccactgtcacccgacacccctcccccatattcagccacctgctgcaccaggaagagggtgtgaaagattgtgcatctgcattcaactaccctgaacccttagggaagaaatggattccctggctgagccagtgtctctttcccactgtcctttctccaggtgtgcagatggcatgttagtgtgggcacgctgttaagtgggtatcccacctccagcccacagtgctcagttgtactttttattattaaactataattatctatttttgttggggttttttcctttttttttttttttgtaagtatataaatagcaagtttcattaaaattatgcaatacaatttgtacttgttgtttggtattcttcccaggccaccgtgtccagtgaccctggaccagaatgcagtgtgtgctgctttgctgttcagaaggaacatagcgttaaagtgcaggggaagtgaagaagggctctgacagccccggagcccgcttaggagaacagcgttagcgttagcgttagcgtcgttcctgagtattccttcactctgagcaggtacagagatgaagctcacacggcccttcagccttggattgcttggggctggagtgagagacaaggggagatttacgagtagatgtaacatttaggttaatagacgaaagctttgtgatgtctccgtctgggactcagggcacttgaggtgaccga

SEQ ID NO: 18439 - DNA, 1215 bp, Mus musculus
ctccctggaaagccagagagggcctccacagctagcggtctcagtggggtccatctcctctccagtgctatcaagatcacaacctgggtcagaatggctctgcaccaagcttcccattgtgtgctatgcagctcttctcacacatgcacgccgtcatcagcactgccacctgcatgcggcgcagcttcatccagagcaccttcagcatcaacccaggtaggtggctccaagccgtgcaggtggacccaggcagcaggcactgggtgggagagttgtgaagagagccggagctagaccagttgaaggtggagaaatggcccttggggtatatgaggactagtctgaggtatcttgaaggccttctccataactactctctcccttagccctattgatctctgtttgtgtcccactcagaaatcgtctgtgaccccttatccgactacaacgtatggagcatgcttaagcctataaatacatctgtgggactagaacctgacgtcagggttgtggttgcggccacacgggtgagttctgtccctctgcagcatactttaggtatctgatttcaggaagctgggaaaggagtgggagctgggctgttggactcctcagcccaacacacgtgcattctcttgaagcaggagaaggggcttgggcttggctctgatggtccagttttaaagtgtaccaccctttcctatcttctgctgttccagctggatagccggtcctttttctggaatgtggccccaggggctgaaagtgctgtagcctcctttgtcactcagctggctgcagctgaagctttgcacaaggcacctgatgtgaccactctatcccgaaatgtgatgtttgtcttcttccagggggtaagggctttctgcctagggcatgatgacaaagaagaaggggatggtaatggtgggagaggaattattgatctgagctgttaatcagagtttctgcatgggtctctctgtttcgctttgaaacaccccccgcccccctatttttaggaagctcctatttcctgaaattacgtctcctttcttccctatgttgataagatttatttgaggcttcttttcatgtttattgtcccagtccctgtggtgtgacagcctggctgtagtataagttaatagcagccagaactgtggagagtagaagagtctagaagcaagtctgtgacagctggtgtttgctttgagc

SEQ ID NO: 18440 - DNA, 1177 bp, Mus musculus
tctctgaagccaaagagagcacacagctcttcttgaaattgaaggtgtttatgcctgagatgaaactgaattctacttgggcaagaggtgtgcgtatgtgtataaagcaaaaacagtacagagactcctggaggcgaaccaaacacgaccagagtgacccagggaaagtaactccggccagagaaacagaggcatgatttgtgccgaattctgaagcaccttcctgcgaaggccattggacagagaatttgtccaatgggtgatgctgtacccatcccaggtttaaactaaagaaaattaaatatatgaagtggatttgtgcttttgtttaaaagagaaagaaccgtagtaggaactggtgaggtggctcagagtaaagcagtgctgccaagcctgaacaccttagttccatccccaggacccacatggtagatggagagaactgactgcagcttgtctcctgacctgcacatgggcacccaatcacgtacacacaaataaatcattttttaaaacacctttgacaaagacgttagaggatagctttccttactggtctttgcctgtctccttccctaggtccagtgcgtggcattgacttccataagcagcagccactgttcgtctctggaggcgatgattataagattaaggtacaggggatctgtcatggctgggagtaataactacgagaatgtggtggtcaggtttgagaattatggaaagaagtgagagacagaattcatgtgtacaaactttgacttctaacattatccagagcacttccccagcaagtgcttactgaacacttattgtatgccagaagcttactgtgtggggattgaaagatagatacaaagtgacttctgctctcaaagagactttaacacagggataaatgtacactcacataatatgtgtagtttggtgaatgatataataataaatactcaaagaacagtccaggtacagagatggacgtggcatagctggatgtgtttgagaatctccagttggtattggatgagttgggaaggtctagagagatagatacccataagaatattatcttataaatgcgttggcaagtgagcagagcctgaacttgggcaacaccatctgagtagagaggaaagcttaagggtacttgtgatgactgctggagggatagggagaa

SEQ ID NO: 18441 - DNA, 1176 bp, Mus musculus
atacacagtgcagaacaagacagaaccttggcaattatttttgtcttttgtttggggttcgttttgagatttaacaatacaatcaaacatatttactgacattcacagttaccagtttctaaatggacacatatttctgaggacacagttctgagcaagttttgaaagcacgcaccttgcctgtagaggagatcaattgcacttgagacttgctaggttctaacctgttccctctgcccttgccatggtagggaagggaggagcattggctgctgacattgacatcgacactgtaggcactgaaggctggggagaggacgcagagctgcagctggatgaaggtaagaacgctgccttaggactgactgctgagctgttgggctccatgagcagaaaggatttgtggagcagtctacaagcttctggttcatggagccaataggatcctgatactttgcctttggggcgggattcccatgcaagtctattttgatcatgaattatccttacagatgggtttgtggaggctccagaaggtttgggagaggatgttcttggaaagggacaagaagaaggaggtggctgggatgtagaagaagatttggagctcccacctgagctggtatgtgaggttcctgctctgcagtttctctcgatttcaccctataaaaagttggtgcgtgtctctctctgtctctctctccacacatacacacactcacacacacacacacacaccacacacaccttgtagtgtgcccatcctgaagtctgaagtatccacaaaggagaggttccagaaagtcctcctattctgatacatagctccacttgagatggggtagccagcgtttgttgccttgttgtttcagttcatgtgtagcaaaggagaaggagatgtgcagcctccctctaatccaatgcttatctttcatttgaaagagggaagtgtttaatgtctgaactgcagcttatgataggtcattttggtcttggtgaggtggctcccattctgtctttccattaaccatcacctcttttctcaagcaaaggttagcatctaaatgtagtgtgttgatttcaccagaacacagtacttggatggctaaaatcgcctgggaacgtagctcaattggtattacgctttccgagcatgcacaaagcccttgattggat

SEQ ID NO: 18442 - DNA, 1539 bp, Mus musculus
agaagtgtccactcagtggggcctgctattcccctgagttcaaggggcaaatctgcagggtcactacagtaagtactgtcctcaagaatgtgtctagcagggttgggatccaataaaaaaaggacgtgtgtgggatgttgagggaagggacaggagaaggaagcgcggtgctggttctctcactctgcatttgccccgctccctgaggcagggacactgggaaagccagcactttccccactgttcgcttcccagcaccaagcgtccatctgactgctcatcggcggtctagggagtaagccgtctggagttctctaacctgatgctgtttccacttccacaggtgacagagattggcaaagatgtgattgggctgaggatcagtcctcttcagtttcgctaaggcccttccttcgcgtgcatggttaaccccatactgttcttcagagtctccccttacagccacattcagcttgttgatgttggttctccctaaaacgtcatgtcctctctctgctattgcaaatcagaagtttcaagcttgactttctggttcttgcagacctctgccttgacggttactgtgcttgtgatcatagatgactttgcctttcagcttaggccttccaaggaacaatgaaaactatgtgctggccatttgtttatcagattcttagtatatactcctcccttcccaccaccttcctgtcaattccagtacgagacagaaggattcaataaacgccactttccccagccacgcgagttgttaactatcccatctttttcttgggcatttaatgtcataaataggttcctcctttatgtggcccccacacttcaggctgagaagaagccatttggttttgcaaaatgtgtaccatttttcattgatttgtttctatcctttataacataccatcgtcgttatgttctgttgccctcactaaataaagtaaatttctgagagcctcctgcttgccgtttccctgtttgacactcactttcatgaccctgtcacactgtagctgtctctctcaccagagcagatactctgcctcaggatcactttttaatcattagatgcattatattcattttaaactaataccctcgactagggaaaaatgatacagtttttcttagagacatatgaaacacctacattgttggggactggtgtaaagagttccctgtaccatgtttactgcaactctattcatttcaaattacagccagaatttgctgggctcctattggtgtccatcactgttctatgtgttttacatattatgtgcacataaaagagaatgtggccataataaattacatatttactagaagcatatagttgtcttagcttctgctcccattggggtgataaaacacccagacaagagcacgttaggggagacagggttcatttgactcaatgccatgtggcagtacgtcattgcagggaagggaaggtggctgaacctgaagcagctagtcacatgatacccatggtcaagagtgggcagcactgacttcaagcct

SEQ ID NO: 18443 - DNA, 1576 bp, Mus musculus
ggacttttccttttttttttttttaatctcttattctttccgttttctagttacaggccttgggccatcctccaaaagagctggctggggagatggtgagtttgtcttctgtattttaacccagttttcagtttgcagacgccagtaatccttaggtaatccatatagggtgatcactgtggctgctagggacagaccttcagaagctctgacttgaaatatgagtgattgtctcagtccctttgtctcttctccagcctcctggcctcaactttgacctggatgctctcaatctgtcgggccccccaggtgctaatggcgaacagtgtctgatcatgtgaaacacagcacagtttcctccctgagccccagccgtggggaacatctggagtcaacagagtcactgggaactgaggcaggagtatcatctgtgggagctggctgccccacccacactctccatcccattcaagactgtgccataccagctgatctgtaggccttttctatgagtcctactccatcagggtttctgctgttagaaacaggccaattatctgccaggtgaaggaaggcatcccttgtggggcatttcacttcttcccactccccaaataatgttacacatggcagtactcatgttccccttgattcccagggacgtcgcgccttgtttctcctccctctctgtgtctggggaggaggagctgagtcctgactctgtgctcctgttaggcagggcctctgggaagaggagaaatgtagcctgagctggggctggaggctggtcaccgcatatccttgccttcctttggaattctcttaagggaaaggaattttgcacttagccatggtcgggttggaagcaaagccttgggcttttcctgtccctaggtgctgagccccaatccccctttcctcctgagaactcatgttgctgccctggttctttctacagctctgggatttagggggagccaactcttggccttcctttgctccctgactgtccttacgtcctctctgtttagagtcttatttattctgcccttttaaccagtgctgtgatggatgaaggccaatcttgtttcctttcatctagtacctggaccattctccctagacccttgccttcctccctggccaacacatacttgcagtgtcagatctggtacatgaatggccattctacccagataggttttagcttatatataggacatcagattccctggaatccttggttcaggaaggtgcttgggaaaggggtgtagccagaatattttttccctgcaagccctatggggtagtatctaataaatattctgagcaagtgtgtgggttatttttcatccaggtctatttctaatcttccctagtttctataaactgcagagtgagatgtgttaggagatggatagttctgtatagtgttgttaggctctaccatggcccagccctccagctcagcaaaagaatactgtcttcgtctccttggcacttatttcagtcttaacgttttacgatatagctgatgttagtgattgatatattatcaacatgttttctaaattat

SEQ ID NO: 18444 - DNA, 1201 bp, Mus musculus
ttcccccagtctccttttttttccaggctgaccttgaacttgctgaagatgactttgaactcttacatcctcctgcctcttgtcagccaagtacttgggttataggcatggatcagcatgcctggctagaaatcactctttataagcatttggaaagtaaacacattttctagaatttgtttcttggtcttaagtgtagcttttttagaccacaaggtgaaaagtctttctgaccactgtcctaattattttccttcttttttctgcatctgtcctaatgttcaggaagtctgtccagcagcccagaggagatgtctggagctgaagaggggagggaaacatcctcagggattgaagtagaggcatcagacctgagtctcagcttgactggggatgacggtggccccaaccgcaccagcacggaaagtcgtggcacagacacagagagctcaggggaagaaaaggactctgacagcatggaggacacgggccattattccatcaatgatgaaagccgaggtcatggccactcagacgaagaggacgaggaacaacctcggcaccgtggacagcgcaaacgggccagccgtgaccaggattcatcagatgatgagcgagccctggaagactgggtatcttcagagacaacagccttaccccgacctcgctggcaagcccttcctgcgcttcgggagcgggaactgggttccagtgcccgctttgtgtacgaggcttgtggagctagagtctttgtacagcgtttccgtttgcagcacgggcttgagggccatactggttgtgtcaataccttgcactttaaccagcgtggtacctggctggccagtggcagtgatgacctgaaggtggtggtgtgggattgggtgcggcggcagccagtactggactttgagagtggccacaaaagtaatgtcttccaggtaaggcatagagacataatataatagcaactgagaaagtcaaacatgaggtaaaaaattgagttgctgtctagacagaagatagtagcaagttgtgattggaatgaggtatcggggtttgctccagctttgactccatagtaacatactgagagacagaccatggcagccttttgtttccttgcacagaaggactttattaagctgaatctggacgagatgcttggcactcatgcaggtgtgtcagtataagacagtaggag

SEQ ID NO: 18445 - DNA, 1187 bp, Mus musculus
cccttccccattccctgcatggaagaaagcatgcaggatgtctttatgactctggctcaattacttaccagcctatgctcttcaaacagcactagaacgtctcttcatgttttctcccagtcctcagaatagcatagtgcattttcttgttttgtagttcagaatagaacaaaaacaaaaacacctctttttgggagtggggggggcggtaaagattagaatttgatttcctactgtctctgttgatttttttgttttccacttttcatgaccatcttggatctttgaaggtttttttttgttttgttttgttttgttttttttggtggtagtggtgtttgttttgtttttgtttttgagacatttctctgtagctcaggctggccttgaagtcactatagcccatgctggccctgatttcaggtagtgaatctcttaagtgttgtgattccacatctgagctgccatgctgagctccatctgggtcttttggaggatataataactatatgctttttctacttttgaaaggaaactagtggtgacaaaagagaaggagaagaaagtggggctgtatacaatctatgtgaaccctgccaatacccaccagtttgcagtgggtggaagagatcagtatgtaaggtgagttcaacagtcttttgtatgtttgagaggttgagacttaggatacattgtatattgcccgatgctccccagtgctaagttagaaaactgtaggaattcgttaactaccatgttgaactttttacccttttgggaatgcttaagcaccttctgagacagtctgttccctattacaacgatttgaggagttttatggtatacagattatcattttcaaaaattaatcttattaatttatgtgcatgaatgttttgtttgcgtatgtgtaactgggtgccatgttcatgagtggtgtttgaggaagccagaaaagagcattgaggctattgtctgttatctttcttttttttgttttttgttttttggtttttggtttttttcaagacagggtttctctgtgtagtcctggctgtcctggaactcactctgtagaccaggctggcctcgaactcagaaatctgcctgccactgtcttgcaagtgctgggattaaaaacatgcaccaccactgcctggttattatcatcgagtcctgggattatc

SEQ ID NO: 18446 - DNA, 2351 bp, Mus musculus
cacatggcttaaaacacttgctgtctggctttttaagaaagcgctgagccaggtacagtagtaaccataaccctagctaccgggaggctgagggacggagagtcaacagcccaccctaggttatttaatctagaagaaaaaataagttctgccgattcctgacccaatctacatctaacagtcttgtccttgatccaaggacattactaacaaggatttcccatcctacagcgctggcgagaacctggggttggggccacagatgcagactctgatgagtctcccagctcctcagacacatccgacgaggaggagggccctgaccgggtgcagtgcatgccatcctgaggccccacacctaggagggatgggctggggctgccaacccgatcctgcctgggcaactctttttcagtcccaggcccttacattcaacagaaatgcactttggactttttgtttaaataaaagaaagatacctgaggaggacagagcacaggagacggaaccagcagagagcccctagaagtgagagatgagaaggagcctgaatgagcttccatggaaggtgcaaaggactcagagaaatgggcctctccctgaagccttttgtcaatgggcttggataggaagtggggcttctttttctttaacctcccttgtttcttttgggggtggggggtaccaataggccagagagaaggctgggcatgccactctctttggtttagggtttcaccttttttttttcctttgttttttaagaagtctgacagttgctttgttttttgcccgagcaaccacgtcccatcccaggatcctgtttttctgggaaatccttaagagcccccagccaccccagcactctgctctcccttccacaacacttactctctgaccttaccacagtgctctgcactgctgcccgttgtctccttcactcactcgtcatccagcgccctctaaatgggggctgggatggggactgaggagacgtgggagggacaagagacggaaaaacaggaagaagttacctcttggttttggttttaactgttcagtggtggcaatttccctgtccctatcactgttagaggcctacttttatatctataaatatattaaaaagcaagttaaacttggatgtatcaagttaaaattattgtcagaagtttaaatacctatatattctctatgaatccaatgcaataaaggggctgcaaggaagagcaagcgatcgagtgatgctgaagaggtgacgtgggtcagatgattcatggctgctctcagagcctagggcttacctgtagctttcccaaggctcaagggtggaaacatagtcagctgtgcccttctctgcctcagtactgagctttagaaaaacaaattcctctcaactttgcctcaggtctcctaatttctgtaagtctgtgggggctcccaagattgctcctctcattagaggctggcctgtctctaaaacatgactgaagtgtgacttcaggaagggcgtcactgctgcagactgtctcctggttctgagtataacggaaagcacactcgccccctccctttagttagctgcttgattctttaagcatccaactccacaccagctcccttcctaatggaaggatgaagggagagcttcctgggaatcaagggacaagccagtaattggaggatttattctggtgcctggggcttagagccctgtcttcagcactggccactgagtatgaaagtccctgtggaattcttaccctaaatgcttgtgctgctcttcctgtgccccggtgttcacaaggtccagtcaggaggcctacaccatgggatggaagttggagagagagcggagggtggtatcctacacactctttcctcttgaccccatccagcagcgcaggccagatgccagctcctgggcttccttcgtggcagggagtgtgtggtaactgagtagtagtcttatgtcctcactgctagagggatgatgaggtgggcttaaaaccatgcactctggaatttgttgtatttttttctcagtaaagcttttcccctgactgctgctttgtgtggtatgtggtccatttattgtgatagaggacatagtgtacagtgtattccttccagatacatgcttgattttgctcatacttaaaaagtgaagtctgggatatccctgtttctagtgcttgagccatagaagaatgttgtaagggaaataggtctgttaatgtcagtggtgcttaagagatggggcactttctttggggttgttttctagtcccttgttctatactgcagtgagtggtgatagggaaaacatggctacacaccccctcccagtc

SEQ ID NO: 18447 - DNA, 1217 bp, Mus musculus
caagagcctggggccagaaaaggaagccaggcggagagattaggtctgtctcccagccaaggccagtcaggaaccagaggggagctgggctggcaaggaaaggttggggtgtgctggctgaaggagagaaaggagagaaaggaaagaaggaaagaaggaaggagagaaagaaagaaaggaaggaagaaagaaagaaagaaagaaagaaagaaagaaagaaagaaagaaagaaagaaagaaagaaagaaagaaagaaagaaagaaagaaaggaaagaaagaccacaggtttgtcatcttcagcctccaggtaggtggggtaggctctggctctgtgtcctgcctttagagactagcacaccagcaaaccaaattcccatctcgtcagagtagcagtaagggcaagcccaggggggtagtgtgccacccagtgacccattgatccttgggtaatggtcctctctgtccataaggctcaggagtcacagaaggtccagctatctcaaccccacactcttgggaacacctccccgcctttttagaacagtaagttctctgtggcctcacactgttctgagagccccattagctgccacttctccctgtgctctctcattcccttctgcttcctgcacatctgctgaacccacgtcatttccggtactgcctagttagtcctggaaaaggctctcttggccattggcaggaatcagtgtagaaaagtttccaggacatccctggctttccagagcatgcagaatcagcgtagctcatgacactgtcagacactttagacatgagagaaattcttaagagacctatgcctttggcctctcagatggcacggccgctgtacacagggaagtgttcactttccttgagacgggaagctggcttcaggttcctatggaatagagttttctttccttattcccttttcacctaacagttttgctcttcggacagctgcccattccctaagcctcgcctagaaaccatagcatagatgtacctagatgaatgagccaagcaactgagaaacagcaaggaaactggaaggcttgaggtgggaatatgaaggtcaagacaagaattagggagctgaaaagatggctcatcagttgactgctcttccagaggtcctgagttcaattcccagcaaccacatgatagctcgcaaccatctataataggatccaaacactcttctggtgtgtct

SEQ ID NO: 18448 - DNA, 7573 bp, Mus musculus
tccaggaccggactctgctggtgaggtacaccgacatagactaccacgtgttcacggacgccgcgcgcttcgtcacggaagggcgctccccgtacctgcgggcgacctaccgctacaccccgctcctgagctggctcctcacccccaacgtctacctcagcgaactcttcggcaagtttctcttcatcagctgcgatctcctcaccgccttcctcctgtaccgcctgctgctgctcaaggggctggggcgccgccaagcctgtggctactgcgtcttctggcttctcaaccctttgcccatggcggtgtccagccggggcaacgcggactccatcgtcgcctccctggttctctcgaccctgtacttcatagagaaacggctcatcgcgtgcgccgcggtgttctatggcttcgcggtgcacatgaagatgtacccggtgacctacatcctccccatagcgctccatctgcggcccgagcgcgacgatgacgagcgtctccggcaagcccggttctctttccaggctcgtttgtacgacttcctgaggaggctgtgtagctgggcagtgctgcttttcgtagcagttgcagggctcacgtttgttgccctgagcttcggtttttactataagtacggttgggagtttttggagcacacctacttttatcacctaactaggagggatatccgccataatttctctccgtacttctatatgctgtatttgactgccgagagcaagtggagttttactctggggattgcggcgttcctgccacagttcatcttgctgtcagccgcatctttcgcctactacagagaccttgtcttctgctgtttccttcatacgtccatttttgtgacttttaacaaagtctgcacctctcagtactttctttggtatctctgccttctgcctctggtgatgccactggtgaggatgccttggaaaagagccgtagtcctcttactgttctggttcataggacaggccttatggctggctcctgcatatgttctagagtttcaaggaaagaacaccttcctgtttatttggttagccggtttgttcttccttctgatcaactgttccatactgattcagattatttcccattacaaggaggaccgcctaacggagagaatcaaatacgactaatgtgttctggatcttctgcaacattctgattttgccgtatggactaggaggctttggaatttttctcctccctgaacattctaagcactctagtgaaagttcctttgttccaatagaaattaaaaccagtgttggccttatatataaagggggcccaagaactgaggtccatggtccatcctttagaagtcttagggctcatttgcttgatgagaagaaagccattcctgtttcacagttgagaagccggtgaagctagaagatgctgaaatatttttgaacagtagaggaataaggtctctagcagcgtttgttcctgtcacatggtgctactgttgtaccttcagcccctgcctttttttttttttcctgcagttctgacagcggtggaagttgacaaaatccctaaagcacaacatttttacgtattaagtattaacagttccatgctcggttgggaaagtctgaaatttttgtagtaagtgtgggggcttagaagagaactaatccaaagaatctaaattgtgatcatgtatttgttttgtaattgagtttttcagtattagtaccagtggtattcattttatataaaaagattaaatttaaactcatccactgtagacctgagtttaagaaaacgaaatggagcattattaacatgtatatgcttatcctttttctaactgctaggaagacttttcctctagagtttcctctgagagcggtgtgttgtaaaagtggtaaaatttagatgctaaagcctaagttttgagtataacttcacttgctctcttctggttttatcatctaaattgttacaaaggagaacattgtttataaggcataaatcctacactctgaaaattccaggatagaaaggaagactgcttgctgtaaagcatgagtgctgcgtgctgtcattggacaatcaagaggtggtaagggatttgaggaattacagaaatgaggctgtgaggagcaggtctttctacttatcacttgaagtaaacacagtgaaactgtatgaataaactttctcaactgtatgaataaacattctaaaatatttttagaaaacatagagcctgtctgtgttgagggttttctaacattcaaagatgcagtagcaatagatgagtataattttttttttaaagaataaaattatcatctttaaatgcaagttcaagagaagataggatttttgtttgtttgtttgttttttttttggtttggtaggggttggtttttcctttgtctggttttttttgtttttttgttttttttttttgacccagggtttctctgtgcagccctggctttcctggaactcactctgtaggcaaggttgactcaaagatctgcctgcctctgtctcctgagtgctgggactaaaggagtgtgtaaccacactcagcaagaagaaagttttaacaggctttaatttatttttacttttaataagaatgttgattttgaatgtttatcagctagttctgattgttttatttttctttgagatagcactccattctacagcacaggctggcctcaagctcactgcactcttcttgcctctgaagtgctaggtctacatgtctgagccactataactggctttctgattgttacttctaaagcaagattttagggctaagagaacaactgctgaaagttgtcctctgacttccacgagcatgcagtgacgtgtgcttgtgcacgtacatgggtgcacacacacaaactaatgagtgtattctctcaagaaagctatttaaaacatgaaaaggtctagatgttttcagatataaaataagttgtctcaatgctgatgtctaacgacttttagcaaatgtggtagtaaacaatcacataaatatgtttttggctttaggaaaaggactttgttttttggagccaaagtctcactgtggtagcctcggatgcctcagactcagtgtgcaatcccgaccaacctccaactcatcctcctgctctagcctcttgggtcctgggattaaaaatgtgccaggccagtttttactttgactgccatatgcatatccttaccatgtttttctctttctttgtaaagttccagcttccatgcatgtacctgggtgacatgagaattctaaaaaaaaacaagctagaaaatagttctgtctccagcctgcataagcgtagatggcgataatacagactctctcagtaggtcctctagccgcttctgttattccacctttgacttcgattcctcttccagctgcttacccagcctttcactctgctccgccttctgctggacggcatccaactcagccagggcgagctttagcttttccttaaagacattcttttcggaagtcatttcctcttagagcagagcatcagagtgtcctttcctaaggcgctcctgaaaagattcaatgacccttcgggttgtgctccatctccaggtgcttatgatggtaaaacttgagaagcaaactctccatgaatataatttttgtgatcatgatgtttttgtttttaaattggattcttttccagggtcagcaacaacaaaaaactcctgaaaaataagcactactccagaaaagtagtattctttccccctgtcacggcaagcctagaaagcctttgaggataaaatctttataggctggtcataattaaaaattctcttaggggcagcatttctttgctggattccttttgggattggccttaggaagaagaataggtggcttttctgttgcttactgtatgtgagaaaagtggtcaattgtagaaaacagtgacctttcctaaaatggcaagatccatatttctatttagctcctaacagcacactgcttaagacagtttaagaagtggctttccaattatggtacatgaaccttttaaaattattatggtgattgaaacccctattctaggcaagcagtctgccactgagtaatgtacccagccccaagtgaatatttgaaattgaaaatttgagcaaggaaagtatatattcatgtgtttttataggcctgacttttgttgttcttttagacagtcttagtccaggctggccttaaactttgtttgcccaagataaacttgaactgatcttcatgcctctacctcctaaagagctgagattacagtcctgtgacactgtgcttggctcagaaattctttatcaaagaaatgcaagtgtttcttaagggatgcagaagatatttgcagttagtctgctgcaaacctttatttttttaatttgctttatatgtataggtgttttgcatatatgtctgtgcaccatgtgcattcctagtgcccaaggtggccagaagagggcattggatttctagaatagatggttctgagccaccatgtgggtgggtactaggaatccaacctgaaaatctccgggaagagcagctagcactcttcaccactgagccaactcttcagccccatgctgcagagacatttagtaagttaagcggagaaaagacctgatttgatcttttggcttttacttctgttttgcagcttttaaagttttatttggggaagaggcacacataccttgtcctgtgtatgcaggtcagatgcacttgtggacggcagaggacttgtggtagtccatttccctctttccattatgctggccctaggatcaaacttgggttgtcagtcttggcagctgtacctttttacactgcactgtctggtcgctttgtcttttttccgtttatgatatcttttgtttccttataagtccttaaataataccttaaaattgtgtcgctctttgacgtattttctgtgtaattctcttgttcttatactacctgcattatctttatgtcactgtagcaaatgcctatcataagtcaactctcaggagccataatgggacaagctaataactagcaggtgatcatcctgaagtggcctgcctcggattattatataatctgcgacaggtgcgcccttattaagaaaggctgtaagggactcattttaggaaagatgcctgctattaatgtgcttttcctgttactattaaacatatataacaatcactaagtagtagcacacccctgtggagcagatctctgcagatccacaaagagcttgtcgtgttgctatatagacaaatagatgacttaagtcttcatgatgatcctataagaattcctaaaattatatctgtgtttattaagctcttttataacaggactgctattaggtccttttttgatagtcaaagctgcaatgagaactctgcccaagtgtccccagttaattgctcttagatagtaaccagactttatcctattcagagtacactccaagaagttgtaaaacaattaaccaaaggtcataaaaagggaactaatgatttattataggtgttaggacagaagataaaatatctattgggcttatctatacaaaacttcactgataacttagttatggttttaaaccttcagggaccctgtagagctgagacaagtgatggatgtttagccagataattactcctaactgttaggagcgtgcatgtaaacattcactgttgtaaacttctatttcagtttatgatttgattttatgtgtgaacttgtgatgaacttgtaacatgtgatcatgtattctggaagatatataagtactgaggacagagagatgaggggagagaaaggagaattttttccctttccccacttagagaactttttccctttccccactcaggatctttttgcttagatagctttcataggaaacttttttacaacttagtaataaactctataaccacttttctaagtgtccttttttctccctgcaacttccaactagcaggctgaaagttagagcccagcagcaattcctgctgcgatagaacaaaggctattaacttaatcctttgtggtttgaggaagaggtgctaagtgccagaaactgcagtctctgcctcagaggatcacagaaggcaggtcagctacaatagcatagtaacttagaattagacaagtaactttttagtatatagcaaccctaaatataagaaccaagaaccctccgcctacgcgctccccctctgctgtctcaagaagaaccaagaagaaagaacaaaacccccaccagagctgccccccccaacagtcaatttatagagagaaaagatttatttggggccatggattaaaagtttaactttgagattggttggccttgtggccacaggcctgtagtgaggtagcacactgtagcatgaggacacgataaaacaaactgttgacgttattgtgggtgcagaagacagagtctgagacatgggtctctgagatccttttgagggcacacccctaatgccctaaaacctcacactgggctggcctaaagtttccacagtttccagtagtgccgcagtcaaggaaacaagcttttaacacctgggccttggggagagttcagatccatactatagcattaactgtgtaggacagactgactgacaggcaagcagtcatgattagattaagaagaatgtttctccacacaggttgtgatttttttttttttctgtaactgcttttctgatgtccccaaaatgtcattaaaggtctcaagttccctggattgggatcattatcgtctgttttgttttttagttgtaggagatagggtcttatatagctcaggctggtctcaaacttgttatgtaacagaggctggccttgaactcagcctcttgagtctacctcccaagtactagaattaacaggtgtgctggaccatgcctagtgtggattaggttctttggaaaagctgtgagaaatatgtacactactgggcaactcagcaaaaggattcttaaaactgtagatctcagtcactgacatctcgccatctggattttataagctgtataatgatgtttcataagttgtataaaacttgaactttaatttatggctgaatatattgttctttttttctcttaacatccgttattttatattcctacctacactctcttgccatctgtgatgtaagttatcagtagaaaagaaaaacctgaaaaattctacctgtggtggtctttatatccaatctcttgtcatttccctcatgctttattatttgtgtgtgtgtgtgtgtatgtgtgtgagtgcgcacacctttgagctggccagattggctaggttgactggccagcgagccctaaggatctgcctgtctttgcactgggattctaagtatctccatacctggcttttgttttttctttaaacattagccatataaccattacttttctcagtctaaacagaattggcagctaagtaacctttccccttcaccagagttgaacacataacttttgtggacaattc

SEQ ID NO: 18449 - DNA, 1101 bp, Mus musculus
tctacacctaaagagcttaggttagatcttgagcaagatctccacatctagatatattgttttccatctgtaaaatgggggcaaacatataatcagaaaattgcttggtaaggaattagagaggcaggcagatttctgagttcaaggccagtctggtctacagagttccaggatacacagagaaaccctgtctcaaaaaaaagagaagaggaggaggatgaggaagaagaagaagaagaaaagaaagagaagaaaagaagaagaagaagaaattaagccaggcatagtggcacatgcctttagtctcagcacttaggaggcataggtggcagatatctgagttcaaggccattctccaggacggacagctacataatgagaccctatcttgaaaaaagagttaatatgcttaacattcttgtgttggtactaaatattgaaggcaaaacaaacaaacaaacaaaaacagtcaaatctcgtcagtaaatgggctaatgacttgaacagcagttctcgaaaggagaagcaaacggacaataaaccctgaaagggaaatgcatcttaaaagtgaggcttgtcctcacccgggacagaatggcttaagtcaaaaaaatgaacgcaggtgaggaggcagactgctgggacagtaaactggggcagctactgtgggcatcaggatgcgggtgtctcaaacagaaatgcagctaccagaggaaccgactatcccactcccaggtccaacatctaattctacagagatatggttttatttctgtttattgctgcacaatttacagtgatctaaaaggcagaaccagtgaataaagaaaaggtgaagtctacataccagagttttattcagccatgaaagttatggcattatcaaagcaaaggattcgattggaattatatgtatatattatgtatatgtgtgtgtgagttgggattatatattatggatgtgtgtgtgcggacacaggagcacacatgcacacacacacactagatggtggaataagaggagggaattattctagagttccaaaggaaatccagacaggatttctctgtgtagccctggccatcctggaactagctctg

SEQ ID NO: 18450 - DNA, 1714 bp, Mus musculus
tttcttccaggaaagaacatggcttgtgtgcagcggacactaatgaacctgggtgggctggcagtagccagggacgatgggctcttctctggggatcccaactggtttcctaagtaagtgtctgtgggaaagccagagggccttgctggtacagtattcttgcctattcctatctgtagataatagagtcagtcattacaaagcatctttaaaattccagaaggtggtggtggtggtggtggtggcagcaatggctgtccttttggagagacaaagaggtgctttggagtctcagaagcagagtgggtgtcagcttatacacctcagggaagaatttaactggatagctagcccctgaccaccccctaactagtactccctttctacccaggaaatccaaggagaaccctcggaacttctcggacaaccagttgcaagagggcaagaacgtgattgggttgcagatgggcaccaaccgtggagcatctcaggccggcatgaccggctatgggatgccacggcagatcctctgatcatactctctctccttcccctgccctccatgaatggttaatatatatgtatatatatgttttagcagacattccctgagagcccctggattgctgaactcccctctgccagggtccaggccagcctatcttgtcaccactggcagggcctgataattgcctctctctctctctctctttctctctctctctctctctctctctctctctctctctctctgggcttactaatgcattccttcccccacaaccatcaaaactggaccaacaaaaaccctgggaccaaagttgcctccccacagcatctttcctgctttcctgatctcttcttttagtccatcccttggctaggagtcagagattctgccccatggcctgatgctgcaccgacccttccttctacaaggaggcctctcctacagctgtggctgcagggacttaatttatagggaggggcctgtggctgtcactccagccacagctgggctgtacttaccacacgtctgggcagctttccctagcagaggctctttggcttctttctttccattcctctctcactgtggctaaggggtggagcagaggtaggacggctgcccaccatgctctggggcttgacgaacacgagtttgctgattttaaataaaaagatctcattttgttttgcatggattctggctgtttctagggccactgcgcccatttcggggtaagggagtcataccaggcaggcagggaggggacagatgagaggttgccaggccaagctctgtctttattttccccacaattctctgtcatctggtttaggggaggacaggttgggtttgagaaggaaggattcagagctgtcatggggtaggagccttaatgcagattgtgtgatgtgtgtctgcaagatgggagaactttactcctcagcgacttgggcaggtggcctgctgttcctggcccgacaagtacaggcctcatctaacaggagatctttcagggagatggggcaagatggcccccatgttgaagcaggccgttccaacttgggttgctgaaggtgtgggggaaggggggggcgggggaggtcatagtggctggctggaaccaagagctggaaaatgagcaaaagtgagttggtggctgtggagatggacgctttgccccttggtcctactcacctgtgggct

SEQ ID NO: 18451 - DNA, 1203 bp, Mus musculus
cttctagaggacttgggtcttactttcaggaactatatgatgctcacaatgatctataactccagtctcagaggatcttgtgccttcttgtgatctccgtaggcactattcccacaaagcatatgtatatacatgcagacagatacccataaacacaagatataaatacataaatcttttaaaatatgaaaaataagctgactccacaaagttgtcaatttatgttcatacatgtgctatgaaatgactagtcaaacacagagatctatttgtctgtctgtctgtctctttctctcagacaaaacattcataaatgaaaaatactttaaaatcttctttagaaaatatgtattacagtttcagccatgtagaatgaaatgtaagaagatgtgaaaatatgcatatgcaaggagattggacatccattgttgtaatctgatggtgtatttggggtggtataatgctttctaaaagcgtgctatgacacaggaagaataactattataaaacctggagcaaccacttaaaagtagaacaaagaagtttagctactaagccaacattggctatgagatataatcttaaaatgcaattaagtaatacaggaaaagaggaagatggaacaaagaagagttgaatcatacagctgaatggcaaagcaatggattgagcccaactgtactaataattacattatgtttagttaaaatacagagactgtcagataaaatgaaacaaaactattatatgccttctcacatgaagcatactttaaatatgcagaaaaacaggtttaaagtaagggcagaacattatatactgtgcagtcactacgttcaacaacactgtaggggctacattaatattagatttgctatgtttaactaaaggaatactgttcctttagttaactcagacataggagatatttcacagtgatgaatgagacagcctgtttatctgaaagacagtattctaaatcaggacatgtctaataacagagactgaaagtatcatacaaaagcacagcaaaactaaaatgaggatagacaaatatataattaatgttgacaatctcagtggctctctctattatatatagcaagtagagaaaaagttaagtcaggaaatgccttaaagacactttcagccaacttgcacaactgtggcagacaggaaacttgtctagcaaaatgacacgaa

SEQ ID NO: 18452 - DNA, 1189 bp, Mus musculus
gctaagccatctcactgggtcttcaaggaacctttttataaccactagtggaaatggataagaactctgattaatatttagaagccacatttaccagcatacaaggaaaatgaggatactacacatttgagtaatgtggtgtgaagaaaaaaaagctgaatggtcaaggacttgtttaggcgagtttcagtgttagagtttctcattttggttatgttacttttgtttgataacattctaactatagcatggaaattcgtacaatggtcaaattgggaataaaatagggtaaataaaataaggatatcttttaccatggactacatagaaaatatattacaccacttgtatatattaatattatggccttttgtgtagatattgttgaaaataatgaagtaaggatttacatgtgtgcctaagtttatataaatcatatgtatgcttaacatttgcccattcaaaatgtctatctctataacttttggagaaccatcagtgaacactttttgaaatgctttgagtaaaatattaaaattgtagaaaatgtgataataagattatgatatacattcataatatatatgcccattgttttgtgtgtcaataacctatcacttattcttattggagactcttaccacttctaaaagctagtgattgcctttaatattcaaaggtaacttccagagcctttgggagaatgccctaatagcatcaatagcataatcaatagcaatagcatagtcaggaaggcaaagatttatcttgtagaatattcttccctgttcaggggtactattctaattttatttctgttattgtgataaaatactcttaccacaatcgagtcattggaactattctagttttatttttgttattgagatagaacacacttaccaagaccaaatcatcagggagaaataacatatgccttgtaattttgggttacagtccattatccaagagaactcaaggcagaaacctgaagcagcgagtcaggatgcacccccagtttggagcagaacatccattcatttctctcttctctgctagctttctttacttatctacagttcagggccctatcagggtgggtacttcatcccacatccatgaaagtaaccaaggcaaccacacatagacttgtccaccggctgacttgatttaggtacttcctctttat

SEQ ID NO: 18453 - DNA, 1162 bp, Mus musculus
caatgagtctgtcttattgtcttttatcattaaataaaaattaaactcagagtttgggaatggtaaaatgagagaattttattcagaaagcttttggtaattaaaataaaatgcatcaaaacagaagcatctagtcaactgtatgtccagtgacatggggaggaaatgtatattttttgggaaacatggtaaatagctgctattcatcagtggccaggcaaaccataagttacattgggccagcaatttgccatgcatccttactgctctcagaactcctcttatctcctgtaacaactgtaccccatatacacacttatgtgatggacagacattggctcgtggtacacagaggtgctgcatgagaaagatatccatgatattcccagtttactaagggcacaatacagttcaatctccagccattttcctccagagtatttgttcttcataattaaatgaaaagtatggttgtggaatatcttctttgaatatacatggagtctcaaatgatgaatttaaaaaatgactttgtatttattctgtatgttaaatatttaatgaactgtggggggggaaccccttttcacattctaacagatgttgagaaggtcatagactatggtgccatgcaatgtgacattttgttagttaaataaaaatgtatctgattaattgctgccgtggacacataagcttctgtaagcagtacaaagaaagaggatttgtggcatttaaatagtgaatcgaggcagatagccactgtggttatgattaggtgatgggttttcattgaccctacaacacataacagcctctctccagtatgccttcagcgggtagtgtctaatcctaggcagagcataatgggacatgctgcccacaggataaatgtgcgcgcataacgcaacctgtgtattcagaggatctatgtgatgttttctactaattgactgataggtgaataactacttattgtgatagaccttaccatagatttcttctctttgtcagattgcaatgttctttccagagtgagggagagaaactatttagaaaggttaaatatatcctttataggatatatttcagcctttggagatgcagttggaataaaaaaaaaaaacaacagaaaaattgggttatgataaggagaggcagt

SEQ ID NO: 18454 - DNA, 1235 bp, Mus musculus
gagaatcatcaagaatttaatattattcaaatccttctattttttaaaaactttaatttaaaataatagtaaaactttaatttgaaataatagttaaaaaccagaaagaattaaataaaataaagaaaaataaactgtgaagaattatcaaatagactcaacctaccagaagaaagaatgagaatgtcaagaaggaacagcaaggttgaggaatgtagcatcaaacatcaagaaaaaaaaaaaaaaaagaaagaaagccaatgaccatgatgacaaccttgggacataatcaagacaaaatcaacaatgggataaaagtaagaactgttattgagaatctattcagtagcaaaagcagaaaattccccaaatttaggggagaatgtagggatccaatcacaagaaacttttacaatcccaaatgggtatgatgacagaatttctctatggcactttacaagcaagacactaaaggtatgaagtaaagaaaaaatgtcatagaaaagtgccaactcagaaagacaaacccactagaatactcttatactgtgtgacacaaaccctaaaagccagaaaatcatggaatggcacatgtcaaacttaaaaaataaaagtaaaagtgaccaaaattgctgcatacagaagagtaaaataatagagatggcgaggataaggaggagctaatatcagaaaagtccattgagatgtaataataaggaagatatcataataagacctgttattttgtatgctaataaaaaagtaagtacaaacaaaacaaaatccactttcttcatatcttgtgtttccttacttcagaatatcattggaaaatgtcagcacagttcattacaaggtagtatacaacagaactatgtgttgtactgactcacaaattcactgtggctttaaagtacactcttacattagattccaagtttatgcttgaaggtaataaaacaaaacaaaacaaaaccaacaaaccaccccccacaaccaagaactggctcctggggttaaaataaactaaatgcttttataaggctattctgaaaaggaatatcatattaaaggaaagtaatgccttaccatttatgagtctctgtcagggcagcctcctgtgactcttggtcaattttagctgaaaatgaaagaaaaagatgtgaaataggtgctaggctctaccatctcatagagtatacaatctaaacaacatggagttgatttaactacag

SEQ ID NO: 18455 - DNA, 1169 bp, Mus musculus
ttctacctcagcatcagttggatcttttgaagggagaagacactgcagtgaccacttattcttaactgccacgatctttctactttctgcggggtggggcaggggcggggctgggcgaggggcggggccggggtgggagaaatcgcataaccttgagaaggactatattaatcactttgtaatcccttcacagtcccaggtttagtgaaaaactgctgtaaacacggggaacacagtttaacaatgcaacttttaatgactgttttctttttccttaacttactaatagtatgtggatctgataagcaagggtgtgtggttgaagaaaacctctgtggtgggcttaatcagtcactacatgcaaaccctaaaccggcaccctggtgaccgggggcattcgtataagaaaagcattgtgtgtgactctgtgtccactcagatgccacccccaccatgatcatagaaaatctgcttaggacaccaaagatgagaactagacactactctcctttgtgtataatcttgtagacacttacttgatttttttttctttttttacttttcaattctgaatgagacaaaatgctggtgtatcttttaatacagctagcaaaccagaataagttatgctcgttttttgtcttgttttgtttttttcaaaaagggaagtaaacgagaaccgttgactcctccgtttatggactcacacacagcagcaggagtgataagcccacaagctctctttcccgcctcgggaaatctacacagccaaaagccacttagccataaatgacacttgtcagccttgaagcatccgagataactagctgagtaaaatgatccttttttggaatttaatgaaaaggttaacagtacccaatgaacccacccaagtgatgacgtgggaggagcgaaaccgaaatctctcttgctatataaaggacactattttttaaaaaataataataaaaacagctcccgctcgctctcctctctccctcccttctctccctcgcctctctctcctctctatattctctgttcttcattgtgtaccagtgtccgtgaaagaccgcagtaccacttacctcagatgaagcctgcgtgttacgtcctgtaacacctttcgttttgacataagatggctagcccgggtgcattatcttggt

SEQ ID NO: 18456 - DNA, 5067 bp, Mus musculus
tggctggaaaatcttaggaaacattgagaggactgaagggccaatgagatacacattttttttttttaaatcctgctggctattgtggaggaagcccagtgccacccatggatgcccaggtttcaagggcaaatggacattgttcaaccaagtactgacggtgcagagtcccctagagagtcttaggatctactttgtaccagagagtattttcccctgggcttggcaacctttttcccttctttatatttatcacctctgatggctgaagaatgtagacagtataatgatcctgctgtcgccaaaatctatacaccaaggtgaacaggtgtttgccttaccagttttggagtttttactttcagttataggtaaattagctttttctcagatgttaaaaccttgaatgtcctttatggttttgtttatattacagtagtatttattttttagtggtaagaattgtgttgtcatgttagcaagcgcagctccaattcacagatcattgcctgcgttttcttttgacccatgtgcaaggaatgtacacacccattagaatcatgcactttttctcctatgttaaaaacaatggtaaggctctgggactgtatctgttggttagaatctggctagaatctctgggagaagagatgctgtgatttaaccccttggagctgaaatgagagcatccccaactacccagtgccaagggatggatgtgagaggatagtctggcagaaagtaatggagaaagctgagacccaaatgatgatgagaaatgaactctactcggcaaaatgaacacatcacaagtattcacacaataggaagtaaaggataagaagctgatgtgtttattcttatcaaggtacattcattactgaatcaagccatcagggaaaacaacaaaacaaaacacctctagcttttatttttctgtacatattcatgtctcccaacccaaacatttctcactgagaggggacatgtatgcaaacctcatctttctccttcattaatgatgatcttcagattaaccctttggtgctaggagctgacactttccaaagcagactatgacgtccaaggatcaaagcctctcttgcagcaagcaagagcaactgctgctccaaggcgtgatcatggaagtggaagaccacagtgtgacacagtggtactgcattgtctttttcagtaggaagtcatgttctcatgcaagtgtcttggcctctaggctcagacttagagaagcagagccgctgctggcagtggctggccgctgggactgctggggtgtaaagggcattttcctaaggcagctaagacagactcagacatagatttttgtcctaatttttcatgtttctacctgggtgagtttaccctcagtgggaagtaggaagttaaacaggtgtattcttacatctgctgtcttctgttttcctacatagaagtatgttgaatgttgcacattgacaaggaagtagattagatggtaagtccttttaagttaccctgcatccattctgtaagaaaggaggaggagaggaagaaaagcaagctgagcctggccgatgttcagaacatttactccctcagagggagcagacactgtacactaagcacacagcttcttttgttttgtctctccttccaagtcttaaggtaatttcatgaccttggccaaggatactttgtgaagattaatgaggggacattgacaatgcctcaggctggccactcctcacactggcccttggtccccagccattcaaggggttactcatcccatccctgactacctgagtgtcactacaggtgggttcttggctttgagttcaagaattctttccttacaccctccaccagatgtcagtggaaaggcagaagtagaaccgaggtgtgggaggagattctaaaagcttgtgttgcccaggcctctagcttagggttctggcaattgagacggcctgaaacctgacagcatcatgtccgggcagctctggctttgtgagtccagctcctaccaactccaccttgacctcttgtctccatgcagggctgtctgggaggaaactggccacttctgctcagactgctgccagcgctctcacagctttgctctctacactaatgacatagattattccagtattgttcccatttcccacctgacctccagcttctcggagctgacttcttgcaggggccacatgcttctttccctcactaactgcagggtctccaccacacctcagtgtacacactttgctgctaccgtctgtactgtctacatcacggttcccttagcttgctcctggtagtgcattacaggcaagcatgaaatgtaaagtatttatttaaataaaaaggaaacctctgaattggtcatcgagtcacctccctgtagatttgtagtctgtgacatatttcgactttctagtcctgctagatccatataagatctggtcatctggttaagggtttgaagcagacatagctatgaacccggatggtatcatcactgtcacggctggccacactacagatgtttatgtccttacgtttatgacccacagggtgtgaagtaacttccaagaacctgattttgtacactgtccactctcagtatctcacactctctgatagggacacacattacttccttcgtacagacagcttaaataaagccctatgtcaatctgctgcttctctgtttgttgttgttggatatggctctgtaatttcagaaaactaaatttcctccttttctggaaaaatgattatagccccagctgttattaaccaaccctgtatgaaggtgtgataggaaaagaggtaaatttctcttccataaaacacatacggggtgtttttacttgaccaagatgccaatagcatgcttgtacaaactgataaagggctaggtgtggagtcactggccaccagcagtagattttaaggcacatctactaggatgccagataaagagtagattgcagaccctaaaggtcttaataagaaagggtgtgggcccagaatcctcaaggaatgcagctcatcactaatgtcttcctgataacatactgtgccacacccttcctggcaagggtgtctttaacccttcatgtcaatttgacttagacatgagtaattgatggctagaatgtctggattacatggttttggacggggtgtctttctgatttttacctcataagctacaattgtagaacttggctttgctcttgtgagttcaacagagagaggaatgacttttgggaccagttaggcatgcatgtgtatttctcacagccaaatttggggacattcttacatgtgctgtcctcaaaatcaactggggttggcagatacatgaggctgaaataaagtgacctctacaactctctaaaggtgctatttttagaatattgtataatttattcctggtatacataaaacaattgaggacagttaaaacctgtgacagctttatgtctagcacatttgatgaaacctgaaacttctgactcggaagttgtgctgttctaggcttgcacctttggcatgccccagagatgaggatggcccatgtgccatcatgctgccagcacaccatggcctaagctgtatgtttgtgaagggcaggctgagcatgtggacaccatgcctccactgagagccctgggctgccgggcagccgggcagctgggctgcgggcagggagaggtgaggtctcacatgcaggcttgcccttagtgtttcatccctccctcagacgccatgaccatctcagcatccgggctttatctccatctgtctgtttggtttttgtttttgtttgttttgtggtactggggtaggaacccagggcctcacacatgctgggcaagtgctctgccaccgagctacaccccagaccttccagtgtccatttgtattcctttgaagcatttgagggcttgactgtatagtagaaatactattttagactaagaatatgatctgtgtacagatatttgatatactgttaagtaaattttctaatttcacatacatttgtttttaggctcctctcaaatactgctattgaagacaaaaatctgacaccatcgagccaaagatgcctttttggggggaggggaggggtttgctttgtgttgttcagagaatgggaagaaaaatgcagagtgcttcctgagtgcacacagttcgatgggaaatactggatgctggctaaaggtagacatggtcatgagcgggaagaagcagtggccggcaggaggaggggtggtcttcagtccacgttggctgacttcaaacatgtgcctttcagtgtgttttgtcattgctacaaaatgaaaaggaaacggaacaactcaagtctttaggaaggtcattttattaatccatgtgtatactttagagacaacgtaaatcagtgacttgaagctgttctgagcacacactcccaacgagccctagccagttgatgctgaagcaagcactccctgtccatagcacagggacagaccatggcatgaggaccagccccccctgcagtccctggtggtgtctccctggggaggtttcggtgcactgtggcacattaagtacaaatcagatgaatgtaaatatctctttgtaaatcatttatttcactctgtttcatccaggtcagcaatcagattgtggcatgctgggtaactggaaaaaaaatgataataaaaagtaagtttaaatagatcatgggtatttgttttctcatttgctggtttggtcagctgttatcactgaagttttggaggaaaagtttctgttgctaaaagtgtgaaaattatgtgtagccaactgtactaaaaatttgtaccttacctgctgctaccagagagcaaagaaagccctgtttgtatatcggtatcaagccatacactttgaacgctttccttctgaacgcagcctgtactccaggcctgtgtgtacttctacctgtggacagttgacattgtgacggtgtgctgaactatgtgttaggaaactgatcagacattagatgggcaaacggga

SEQ ID NO: 18457 - DNA, 1164 bp, Mus musculus
aattcaaaatatgaattttaattgatgaaattcatatgctagaacaggtttcctcaaagctgaggaaagggtcaaataaactgaggtttagtatcaactctaatgtagttatgtaattaaagtaggatgaggaatattccatcaagcaagaatcacatttgcatttgagggtgtggtttagtggcaaaacacgtgcataaggccttgggttctagttgcagctccataggttgtcattggtgatagtaaatttacttcttttgaataatgctttaaaagttaatgtacatgggttggacatggcagtccagaggcatacagacagatctctatgaattcaaagccaggctagtctacatagcaagttccaggccagtcaagaatatatagtaaagctagatgatgatgataagaatatatagtaaagctatctgatgatgacgatgacgacaagggggaggagcgagaggaggaggaggaagaagaagagccaagactataatagtgaagttgctgctgctgctgctgctgttgtgttgttgtaaaaatttgtcatttttctggttttacttctaggtattagaagataatgactatggccgagccgtggactggtggggcttaggtgttgtcatgtatgaaatgatgtgtggaaggttgcctttctacaaccaggatcatgagaaactctttgaattaatactaatggaagacattaaattcccccgaacactctcttcagatgcaaaatcattgctttcagggctcttgataaaggatccaaataaacggtaagcttcaatgatggtccataagttactgatgaattggttagagtgatttgtgaaattaattcaaatatgcctgatttctggaagcattgtatttggtataaacatttttccactgagaaacttgtcttatttatgaatgcatagtacaaaacagtttaaaaattcatcagctcttttttaacttgaaagtattatacaaacttaccatattagagggtttttttaaatagaaattctttatttgtactatgaaaaaacaattttttcattatcttaaatcttgctcctttgggataggaagttcccttttctcctttgagtctctagggcttcctattcctactgactcacatcaaagaaagaaaagtcg

SEQ ID NO: 18458 - DNA, 1137 bp, Mus musculus
tatagatgtcagttaagaccatttgatctatagtatagttgatctctcaagttgctttgttaatttgttttgtacaggtgaactatctattgattataattaaaattacctgtcattactgtttctgaacttgtctgtcatgttagttttgtctagtagtgtttgttttatgcagtagggtgtaccaatgactgttgtatacatacttgcaatcagtttattatttctgtattaatgtgtaatgacctttattttcttattttttccttattttaaaaatgttgtatccatgtgcacatgtatgcatgggtacatgcctgtggagagtagaggagagcgggctcttcttccatggatctgcctgattcccttggtgcagcatctcccactagctcacagagtttggctagactggtaactagtaagatccagtttctcctcacagcccactcttcctccccagcactgacgttccaggttacgtggatgctagagatctcaacttaggacagttgtgctcatacaggaatcacttttagccactgagccatctctctagcctcttctttatttcttttgactaattttgagataacttttgccaggtatgaggatagtcacccatgcttgtcagcgtccatttgcttgatatagtgggatttagttttctaccttcactcttggtatttctttgccaataaagtatgattattgtaaacaataaatagaaatagttttaagatactctattatttttaattaattgattattatattttttgtgtgtttgtgcatgcacacacaggtgtcttgctcatgcatgtatgtgctaccacataccagtgggagacagggaatgggatttgggagtttattttctccttgtactgtatgagccttgaatatcaaactcagatcatcaggctaagtgccaggaacctttgccacctgaaccattttgctggcctggattttgttttaatccagtgagttaatccagaaataggcagcatttataggttattgttgagatgtttgtcagttccctcaatttttttttgcgctcttcttttgttctattctttctcctctggtcatataagaagttttctggttcagggagttgggcattattca

SEQ ID NO: 18459 - DNA, 1370 bp, Mus musculus
aaaattatttaatttccttagaaaaatagcaccatttgggaaaaaaactggtgttacgaagaacataaatgcactgtctttatttttatttttattttatataatttaaattgacttttcccacgtctttaagtttgaaactgttaagctgaataaaaacttaagctgcaaattgataacttcgctacattacaaggaacatataaatgtttacaaacggcttaaagaattgcatgtgcagtgtgcattcataccacacttgtaattgcacagaacccatgccagctcagagtttaggtgtacacacgtacccagccgagtgtttttagaataactactgcacaaattgacaataggtcataggtcattctctctctccctcctttttgcttcccctttctttttctcccctatttcctttccttccccctaccccctaactcatgaaaagattctatggactgaaaaagccccaggctgaaaggactgaaccgccttgattgacatggggaggggggttagtagactgtgtatcggcagcagaggctgcagcccgatgtgtggttctgatggccagcgcggggcagaagcgttttgcacactgtttgttttcctgtcttgcacttacaaataaggtctatgggagtagcatgggaaacagtggttgtttttccctttttcttttttaattgcttttgtttaaaatttgatcgccttaactactgtaaacatagcctatttttgtgcttaagatactgaatggaaaactccattgtgtgttgctggactgttttggaaatatttggtcaaatgtatgttaatttggctgtaatggcatttaaagcaaacaaacaaacaaacaaacaaagctgtgaaaatggccttggagcattatctttagttacttgaagagtttctagtttttttttttttaatacagtttatgttaaaataatctttattaatctagaggagacaatcaatgtctgtggaagaacggacttttttggattttcttttttaatggtcattgtgagtgattgctctttcttttacttagtttcacattcttcctttgttctaaatcttagactgacatctagctttgacaatcatagtatgttttatttcctgagggggaataacttataatgctgtttagttttgtactattggtgtgttggtgaatttttaaactgtgtgctaactgcaataaattatatgaactgagaattccttgtgtgctttttgtattatagtcgcacaacagatttggagttagtatagtgcatgacgtcttcattttaatgtcaagttttattcagcttatgaagtattagactgctttagggtcacccaaatggaaatgt

SEQ ID NO: 18460 - DNA, 1434 bp, Mus musculus
attcattatactttaaggaataatattaacagtatacaataacctttaagaaataatactaactttaaaaaatttcacgtcagtcactcatagttctagaaaaatcctattacttgactgttttgaacctttttaaatacaatattgctttgatctgaatgtgggagagctgggagtttagctcttgcctagcagtactgtcctttccttacccaagtgtgaatgcctgagggacttgatgctattttcttatgttttccagttaaatggattggtgtaggtaaatccagagagtccatgattcagctcttctaaggattgccagcaacgcatgagacactccttaagaggaagggaaaaagacttaaacatttctttgtgatctgcaaattcaagaataaagacattgaaatgagttttcagctggcgttggtttgcagtttctgatggatggctgtcatggccggccttgtgctctcatccagcttcccggctggcatggctgccacatctgttgctctgcttctcatggtgccgcacagtccttgccatggttagaactgtataatccccagttgacatctagaacttccagtgtagcttttcttcattatggccgttgtgtttgaggttgtaccccgattagatggtgagaacagttaatgcaattttgcacaaatatttttacattctgatcattcacttctgtcattgtgatctttgctgttagaaaaagaaatgatggaaagataagggttctgtcaacatttgtaaagctaagaattctgtttaaattgtgaactgcttttttttttcctctgctgaaaccattgcaaaattgagctttggtagggtagggggagtatgttcatgagacttttaatttgtataaaacacagaacttagttctctctgcaatttatttaatacagtcaacattaaattgagtgttcaaaaagaagagatgtttccctacaataacaaccttaatgtgagaaaataattattaaaaaaaaatctgttgtgatatttgatggatatttttctttgttttcagatatgatctcaaatgtttgtcttttctttttcttttttaagcatactgttgtttctaagaacagtgggtttgcttacatttcgcctgccagtatacctacaaaatgacccacaagtaacccgcatgagtccaagttgtcagccatattttgatcatgccctcatccctcctttcttgaaaaagcaaagagggatcacctggcccttggctttacattgtgctgagattagccttccctggaccattaaatgtttaaattaggcatcacctgaaattattttataataccaccaacagctgattaaaagcaaccaaatatttccagtatgctttgtgtgttgtttttcttctgttcttgataatgctagtgcggatga

SEQ ID NO: 18461 - DNA, 1177 bp, Mus musculus
atcctttaatcgagcttgtgagcacaatacagtacataagataatataatgaatgtgtcatggcttcaggatgaagctgggtgtcaggagagcagtcctaagcaggagcagtcagttttgggagaggtagtgggaacatgtccatgttcgttctagatgaagtgcctgggaccgttcactgagaaatgaggccccagtggagatgaggcacgagataacaagcagaggtgttagctgtattgtgggctatgctgaatgcgttattttattaaatgtgttaaagcttaagtagagagctggggatgtagttacatggtagaaaatcctgagtacttaccagtatcaaatacttgcataattaaaactcaaccaagtttatttataacaatacttttacaggcatgctaatgaaactgcaaaggatgtacagttatctttcagcttaaaaattacactaattctcaaggtttttgttcttttgtttttgtccttcaatgtctaggcctgtagaaaacaaaagcagtattcataacaacttcagagagagtaatcaaaactagttagaaggcattaaggttctaccccatgagagtcattgttctgattatactaatggcttcctggggcctaggaagagctttgtcggggtactaaattaatttttgaaaatacagctctactgctttctgtcaactgtttatttgttgtttttctagttgcttttaaaaacttctctgataatgaaaaataagtatttaagtgcaaatgcttttgtattcagaagaaagtgtatggcatattctagaacctcagtcataactgacttgcaaagttactgttaatgaaacaattcttaaggataattctagcacctgaaatacgttagaaaggctattgtcttggcaacaggataggaacatgataataaactaatcatatgatagcagtttgaagtacaacatgacagactgaaattcactaaagcgtaaacaaaatactcaatcaccatagtctttaaaatctatagtcttccaagaaaaattgctatgatgatttttctgtttcctttgatcaaaagtgacacagcctttgcttcttttacagattaattttgacatttgaaactttatttaaaattgtagtttatattgtcttttgcatctggcctccactgaac

SEQ ID NO: 18462 - DNA, 1380 bp, Mus musculus
taaaagcctgaaatctcatacagcctaggccacaaacactgtggatgcggcatacgtaagtttaaaaacccagccattaagggtaaagtaaattatgttctcaatacctcttaaccaaatcacttacattaaaaggagataggagccagccagcgccgagcgacgggcatctctcagtacaactggcacaagtgccgcaagaccggcggtaagcaaaaaccctaccacaagaagcggaagtatgagctgggaccctgctgccaacacgaagattggccctcgccgcatatacatagtccgagttcgaggacaaataagaagtaccgtgccctgagattggatgtggggaacttttcctggggctctgagtgttgtactcgcacaaggatcattgatgctgtctacaatgcatccaacaacgagcttgtccgcaccaagaccctggtgaagaactacatcgtgcttattgacagcacgccttacggacagtggtacgagtcccactatgcactgcccctgggctgcaagaagggggccaagctgactcctgaggaggaagagattttaaacaaaaaatgatcaaagaaaattcaaaagaaatacgacgaaaggaaaaagaatgccaaaatcagcagtctcctggagcagttccagcagggcaagcttctagcctgtattgcctcaagaccaggccagtgtggcagagcagaccgctatgtgctcgaaggcaaggagctggagttctatctgcggaagatcaaagcccggaaaggcaaatgagcctcatgatagtgtaataaaggtgtctgctgttctatatgacaaaaaaaaaaaaaaaaaaaaaagaaagaaagaaagaaacaaagaaacaaagaaagaaagaaagaaagaggagataggcgctatcctaggcaggaaaatctttctactttgagtgtccttccaaaaactaaatgtcactcactcatctgtagtctcctcttcatgttttgttgcctaagaaaatgcatttgctgagtcctgaaaacttaagtggtttaaatttattttcaccatttacaacagattactggacatcaaagatccattgcacttatgaacaaagagccttattttcaagttctatataattttgcaaaactgtacaatgagtgggtgcaagtctttttcagtttgggagaaaaatgtttacatatgtaaaataaaaatttatatattggtggtgcacctctgcaatctcagctattgggaggtagaggcaggaagaccaagaattcaagtcaccctcagctacagcagtgagtgaggccagtctgggctgcataaggccctgtctcaaaagtgccccactcagcccacgatttgtctaaaggctgccat

SEQ ID NO: 18463 - DNA, 3184 bp, Mus musculus
acttcagtctagtgtcagccaagaactccaggatgaactagaagaagcagaggatgcagccgcatccagtgccatggcaagtgctgcagctggtgccagaactgggcgtcacactaaactataagacctctgaagtcaggccttcagaactgtctctggcagttgagtatcactagagaaaaagaaaatagagttaaatgtcctttggatattttgtatgcaaagatggctctcccccaaatcccagtttttcagctcaggattatatttgtaatcaaaaacaaaaaaacaaaaaagaagaaaaatagcttggcgcaggagggagaactttgtatgaagctgccctcttttcttttctttttaacccacttgtaaatttggattcacttcctctgttttatacgagctctgttaaattacgtttacagtattttgtaccactgtttacaaatcttgcatggacttctgccaccatgaaagaagaatatcctcatcttcaaatattaggcagatgatctttgtacacttcctgacagttgccagagctacagcataggtagtaggcacaaggaaaggcttccacagccgcagtcctcatcgctgcttacaagctgtcccggagatctgtatttgttttgttaccaatgttggcacccagataccggaatccaaactggcctgacatgaaggagcacacacacagccagagggcttgggtcctggtcagttcctctccacacccttcttcccattctgagtagcacatttcccaaggtgcccgtggagcagctggtctcaccccagatatgcccacctcagcagggtggtactcttgtatctgcctggcttgatgcctctgattctttaatgaagatactcttataactgatgagtgtttttgcacatgtgttaggagaggggcttcattttattttaatacattctaactcctccctgtacaggatattttggtggggtgggagtatcctaacctagcttcctgagcagcagtacaagctgacactgaactgctttttaaactagccaggctaccttttgtactggatattgaaacctagaatctaaaacacaccccaaaggtaattctttaatagtttgtgtacaccgtatcagaaatggcttattggagtttcttagttcatgatgggagtagccgcacctcataatagagattctattttcattgatatcttgttgaaaattatacttttgtgtgtcttaaattcatttttttatgttctcaaatgtatctctcttacataacatactcttgggaatgaggttgtgctacagagaagtcttagtgaggaagtcatctgttagagtccaaccccagttgacccttggatgtagaaccaatcattacatgtcacaatcaatgttctgccttaagagtgagtgtcctgtgtaagtagtggatacaacataggaacatccaaggtactgactgcagctttagatacgtgattagtgtgagagtcacattctctgtgtgaagatacatgtctttgagtaaatttcatctttaatttttccatgagctgattttgattgatactttttaacgtaagcacaccctctttatagggaaagtaaaccttgagttatttaacactggcctgaggaaaacgaagtcactttgtactgtttgactgttctgtttccagagaagaaagctgctgcaagttactctacccgtgccgggtggggcagagcatttgtttcaggaacggtgcagcaagacagaatatgtggtctttatgaagagtcaacttagttcaggtctgaaaatgagacttaggacaaaacactaatgctccccaagaggtgtcaccacgagagcccaagccctcagcccagcttggtaagaaagagatgcttggtacagttgacttgggtttttgttgttgttgttgttttattaatagtgtggatcatggtgttttctaatccattgagatataaatgttttgacccaagggagtggcccctcagttagacacttctgggtaaatagccaggtacatctctgtgcttaccctcatttcagcagctcagcacacaagtgacttgctgttctcatgcctgactgggacatttgacgtttgaagaaatgtaaaagtcttctaggaaataaacagctcatgtgcaggtcacctgagagtcaggacacaagattccttgcactttggtgtccctgaggttggaaggaagaaaatctctttagtgagaccaaccttctccacagtgtagattagcaatggattaattaactttgcttttcttgccctcagaaggtaacaatgagttctccacatgaactcataagaaaaaccacaagtcagaactccagtcatgaatttacatgagtttacatattttgtagttgtaaccaagtgaaactgtttcttctggtaggtgtttgaacaataatagcagtaatagatcagatagttggtttctggtgcttgttttaaatatgcttgggctttttaaatcctcattggtggcattggctttagaagtgtgacttgtgaggctgtagaaagtggtgactgtcctagagcacctccaggcctgaactccggccaactattgctctgcttcacagcaatagcatacctaccatcaccagcatcttacagagcagggaattccagggttagtccattgatagccgtgtgtgtgtgtgtgtgtgtgtgtgtgtgtgtgtgtgtgtgtgtgtgtgtgtgtagattaagcactgcagacagctgcaggactctgtttccatggcttcttccatcataagtcgggtagaaccatgttcactgcttcacagctctaacccatgtgttgtcttatggctccattatatatttactatagctttggtgtatgctatgttttctttttaaatgactaatgttaaaagttagtttttcagcagttagccatcctctcattacatcttattcttgccggtatggtttgagagtgtagcttgattgttagactttcattgtctgctcagtctattcacacacatctccactgtcaacaagtgggacagctgtcaacaaatcttcatggatctgaagagaatttctgtgaagttgaatgcaagtgtactgtcattcacagtgtttataaaacaccaggaaccttcacttttgctaccttg

SEQ ID NO: 18464 - DNA, 1053 bp, Mus musculus
tggtcagcataaattctgtgtagaaaacattataatagagctgttttaatttaaggaaaatactcactggtcaccaagaaatgtccaagtccagtcacaatagatcctaatgagccatagagtatagattctcgagcacatggagtgttctcaacatctaaaatacctaggagcttgaagggctaggataaaatgaaaaagaatttagcctgaacaagaaaatagttaggttcctattcaatttttaattaccagtcagccaacttaaagtgttctaatctgccacttcaggatttacttcagcatttgaaataatgagcacagtgattaacctctagcatgaagtgaccagtcttccaaggacatgtcactcagcactggctcagagatgggggtcaaaacatttttcacactctgttcatgcaagtcttagacatctggtggtttgtgactgtaatgtaatcccagcaatcaggaaaccacagcaagaagaaccacaactacattgctgtgaattggaggtcagtctgagcttgaggatgcaagactacacataacttatatgacagagcatgtgcgaaaagaagccattctctatttgtaccccagccctggaagcacagatgttttctgcaatgccactcaatgcttctagaggatgactgcataagagatgaaacgtaacactggtggggaatggagtaaaagacatgttaggttcggttaaagatagggtagagctgcactccccttagctcaaggatctgcctgaacgtgtgtaacctggctttcattaaagtaaaattgttctttcactgatgacttgcttctcttgtttttaatcatacacccaatcaatcattgtgggctgttctcatcatcaaactctcaaataagaaactacaggtctactggggagttcacaccatctctggaaattactcctatgccaactagcatccagtacatgatgaacatggagacattctggtagcgttagtgaaaccagttgtacctatgtacctaccacctgtattcttgcctagttcagat

SEQ ID NO: 18465 - DNA, 1141 bp, Mus musculus
cagcttaattgtgtagatgggatgagagtaggttgaaatacgctggatatggctcacacctataataccaacactaggatgctgacctaggctaggttacagtggaattgtcaagtacaatattaaagggttcagtggtcaggggattatatatataatggcatgtcccaaacaagtgaaggaaactaaatgctttgtgactctctttatccagttgtgctgctgtgaaaatgagtagtgaagatgtttccagccaagagaggtctccctttcatggtaagatataactgcagaatggatgataaagctggaaggaattaaaatacctgctttttcatagcgatatggctaagaccataaaaataagtacactgtccacacaaactcaacaaaattgtggtttctaccagatgagtaacttttcagtgcccaccactgacagttacacaattctctacaccctgtctttactgtttgaaggataggtgaagaatagaattgtcaaggttggctcatcttgacacaaagttctaaggccagtaatggatatatatccttgcttgggtttgatttctccttcaggctgatggtacttttttgtgaacatgtaattaagctgacaccttgggagggttttacattccatgtttttggcatggtctaacaaacatactgtactggcagtagagaacaaaaggatttcatgtaaaacaatacagtttacacacgtttgagttttttaatctatggttgatttacaagttgtttgggttttaaagctgattgaagttgcttagctgctgttgttggtcttcatttttctttcaggatcaaggtgggtgctttcatataaaatcttattttttattccttctctggcaattctttcctggatcctctgcttagcgaaattatacctacagtggaaccttgtaagaatgaaaaagaaagtaagctactagttcctatatatgagcaacctaaggaattttaattcacagatttccaaaatgcttataaaggactatcccaaaactaaatttaaaggtgtttatacaaatgttctttataactacataaaacatagatttctgtctccttagaataattatacctgttgtagaacaaacactgtaggaat

SEQ ID NO: 18466 - DNA, 1979 bp, Mus musculus
ggcagcagggtgtaagtagtttcttaaatgcttacataaattatgtgttatgtttacaagattgagacggaagttcttacctaggaattgaagagttttatactttaataggacaaggtgtctataaattgttactgtgttattgttactgtaaccatggataggctggattttaacattactttagataaagtaatatttaatacatatggttgttttactacatggtcatttttaatagttttaattacataaactaaccctaagtcttgtgtttcctttggtaatgtgtattggtaaataatatgggtaattggtaaattaaaattaagtctctgatctgatgtagaaattaagtgtgataaatttgtttccagcaattactctgaattagatcattgtcatttcctaaaaacaatttgagtggcttattgatgtttttttctttaaaaacaaaattttctcttacagcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgatttttttttttttcttttcttttttgtacatttttaattgcagttttaaagtgaatcgtaagagaacctcagcattgtgcacgataagagaatgtgtcagtatttcagggttctacattttatctgtaaaatgtgacttttttttttatcacaacaaaagtaaaatgttgctttgtacctggtgtcttttattaagcatttactcccccatttctcacagagaataacagtcgggagtcattgtcacaataaaatagcaatgttagcagccagattcatggaaggactaaggggtcctcatgaattgcattaagattctgtactgctcatgatacactccatcctctctagactgcctgccgggtaatagtggacgggtaatctctgacaaaacgggaaggctattttttttctgtttgacaatggaattggcataattgggaatgaagataaaatttggaaccaagattgagaagatggagtgtatgtagaagggctgttcaaaaatgtaaacttggttgcattatatgtggaggctcaaacttgtgaaggttaaataccataaaattttccatttgttctgcattttgattctgaaaagaaagctggctttgcccatttcttattaaaaaaacttgttgtaaatccagttgtctaatgggatctatatgaagttagctatgtctgtatgcccttctcccacaaatactgtattactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgtttgggattctcgccatcaaggtctaaatccctttatagtatgactcccaagaggagaaactttaagtgtgtgctttctggacagcttattctttactctgtacttcggaacatttaggttttaaaaacttaaatgtatactgatgattgattttataatataaagttgaattcttcccttcccctccccccaagactgcttttaacatttatgaggggcaaaggtactggctgggagaagttaatgttcagttgaccatgtttatgaaatgtgagtggctgtcctcacctgataatagacatataatacatgaaactttgggaacagatgcttttagaagccatcatgcaagccagtcattgatttcactactacacaatgctgctaactta

SEQ ID NO: 18467 - DNA, 2749 bp, Mus musculus
ttcaactagctccagctttagtgacaggaagttgcctaacatggaaccttggacacacaaaagcagttgaaactgggaaaatagaagactgttgtttgaaggatcattaacacattttaaaaggaaaaaaattggtctgaaaatatgtatctaaggcctgattcttgggatttgttgtttataaccattagttcttagcattaacctaaacatggtaacatgtgtgtcttggtgagttgagagaccttacagggagtttaaaactgatcttttttagagctgaagcgatggctcagcagttaagattattgactgttcttccagaggtcctgagtacaaatctcagcaactatgtaatgcctcaaaactatctataatgggatctgttgctttcttctgatctgattttttaaaaattctattcaacagaactttgaaactgatgaagttgaactctcttatgcgaagaatggacaagatcttggtgttgcctttaagatcagtaaggaagttcttgctgaccggccactattcccacatgttctctgccataactgtgcagttgaatttaatttcggtcaaaaggaaaagccatactttccaatacctgaagactgtacttttatccaaaatgtccccttagaggaccgagttagaggaccaaaaggacctgaagagaagaaggattgtgaggtaagttttattgtgtgatggtgtggattgtgttgcagttgacattaggagaagggtaaaaaatgagtgggttatagatttgttactatttactgctgagagacaaagtcgtgatggcgcttctttttctcactgtaggttgtaatgatgattggcttgccaggagctggaaaaactacctgggttactaaacatgcagctgaaaaccctgggaaatacaacattcttggaacaaatacgattatggacaagatgatggtaagtaacaattgaaatgaaagtgttgagaaggcgtggggagtagagcaaagggcgagcaaaacactataccctggctttagtcttcagcactatgacaaataaacagggtcagaaattatcctgggttaatgttggcttgtgttttcatttattttaatatcttagaggaaatgatttttgctaaaacaaattgggagtactttttatatcttccagtgactgctttttcataagtcattaacagcagtaccaaaaactatgtattttttggttactattgaaaggatacaactgagtatttataaaatgatgcctggttcctgtagttctaagctttttacaatattttgttaggtggcaggttttaagaagcaaatggcagatactggaaaactgaacacactgttgcagagagccccacagtgtcttggcaagtttattgaaattgctgcccgtaagaagcgaaattttattctggatcaggtaagtagtagctttgaagttaaagagagaaatcaactgataattggtaaggtgtaacattaacgtctttaacattttcccctcaagacaaatgtgtctgctgctgcccagagaagaaaaatgtgcctgtttgcaggcttccagcggaaagctgttgtagtgtgcccaaaagatgaagactataagcagaggacacagaagaaggcagaagtagaggggaaggacctaccagaacatgctgtcctcaagatgaaaggcaaggaattcactttatttttactgtcttaagtacggtttggggatttatacctagaaaatatcttcacacttagagattatattaatctgctaaatagaaacttgtatggttattatacaaagaatgtgatgaaggccgtgaccagataactgaaagttgaaagaattaaacacattcagagataaagtttatagaatttacatgttcataattgatttataagtttgacttgattccctgtaggaaacttcacccttccagaggttgcagaatgctttgatgaaataacctatgttgaacttcagaaagaggaagcccaaaagcttttggagcaatataaagaagaaagcaaaaaggcactgccaccagaaaagaagcaaaacactggctcaaagaaaagcaataagaataagagtggcaagaaccagttcaacagaggtggtggccatagaggccgtggaggattcaatatgcgaggtggcaatttcagaggaggaggcaagttaattttgcctgttggtatttggaatttgaaaatgaatgagtttattttttaagttaaataggaagttagtttctttgataatttgctgccatgtttgactaatacacaatgaggggagtgtattgggtatacttaaaactgggcattgcttactttttcattaatgataagagataactgtatgaactcttccttaaatgtgtgacagctaaactaaaccctttgtgcatttatttagctcctgggaatcgtggtggatataataggagaggcaacatgccacagagaggtggtggcggtggaagtggtggaattggctatccatacccacgtggccctgtttttcctggccgaggtggttactcaaacagagggaattacaacagaggtggaatgcccaacagagggaactataaccaggtattgatttgccctgaaatgttgtagatgaatggatgttgggagtcttaactggcggcgttgacatagttgtgaaacaatttagttattggactttgctttttcaggtcattaataacagcagtgag

SEQ ID NO: 18468 - DNA, 1356 bp, Mus musculus
gccgggcgctcgggagcgggcctagagcaggaggccgcggctggcgccgaagacgacgaggaggaggagggcatcgccgctctggacggcgaccagatggagctgggcgaggagaacggggcggcgggggcggctgacgccggcgcgatggaggaagaggaggcagcgtcggaagacgagaacggcgacgaccagggcttccaggagggggaagacgagctcggcgacgaggaggagggcgcgggcgacgagaacggtcacggggagcagcagtcccaaccgccggcagcggcggcgcagcagcagccttcccagcagcgtggtgccggcaaggaggccgcgggcaagagcagcggccccacctcgctcttcgcggtgacggtggcgccgccaggggcgaggcagggccaacagcaggcgggaggtaagaaggcggaaggtggcgggtgagtgttgcgtgatgggtgcgcgtggcggtggggaccgtgccccaggcctgccggggcccctcggggcgagcgccgcgggagggtgggggcgggggagccccgggaggctctgctcgccatgccggcggcgcctccattatgtatgtcgggcgccggggtggggggagcgctgcagctgccgcggtgggggggccggccgggcgggagcgccggccgctggggcgctgcgtgcgcgcggtccgggcacatgtcggcggtggggggaggggagaagcccgaaggtcccggagcgggcgggctttggcggcttagcgccgcggtattgtgcaaggagcgcaggggctcgtggtgacgtcacttccggcggcaggcgcggggagcggggcggaagctcagtacaatgcggcggcggggcacgcgggctcgtgtgggggaggggaggtgggcccaggcttccccccccctcgtttgagcgcggccggcgcacgtgggcccgggcggtgtcccgctttttttttttttaaactctttttaaaaaatgctttctggaaggttgcggtaggctggcaagttcagtcttcagactgcgtcactgtgtccagtccaagtccagacttttttattttcatttgtcgattaaaaaagtcaaagaatcagtcagaaaaaaataatcagtaacagctcttgaggctcgaaacacaaaaggtgcttaactgcattatttagttttcggcctgatgctttaaggcggtgttctgtgtcgttataggagacggcaaaacagaacagaaaggtggagataaaaagagaggcgttaaaagaccgcgagaagatcatggccgagggtattttgagtacatcgaagaaaacaagtacagcaggtagaggctcctcacccagttttaac

SEQ ID NO: 18469 - DNA, 1173 bp, Mus musculus
taacaacaaaaattaaccacattagttaaaagattttgattggtttttctttgtgtttatagattaattgaaatgggtaagcatttctgaccagaggagactggtggctctgccttcctcaaccctagggaacaaagatctgattggtttgagttactttccttataaggcagggaagagagatgctaaacaataggagaatcattaacaagttactccaggcaagtcctccccttccccccaaagattaaaacagaaggattctattatcttgcccattgaaactggctttcgcggggaattctgtttggctgtgtttaactttattatgggtgactccagtttttctttttaagtctgttttgggacctagtataggagcttaatccaaaacaaaagtctcttgtaatcatttgctgtgtgagctgaggctaggagaaaggaagcgtggatggacagtccatgcccctggagcttcatactccattttgctttccagaaagatctctggttgaacatgaaatgaaagttttagttgaacaaagagagaccttcggggggggaaaaaagctgcctagaccaccagttggagaaacatgtaagagagttgcttttctttgcttgggggcagtgagaggttgttggaatattaacaaggaatgagaaagaaaagcaacgaagtagaatttgtcctgtcttcttgctccttatacttggtagagtccttgtttattcaatgctatgttaaaaagaaggagtttggaattttaggttgatgcagataaacttgaagtagtaaaattgatgctacaaaggatttactaataagcttgcttaggaaatattaagttacacaaagtggaatttagctaaaggagtgcctccaatatgactataagttaagagctatactcaccagacttgttagaaactgtaggaatgaaaaacttgtactataatggaagtttagggatgtgaagaaagtttctccagggcttggagagatggctcagtggttaagagcactgactactcttccagaggtcctgagttcaattcccaggaaccacacggtggctcacaaccatctgtaacgggatctgctgacctcttctggtgtgtcagaagacagagcacttatatacataaaataaatacattttaaaaagttta

SEQ ID NO: 18470 - DNA, 1212 bp, Mus musculus
ccagatgtcactatggtcagttggtttccttgatcattatctttttttgtgtgtgtgagacagggtttttcactaaaccagaaactcatgtgactttggctcgacagctggctggcaagctctgggaacttcctattcccttccgtgcccccacctgggattacagacgtgccctggcttttgtctgcgtgactactgagaatccatgctcaggtccacgtgctggttcagcagatatgtgactgagccgtcttcccagaacgcccccctttttggttagcaaaggatgaagttatagttgtaacatacatagatgagtgtaggattgaacatagttcctgaagggcttttgcttttcttagcaaataaaatcagacacatgaagcatgggacacaatagttaaatgttcttatcaatgaaaattgaaacaagtattctaactgctaggatagaaaaatagaagatagtttaactggttttagtaacacaacatacagtccatatatttggtaaagtcattatataagtatataaatgaattatactgcctttaaaacgtatattaagatacttacctggcaggggagataccatgatcacgaaggtggttttcccagggtgaggctcacccattgcacttgggatgtgctgacccctgcaatttccccaaacgcgggggaaactcgattgcataatttgtggtaatgggggagctgcgtttgcgcgctccccttgggaaaaaaagtatattaagggggttggagagatggctcagccgttaggaacactgactgttcttccataggtcctgggttcaagtcccagcaaccacatggtaacttataaccacctgtaaagtgatcagatgccctcttctggtgtgtctgaggacagctacaatgtacttatatacataaaataaataaataacttaaaaaaaagtatattaagatgaacaagacacgaaaatagacaagttcccaatgacgacatgagaaaggaaatgtttttttcccatgtcgtttgataaaggaaagttaccgttttaggcactactcatgtttattaaggcaactttaaggactgaggaatgtgaactctgggctggggctgtaagctcagtggataacagacgtttgtaaggcttggtctactcttatcaaccactggatgcttgtcacagaagctatgataacgtaccccatccctcg

SEQ ID NO: 18471 - DNA, 1167 bp, Mus musculus
atgggaaattcaagaccagggtactggtgcctatgtaagggctgctgtctgcttccaatgtggcgtcttgtcttcatgaggtggaagacagaagggcaagagagaccaggcttttctgagtggccttctgaaggttcagccttgtaagatcaaggcagtgatgatcaagcttcaacatgagttttggaggggacacattcaaaccattgtgattgttgaatctaagaataaaaaaaaaatattttctttctttagatagtaaacctcttagtggttacctatatttcagaattctagtctaccgttctttcagggaaagaaactttaaaaataataaaagttcaggctgtgagtgtaccttgtttgatagggtgttcacttagcttgtgtgaagctcaggagtggatcttcagcacaacataaatagggcatggagtgatagcagtagaactaaagaagaaactggtacctctgctctcaaatcggttagtaatgcattgctactgagcatgaaggccatttcaagtgtgtgaatcctttagcataaatcttacatcactgagaagagatgatgtggtagatagtatatggttagatttccccttgcgctgacttctcgctaattacatactttgctttctatcataaaaagtacacaaaacccaatggaggagaccctgtcattgaaggttgagacaatggaaatttcactgttatttgaaaagcaatgagtagatactgtatcatgcgtggagttgcctcaaaccttggaaaagaaaatgaatccttcagatggcctcatagcttcacactgagttttcaattcccaaataatccaaaaaagcatcaacaactatggagttgttttcccttcagtctgtctccttcctgtccccgtccttaaactcaatgactttccatttgaagatccagttgcactatttttttttcttgttgattaaaaatgtctgtcctgggtttgaattttctggataaactctagtgttcaatagagcattgctctctgtggttactaatcttggttgtcaacttgattggattgtgaaggtcagtagaacccacttgctggaattcacagagagtctgatgatataatgagggaaaaggaaggaggggagactgacttggaagaagctgataccgtgg

SEQ ID NO: 18472 - DNA, 1185 bp, Mus musculus
tgacatcacctccaggcgccgataaggactgatgggctctgagccatcaggccctctctcccccaggacttcagcaggacaccgccctcccaagccctctgtgctggcaacacccaagacaacaggatgaggatgaaggttggtagcaagtctggagtgagcgtggagcgaaaggcgatgtttcctttgtttgccataggaaagaaaggtacagacaccaacatgtggaaggaggaaatgatgggaagccccgtgggactgagaaagcactttgaggaaccttgaagaactctgtacataggaccgctagcaaagagactcttaccttgcggctgtgggaaaggggagggtgacatgggattaccatggagaacgaaacaccaacaagatgacccagaatgatggattaagtgccttgcaaatctttatgattatccaaacattgtgtccgtactttcttgtgtccagatggtgctagtcaagaagaaatcaacaaaacagaaaactcaacccagtttttgaaatgtattgacggcttgttttctcttggtatttttctcttgtttctgatttgctgtttgtttctaagaagttgtgtttgtagtgatgtctcctaatcggtattgcagctgaataaatgttaactgtctttcatggctcttctggtaaggccactcagaccgtggaaaccgcgttggcatgagccggtgtgtttcccagggaggtttggaaggacaggtgatgggagagactatcttccaaagcggcaggtcagctggcagacccagggttgggcatggaataggtacacatgagctttagtgacaaggagagatgtctttaaggggaagagagatgtgagcccctgtccctgtttgtttcatgggcttgtggctctcaacacaagctcatgttcctttctagcccaaagactggctggaaagcttgggcaaccgcagccgagtcccatttctttgtttactgtggcatcactgatgcaaagtggggctgtctacatttcgactctctgggctcacacgggcttggggttgcatcgttttctgccatccagtgtcctgtccagtagcaagaggccaactctcccctgtcctaaagcctccatggcttgtccctgccaccttagtatcctaagaaagagagagaaaccccatccctaaattccag

SEQ ID NO: 18473 - DNA, 1142 bp, Mus musculus
ttgctctgaatctcagcaggcagccaaagggactgagacaaagctcttcctttcaagttggcatggcaatcaacttggaaatcaggttccccgggcctttgccttcctaacaaaggatccagcctcctccaactgggtctccactcagcccctgtagaaaagtgctgacagtattaagttctactcttccctaagaccccaggaggtcctcaccgtgcatagatgtgccatctgttcttgagaaaccaaagcactttagtgagtcttacaacccataatacttacagtatttgccctctgaaaggtggaaggggcttgggctaggtctcatttgagaggcaactagagctaggaggaaaagcctggagctagacagcagggagctaagccacatctgcaccaccacaagctatgaacctcgggtaggttgctgaattttgctgccccccccccctagacagttgtggggaggtcctaacagctaccctcctgggatggcagaaaaggaagggaataatataactggtgggacacgctttgaagaaatcagaagctctctccagaggggagggaggatcatgtatagatgaagaagttgacatccgtactcactgcctggccaggttcacagtctcacagcagaactgggacatgagccccgccacctggagtgtccctgatagagcacctttcacccagagtgtgtacatgaacacaggctgcttctctgtgccagtgtgtgcacatatgtgggtgtgtctgtatggggggtgtgtgcagcacagatgaacgtaggacagaaactccgagtcctaattcctttctaacagtcgacctgtctgtggcctgggacacacaaccaactcttctggacctcagattttctaagtcataaaacaaggacattgtggcatgggatctttgtggttcttccaactttggtgacgagagcccctaacgggtgatgtatgtatgtatatatcgatatgcttatctgtagaaacgggcccattgggaaattggagacgaggcctgcccgagtgcattgacttgtaacagaatcggcaacttcacaagtccgtaagccttcattttaaaagtcgatgggatggtgtcatttactgtcattgtttcaaattcac

SEQ ID NO: 18474 - DNA, 2037 bp, Mus musculus
cccctaggcagtgctgtctctgctagccacagtagcttatagtgggcatctgaaggccgtttcacaatgaggaaagaagtctgacgtcaggtgcactagaaccccaccccagatttgctaagtaactctgagaggaccttgacctcagccttttgaaaggccagttctatccaattcaacagatatctattaaatgattctgatgttttcaggaaacgtgcacacaaaggccaaataaaacttgcatgacctaccaagtgtatactgagagaacttgcatccattagcttatgctgtatgacaaacagccccagaacataacttggtttagctcatagtgctgtaggtcagcactttgagctggacatttctggtttgttccgggacttattggttgtgaatcgttgctgttattggtaggtcacttgcagaatcagagtgactaaatgatacagcaccttaagttggctaaccagttatgtccacaggccaggagagttccaggatcagtaagtcaatcaactcccagccaaccagtgcttttcaagcctgcttctatcacattggctttagtccgataggtcaatgcccaccccaaggcatggatatgtgttcccatctctgtagaaacagctacagtccctcagcaggggcatagccacaggagtggggaatggtgccatctgggcccttcaccatagcagccctgaaactatctatatgctatggaacacttaacaaatatgatgaaatatacactctgtacttccggtaatagactagaataatttgccattctaatccagattcttagaacactccagggcccatcggtgaattctctgacattctcatcaaatgaaaaacaaacttcctacattctggaaagatgggggtgggggatggaaccaagagatgaggaccaagagaaagctgtattgtttgtccccctttaactcactggggaaatgaaagaccccaagagaaagtcagggagtaacttccatggcccatgggcagagttcgtagataggatgccgtgcttgccagctttctgaatgaaatttatcagtcactgatgatcctggattaagagatttgtcttcacgcctcctagagaaaatctgatgggctttgaaatccctctctgccaacttacagtgtgtgaggatgaaggcaccctgcgtggacccagttttaatacaaagcaaacatttaagcaaaggtaaatatttacccaataaaattacagcaaaataattttggcaaagagggaaacggtcagagaacacaatttaaaatccgtgtcgccagtgactgaggattgattgcggccccagcctctacgaagccttcccattaatccatggtcattgtagcggcaggcttttctcacgtcagtaacttgacgccattagccgctcctctgggatgagaacacatttgaactgaaaatgaacacgccgggcataatttatagccgtgccacatgaatgccaagagtgtgaggaggaagctgcttgggaatccactcatggtggctacccagacctgacttcctctaagcaagagccagacggctgcaaaccacaggcccccagttagacttggctgcagggagggagggaaattgcatacaggagccagatgtcttgaaaattccctcctagtccagccagtcaggagtggaggcaaggctcccatagcagagcccaccggggttcatcagagagagggttctggaccttgtgaaaaccgtgaaatcttcatgtcaagcagtcacggaaggaagcccctttcctctgaggtctgatgggagaacacccgaatccaagccagaagcctccctaagactgggatcagagtgaggatgctctcggcgtgttcaccactaatccaaagctctgaaagagcagccgaagcatctctcctgcccctacatttactattcaaatttgctttcaattggcatagaaagtgtgcccctgcctatggacctaacctgctattccagagggaccagcttcccagtcccag

SEQ ID NO: 18475 - DNA, 1216 bp, Mus musculus
gtttctttgttagatttttatccttacagaattcatcagaaaaaaataggaaaaaaaaaaaaacctttagtttgcttcaaaattcaggaaaaaaattacttcattcgaatgttagcaaatttgatttgcttggtctgactttttgttggtggtttgctttccctgctgttctgaatataaaatacatttaaaaatgtgaattctgtaatcatatccctcaaattcacagccatttgagaatgtttaaaatctcaaggaccagccacagagcctttagcctcgtatttttatcatccatgttatatatgggtctgccctcttgcaggcactacactcttgcagcttaatacaaaccagatgcctgtaaagcaatataaccagaatttgtttaaagtgtgtctgtgcaccggtttactttcagatttgaagctgtggttttatcagactttgaaggggggccggggtggggggcgataatgccacgctgcctagctttcactaagaattgtttggagcagcagaggcgcttgcgaggactgcgtaccttttcctattctcttcccttctgtaaatctgacagagagatttgccatctcagccttttctgtagaaactctctaacaagtcggcattcatttgtagtcatggtctgtctcaaacatggttgtgtctcctttcctctcaatgggctttctatatttcttcctaaatttatatctctggccctacctgctctccaaattccatttgttcgttcctagtctggcttggaagtggcccagggccatttgaaattcaccctaacaaaacaaaggggcacattcctcctcaacacacacacatacacacacacacacacacacacacacacacacacacacacacacacacacatatacacacacatacacacacttacttggtgccagacttgtcccttttgccttcttcctcctcccaataaatgacagcagtggtcagccacttagaagccaaacaccaagtttatccacgactcctccgttccccatctgcagctccccagtgaaggctgtggcagaggtgccagctcctcccactcctgtcaccagtgtccaagccaatgcgtgcattatgaagtgacctctgacctgtgtgctacacacgcatgctcaccattgaacaaacagctcgttctgtgcatagcagtcagagaaatcccttgggaacagaaatc

SEQ ID NO: 18476 - DNA, 1134 bp, Mus musculus
gtgttaatcccgtttaagagcagagggatcaggacacaggcctttaggacaacccactggctcattacctagtgtcttgcagagttaataaatgctctctgaatggagaaataagcaaaattagtgatcaagtcaggctttaaaatcagatcttatagcctcagacccagctttttttttttttttttttttttttttttacctcattgcttctctataagagatttgggtgaacctaaaagacccgttgtgctctttactgttccctgtacagtttgcttgactttgaagaccatgttagcttcattgactccttcattctgtgctttagcctgtaactgctaactctctccttcgcgtccctcctattttcccacagctacagcttccttgttaaatctattacttctggagtcccagcttcctgggtataaatctgcgatttggtctgtgatctggatgaatgacttaaccactgcatctctcagaatcactagccttaagccgaagatactagtattactgaccacaagagcttcttacgaaattgatgccagtagacatgtacctaaaataggtctttgtcattgtgatggctggttttatgtcaacttgacacaagctatggtcgttagagaagagggagactcaattgagacaatgcctccataatatcagactgcatagggcattttcttaattagtgattgatgggggtgggcccaacccattgagggtggtgccatcctggggctggtggtcctgattctataagaaagcaggctgagcaagcctgtaaacagctcccctccatggcttctgcatcagctcctgcctccaagttcctgccctgcttgagttcctgttctgacttccttcattgaagaacagtgatgaggaactgtaagccacataaaccctttcctccccaatttgcttttgttcacagtgtttcatcacagcaacataactctcactaagacaactacttatttattctttgagactttgagacaaaaatatattcatacaatatactttggttttgtttttttcttcccccaacttttctcagcccccccccctccacttccctacctactcaacttaaagttctttttctcttagaaaaaa

SEQ ID NO: 18477 - DNA, 1242 bp, Mus musculus
ttatgggagaaaggcgggtctttctcggtctctctctctctctctctctctctctctctctctctctctctctcacacacacacacacacacacacacacactcataaactatgtaacatctttgtatgccaggcctccaccacacatcctttcacctgtgcagtcagtgttcattgttttctgtttgagaaggactagcagtaagtaaacgggccattagggtgtattgttttgtttccttgtaatatcctttcgactctgcctcctccttttgtcctccagcctggcctggtgactgctggctttcagcatgctggaggactggaactccccaaggctgcattcatctcctcgagttcacattatcttgtctttgcttccgtggcagcctctgtatggagatggagtgctgtctcctgtagatgagcaaaccagagcttaaggaagttgtctaaatcttgacagggagtgagctgaggaattaggattgcaaatcaagtccaggtcgtgatgatgaaattgctccaccatatgccgaccgcttctcagcctccagagctgttttggttaccgtaaggaaaagctgtgctgtgtatcttggttcttggggcaatgagaatagtttatggtctttctgttggactatcagttgacaaaaagataggaggagtttatatttgttaaacatctccctcttttttcctcccctccccgccccccagccctccctttcttttccttttctgacagggttttactatacagcccagactagcctcaaaccctgagttctcctgtctcagtttcctgagtgctaggctagggttgcagttatacccccaacacgcctggcctttatttatgttgctgtggcttctatttattaaataaatgatattatcgcttttgttttgtttctggtagcacctgtaccgcgtgggcctcccagggaaacagtatttcctttcactgtatcttatggtcccccctccccccacacacacacacagatccacacatcttaccagttggcccatccacagctcaaccaggcctcaaccttacatagccttcagggtgacctctgattctcagggctcctgagagcagagcatcccacagcatgaggaagcccgagagcccgaatgcgttactttgtttaaattcttgccttgaagttcctttagtgaaggagccagattggcaatcctacgagaaacagttgtgtttcttagttacgc

SEQ ID NO: 18478 - DNA, 1179 bp, Mus musculus
gctacagtttacttacatataataaataaatcttaaaaaaaaaaaaacacttaaaaaaaaaaaaaaaaaagaagtcaactcacttcctcattcagaggtttttattctagtggtatggcctatttttgccttcatgaagaaaaagagaaaagagacttttagtataagtaccccaagtgtctccttttgcacaggcataacactactgagtgatagcctctcggccaagtccactctaaatttcatggcaaataaatagaagtggtcgcatgaagccacagtatctgcctttttgtctggttgtacgtgttctgttaaacagtttttcctactttggagctgatgtgaatcacctcatacacatttgatttccaaagcgtacatcagcacgtaatttttagctggtatgtatgtccatggctcatggctcccagcatcccacccctgtatcttgttacagctatttctgtctcttgtgtcaccgttgagagtttgagggcatttaaaatgtttatttataatgaaggtgagcacccccatgcagtggagattcaaataggaatgaaggagaaagaaatgggtgctgaatggacatcagctagagctcactgggctgtttgccctttcagcaacacttagagtccttcccggatgttgcttatctggtttagcaagtaacaggacagtgcagtgggtctcaagtggctggggctggggtaactgaacaattatgtccaagtgtaggtccaaccctctttctacagcatgggaaaaactagggtgaaaacctttgtcctaagtatgatgcctgaaggaggaatgaccatgtccgccactgaggaatcagtgggaggagcccaaagaattattagatgataaaacaggaaccatctgccccttttcttttcccttgtttgattttgttaatctccaagtgatcaagaaagatgttctgctatttgagcaatgccatgccatttttaaccatttagcaaaaatggtagttgagatatgattagggggaagtaaaactttgtgaagtgttcgctcatgaaagctgtgtagaattcttaaatcagtggttcaaaataggacacttacattccacagagcttgtcaagtcctgcacagttcaaagcaacgtttctttaaactttttttttttaaacaatgtatctg

SEQ ID NO: 18479 - DNA, 1132 bp, Mus musculus
aaccctctttgctgtgttgtgatgtttctggttttggtgacaccccaagatggcattcctgatctcagaatggtgccgttcattgtccatttaatgatcagtttccaaaacatgttctcttttacttcctacaaaaatcattttgtggtcaccccatgatcgaacaagcctttatcgttgtattgaaaagacctggcattagtttcctttgattgcaggacataagagaaaaatggtccacattgagaaataaatacaccgaccaaacaaaagagcttgcttctatctgtggtgacagacatattttgatgagtttagattcctttcattttccagagtataattaaaatagcaacaattataaaagcagcttttcttgccgaaattggaagaatttcaaaattaaaaaaaaaaaagtaaagatccccaaataaaacagtgcaaaaaaaaaaaaagcacaagggagaggcagactcagtttgcagacgttgtctggtttcaaaatagtcctgtgttgtggcacagttagtgagcgtatcaaaaaataatcacaaggtaagataaatcatctattaggataatgtcctagaaaagattgctttgtagtgttacaagcattgcaagaatactcaataaagggaccagcatttgcaaccatagcatggtgttctgtcttgaaagctctcgttttcagttaggacccagccctctcagagcaggaccttctcttcctccttttggtggcttcactgaagcagtgaggttagggaaggccatccttcatcttcctgactttagtcaacactcagtaaatatttacttagcgtgtatcctaagtcaggcacatggctccacgcaggaggtgctgactggtgtaataggtggccctgcccttttagacctcacgatgtagcaggagagtccactgtgtaaataaccaaccccagtacattctccactggttatgtacagactgtactggaggcaggtgggaagagtggtgggttgggggtgggggtggcacggatacaagcttgctggcctgtgatgcagtatttataaatcaaactaatgaccatctaagcaaggtcattaggaatcaggaactgtgtcaagtacaaagggtgcagag

SEQ ID NO: 18480 - DNA, 1105 bp, Mus musculus
tggtttctgatacaggaagcctccctcagaaagtgcactgcagaagcttctctctcccatggtgcttttctgccaaagggctgagcagtgctaccctggagagcagaggctggacctgggtcctgccccctgcactccttcaccacaccttatgtggggcccataggttaaacctcatgaacagcgacttccagcaaagctcaccctgtcctcctggtgtgagcaattccaggatgagggataactacatgcttgtaggaagtggtccttgatggatgactcttaaccctcttgttcccagagcaaacgggagagattccatgcctccagagagtcctatgatgccagtgttctggtctcagccagctttctttatccctggctagaaaagaatctcgaaactagaaaggggacatttccaggtttggtgttagcagtgtaacccgtacaacaccttatattcagaaagcatttactgagtatggccatgccctgggctttgttgcagtctctgctaatgtggtattaaatagcacaggagccttgatctcatgcaagagaggtctgtagtggtcattgtgatagaatgagcacattctagtgataactatacatctatgtgttctgggaacacacagggagtacatttctaacacgcgtgtccaggctgtgtcaagataatcctagatttacatttcagaagcagacagacagaggcaccgaggaagtcagatgagatacttccccgtgccccatggtaaaggtgggccctttccagttcctggagcatagaatgtatcgagcttccttttacttgggaagctaaagcagctttgcttgtggggcttcttggtggctgtggtataaagtatagactttattatgtagtccacaaagggcagcttatagcttctaagcagatgaataaatgaacatgctgatttggaaagatagttctggtaatagcatgaaagatggattagagagtttgggagagaaaaaggagcctaactatgaaactcacagagtagttcaggcaggggaaatgaaatgcaaaattggactcttataaaaaggctggacccatctgcaagccagggaggag

SEQ ID NO: 18481 - DNA, 1155 bp, Mus musculus
gtcctttggcagtgcagccttaccttagttcatttcttcactgtttcctgctctccttcttgcacgtgtttgtggctgcctttgttattttctcttccttctgcttcgtgtggagttattttgcgttgcttctctaggttttgaggtaagggcttggattgttgatttgaagtcgtctttttttttttttcttccactttttattttcttttgaaatgtttatatttattttagtgccagagcgaatgtgcagaggacttttgggagttggttctctctctgcaccatgttgtcgttcccgtgcagctgtttacctggttactacagcctctcctctccctcctcctcctccccctccttttcttcatctagaaagataaatttataatatttcattctcccctgctcctcttactttccagagtgttctgtttaaagcaagtgactctgtttgtagttttgggacaggtttttagatttcccgtgtccatctttggttgaaagcatttgtgtaatgtcagcctcaacattcttgtcagataacggcagcacttgatttacctgagcttggtttatgtcagttacctcgtctgggttaagttgacattcccttggattttagcacgagcgttttcagctgtctccgggccattgaagatattatgagatgttggacattacatccacacactgttagtggacttcctcggacactgccagtggagaaggaagggagccacttgttgccaacctggacgtaggtagaattcaagctctgtgctgtctttgaggggccacccgtccactttctggcggggtgcagttcaggctccctttgggctctgctgatgttctgcacgtgaggaggtaaggaggcctcgttaccatttctacattgcttccatttctacatggctatcaggtggagtgtgtgatgtgttactggtagagcagagcctttaccgcattgctgtatggtggggatggaggtccagtctccccatgtggtcctcgctgttactagagagagggcaattgtctttatcagtcagcctgtgattcctatttgggctcccttttgtgactttattatacaaccctggctcccaacactgctttagtctttgctgacacaggtaggaaggggcctgtaga

SEQ ID NO: 18482 - DNA, 1214 bp, Mus musculus
agaaatcttcaatccattgggaatttgcttgagagatttttccttacgaagctcatctttcatttgaaccatgggtccagatctgtaaactcgggagcagaagcttctggtgctgggattcttgagaaattcaaagcctcacgatgcattgcctggcttgaaggttttcaactctgctagggataaatagaattatgctagtctctggggtgtctaacaagaacagcagaataccgaaaacagagcaagaatccccaaagcaaagacaacccaagagggccagtgaaaggacactaaagctgccattgaggcaggggagaggagggatttctttagtgctactgggtgaccctttcatggataaagagggctcctagtattacaaaaaaagaaagaaagagagaaggaaagagagaaagaaagagagaaagagagaaaacaaaaaaacaataaaaaacatcctttgcatctgacagcaaacatgattaaaaagagcaacttgagaagagatctgtgttagcttgtttccttgatctacatacaatgtctgacagaatggcagcctggctttgaaagcctgacttcatgagaaaatgtaattgttgtagtctctctctctctctctctctctctctctctctctctctcacacacacacacacacacacacacacacacacacacacacgtgtttgtgtagccagatgtcatatgcacctgtgggcacatgtgcatgactctggaggccacaccttgatgtctggtgttttcctcactcgctcctcaccttagtttttgagagagtttcttactaacttggagctcatccatttggctagtcaactggccagtgaactatagtgatctggtcacctctgtcctctgtccctattctgggcttatagaaacagggctgcacccagcttcttatgtatatactgggggtccaaacagacatcctctttcttgctgcaaggcgcataactgataaagtatctcctaggcccttgctgtagcttcctaaccaggtagagtgttatgatgaagaacatgggctctgggacaagagggtagtctgtcccttgtctgtccctgggcaagttacttacctttgtgccttgattatcttgtctgtaaactgtgtactcaaaggtacatgaaggaaccttccaggcaaggctccagcataagttgaggacaggcaaaaaaatgta

SEQ ID NO: 18483 - DNA, 1204 bp, Mus musculus
gtggcactgtggtggagtgcacgcttatattctgagccctgcgtttgagctcccacactacagacaataaacacatcaacagttacaaacagagttgaatactggtgcttcagtggaaaatgtaagcgaagaaaagagcagtatgtgttgagcatctgagctgccttctgggcatctctccagtggatgtaccatcacacccggcagtttgtgaccagcagatccatttggtggagtggatcccacctggttaggaatctgttctctcatgttccaggctgtggtcctaggggcagggccagcacacgctcagtgagtgaggacaccgttcccctcagtagcccacgtgtggtccgtgcactcgatatgaccacagcctagccagctctctggagatgacttggcctcagatgtgagactgggcagcatggtggcctcacctttctgtcactcaccagctgcacacagattctaaaggaatttctgaaccttttctgtgtgagaatagccatacttgtaagaaccatgcacggcttagaggacccgagtttgagtaccattcttacccttacgtggtgaggatctatggccggaatctgctgctctcctggagttaccgtctaacagcgccgcttttacaagaggggagctctgtgacgtggccagtgctgtactgatgtgaaatgagtcttgactggacagaaagttacaaacttaataataatgtgaaattctactttctagcaagtcaccttgctattctttagtttcagagcaattataaaattgtgaacgatttggagtaggaggaaggggtctggttaactcagccaggcacgattttctccttataagtgtctctggcctgtctagtagtccggtatgttgtggacactgctcattgtctttgaactttttatcctttggtgtgtgggataggaggagagtggaggtggagatgggggagcagcggaggcatttgcttctctttctagctcctgggtcaggtcactccttacagccacctgctactctgccaagggatctaatcccctcttctggcttctgtagacaagtgcatgcacacacacgtgcacacacacgcacaacaacaacagcaataataacaacaacaacattttttttcctcagaagaaagcaggtcttaaggctgctggctcttgtcacggacacactggtcatg

SEQ ID NO: 18484 - DNA, 1140 bp, Mus musculus
gtattgtgattgcattgctctttaaaagtgcacacgggttggagggaaagcccagcagtcttacaggagcctgcatttgtctcccagcaccctaacagtagctcacaagtgactatagatctagttccaggggatacccttttctggcccccgtgtactgcatacatatatacagtcaaaatacatataggaaataaaaacaaataaatctttttttatagttgcaatacatctctgagcctgagttgtctacttcagggatcaggtgtgggtgtgcctgtgtgtgtatgtttttgtttgtgtgtgcttgtatgtgtgtttgtatgtgtgtttgtatgtgtgtgtttgtgtatgtgtttgtatatgtgtgcttgtgtgtttgtctgtgtgtgtatgtatatgtgtgtgtgttcctatgtgtgtgtgtttgtatatgtttgtgtgtgtgtatgtgtgtgtgttcctatgtgtgtgtgtttgtatatgtttgtgtgtgtatgagagtgtgcttgtcactcctctctcatattatcagcaccatccactcaggctgatggatatggaagcacactcggattgtgctgagggaatgcatttgttagtctctatgagtgtttgttttttcaggttgctgtgttctgcctctaggctctgaaccttggtttctatgtcaacagataggattcttgtggagtgtttgtaagacagctagctggctgtcaaggatacttgttgtccagaatggcttgcattcctgaggctgcacatggatttaacatctcacatgataccacgataagaaactagtttgtttgtttgtttgtttccttctttctttcttttgaaaagagaagggaatgagaggccaaagtttcatctctgatgacattagcaaaagtcacagacactctgtggacttctgtgtcaggtatagtgaagtgacagttcctctctcatgtgtttattggagcactgaattgaatctatgtacaagcacagtgcctagtacagttcctgggggtaagctgcttacccctaactaaccctttctcctctgtgcagcgagtatctgtgtccctgtctgctcagcatccatgcctctctcctccaggaccagcctctgggctttgggtggcttca

SEQ ID NO: 18485 - DNA, 1176 bp, Mus musculus
gcagattgaaaataatttttttttacgtcatgcgtgtccaagcccccttttgtagtcagtatggcataacttttgtttacacatcatttgcattgtacgtgaagcaggggttgagtgtgcatgggaggatgtgtgtaaggttgtctagaaatactctgctatttatctaggatactgagcatcgtgacatcttgctgtctatgtcagcttcttggattccaagggctgattgcgttaccagcgtgtcctgggcattggtgtgtgctcttctgtcggggttaagcctctctacaccgctctgatgttgactttattattatctcctctggaaagataaattaacatagtggatgagaactgaaatactttgtgcgttgtcaccagacctttgcagctgcaagctggtaaatccgcctctctctctaacgtccatatttcccttgggtagaagaagcacacgcgcgcatacacctgcaaacctcgccaatctgagaactctgcacagcttcaagatataaatgaccagtgcagttcagcaggacattactgagccacgatggcgttttcctcccagggaaggtaaagctgtggctgtcctactgaatctgccagttccctcttcccaggcatcccgttctctcttctcaggcatcccgttctctcttcccaggcatcccgttctctcttcccaggcatcctgttctctccctgcgcaaactatgcttgtaggttcacactttcacttttaactttaaaaaccaagcccttgttgctgggttggagtttggcctgtcaggtcattattagttaaacttgtgtaaaataacaaaattcccatcatgtcagatttcggtgtttctttggacttgaaaggatccccacatcgcacctgtgtttctcgctcccgtcccacttactggctttgattcctctctacaaatgctcgttgttctcattggctgtgtttccataaaataaaggccaacccacaggctgtttatcttagcagcctgaggcttgcctctcctgccctggtacgcttcttcttcctgccttgtttccagaggcaccctgtccatccccaaccctgtccatccccaaccctgtctcccacgatggccattagaagctcattctttctgtcactctccttccttccctttttggaacttcctt

SEQ ID NO: 18486 - DNA, 1184 bp, Mus musculus
tatagaattctcagaggaacgttgtaaatcattttttaagcatttctcttttttgtttttgttttgttttgtttgttttgtttcgagacagggtttctctgtatagccctggctgtcctggaactcactttgtagacctggctggcctcgaactcagaaatccgcctgcctctgcctccattttttaaaattctatttacaaatgaaatagaaactgagaaatccaggtatttgctcaaaacaatgtaccactaataaggcacagtggtccaaaccccaagtttgatttctgaatttggcttcttattacattaagtacttctctatgacagactcgataatacaaaccaataatctgtgcttgtctaaaatggagaatcagatgaatgtgagcacaatacctattcatactctaatcccagtatgatttagtataagtgggaattaacattaacaatgtgttgttttggtcggcttttattttctgagtcgaatttgcgctatgatgctgtggcagtttttctctccagctgggaaggttttgattgtctgttgagctcctcctggctgtgtttgggtttctctgagttttactttaacacccttccgattgttggcaaatattcatcatgcagcagacctgcccatccgttctgctgccaacccagacatcacaacaggcacaacagcagagcagcctctgttgtgaatggtgagacaggggagtcgtggaaaagagaaggcagatgtggagataggtacaggctgaacttgtcaagcaaaatcctctgaagcctaggactttctgagtgctcagagaatcaaagattcctattttgaagtatttcagatgtctgtctgtctttctgcctattttgatgtaaggattttctatatagcccaggctggcctcaaacttgtggcagtgtttttatctcagctgtggcattttaagtgtatcaccacatttggtcccaagatgtcagatttttggattgattatatattcaacttgcaaagtcaggacacaaaaatctccaaatctgaaaaattcccaaatatgagagcattctagcctcaagcatttcagattagagatagttactctatatgggaatccgcttggggatgttcagagttcagtacaaggaaagctgaagacatttatgccagacattgtgttt

SEQ ID NO: 18487 - DNA, 1139 bp, Mus musculus
agataagagagaaggagagaagagtggctgccggcagattccatcaagggcttccctcagtcaggcttcttggtgggtttgctcagaagggaatgagacgtgtgtgaagacgagacgcattagtcagcggtgccgaaaaggcagagcagtgccgaaaaggcagactactacccagagatgagcacacacggagatgtccgtcccggttgcagagttaaagaaaaccgaaacttcagcaatttgagtatcattgaggtatcatttgtctacgcattcagaatttttcaggactaacggggaggatcaacttctgatagtaatgaagctttctcccctatgtaaaaccgttgaacctgtgtattcaaaaaagatttgggcgtttgtagtaggcaacagacaacactgggaagctctacagtggcagtattcagagtgcttcctgtcctttctctgtgatgctggaatggacaaagcagaaagactgatgagttggctgtgcagaaggccggctctcaggctgggggccttatgtgctgcagcgcagtagaactgcatcgcccccgtcaaactgaattagtgcgctacatgtcacgggtggcggggaaaccgttttgccgttaataataccgtgttttgaaacaccacatgaagtgattatggtgtgtaccaatgatgccctcggttctctgttttgcatgcgtcacatcctatttataaggtaacgttttacaaaccagacggggcggggggaggggggaaaacggtcctgaagatgagggatcttcttcagtgtcaccagcaaaaggttcattctctccagtggcttgagtcagcatttcagaatataaaaattggaatgtgaagattagtctgggcatgctattgaagcggggccactcaggaaagtaaaaggtgcagcgggctgcatgcaggcgcacgtgggttccttaaagaatcaaatacaaagagggttgcgcttcctgatgctgttcccaggtgtaaggagatgataatgaaattctttaaaaaaaaaaccattcaaatcaaattagcagatactactttaataggattcctccctccctcccttctctccttcctttcttatttttttaaacatctgtatcaagcctggccct

SEQ ID NO: 18488 - DNA, 1195 bp, Mus musculus
gtgcaccctgtgcatgtctggtgccgtggatccccacagaactggagttactgccagttgtgagatgctgggtggatgctgggaattgaactcaggtcctctggaagaacagtcagtgctcctaactgctaagtcatctctccagcctccaaaaggaatactttatcttaagagtaatggcatgtagagatgatgaaacatggtaatgagcgtggtggtgttcttagaggcagtaagcatcccgaaaaggaagtccgggtggggcactctgaaaagtcacagacttaggtcgaatttgtggaactggtttgcactggattctgtgtcaccccctgtgccaccttaactctttctgttttatttcaggcacggatttctcagttggatcattttcatgatcttccatttcctacctcctctcagactcatccttagaaatactcaagtcccttaaaaataacagagattttcttggtctgcgtttcagaagtctctctaaattatgcgtgtgctgtgtcatcttgcagggccgtgggccactgtgtggtgggatgtgtgtaggggtacagtctgtgccactgccggctttgccctgtcttaaagcttccctggcctctctgagctcatttcccagttttccactgccgaagtggtaattcctcatctcagcaggccaggaagtgtgtctgtctccttgcaaaatgcttgacaggttgttggcatttaatagacattaatgtttctgtcttcatgtccttatacataaaatggattttacttataaagtatatgattggtatcttggcttataactattttcaacacggttgtgggtaaaaatgttttgaaaaatgttgactttcaagcagcgtgtctctaaggctgctcttgcctttcccttccccctcctttcccttctgttggaacacacgagggctctcacgggctgttcctagttgaattaactcactacattaattaaaaattaataattaattgcatttgctgtgttctgccatgtacctgtctgcatgtccctgaagcatgggagctctttggactgtttgctcatcttttatccgttcacccttcgttcttctctgtgagaaatttctccctcaagttctgcttcccttactgtgtcctctacaagtgggcatggctgcttctccctctgtctttgcttggaatggat

SEQ ID NO: 18489 - DNA, 1191 bp, Mus musculus
tttcagctgcttctccagcaccgtgtctgcctggacgctgccatgatgattagggagcaaacctctgacactgtaagccagtcccaattagatggtttctgttattagagttcccttcgccgtgatgtctcctcatggcaaggaaaccctaaaacagacatttaaagtatgaacacacatgagacttttatcaaaatttaaagatcaggaaagccagccagcatcacctggataccaaagccagacaagaccactacagggaaagaaaactatgacccatatcaccgtatgacataaatccccaacagggtactatgaagccagattcaacagcgtattagaaaggatttacatcgtattgaaataggatgcattcccggagtgcaaggctagttcagtatgtgaaaaccattgcagtgtgccacattaataaagtaaagggggaaaatcatgtggttatttgattccatgcagggaaagcatttgctaaaacttaacattttattagttagggatataaccttagtattaaaaaaacagccacgtgtgaaaagcccaggcattaaaacagaatactggaagactggagacttctggaacatgcctgtattccacttttgctcagcctaccaccagcacctgagccaggttacataaggacaagaaataaaaggtctacactggaaaagaagtagtaaaatgatctctgttcacgagctgtacaatcttctatgttgaaaatcccagctcatcatttaagaaatcatgaaagagtacaaatgtacttttagagactaaaagcacattggcgttttcagaggcttggagttaaaggggggaggagatgggagttattgtttaatgcatcaaagtccagcttatcaatactgaaatataaggagtgtcgagggttgttctgtgttgtgttttcattgacctgaagctatatgcttctaattattgaagcagtaactttatgttatgcatagcttaccacactaaacattttgaaaaaggtcaagtttcaacctagaaggactttggaagtatagctgatactttgaggaatgaagactttgatataaattcacagtattaagaataaaatttcagccaatagagtttgttgtctatattttaaatatccttaactttctgtgagtaaagcatgtgtctggcttattcagaatc

SEQ ID NO: 18490 - DNA, 1193 bp, Mus musculus
acacatatatacatacaaacatacaaacacacatgcatacatacacacatatatacatacaaacatacaaacactcatgcatacatacacacatatatacacacaaacatacaaacacacatgcatacatacatataaacacacatacacacacacatacatacttccttcattccccaaattagctgtgacatgggttgggtcagggtgactttctcgaactaaccaatgggaaaacagtactttgattgttcggcttgtactgcatgctcgtctaggggctcaatcccaatggctcacacatagattgtgagaatgatgcggtaaaggctcgtcacgtggtgcctgcctccaacggccttgttcactgcctgtctccttcttaagtttctcagatactgagcatccatagtacatgcatatgccacgttgctttcgatagggccacttatttattcatgtatttgtcaggaatttacttgttgccaatgatgttgcagacattgtgtaaaaggatatgaaagcagagataaaaattttttaaaaaagatatatcggatctcgcagggaattaagcagccaatgtgtgtgatttagtctttaagtggactataaagcttaggagatgtcaggcttgccatgagtacctttggcacgcaacaattattttgcacgaaatgggctcttgagatgttgaagtttgtacatgtatcttattaaaacacagtttactacttcacgcttgccacatagcacgtcttgcttagtgaccatttattcaaactgagaccgtagagcattcccgccctgtgttgttctctcttgtccgtctgcacaggaagtttcctgtctctgtgtcaggttcccctggagctcaggaattctagcactcacctttttctctgttgcctcacaggtccgttttggtttatcttggctcccgtacaagcactgtacagtgggcagtgaactgtcgaatctcttgaatgataaaaatgagttgtcaatatggaaaccggtttttggctcctgattttattttatgtgtacaaatgctttatctgcatgtatgtcagcacatacatatatactatgcctagtgctcacagaggccagaagatggcagcgccagatctcctgaaactggagtagaggtgggtgtgagcctgaggtgtgagccttcacaagagtgc

SEQ ID NO: 18491 - DNA, 1177 bp, Mus musculus
gcctggacaacttgtctcacttcagatttttcattccgaatttgtgagccccctccttccaaacagaagcatcctccacagagcagttaggggtgttgttatgttacccaaatcttgcttctttattctttcctgattttatacactaatggtggagttcattaaaatatctagtttttctagtatgcttaccttgttacaactttatctcctctcacaaattgattgatgagatattatttatagtgttatgaatttaatttgaggagggtgataggtggtctgttcgtacttcattgctctatataattaagctctctatttgtaacttactgctaaatcctcctttatccttcatttcataaagggtgtctttgatgctcttttgtaagaaattgtagcccattgctttccacctcactggctacaccttgacctaatgttcttatgtttgttcttttgcttacttctataccttcttaaaaatgtctattaacagggctggagatggctcaaagtgtgagagtgctcgctgccctaattacccagaaggctccagtaccttctagagagccgaggcctgtagcgattcaagtgctctctgcttaactccttctcattgtgatttcaagagactgaggtttacactatcctgtaaaagcctggactctttaatggtggcaataaatgtgggaggcttgaatatattccctgggtcagggaactgtccttgacagggtgaagcatttttgaactagtttgtaaagctgcacatgaatatgagggcacacaatcagaggtcatccaagcgacaaaacaagaaatggcacgtgcatgtgtgtgtgtgtgtgtgtgtgtgtgtagctaaatatcatgtgttcctttggcccctaaggtaatagccatctgacttggttcaacttcagccctgagtgataatgatcgcctgtagtagttgagtggatttttctacctcatcagtgctgttgaatttcataattagttaattacaaggatgcgatcagatttcagaaatccacttctgcttgccaaggtcttgctgctaaggccttgagggttttttattgtttgtctagatgaatcattttattaagaggtgaaagtagggcggggcttctgagttcagtggcatctgaacagatgtcccaggtagagc

SEQ ID NO: 18492 - DNA, 1222 bp, Mus musculus
tatattgattaaatatttatcattagggacattagagataaggccaaatacaacaggactcagactatttcaaattgtaagctgcctttagctggtgtgtactattagggatgggagtgctggtacacaggctacctcataattccagtaaagagcagacagaaagaaaaaatagttacataatcctttctttttaatactttctcttttttctttttaattctgctggagactgcattaaaaagaaagagtgatgctgatcttggtatatctgggcatcagggtagaactagaacgatcagttgatttgtgctagctgtttgtgctgctgtgctggtgttgggtgactcccgccctctgcgccgtctaatttgtaggcagacaattacctcttgctttgaaaggtcatgagtgtgcctgcctttgccatttgatggcttcaagttcacctccaacaaaattttagagcctttttcttgatgagctccgttggcttccgctacagcagcttgctatcacggagtaaggaaagcaattttttgaattaataaagtgatggattgtctaattacaaagctgatgtgcggtggccatattgtaactttgactgcattactagatgatcctagtgactgatcagttgggcctgggttccattaagggaaaatatgctattaaatatttaatactgagagtgagcagacgcgccaggactgctaacctccgggcaccggagtgcacgtacctatatgtttggcagcgactgcttgaagaggcactgtagtgtgctcagagcagctcctggaagtcttagttgtggggattaacttcttggttggtgtaagacaggcaaacagccaagactttaagtgaacaatgatcctggcattctaattacgagctggtgacaacagtcatgatttatatatatattttctttattataatagattgagtccccaagtagattcaggagacatttattctcaaagatgcacgtcagcccttcaaggaaagtgaagtttgtaggacacttgggctttgaaggcaaaacaaatcattgcttgcattttaatgatgatatttgtatattccgttctttactttgcatttggttaacattcctcttcatttatgtgtaaataacctgtgacagctgtgagatagatcatcgcagttaaagacccaatgccttctaacttctgaaggtgggaaggattat

SEQ ID NO: 18493 - DNA, 1236 bp, Mus musculus
gtaaagtgttacctggcctgcatgaggctctgggtatgatcccagcactgcacaacactgggcatatggcgccaacctgtagtcccgtgacttggaggtgagggcatctgaggctacatagccagttcaaagccagcctaggctgcatgatgccctgtctcaaaaacaaacaaatagacagacagacaggcactatgtaggaaatgatgaagtagggcttagcggttaggaacactgactgctcttccaaaagtcctgagttcaattcccagcgaccacatggtggctcacaaccatctgtagtggggtctgatgccctcttctggtgtgtctgatatctgtgtgatccagcatagggccaggctgacatgagcttggtgtattctgagccctgagatgggcaaggtcagtgctgggcaccctttctccatgcctgaggaagccctgataccagtctgcctggttagtctctgagcctgcctcccaggttctagtgttataaataagatcctgctacaaaactctgccccctctgtctctgtctctgtctctgtctctgtctctgtctttctctctgtttctatctctctctctctctgcctctgtctttctgtctgtctctctgtctgactgtctctgtccctttctgtctctgtctctctggcttttggctaacacatagcttctagcatagcccagatgtgggttctttgaatacaaaagccaacaaaaaacaagtcctatggggaggatatcattcatagcaaatggtgacggatttttgttttgtttttcaagatagggtttctctgtgtagccctggctgtcctggaattcactctgtagaccaagctgacctcgaactcagaaatctgcctgcctctgcctcccaagtactgggattaaaggcgtgcgccacccctgcctggtggtgacagatattttaatggaagcatttaatatttaatttaattattaattaattattaatatttaataattatggcagaagctgggaaggactacctccagctgttgtgatcaggtagagcagtgttttgccttccagtgggagcggctgaggggtattcagcccaggctcctaggagatgactggactgatgctcagccttgactgccctttacggaagtcaaacagctggctcggtcctaatacggtcttatttatctgaattagggaactaatttggtaggttttaaaagtgatggagatga

SEQ ID NO: 18494 - DNA, 1231 bp, Mus musculus
gggctgcagacctgcagcaccacgtggcttcataaagatttttgagtgagtgtgagatgtgcagaaggatctcaggttggtgcagatttgtaggaatgctgtgataaggatgatggcccgtattaaaggtgtataccaccacgcctggatctgggacttgctttgtcccaggctgattttaaattcagcttgcctcagtctcctgggattacaggcatgtactaccttacctgggcctaagcttttcatggccactgtgcctcaagatctccatgtcaagaccaggccagaaacttgtgtcttccaagcctcaagatctggatcacaggtgagccctccaactctggattatagttcattccagttatagtcaacttgacaaccaggaatagccatcacagtgtatatgcatgtgtgtgcaagtgccctcggagggctgaagacggcattgaataccctggaactggagtcataggttgtgagcctcctggcaggggtgtgggaactgaactcaggtctcctgccagagcctctagtgatcttcactgctggaccaatctctccaacccgctttgtctcttttgtaactgttgacgtatctgggcatccgttgccttgaactcaccttctcccctctctctgcctttctgccctgatgcttcctcctcctcactgcctctcctttgtcccccaggttccagccatggcctctgtctcctggccactgacagtgactcatttgctgtggattggagccactccggcaatgcttaggctacttattagatcaaaacctttgaaggtgggacccagacattgtaattttcagttaattgcctactcaatattttcttctcttattcagtttgtaaataaaagaatgagtttaactggacacattctaagttcacagcgtttcacttgggtgctgtccactccccagagtggtgtatgagcttctcctctgtctctttctctctccctccctctccctccactctgagcacatctgtgacacagtacacacgttgaggtcaaagacaacatctgagagtgtagttctccttcctctgatctggagctcgaacccaggatgtcagtgttacgccacaagctcctttacctgctcagccatctcgctggcctgtctccacccgattttatttactgagtttggaaatcgttttacttatttgtctatttatttgtttgcttatgtatgtgtgcatac

SEQ ID NO: 18495 - DNA, 1206 bp, Mus musculus
atcataaacaatgacaaattagtaatggaatgatcagagattgtcttttgaacccaggtgctctggaagggcagccagtgctcttaaccactgaaccatctcttcaacctgagatgttcttttttgtttgtttgtttttgtttttcgagacagaaatctgcctgcctctgcctcctgagtgctgggattaaaggcatgcaccaccacacctggctgagatgttctttttaaaaattttgctatatatatatatatatatatatatatatatatatatatattttatgaagtactggagttctgtacaaatattgtcttggagctgattttgagtcatacgttagaaagaatctcccattttccagaataaagtacacaatgagcctgacttttatcatttttctttcgagaaccatggtgattcaagaaccaaaaaaaaaaaaaaaaaaaaaattcttgaaaggttgttggggaactctcagctttgctttaagggtgggagaaacctggatgtgaagatgaacaggaaccaaatcagaactgccctgtagtggtcgggctgtagtctgggccgcatcctgttggtagcaccctggacgagggactctgctgtgctctttgggaagctaattgctctctttcttggattagccgagcacaggccactgcttaccttaactgacaggtgagaaaggattgttctttttggctaaaaggtaggaggcagccctcacctctcagggttataaacaaatgccaggaatccaaacaagtgcatccttcaggctggctaacagatacttgcttattcgttctttacacaaaacagttgatttgtgtttgctttgggttgtcacgctgtatgtatgctggaattcacttgcgttataatagcaagcccttcacagaacacactcgtttctatggttgtagggctctgagctgcctagttgagaatcattgcagcctgaaaactgtattagtgaaatgctggtacattcttaatgtggtttcccatcagtaatgatgtgcatcattgtggaatacattttcctgttcttcttcttgtacgtggagtttgtttgtttgtttattattcaccatcacttataaagtgagaagaaggtgttgtattgttgagtttttgtgttctaatgcagagcagacatagctctcattttgtaatatgagtgtctggcaggatta

SEQ ID NO: 18496 - DNA, 1209 bp, Mus musculus
gaaggtggaaaagttcacgactgccaaccggggaaacgggctgcgtgctgtggctccactgcgccccggggagctgctcttccgctccgaccccttggcttacactgtgtgcaaggggagtcgtggcgtagtctgtgatcgctgcctactggggtacgtacggaacctgagcccggggcgcgtggctctgcgggtgggggtgggcctcgagggcacagctctgtggggtgtctgcagcaccctaggctgcggtgggaattgggggaggcagtggtgcagatgaaggggaagcgtcgggcagataattttgctggggaacaaaaatattcaaagcctgtgcaacgagcttcattggttgtggaaatcagaagtggcaggggggtgtgagtctgggaaggagtaggggtgtgtacgtcaggatcagaactgaggccccacctgacctgtcttgcgggaggagcgagaagcctggtgtttatgttgtactttgctggtctggattttacgtggcttgggtttaggaagatgaatgagacatccctaaggactggagcaaatgagaattaaccgtgtaacaaaagagcaaaataagagatgcaaacagtctactctaggagcgtaggactcgcggtgtgctttgccctctagagattgtgcggacaaatgtaactcaccacctctgtgtagatgcaacagtttatgtgacagtgtttcgaagtctggaagcacggtgtcagcggagggtgctttactgtttatagagttgtgtaacatatacacttccgtccgcacacatcgggttcccaccatgcactgggataaggactctgaggtaggtaggttccagacccatccctctgtgtttggggtgggtagaggtggggagtctagctttactatacattccaggatactcccctcgctcccctctcctccctcctcagtccccgccccctcagacagggtttctctgtagctgctctgtagactaggctggccttctctgcgtcccaaagtcttgctgttaccaacgcccggcttccacaatattcttgtttagtttataactgaagacttcgctttgcattttaaagttagcaaataataatgttatctgttatcttctcaagtggtgatcgaaatgacatgcacacacctgcacgcgatttgttgctgaaagagcagcgggaagtttgtggggttaaagca

SEQ ID NO: 18497 - DNA, 1168 bp, Mus musculus
gcttgctgtgccagagtgttcttctgggtgacaggtcttagagaattcagaactaacaaattaatctgtgtgtcttagctgtcttagcttttttgtctgtacttctcttaaatcctgtgtgtgtgtgcctatgtgtgtgcctgtgtgtatgtgtacatatacaatacatatttttattatatatgttatatataatatactttttgtggtacagagaattgaacctaggacctcctcctgttaggtagaagggacccactggcatgttactgaatctaaagtaacaactggtgatgccataaaacatgagctccgaattgcatcttacatgtccgactttgaccataagacagacttttctaactgtccttcaaattcatgtggagtcacgtaaggattctagagattccaactctggtcctggtgcttgtgtgacaaccactttatccatcagccttgtctccagcccaagatatattcattaaaaaaaaatcccatgatcccctagtaaatttccccaactcgagaggttcaaaaacagcacataatatctaacatatagttctataggttaggagtctgcccttgctctctgggctaaagtgaggttgtcagtcaactacgttctttgtagatactcttaagggggtttctagactctagccagtctctctgtctttctagcttctagcccagtgtgtggctcccatcctccatctttgcagccagcaaagacttgtagagtcctcgcagatgctatttggactctgctgccttcctcttctgtatttaagggttctcgtggtcccacaaagcagaacctccttgttcaaagataactgatgagcagccttagatctgtctactgcctcagttcctctttgacatagataatgatatcattcatgtcattgggacataatcattttttggagcctttattctgcctaccccgaaaatatcttaactaaggcacaatggctttatataacagaaaaattctgtactttataagtactgccattacattaatttgtagacccatggagacctcttagtcagcaggtgtttattgagtgttatgtaccatctacccttcaactgctggggagcctgccttcctgttcctcgtgctcaggtgagtcagcgaaggagctaacaggcagtc

SEQ ID NO: 18498 - DNA, 1198 bp, Mus musculus
gccccgagttgagaactgacagacctgtgtcgatgaacttgacaggcccaaaggcacagggacagaactcccaggtcccaggtgagagttcactctggcttctatgctgcctcaagagatgagtgccgggctctgtgcgcagctcaagagaaacttactgagtgtctgttatgtcctgagagcctcaggagagcatcctgagtaaggagtggttgccactgtgcaggtgtttagggcaggtaaacccatactctgacgaatgaagcagactaccacgtgtatgcgtactctcaggccgtgcgcttaggtgtatggaatgtgttcctctcgtgggctcattctagaatgcttcatgggctcatgaagcagaaatccagtcataccctaaagagacaaatgtctagtgttgtttaattctgtcaccaggtggccattcctcatttgcggtacagtgatctaatgtttaggaggccttcctttgactttttatattcgaggcaacatctttttttaaaaatcatgaattatagttttttagcaagtgaccgttatgttctgttttcctgtcgggatcgtttggaaggaaggagaaaactggctttgcaggtgttactggctggcacagtaccttcctttgtgtctctgcttatttatttggagtgtgaacttaaggagcttttttatgaattgagcgtgcgctgctgagcctgcattccttcatcccaccgctgcctatttaattagatgcttagtgtttggattttataccatttcagctccgtgtatttttagacttattttgaaattgactttttattttcacttataatactgcgtggcttatctcttatgtcaccataaactgtaatattttcgatgggtatagatcagagttatttatttagaagtatacagaatgctgaaatttagattcgttatacctaaggctgattttattagaagattattttaatgtcctactataaactttaagactttgtattcatatcatatgtaacataggtcccatcatcctggaacagtggttctataggagccacgagcgaggtcatctgtgcaggctcctctcgatacacagacatttcaccctcatgatttctagctgcggggatttgatgatctttgtttctgccaattttatgtcaagaaaagttcaaatctccctcctgttcacctc

SEQ ID NO: 18499 - DNA, 2118 bp, Mus musculus
tgagtatgccccccggcacacatggggacgcggtgggtggtgaggccttaaccctgcctgcaagtccactctccaggtctctgcgagagaagcacttgaccagacagcactttgtgcccattcctacttgactgtatctttctttcagaaacacaggaaaaggaagttcttggtcacctcctcctgtagaaattaagctggtttctcccttggcgagtccagtggatgaaataaagaccggcaagccaagaaaaactgcagaaatagcaggaaaaactcttggaaggggcagaaagaagccatcttcttttccaaagcaaattttacgcaggaaaatgctgtaatttttagcccaagattttaacacgcacctgtttgtaaaagtcaacagtatttgtgtggattattaaagtcaccaatttggatggaaatactttatataaattgtacaattttgtaagcagtaaatgagtaactccacatggagtgcagttcttgtagtgcaggcgttttatacgacttgatgcgtttatatcaatgtaaatatgacttatcattgggaggttaaataaactactgtaaagtacactgtgtgtctggtagatttttgagaggagctttctgtttgagttgtaattttatatgctactggacatatgttcatatcctttctttacagttaagatactagaactgtcttaaaatgagggcgatgaactattgattatttttaacattgctgttttataatgtatgcactttgatgctgttcctcggatctctggtcagtacctgtgctcattgggctttgcctgatactgtgttgaatttgaattgtgggcatgtgattttgcctttttgtagttttacaaatgttgtgtaatctacctcaaatgagtaattttccagtactgcatcggtttcctagctagcagttctcttcagtaacttaaggactatcttgtctctcagttcagagacttaattatccaggttagattgaccggtttcactgcttcctagcaacctcatggaaggattgaagaaagaaataaaacagtgcaccgacgtgtgcctgctgctgagaagaggagccgacaaggtttagacttcccatgctgtgaaagagcttgcgacttcgtcacaggagcctctctagtattcaggttttaaactggtaactgccacagaacctcaggcacaggttacagagaatggaagagtgtgagcagatgtcggaaaagaggaaaggaaccctcttttctgcagcgtgtgtaccgttggtaatggcgcctgatggaagccatgatgttcatcaataaataagtgttgtcaaataatttatgacaggtaattgatagtgtgtaatgaatggacgcttaataattgatacctaaaagcagactttgtcagctaagctttggatgttttcgtgagcagtgtgctttgtgtgttatttttctaccgagtagcatcatggataatgagaaaatggggagagtgcctgtgccgagatcggacagtgtgagagtggccgtccgggtgcggccgttcagccaggtcagtccatgctcattgccttgctgacaattactgcctgattttattaattttttaataatagtttctgaatttgtatttaagctgcttgtcatttatgaaatattaaacttatttaaatggatttgtcaaatgattcacaaaagctctaagcataatttagtaaacatttaatttcattccttggtacaagtagcacaataaaaaaaactgacaagagaaatactgtcaagttaataattatttaaccagtgcagtttgctaaatagagatgtgcggtgtctgtttttactgcatgtcggtgtggggcagagatgtcagttggtaagtgtgcttgcctaccgtgcatgaatccctagggtagctcatcagcactctatgaaatgaggcacagagatgtgtggaatgccagcttgaggcgaggcaacctactagaagctcagtttttatccttggctatgttgtacattcaaggccagcttgcactacatgaaacaccaagaaatgtttatcttaaaagtaagtcttgccacatgtggacacgtcagtgatcccaac

SEQ ID NO: 18500 - DNA, 1228 bp, Mus musculus
agccttcagcagttgccactcctaagaagagaactagaaaaattaaagaaactcctgagtcttctgaaaggacctgttctgacctaaaagtagcacctgagaaccaactgacagctcagagtcctcccgctcctaggagaggaaagaagaaggacgttagccaaggcacactgccaagttctggtgctgtggagccggagccggaacctcagggtacgccgggaagactgaggctgagaacgcagccacccgagccagcagctgaagaaactccttctagaacaaaagtcaggctttcatctgttagaaagggaacccctagaagacttaagaagtctgtagaaaatgggcaaagtacagaaattctagatgatctcaaagggagtgaggcagcaagtcatgacgggactgtcacagagctgaggaatgccaatttagaagatactcagaatatggagtataaacaagatgaacacagtgaccagcaactgcctctaaaacgaaagagggtcagagagagagaagttagtgtgtcaagtgtgacagaagagccaaagcttgactcatcccagttgcctcttcagacaggactcgatgtacctgccacccctaggaaacgtggtagacccaggaaggtagttcccttagaagctgatggtggcacaactggtaaggaacagacaagtcctcagaagaaagatgttccggttgtccggagatctacacggaacaccccagctagaaatgtgagtactttagaaaaatcagttttagtgccaaataaggaagctgctctagtggtgacatctaagaggagacctacaaagaagtctgcagaggaaagctcaaaagatccatcagcggcagtctcagacctggcgggtggagcagcccacacagagtccgctgaccgaagggacggactgcttgccgccgctgctctcacgccatctgcccagggcacaaggactaggtctagaaggaccatgttgttgacggacatttctgaacccaaaactgagcctttatttcctcctccttcagtgaaggttccaaagaaaaaatcaaaaggtatttagttttattcatttttatctttcttagaatacagagcctaaaattttgagggttttgttgttgttgttgttgttgttttagttaattatttagttaatttccttaaagaaaaattgtgattaagacagaacacctactcccaaaaaaccca

SEQ ID NO: 18501 - DNA, 1212 bp, Mus musculus
atttaacatgccatccctcttcttattctctgtccatggcttccttttccagttgccattagtgatatctgaggtttttacttttctcttcctgccgaggccccttctggtgccattccactgccgtggtctaggtatttgcatttgtttccgcctttgccatgtggctagatctgcctttctcaactcagttcctctaaaggattaaaccacagacgtccattgtaggtattagattagctgctggtgctagctgtctactgtctttggggaaatatttgttgaaatcactttctagtcttattgtctcaaaggtctaaagtattacctggaaactagtaaagggagaaccttctgatgagaacttctcaccaggaatgtcagggtgtaagtgagactcaagtgacagaaatggttttcataagtctactgaaatgtgaattaaatgttactgtcatttggttgtggttatgtttaggttctttattctgtttttgaaaaatagctgggttttttgttttgttttttctttcttgcagctctgtctcccgataccagcgtttctgtctttacctggcaagtgaatatatatggacagggaaagccttctgtgtatttagggctatttgacataaatcgttggtatcatgcacaaatgcccgattctttaaggtatgattactatgttttctcaccccctctccctcagatattgttatgtatagctgatagtgtctcagtgctttaaaactttttcttctagatcaggagaatctctgcataattgctcttattttgcgttgtggtcattggattcggttgtaagtaggacttctccacatcacatcttggacatactagtacatgagaggagtttaaaccgaggggttcctccttcctacccacctccagagcaattttttaacccaagtacttttaattttggtaagtattttcataaatttttgagaaaaataatgtgtaaatgtagtatgtcagctgtatgtttcatatctcactatcatttataacttacataacttctgatacgtatttatgtacacaagaaatagagtatgtttataaattttgagttttttagaaaatgtcagttaatatattagtaataaagtttgtcactatctcaaaaggaatttataattgctgggcagtggtggcacaaaccttcagtcctagcacttagaggcagag

SEQ ID NO: 18502 - DNA, 1193 bp, Mus musculus
caatttaggcctcctttctcttggtctcttctaaattgttgtccctacagttcttttagacaggaacaattctgggtcagagtttttgactgtgggatggcaaccccatctctccacttgatgccctgtctttctactgcagatggacgctacagttccctctccccactgttgggcatttcatctaaggtccctccttttgagtcctaagcttctttcacctcccaggtctctggtacattctagagggtcctcccacctcctgaggttgcctgtttacattcattctgctggccctcagggcacctacattccctgccctcaccccccttgtgattgctttcttctccctctcaagtgggattgaggcatcctcacttgggcccttccacttgttaaccttgagttctgtggatttaaaaaggattccatcttggttgtgtgttattctttttatgcatcagtggatttggtatgctttaaagaatatttgagtgtttaattttttttttccacttttttattttgggatttttggagacagggtttctctgtgtagccctggctgtcctggaactctctgtagagaaggctggcttcagactcagagatctgtctgtctcgggctcccaagcactgggattaaaggtgtgagccatcactgcccagctggtttttaaacctatttttgatacagaacttggcatgtaattttcttccaataccttcatcagatttttggggggcttgtctgtgctggtcccatgagaagagtgttccctaaatgttttactgtattctacaagcttctaaaatagttaccatctttccttatatgattctggagtctgttactaagataatacatttttacaatggattttttttaaattatgtgttagttttattgtgtttacacacctcacataacttttagaacttaatattgtattgatcacttactgattcatacgaccattggttcatcttatttttaaattcatcttactagggaactgtcagttttctttgctttttagtagttaacttctagtctcttcagttttgctgttgtggattaattcttgttgtttaatattttgttttctgtggtattaacttgctatttattcttctaatttactgaagtagattatttaacttttttatttttagctcttcttttaaaatgt

SEQ ID NO: 18503 - DNA, 1201 bp, Mus musculus
ttgcactatgtccacctttgtgtgtgtgtgtgtgtgtcctctagggtgagcgatgagaaggatgcacgaggctatcttcaggccttagcttctaaaatgactgaagagttggaagcattaagaaattccagcttggggacacgagcaacagtaagcaagctctgccgtctcacacagagacacatctcttgctggcagaaagcacatatacatctgacttctgtaaaagttcttgtgagaaatattttagatctttataagaaaatataacatattactgttagctcttatgtatagctacttattattgaaggaactgaaaaggaaaaaacaattatttgttcatttatgcatatttactgatatttctggatttaatgaaaatgtattttcacaagttgtgcatcagttctactcagttatcagtgatattgcttataaaatagctgcttgattcacttgtattataaaatttaatcttaagaataaaatagggaactaagacatagccatattattctataggatatgccctggaaaatgcgtcgttttgcaaaactggacatgtcggctagactagagttgcagtctgctctggatgcagaaataagagctaagcaggccatccaggaagagctgaataaagtcaaagcatctaacatcttaacagaatggtaaggaccaatcatctagtcactacagtagtttataaacttgttgatgttacgtgtttcgttgcctgttaagggttgttctttgtttgtttttttaagcaaaaaatgatgaccagaagactaggaatacaattcagtagtataatgcttgcctggcatgcccaaggccaaacgtctgccccacctccctgacaaaagtgaggaacaggtttagggagatagctgtcataaaagtgcttaccttataagcataaaagcctaaatttgagccccacatttaaaaaaaaaaacaatgctgagagtcatagcatctgtctacaatcctagggctgaaaagagagaggagagttagagggagagggggagagatggagaattccagctcactggccaggcagctagccagatcagtgagctccaaattcagtgagagactttgtctctgaacctaaggtgaagagctgttgaggatggcactgatgttaccctttgtcctgcacatttgtgtacacacaccagacacacac

SEQ ID NO: 18504 - DNA, 1115 bp, Mus musculus
aagtcagagtggaagtcatacacgcgtgtatatgctctagctccacggtgatgtatgaagaaagtctaacaggattctcaaactaaccatgtaatcattcagctcagggtcgtcaggtgtttctacaacggcacgtgcagcctctgctcagtccttgctcacagtgtggcagcagcagtcctgtcctgagtcttgtcatgcgagggactgagctagggcttccttcacacagccaggcaagtcctctgctactcagcttcatcccagacctggaagccaccatctttacctaaatgaatgagactggcttgctttattaatttgtatactagcgggtggcaggctgcatttgtcttcatgcaatagttagcagtcttctaatttagcctcacagacatttaaaccaaataagcccagctacacaaaactaatgactgttttcctttccctgcttatttaagtaaactgaaagattcagagaagaagaacttggaactgttgtccgaaatcgagcagctgataaaggacactgaagagcttagatctgaaaagggtatgagattgtgtgtttgcatcagcgcttgctgtactgagtggccattactgcagaggagccagcttactgcacagatggagaagtctatacgttagcaaccacacatgtgcacacccttgagagttcatacacacatgcacacacactcaaatgcgtatatacacgtgcatagactggctgagatattaggtattagttaatatacattatattaagaattttaaattacagaaatgactgctttgccatgaatttgactgttttttcagtgttaaaatatacttcatgagtaacttttgagttgggataaaagtattttgtgatgtatttataatgttctcacatatcatatgaggtagacacttcaacagtggtaacattagaacttagtgtagaaacttgaaaagggagaagttgatttgggggcagagtctggttgaatagcccatggtgttcttgatttaagaatcctcttgcccacttccccagagtgctaggattgcatttattagcactgtctatggacctacagtatacaaaatcttatgggtataggaaa

SEQ ID NO: 18505 - DNA, 1582 bp, Mus musculus
ctcccactccgacaacgtgcctggcagcagccttgccttccgcactgctgcaatggggattcctccgcagccaggcccgcttcaccctcccctcaacccccaggtagcttctgtagacagactgcgcagacgcagcgctaagagtagaccggttgtgttctcaccgtagccctcacgtagcgcccagcagcctccatgagcgtcagccaactgttgccaggaagtaaaccctcacgaattaaaacaatgcatattttactacaatacagagtttaaataaatacatagatgtagaagttaaatactgaatgtaaatagtcaaagaagcatcttgtgtttgatgaaagatggatgcgtatataagaaagatcatttaatttaaagaaatgtgttgtttcttgtctgtttcccagctatgtcatatacagggtagaaaggcctcaagtgacactgtaaagagatcagaagtcaggtccccatggtgtctcttctcaagcctaggcaggctgaggtcacagggaaatctaaggaatgtttggagattagtgccattggtgggatgtgacctgaacaccaccgggggtggtgaagccactccagaggctcacttgctctgaggcatcttgcctctggttctcagaccatgtcccccacttacaatattttggtatctcgcacagatgaatgtgaaacaattctgccaccttccagcccttcccatcctaacggggaattcgtggcttctgaagattatgggatggtcacgcagctacttttctgtccctgccaaaccttgccccctctaggttgcaatgaggagtctctggattaagcacaacttccctgttggttaagggtagttttaaacacactgctggggacaggtctccttactaaatcacagaaaacctcagaagcataggcttgaatggccttgaccaaatatgccttcccacgtgaggggacggtggggcttgtggtgtgctggccaccgtggactgtgagccagcttcccctctggatatctactgctgcacttgtcccaggaagcatgaggagaccacagagtcctctactcagacgtcctccagctacgcacacaggaggggacaggtggaaactagtgctcatgacgtaaagaggccctgcctctcttaatcctctcctcttccgggatggaaaagccaccatttctccccactttaagccacatctgaaatagatctccaagctgacctttacacagctgccaggccctgcaggtcagactccccaggcatgcagctttatgggggtgttaagagagttgagggtgggctggggtctttgtaagcagcagctttgacagacactctggagtctggagtgagcaagggttttttggggtgggcactgtgtcactctatatttatccttttggaaacagatcatataaaaataacttgtgtacacccaaaaacaagggtcagatctttagtttggccagatccctatacatctgcttcaacttgacactttgcttgaaagagctgcctccccttccctccgtcctttccctcttctttctccttcccccagcaga

SEQ ID NO: 18506 - DNA, 1239 bp, Mus musculus
agggtttaagtccccagattggaagtcagcacagcaggctttatatcctaccatagaatctagctggctcccacaacgtaaagcaaaagttaacacttcgacgtagtgtttgctatttccagacactggtttaggcacattttgaatatgtatacaggactaaggacatagtatgggtaacagaatgccttcctaacatgcaccatgccctgtgattggtcctcagcaccgcacaagccaggcttgttggcctagtgacacgaacctgtaatccagcactgtagtggtggaggcaggaggatgagaagttcaaagtcactattagctacatcaagagtttgaaagcatcttaggctatctgagatcctgtctcagcaatccctccttacctctaacacacgcacacacacacacacacacacacacacacacacacacacacaagagaaaaacaatttgcatattgtcaaccttataacaacactgtcaggtaggcgttgttacaggcttcatttacactagaaattaaaattcaaagaggcagctctctgctcctccctgttccagagacagtgcatcttcttgtgcagtgccagcctcgtcccgtagacaaaatggtgaaggccggtgtgaacggatttggccatattgggcgcctggtcacgagggttgccatctgctctctacatggcaaagtggagattgttgccatcaacgaccccttcattgacctcgactacatggtctacatgttccagtatgactccacccacagtaaattcaacggcacagtcaaggctgaaaatgggaagcttgtcatcaacgggaagcccatcaccatcttccaggagcgagactgccctccccccaacatcaaatgggatgaggccagtgctgagtatgtcgtggagtctactggtgtcttcaccaccatggagaaggcgggggcccacttgaagggtggagccaaaagggtcatcatctccgtccgttctgccgatgctcccatgtttgtgatgggtgtgaaccacgagaaatatgacaactcactcaagattgtcagcaatgcatcctgcaccaccaattgcttagcccccctggccaaggtcatccatgacaactttggcattgtagaagggctcatgaccacagtccatgccatcactgccacccagaagactgtggatggcccctctggaaagctgtggcgtgatggtcgtggggctacccagaacatca

SEQ ID NO: 18507 - DNA, 1221 bp, Mus musculus
ccaactgtcacgggttctgctcattctcttggaatttatagttatgcatttaagtttactaagaatgaaaaatcaggctttagttggttttctgtgtcagcaatgtggaggctgcaaagcagaatactacacttagggtcagcagggttcgctctagacatacctagaaaaaaatgcaagtgggtgaggtggaattatttgggcgaacaaaaagcctttctgggacaaaccgacaaaaggggtggcgcctgtcagattccccgggtccccgccctggccccttcccagaggcagagaccagcgtgcacaggcgcagtcgcgctgggacccaacctcccaaggacacgtgctgaagccccgccctatgagctgaggccccgccctccgcgcgcgagcttgggggggcggtcccgccgctaggcatcagtaatctatcctgagcggaggcggctctgcacgcttgcgggggaaaccgacacgttagcggagcgcaccagcggcggcgtcgggctgccgctgcagcacgagaaggaggatggcggaggcctcggagaggctttatcgagtggagtacgcgaagagcgggcgcgcctcttgcaagaaatgcagcgagagtattcccaaggactccctccgcatggccatcatggtgcaggtgcgacggggccgggccggaggcgcagggcgacgcggcctgggcggctgtgtgggctcggggccgcctcactccgccctgcggctcagccggaccgggagagaagggcgggaaagacccgcggcgctgccgcggaggtccttgaggcccattgggccgaccccttccgggacattgcgcttaccctgcaagaaaagcccgggaagtaagagcatctggcgtaagtgcctctggctttgtaaagacaaggggcctgcctcttcgctgggtctggatggtcgcagagtttttgtttatttcactgccttctcggcgtcggggtggagggtgtgcgcgcggtctttaaagctgctctgatttgggcctatcttgtcccggaagattattgtcctccatgaatacagaagatttttttttccccttaagcctatttttgatgatcctttcaacatccgctcactctcggtatttctattttagttatgcaaagcagtgccatttctttacagtgcattcgctttgggcctgatttctacttggaaataacattttctccaaacttcccg

SEQ ID NO: 18508 - DNA, 1959 bp, Mus musculus
ctctcctgtctaatcagagaaacgtcacagaccagcctcccttgccaccagttcttgtcaggtggagtggatgactggctgtgttgctgggaacagtaggaggagggatgcctgtgcttgccagcattcccttctctgctgccatgattcattcagcattaattgtattatgaagtgtgagtcagttttctgtgtggtagatgatatgatgcccgagatggtccacctgaggaggaggaggctgatgttggctcacggttccaggcatctcagttctggtccatctcttagtcctgttactttgaacctgtcatggcatcctatgtggcaggagcacgtggcaagggaggcctgtttagtttgtgggatataaaagaggaagaccaacgtcttaatatcaaataggcctgcttctactacctcccaagaaagagcgccacagtctggtactagaaggacctttgagaatggttcaagatctaaatgtagcagacatgaaattaagaaaagtgtagttgctaaatgtcctctcacctttcaccattagaaactggagacaaaactgtggtcctcttgcctctgagggagcagcagctgctctgtgttctagagtttagtcagcctgaggtatgcttttctgaattgtcaggacccctgttggcccaattctttgcagctgcctcacaggtgagaaacttcaggaatgtcagtcatgcgaattgtacacctggcagattggccagagccagctcctgtttcttgttgcaacgtaattggaccttaattatagcaaccagagagtccacaggagggtgaggatggacagaaagtccctattgggataagttgccacactaaagccatcacagagtgtgcagtgctactgctgtccagcatactgtgtcagcatcttaacccatccctggggaagtgttagcactcactgtgtagcactcaccattacttgtctaagtataggtatgtaggtagtcatttaagatgtgtaagcaaggtctttattagcatagcaggtcatgtatcagtctcatggagtgtgagtgctggggcctaagggtacctcacagtctgtgatggtgtaaaactcagaatgttttgagagcttcaagctggcttcatgtgcctttgtttggactcaaggccctaggttagctggtccttgtcctgccttgttattccctagatacctcatgattttccctacagggccagatgcgcctgtccaagaagatggtggatccagagaagccacagctgggtatgattgaccgctggtaccatccaacttgctttgtcaagaagcgggacgagctgggcttccggcctgagtacagtgccagtcagctcaagggctttagcctcctctctgcagaagacaaagaagctctgaagaagcagctcccggccatcaagaatgaagggtaggtgggatgtggttagaatgtacagttctaggggagcctgtggattccattcctctgataatgatgatcagaaagagaggagctctgaggctataggagcagagggcatctgctgctccagtacccacccaccagctcgccgaccatgacatcttcccgggcttctgaacctctcccgactcctgcacccaggcgttagtacagcagactgccactttctcatacaaggccacccttgtggccatccaagcttccttgctctggtgatggctgtgcttccaagatctgcatttgtgttcctttaacgttgccttagtcacgcagcagaggtgtctctgtgtctgcatctctgggagaatcatgactgttcacaaaaagatgaacagcgggaagggcctggaatcagaacagatgggcccacatgtggaatcggcatctaggatgggaagggtctcagtcttattaatgagcatgctgagccttgtggaactgtaccatgctcatcagcgacacccat

SEQ ID NO: 18509 - DNA, 1183 bp, Mus musculus
caacttagctcagtgtggccatgctaaccaaaccttttagctttgtcagcaacaagtctgatttgcaaataagaactgtgctttcttactcaggagttaggagaggagagtgtgaagcactcagagctctccacccaccttcttctagccttctggtctctcatctctctagatgcagcctttctagtctgccccccccccccccaagcagtccccgggtagccagcctgggtcacctgttctgtgtgtggcctatgccctacccagttttctcagttgcagaactcatgggttgggtccttgatttgctgttctgccctctgtttccccgctgcctgttggcgcctgtcttcataaagttttcccaaagaaaagagtgaagaccaaggctggccaggctctgtggcttctatggtttctcctaaagccagctgttttgtcttgcctccattcatcctttcctggggttagagttgagtggtcgtagcctgttgcttctgatctcttaccccagacaagcccctgtctaacatgaagatcctgactcttgggaagctctcccagaacaaggacgaagcaaaagctgtgattgagaaactcggaggcaagttgacaggatctgccaacaaggcctccttgtgtatcagcactaaaagtaagttcagtggttcaaatgtggtgaaggttggtgtggcacagctaggggtcagactcaccactgtagcctgatgtaaagctaggatctgtactgtagtatatgtgttcacagtggctcagtcccgtaagcttacactgctccccagtgctccatggggtatcctgggtcctctgtaggtaggtggaggttattaattactttgtagtctggtgatggagcccaggcccgcatttatgttatagactttcctgctgagtgttaggggtctgggcctaagagtccatttcagttgtgtgcctcctgataccacactcaaggtttagagaaggtagcctcccttggctttgcatacccaaggggcagccaggcgctggagcgtgactgctgggatgagattcagctatagcttgggagagaagttggtggtgatggggtcattggcgttgtcgggctgtagtgaggatgcgttcagtctatcgttggggttttcctttctccctgtctggttgtaaacagaggaggtgg

SEQ ID NO: 18510 - DNA, 1187 bp, Mus musculus
cgcctttggggtctggcatcccttagagaggatttttttctgttgtagagtgttatgagctctgcattaagaattagactttagaggtcaggtcagtttgatggcacacgattagtcctggtgcacagggagcagaggcagcagatctcactctggtcttcatagtatatttcagggtcacctgagttacggagtgacaccctgtttcaaaaaaataaacaagtttataataataaacaatggcgactgagcccttggacttagaggtggacagggtagtaccctcctaagcacttgtttcagaatttttttgagaaaggtatagaaaataaaactgcccaagattaactgtaacacgtggtactcacccatttctgccttcatggccaggattatgccacacacactctctccaaagaccacactccccatagggggcacaacgtgagacattttaaaagcagaacccatgaagctaatcttggacacaatccttgtcctctttccccccttccctgaaggacgaagaggcagtaaagaagctgacggtgaagcctggcaccaagtcgaagctgccgaagccagtgcaggagctcgtggggatgatcttcgacgtggagagcatgaaaaaggccttggtggagtacgaggtgggtgttgagtgaggcagctctcgctgctcattggctgagcgtcatgagcgtggttggtacacactgagcttttgagctcatgtgttacctttcctttctaagaccatgcagctgcaaacctccatcccacccagctcctgcttgcccagtcactgtcgtgggacatgcagtgtactgtggaggactggccctgggccctggcccccattgctttttcccactttgatttctgtgttagggtgggtaggtctggttctttggggctcagacttaccagctggctgatgccgatggaagtccaagccttcgatcactcgcagaaagagaaaactgggtggaagagagtgcttagtagataagagcactagctgctcttccagaggccctggtttaatttccagcacccacttggtggcttccaaccatctgtatttttagttccaagagaaccagagccctcttttggcttccacaggtactaggtacccaagtggtacacaggcatgcaggtaggcaaagcagtcatagacataa

SEQ ID NO: 18511 - DNA, 1195 bp, Mus musculus
gaaccctgtgcctctgagcagggaactaggtccctgcttccacgacatggttcgcttcctgactcaagctctctcaggctcctggcccttggtagcaggcgtggactgtctttgccactgcaacagggcgatgctccccagcatggtggacagttttcgttggttgtctgtctgtttgagatgggggctctctgtgtagcccacactggcctagaactatggagacctggctggcctccatctcacagatccgcctgcctcagggtgctgggattaaaggtgtgtgccaccaagcccaggtgaacaattttcaaacaaaaaaaatcaggacttctacagcagtagccatgagtgcgcccccccccccccattgattctgcagtagctctttgtatgaagtgtatgatagcatcgttcttagtgtaaataaataaataataagcagttacatggccatgatcctgcgtgcctcagtgccacgactcttggtgagaaggtactctaatgaccctgcttgtatagacagcagctgctttaggcctgtgtccttctgtctgtccccttcccttccaggcagtgtctcaaggcagcagtgaatcccagatcctagatctctccaatcgcttctacactctgatcccccatgactttggaatgaagaagcccccactcctgaacaacgcagacagcgtgcaggtaataggcagtggagtggggccagcactgggtcttactgagactaactgccctccttactatgtttgttaagagtaggatctttcctactcttcctttctttcctttgctttaccaagtcagtctaggaaattgtcattagccaagaagaccatttctctgtctcacataaaggtccccatgaatccctggcgtaggtcactttgtggcatccttagtggcatctatgttcctgcctatcattcatgtttaagagttctgacatcttctcttcacttccccaggcatcagagccccattagcattctggaaaatgcctgtgagtgcccagcattgagtgaggggtgatggcagggtctggccagcacaggctcttcccccacctaagggaagatgtcgggtgtcatctactttctgcatgtactcctgtcagggcttgatgtctccttccctatggacttagctcccaggtctgtgttctgtccccaggccaaggtgg

SEQ ID NO: 18512 - DNA, 1749 bp, Mus musculus
cccctgttaaacctagaacttgactcttccatcttacaggtttgggaaaaaccacccctgacccttcggccagcatcaccctggagggtgtagaggttccactgggaacagggatcccatctggtgtcaacgacacctgcctgctgtataatgagtatcctttcttggctatgctgtgtgctctggagctgtaccagcaggtatgcatgctcttagatcccaggacaacttgcctcttgggtggtctcctgtgtcaacttgaggtctgactccctgctgtatggataaacctgtctctctgggcactagccttccctactttcaggagattgcatgttgggtaagagatcttggggactcaactgttggctccttgacaactgccctccccaggtacattgtctacgacattgctcaggtgaatctcaaatacctgctgaaactcaagttcaattttaagacatccctgtggtaaagtgcgaggggtgggctgtgcccagcacccagggcctagggggcaattctccctagtgcctctgcaccagacaccacaaaacctcagccatgctgccgccgaagggtggccccctcaccgaatctccttaggaagggttttatacagacaggttaaagggctctggtttcaagtcccttgtccatgctgcactggggcaggccggttgtttgtggtttgtcctaccagccacagctccatagacagcagctggcagtagagcaaaagttggggagaggattttgttgtttgcctagactagtcctgagggaagaaacaccacgtcacagtcacgatgtctgccttactggcttccccagggaaggaaaaatgtgcttcctcccttttttcaagggttcatctttgctttaattttggcaaaatgttaagcatttattttgagctaaaaataaaagttaatttcatactatatagattttcttttttatcttgtatgtccccctcttagtctgctgagcttttgttttgcttggttttcagtgatagacatgggatagccaaaagaagggactacctgaaacccctaactggggcgactgagcctgtagtgtggtcagttcaaagttgcatttgggattctatgtcttccaaattgaaccgtctgtaatcagtacagccacccaaagggctatagttctcaattaaaatgcaaatggatatctactctcgtgttgtgtgcctcatctcctctgacagggctatggttatcttcacagtgaggagtctccataggccctgtaggtatgagcttctatagcattgagtcccaaaagtgtatctccagattcccagtgcttggcaaggcaggaggactcagctatatgagtgcttctcagccttcctaaggctgcaccccttttaatgcagttcctcatgttgcggtgaccctaagcataaaactgtttttgttgcttctgatcagaagtgtagtttatctgctgttatgaaatcataatgtaattctctatagtttttccatggtctcctataaaagagctgttcaatccccaaagggttgcaaccccaggttgggaatctctgcactgtactgtcctaaaaccacgggccatctagagctagctggaattcgaaaatcaggcttgactgttacgttcagctctgaaagtcagggcccctcctgaccttccacagacgagtgcaggactgacaggcgcaggatcgactcccaccatccctaactcaaggactcacaa

SEQ ID NO: 18513 - DNA, 1515 bp, Mus musculus
tccacaaaattatttcctgactgccacagttatgccatggcacacacaataataataatgagtttaatgttttgtttttcctaattttgcaatagttaatcttattttctcttcctttagttgttttcagaataacgtagaaatccatgttgcacatatccagagtggcctgagtcagatgggaaacttacacgcctttgcagccaacaacacgaacagagactgagcacaggattctggtacccagctgcacacagccatggtctgaggagtcctggtccttaacccatgcttccaacaccagataacctagctgctggaaaaccggagaactgtacatctccagatacggctttttaatacactctactgcttcttcaaccagcattgtgctgaccagcatttatttattgttcttttattatccagatgcagtagtgttgcttatatttcctgtttatcagcaaacatttttaaccggaaactctctgaacgtactatcccatggaggataaaccactgttttatgcatgcatgaattctgctcagcacatgcagacgactcctgtgacagacagagaacatgaagaagcacggtctttccatgcatgatggtgggaatcccatccgagagtcaccggtccagtggagttagttggcattatatcttgggctgcaaaatagacgtcatgagtgtgagagtccgagtcgtaaggaacccgctggggtacagatgggaaacacggacttaagtgtatgtttcatatactgacagtgggacatggttctatagatcaattataataataaatattttaatttatcataatttataaaagctttgttgtttatcagcagaggaaatgaaggagccggaggaactgtactgtgccccgctggatcccagcgggtggacttggcatgccttccatgattcagggcaaaagtgttaagtgttgagacttattttaaaaaagactgatgacacactattttcgtatttttttgtttatttgcacaactttaaaccagatgactggttaaaattgaacagtacacaatttataaagtgaaaatcttttataaggaaagcatatgacatgtgaatacacagggaggtttggctttggttgttttgtttggttttgttttttctttttaagaaaaaccctgcctaaaataatcttgtaaaaagtatgtattttaaaatttttgttttaatatagaatattataaagccaaaatataattgttttcagatttggagtttaaaatagagctatagaggtggttctgattctttgacgtctcataaaatgagacttttgtatattaatgtataataaaactgaaataagattattttccttgaaatttttgtatagtttaaaaatgcttctgtgttctttgttggtattgggccactgcagatcttagtgcagagtttatatttagctagactgttatgttaattaagaaatgcataaatcttttattcttaatatttgtaattct

SEQ ID NO: 18514 - DNA, 1594 bp, Mus musculus
gaagatggactcgtaggagatcagcacagttttcttcggtgttccgtgactaagattgttatatataaggaaggagttaggaactgagtagaaacagaatgggtaaaacaaggccaggaatgtgagcagcagttacacggaaggctggggtacaggttgttacctccaccctgtgtctgtcactgcactctcccagcccagcaactgtacatggtggtggtcaggccttcaagtgaatgacgaacatgcgcctgcatgcagagttgaaactacctcaaagcgtgcagtttgattgcttgtgagagaggtgattgctgggtctaacacttgacttgtgtcttctgttctttctcaccgtctcacagaaaatgtcacttgtgaagaaaaagcaaaaaagaacgccaacaagcctctgctggatgagattgtacctgtgtaccggcgggactgtcacgaggaagtatatgcaggcagccaccagtatccagggaggggagtctatctcctcaagtttgataattcctactctctgtggaggtccaagtccgtctactacagagtctattatactagatagagctgctgttccagggtcgggagtctagggttgagcacaacatgacgtttaatttcctttgacttttgtggcgcataggagtccgtgtttatcttctcgattttgttctgagggtttatgaactcattgagaaccaggattccttgagactctttagcattagtgctctgaggttaaaagcagttcggaagactcatctagcccttgggtgctgaccagcagagctgctagtggatattggagttacatgagctacgtgttaatattcagtctccagaataaacgtcccagcgttgccctgacctggctggagggcgcattgctgtctgtgcctgtgttgtgcacagccacagttagtaactggggaagcttctgtactagtctccttcaacgcagctggctttgactgagtgctttgacagtttgagacttcaccaagtatagtagaaaaacaaatggcctcaacttgatcttacctgagtaaccaaggctgcttttgctttgggtacagctatttagttagttgtgttacaaagaattattttctgagagaatcttaaacttagaatattcagatgcagtagatactggcgtgtggagattcacagacgacctcagcacccatcccaccaggtccctggactcacggcctttccttcatttgccattcacattgctgctcacaaaacagaactcggtgactttgttttgatatagttttgtggaccatctcaaattaaaactattttctgtaaaaaatctatagccaggagttttataaactcacctggcacctactgagctaaaatatgcaaaatctgaactaaaatatgcaaaatcactttaatataatttgacatttgaggagtaccattgcactaacaggaaatcactgccggagacagcccacatttccttgtagttgttattagggcacaaaccactccacagtcccagtgtggagtcacagtctagagagaattggaaatgcacgtgcttaaatgatacagctttaat

SEQ ID NO: 18515 - DNA, 1195 bp, Mus musculus
cactatgaggggaaacatttcattctcaaaaaaattttttttcctcttcttcctgttatcagtagttctgaatgttagatattttttccatggggtcaaaggtacctaagtatatgattgcgagtggaaacataggggacagaatcaggtattggcgtttctccacgttcatttgtgtgtgaatttttaatataaatgcaagatggaaagcattaatgcaagcaaaatgtttcagtgaacacatttcaacagttcaactttataacaattataaataaacctgttaaaattttctggacaatgccagcatttggatttttttaaaataagtaaatttcttattgacggcaactaaatggtgtttgtagcatttttatcacacagtagattccatccattcactatacttttctaactgagttgtcctacatacaagtacatgtttttaatgttgtcagtcttctgtgctgttcctgtaagtttgctattaaaatacattaaactatacctgcttctggtctttattattaaccttacagatacaagtttaatatctggtgatttgacagaaactcttgaggtataggagaaagaaggttggcgtgaaaaggaacaagctgattactagtcagcagaatcttgccataagccatgctatactattaaacatttaatggtaaatgacaatgtgtaactctaaagcagtgtttgctattttaaagtgttcttctatattaactgaagttattcaagcaccagtcattgagtcttaccttttttagttattagcattagtgtttatgtagaatacatggtgatgttcaataatgacatggagttttaactgggcagggaaaacaatggactggagccatttggcagactcttggttatttttttagaaaattataggtgcttattaaagtttgctggggcagaaagtttgtgaggagaagcagatttcttgacttcaggcccccaaggccacagcaaaatacattggggcatgtagctcattaaagaacttgcccatcacagttttcggtccccagcaatgtccacactggtgattcatcctagtcccaacactagggcagtcagggtataagcgtaggggatcagaagtttgaagctatgcttagctacatagttcaaggccagcctgggttacatgagttttgtttgtaataatctc

SEQ ID NO: 18516 - DNA, 2426 bp, Mus musculus
ataaaattatgagagtaggcttgctctgtattataactggtgaaatctgaaaagaaagagtaacgttaacaacatgttctgagctgggagtgctgggcctcacctctaacaccccagcacatgggagggaggcagaggcaggagtgctgctaaatgttttaggccagggatacatacatagcaagacccagtcttaaaaagccaaaaacagatgccaggtatggtggtgtgtgcctgtatcctagcccttgagaggcagagacaggaggatgaggaggatgaggagttcaaggccagcttcagctacataagcaaattcaaatttagctttgagtatatgagaccctgttgtgggactggggaggaactgtatgcttgtcgctgtcgtgagtgtgtctagtcagtagcagggagaaaatacagcgaatggcactgccttaaaatagaatgtggtgggtcttcagtcttcacaggctggctttaatgcttctttttcccatcaggctcttggtctggaagcggtggatctgtcagcattcagctctgcagccgagttggagtcgctgggtttggagaggctcaagtgtgaactgatggtccttggactgaagtgtggggggaccctgcaggagcgcgcagccaggctcttctctgtcagaggcctcacaaaggaactcattgacccagctttatttgccaagccttccaaggggaagaagaagtgaatttccttggcacacttcctccgctgtgacagacttgtggcctgtgttccttttgatactaaaagccaattttttaataattcggttctaactagtctcttttcaaactagtctcttttcagtggtacctgaacttgaggttttcgttggaggagaaaacttttgtatgttatttttctttgtttttgatgtttttgtaagagatactctgtagcccagactgaccaagaactgtgtggttcactttggtctcaaacttgcagtgatcctcctgtctcgcatgagctgctgtgcctgctttgtcagaggtttatacatttctttggctttatatactgtgtcacttgagtaagatattttcaagaaatttatttgtataacccaaagcagtcaggtttgtagacacagatattcataacattcattttaaaaacttgtttctctttctaggagagagaaagagagagaatgagaatatgaatgtgtgtgtgtgtgtgtgtgtgtgagaccagggatggagcctagctgcttccaggcctctcactggggatttttattctagctagggacctattttgtttggttttcaaagaatcagttttttgtctttgtggatttttctcagttgttgatctcattggcatttgaattgtatttcctctcctacatgccttgtgtttatcatttttctttagctccttaagtctttgatcactgattatagattttatttttattattattagtgtattgcccaattagcaaatgtttgtgttttctgtaaatgttttattgatagtgactctctgactattcaggacagaaagtacctggcatccttgttgtgactgacccaggatagggtctgacatgatctgtgctgtgtgtgttggaaagaacgtaccatcagccggcagcagggtgggttctggacacctatcatgtgagtggttggtcggatcggtcagatgaccgccttcgctggttcattttcataaggaactaagagcaaaatcaaatctcaattaggattgtggcaattgccttttttgagattaaaaataacttcatcagcgtttgctaagttgtcagttgtatattaattcagtgactttatatgtctggctctgggctggagagaccgcactgactgctcttccaaaggtcctgagttcagttcccagcaaccacataatggctcacaaccatcagtacagctacagtgtactcatatactatacataaaataaataagtaaataaatcttttaaaaaatatatggctctgatgggttttggatttttttccccatctgacagttcacgcatggacactgcgtcctgattaggtccacagtttctacttctctaactcttctggtttactttatatgttaaagctactgttcagttcttacacttattgaacattacatcatgaaattcccttcatctctggtgagtttcttgctcacctgtattatctaaagcacagctttgtccttgtttccacagtgcgttttctgttcctctctccttgctcctcctgtctaacacacagcaggtgtgtctcgcatctgtgtctgacttcttgtcatcatcatcactgtcatagccatgattgtcattgtcatcatcttcatctggtccctgtctctgatgacaggtcagcagtgagtcacatggttgtttcggtcataac

SEQ ID NO: 18517 - DNA, 1439 bp, Mus musculus
gtcaccttccttagaatgaccaaaaccagggtgggtaagagggcctgttgttcctatcccagtccacggcgcttcctcgatagcctatgtctctctagacttcttgctctctcctccagtgcattccgacagcccacacaacagagaactttgagaagaaaaactgagggcagaacgcacaaactcatcttgccccaggtcgctcagccttgactggtaaatctaccctacttggatgtgaacccagacgccctgcctcgacaccctcctgaagccttaatctcacagtcaacaatcacacaattccagtaaaagggtggctttgggtggcgaagcttatccaccgttcattcagtcaacatcagctcagcactgtgggtcatcagacaccccgctcagagctggggaaataaagactccataataaggaggctcggagctggggaaacaaaagaccatggatctacccctgaagagttcagttgagcaaacactatttgtcaacagaccacgaccatagctatgacagctgggctgatccacctgatactaatttggagaaatgtggattcacattggcttcccctgactttcctttccttaaggctggaagcgtctgtgttgactggaccagactcataggcctaataccttgacctggcttgtctcttagctggaggacttgtgccaccatctgggttgcaaagcaagtgtcaccctggcagtcctacagtacagtagtcagactgctgtatgcgccaggggatgtgaccagactcacaggagcatggaggattctgtactcagaacacttaagtgggctgagcctaaaagaagtgagtgataggctagagctcttactgtctggtttccagcacccaacagcggcacacacctggctgttaactccagttccagggattctgacgccctcttctggcctccaatggcactgcatacatacggtgtaagtatatctcaggcaaaccactatacaagtaaataaatcataaaaaggaaaaagaggtgcttgagagatggctcagcagttaagaacactgactgctcttccagaggtcctgagttcaattcccaggaaccacatggtggctcaaaatcatctgtaatgggatccgatgccctcttctggtgtgtctgaagacaatcgacagtgtattcatatacataaaataaattaatctttttaccaaaaaaaaaagagaaaaagaaataattgagacttgtagtgagagttttagtttctttgaaaaacagaaatattatggaactatgtttccattttaaccccaggtgtgggctgtggggctgctgcgcagcaggtgactgtgatttgccttgtgctctagcagggggatgattttgccagctgcaaattgtgtctgtgactgtgtgacctttggaattctggggacttttca

SEQ ID NO: 18518 - DNA, 1141 bp, Mus musculus
aaacagacatagacaacttttcaggtacaaactgacaggcagttttaaagccttaaagttgtgttttctctctctctctctctctctctctctctctctctctctctcatgcactcactctgtgtgttcttctttttccactcacacactccacacactctctctcctcacactctctctctcacatacacataactcaccttctctcatctttcactcacacacactctccacaccatctgcatctcactctctctctctctccactcgatgacccactctctcacctttttcttgccctagtcttttattgatactccaaatgcagataggaaaaaaagacattgtataatagttgccaaatcaaaacaatacccacatcacacaaagaatcaagaattacaattgttcttccaaagtttcaagcttcccctattcccaggcctctggccaaaataatatttattgcaaacttatcattatttaaactttaccttttgacttattatactccagagctcagagctccgaagtcggctacttgcattttcccgtgaagctctgataataaatgacatgggcaaagctgccaggcagtggccagaaagactcaggttcacccttaacttggcagttctgctagctttctgcttctgcacattgcacacagtgaccctcctaagagtcccggtgttttggcttagttttactagtataagattttatgcattctgtactttcttatccatatatatccaaaagagaccaggaactactcttaagtgttgtgcaaacctcatttcataaattcaatagctttttcctctctaaattaaaagtaccccatgtttatgttcccttattccatttcttctttatcccaggattatgtctcttgtactaatgcttttggggggggagggcattgagacagggtttctctgtgtagccctggctgtcctggaactcactttgtagatcaggctggcctcaaactcagagatctgcctgcctctgcctcccaagttctgggattaaaggtgtgtaccaccactgcccggccatgctttttcataattccaataaattccttcactttctggtaatggatcctgtatgactctagcagtaagtggctctg

SEQ ID NO: 18519 - DNA, 1816 bp, Mus musculus
cactatgtggctcaggctgtccttaaacctgcagccctgcccagcatgtctcaagcctataatcccagaattcagaaggctgaggtaagaggatcccatgagttttgttttgttttttgttttttgtttttcgagacagggtttctctgtgtagccctggctgtcctggaattcaatttgtagaccaaactgcctcgaactcagaaatccgcctgcctctgcctcccaagtgctgggatttaaaggtgtgtgccaccactgcccggtggtcccatgagtttaaggctagacagcctgggctacagagtgagtttttggatcagactctgatggtaaagaataaataaagcaacctgctgtccttctgtctcagtgtggacagacatgcgccacacacccagctctgtctattccaagtatgtttttaaaaaacatttaaaaagatttattttcttaattatgtatatgtttgtgggggctagggaaggtgtatccacataagtgaaggtaccttcagaggtcatcagatcccctgcagctatgggtactgggacccgaacccagggcctctggaggagtgcacatgtactcctagctgctgagctgtccctctagccctcaagcttatctcttcctgttgccttgtggcttctggacacagagcacttccttattacaaatgtgtcgactagattctccacatcttttcttttttttagatttatttatttattttatgtatatgagtacactgtagctatcttcagacacacttgaagaggacatcggatcccattacagatggttgtgagctaccatgtggttcctgggaattgaactcaggacctctggaagagcagtcagtgctcttaaccactgagccacccaccccacatcttttcttttaataattatttcttttctggtttatggtacctttgtacttcgtcaaaggtgaattcattaaccctctactttttgcaaattattgaagaatgctttcttaatccaatctggtggtatatatctatgtctcagctctcaggaaggctgagagaggactaagcattttggataagaaggtttgtaggccagcctgggttgcatggtgacactctatctcaaaacaagacaaatgccacaaacaataaggacattttcttttctttcttttttaattttgttttggtttgtcttcaaggtttctctgtgtagccctggaacttgctgtgtagaacggggtgacctcaaactgacagagatccgcctgcctctgcctctggagtgctggggttaaagttgtatgccactactaccctgcctaaaacgctttcttttaaaaaaaccaaaacaacgtgatgtttgaattatttatgttttatgtgcaaatatgtctgtattagatgtgtatgtatgttttataagtaccgtgtatgtgactggtgcaggtgccagatcccctggaactggaattatagatgactaactgctgagttagcacccccaaatgtcttctttatgccaatacctacaaacctccatatctgaaattccagatttgttttttgtttcttggttgattggttggttggtcttttgagactgtctatgtggctaatgctgccttaaaactcattagatagccctgactgggctcagtcttgagatccaagccaggtatggtactgcattcctaaaaacccagcccaggcaggaacaggcaaatcaggggttcagggccatcctcacttagtaaatgtgaggtcagccggggcagtgtgaaactgtgtcaacactcagctatcctcgacctggt

SEQ ID NO: 18520 - DNA, 1205 bp, Mus musculus
atggccatctcctccacatccgcgctgtccagggtgggggcctggctgagctgcagctgctgcagtagactgctcaggacctgttcctcggtcatcgctgccccagggccagccaggggcagtacccagagtgcccagcaaagccacagggacttcatggcgctgcccaggaggaatcgtggatatatgcgtccctaaaagtgccctgaaaagttcttgggacctagacggtctgctgagggctggcactggccttctttatagttggccctggggtggggggcagggaggaaggacaagaaaggtcacacccctgggacctcctgggaactcagcatgagacaagcccctgcgccctgaggaggggctgtctaagaaaggacacagagagctgtctggaagacacacggactgagatttctgtctgtggggtcactgcctctcaacgatactgttcgctcttgttggaattatctgataatatcaccgtctgttttgtgggatagagaattcctcggggcaaaaaacagagagactctttcaccagttgttgaagtactatattacctgcatagccatggctgggctgaattcttcagaaacgactctaggtcaggcggaccccaaacttgtgataatcctcctcccatcatcctctgcatgctagaactacagctgtgtatcactatgccagacctgtttaagactctggaagattctccatgggccagtggaggtctagatttgtccgtggaggaacaaagaggggcagagtcctgtattccagctgtctctggtcaattccacagataccccggagtcaaaggaaccgtatacatccttcagtacccccacgggtctgtccaggttcgtcacggtcctcatcacaccccacccctcccatgccagaggaagacagatgccgctaactagagattttgctagcatagtctcaggaaacatgaagactgcgcatgtctctctgctctcagagtgccacagaatgtgcctcttcagacagcaactccttctgggagggctcgcccactaggctcataccacaagcgctcaggcttgtgtcttgctcataccacagacttagagacagaaaccatccagaggccaaatctgcctggaaacatgtccagtccacagctgcaggcacctgactggccctacttcttctagctcccagtttacaacag

SEQ ID NO: 18521 - DNA, 2332 bp, Mus musculus
gtagttctggcataccaagactcttagtaagcactttatgttctagacatttatttgttctttaatcttcacagtgttctctttgaagaccttgggaaatggttggtaggacttccttccctgccctgtcaggtgacctttgctctctcacccctacagagctcaaggcaattgtgaccccgaggtaccagtgactgaaggcacccgatgctgtcgccaggagatgtacctggacctgcaggggatgaagtgggccgagaactggatcctagaaccgccagggttcctgacgtatgaatgtgtgggcagctgcctgcagctaccagagtccctgaccatcgggtggccatttctggggcctcggcagtgtgttgcctcagagatgacctccttgcccatgattgtcagtgtgaaggagggaggcaggaccaggcctcaagtggtcagcctgcccaacatgagggtgcagacctgtagctgcgcctcagatggggcgctcatacccagggggatagatctgtagtctccctgtccacagatgtattctcagtgagcttgtcctaacttagtgctctcgtcagacctttgctctacagtcttggttttcttgtccatcacccagtttaagcacttacatgggtaaatcatgtcactccagtaggacacactgaccccacttagccaaggacatggctatgcagtgaacaggttcgcatctgagtctgttttctggccagaactcagcttaatgtacaacaaaaccctacggtgagaacaggggaatcaaaagctcgtttactcttacaccgtgattactggcatcaacgtaccatgtcagggactgcccacagcaggctgggagggagacatctcagaagcctgcggcagctccttgtgaaaaaccgttgttcccatttctcctaaccttagccctagacaagagctgtatagatttcatgtgtgtgactgcttttcagttggccttggtgttcatagttattctatattatttgactttcctactcctttctccttctgccctggtgaattctatgaaactagatgttccttgatgtaatgattcttaaacaattaaaaagttgaggcatgggacacagcacagcacagtcctgatggcccaggtgcatgctgtagatgtattctgtgtgctcttatcttggaaacaatgcaataactttgcaatgttagttcagattaatgtttgacttgcaaagaaagtttgaagaaattattagaaagtgaaatagagccaacactgggatcccgaaaagaaaaaagctattgaagttatgaaataagttttgcacaaaatttgagagtgtttcctggataagcaagtatagaatacataaaatcttatattagtaaaactaagccaaaacaccgggactcttaggagggtcactgcgtgcaatgtgcagaagcagaaagctggcagaactgccgagttaagggtgtacctgagtctttctggccattgcctggcagctttgcccatgtcatttattgtcagagcttcacgggaaaatgcaagtagccgacttcggagctctgagctctggagtataataagtcaaaaggtaaagtttaaataatgataagtttgcaataattattattttggccagaggcctgggaataggggaagcttgaaactctgggggaacaattataattcttgattctttgtgtgatgtgggtattgttttgaatttgatttggcaacgattatacaatgtctttttttcctatctgcatttggagtatcaataaaagactggggcaagagaaagggagagagcgagtcatcgagtggagagagtggggtgtgcatgcagtgtgcgtgaggtgagtgtggagtggagagagtgtgaggagagtgtatggagagtgtgtgtgagtgaaaggggaacgcacagaggtgtgtatgagcatgagagtgaaaagaaaactgcacaggagaaaagagcgtgtgtacagcctcaagctgcaaacaagcaagcaagaaatagaacacacacacaaacacacacacagagggagagggagagagagagagaacaattttaagcttcgaaaaattgcctgtcagtttgtactcggaaagttgtcagtgtctgtttattatgtgccttccagatatccctgcttccagttgagaactccaatcctgtgtcgaggctggaccccgacaagtgatacataaattaatttacacaaaacagaacaaagcaaacagaactccaacatgccctagataggagaatatctggaaagagcccaccaggtactgacccattccagacttgtt

SEQ ID NO: 18522 - DNA, 1163 bp, Mus musculus
aggtggaggaagacctcattgatgctatcaccgggctcagcggcagcgggcctgcctatgtgagtggttctcacttgcccactggcttgcatgcatcctgggcagcaggaggggctggcggaagagagggcagccggcacatctcttggacatggctggctggtggaaggagctgaccttcaggattggtcccagtcacctgagaaagccgcctgtggtgtgtgggtgcgcggatgcttggttcctgtgttcagagaatatctccacaggcattcatggccctggacgccctggcagatggtggggtgaagatgggcgtgccgcggcgcctggcggtcagactgggagctcaggcgttgctggttagtgtctttgcgcggttggtggttggttttagggttgtgttttgggggaggggcaccgagctgggcctgggttgagtctaatgctgctttgtatctcagggagcagctaagatgctgctggactcagaggaccatccaggccagctcaaggacaacgtctgctcccctgggggggccaccatccatgccctgcacttcctggagagtgggggcttccgctctctgctcatcaatgcggttgaggcctcctgtatccgaaccaggtgcgcgttctcgctctcccctgtctgagttcttccgttggtgttactcttgaagatttcatgagcgcggtcagagtctgtgctctgttgataaccacagttttaagcttcctttaaccaagggtttgctaacctttctctacttagttcttagcgcacttctgatggctatgattaactttgtttatgtagatgggtacattcgagatcaaacagttaaatgatggagatgggattcaactgctgactggcttcaaattctataacttcccctagtttttttttttttttttttcttgtgtggtcaccgatatcactggaacactgtacctagcttggatcgcaccgggggactgggatatcccctgttagttatttgactcttaagaagcttggagcttctctggtttgggattctgagtcttggtggcgtcgggttgagagtctgggtctgtatagctggggaaggcgcaaagctctggctccgaggtttatcatcttcctggtggggctttgtttacagagaactgcagtc

SEQ ID NO: 18523 - DNA, 1099 bp, Mus musculus
gatggacaagactacaggtgcacattccagacactgggagcaggcatccagcagagaacgtgagacctccgcgtcgtctccaggacccaccttccatcccatgctgggattgaatttagggcttcacgtgtgcagggccggtgctgctctaccactgagctattaccacccctgtcctgaatgtcctaattggtcagacacccttaagtcaatggtgaagtatatggctaacagacagcggtgaccagatgttctcagtccagacaggcttttgtgtcctttctagacagcccctcctcaggactcaggggcttgtttcatgctgagctcccaggaggtcccaggggtgtgacctctcttcttcctccctgccccccaccccaggaccagctataaagctgttccgtaccgtaccattcctccgcagactcaagaccctttcaggacacctcagggacacacacatccaaggctcctcttcccggacagcaccatgccattcctgtggctctgctgggcactctgggcactgtcgctggttagcctcagggaagccctgaccggagagcagatcctgggcagcctgctgcaacagctgcagctcgatcaaccgccagtcctggacaaggctgatgtggaagggatggtcatcccctcgcacgtgaggactcagtatgtggccctgctacaacacagccatgccagccgctcccgaggcaagaggttcagccagaaccttcgaggtgagccctcccctgttgtccttggtctctaggaaaggccggctgatcatgccttccttccacctgtggtgtgtatggacccttgccttgtggtgctcagagtcagtcatgggggtggggggcacagggtgaggcggatgttagaggggagaagatctgggagggtgggcactggggatctggctgtgcactgaaggagtctcaggatgggaaaagcggggctgtgcttgctggtaaattaaggagcagagaagagggaggagagtggaagaaaacagaacccctggagcagtcagggccaggtagaacttcctggggtcactgcctggacgagtggctgactatgtcttgccatg

SEQ ID NO: 18524 - DNA, 1491 bp, Mus musculus
tcctttgctacggcagtgggtttgaaatctaggccagaaaattcctaataagctacacacccagcccagttcttcaatactcgaagaactagatcttacatctctcccagatgctcctgacccctgccctgtcaggtgacctttgctctctcacccctacagagctcaaggcaattgtgaccccgaggcaccagtgactgaaggcacccgatgctgtcgccaggagatgtacctggacctgcaggggatgaagtgggccgagaactggatcctagaaccgccagggttcctgacatatgaatgtgtgggcagctgcctgcagctaccggagtccctgaccagcaggtggccatttctggggcctcggcagtgtgtcgcctcagagatgacctccctgcccatgattgtcagcgtgaaggagggaggcaggaccaggcctcaagtggtcagcctgcccaacatgagggtgcagacctgtagctgcgcctcagatggggcgctcatacccaggaggctgcagccataggcgcggggtgtggcttccccaaggatgtgcctttcatgcaaatctgaagtgctcattatactgggagagctggggattctaactccctaatgggcaatccctgtgtgtgctctttgcttcctctgaagtagcctcatccctaaatttttaccttcgaggaatgtgactcgctggcccctggaggcgctctgacccagtggtctctgtccttcatattgttcactgcactgtatgcgaagcacttacatgtatagatactgcaaaccaaggacagaatccccaattgccattgttcccttaatttgtcgctgaatctgggctgagtcccagtcttgactctggacctaagccacaagttgggcaaacatgtccaacctaggcaatactggctttgctagatgtgaataaaatatgctttgttttgtagcttttttgtttccttattttctctctctctctctcaagacagggttttgtgtgtgtgtgtgtgtgtgtgtgtgtgtgtgtgtgtgtgtgtgtagcctctgtcttgtttccccatttaaactacatctgtgtaaactgaggcagaaaaaagaaaggcctggtgttagatcaacttaactgagaactaaagagcttgattttgctaagacttgatcgaagtttcagcgataaaagaagccaacttggtggtgtctgcttttcagaactgagatagaaatgtttggctgttgagattttggctttttgggtccaacaattagggttttatttcgattctcgttgcattaaggaaaaaaaatcttattatgtcaggtgtggaggtgtgcacctttaatcccagcagaggcaagcagatgtctgtgagtttgaggccatcctgtgacatagggagtttcaagtcacccagcactacactgtcagaccttgtttcaaacaaacaaacaaacaaataaataaataaataatcaaaaatcaaagtc

SEQ ID NO: 18525 - DNA, 1225 bp, Mus musculus
atctaactctttgcctttgccgacagccctatgtgcctcggattctgaacggtttggcctcagagaggacagcgttatccccacagcagcagcagacctacggtgccatccgtaacatcagtgggactcttcctgggcagcccgtggctcaagatcctagtggcactgcggcttatgcctaccaggaatcctgagagtggacaagctggtctggcaggctgggagcatctaggaataccgagggacacaaggggctagagccccagacaggctcttgagggttttgctgcttaaaacccccgtattgtgagaagaggaaaccagcgggtcgtggggctctgggtaaccgggctgagggtatccatccggtggggctgctgtccctgggagccatctgtaaggtttcttttctggtcccagtgtggggaacatttacagctccctcttgtggtcatctgaggatatgcacttttattcccccatacactgctcaggatgctctctgtagtgagcatggtgtatgtccctagtggtttgtggccaagatcatgtgttgggcttttgcctttagggagatcatatttggggacttctggttgatggggagatgcgtccaggaaagacttagtccctctgagccctggaacactgcttagccttctgcaagctgatgaatagcgcatcagttgggtctgagatggaggccatgtggggccctacagtactgtcctgcctgcagtcccttttcagggatccatggattagctgtagggaccggggaataccttgttcttgttgatggcagcagggcagcaggctcatgcccactggtttgtagctgcctcctgctgtgtttccgggtttttgtatcatgttgcctgaatctgggctgtgactgggtaaccccacagcaggtggggacatgagaaccattaataaagtacccactgggctggtggtgagaccctgcctctcatgcttcttccgggtttatgtacagattttccacgtctgtgcaggattcttccagcctctacctgataagtctgctctgtccaagatagcaggggcagtgtcaagggcaacttggaattatgagaggtcagagtggcaggcacggagagaacagggtgcccctccatttcttcggttttgggcagctcactctttttccaaagtgggacctggggttgggccctagggggcaggctgagatgagaaggaa

SEQ ID NO: 18526 - DNA, 1430 bp, Mus musculus
caggggatcctgcacttctggcttctataggcacctgtgctcatatgcatgtagcccctcccacccccacacactttttttaaaaattaaacatatttttataaaacaaatggaatatattcaaaaggtatttttagaagaaatgttgtaatctattttccacccagtaactgtcttctgttcaacttgtaccacagcagacacagcttgtattttatgtccaggccaccagaaataaacgcacttagacccagcattcagttgtcaagaagagctgatatggcagatagtgttttcatttggcatattacaagtacagcagcagcaggctcaactgctcagattcactatttaagactttctgacatttacttctaattctccagtcacgctcatcatctacctctactgatccggtttggtttttctctcctctgttggtctctttctgggaaccagtatgttctcctttatgtcctccattgaacagaattatcattctgcttagtacctacaaacctctgccaagccctcccaaaaaagggagtcatgctgactttgtaactgtaatcccgattttattcagttgtattcttccaactctgtgtggtgtgtgtgtgtgtgtgtgtgtgtgtgtgtgagagagagagagagagagagagagagagagagagagagagagagagagagacacgctgggtcagagtacaacttttaggaggtagttccttttttctaccacatgatccccaggatcaagatcaggttgtgaggcttagttagcaagtgcctttacctgctcaatcatctcaccagcctattatcaattccatttgtatattcaatactctgtagactgcttgacactctgttcttatgtggtgttctcaactcagtagaatctttagacattcacattttatagaaatatagattgcgagtttgctaatactaacaagaggagcagaggctgggaagctcctagattagcacttggaagtgctgttggcatcttggttgggaatgtttcttaaccaaggttttcatgactggctcacctgtgcccttcacaagaacccttgagatcttactcttccaatttaaggatgagaaatttacctaaggtttggagggatgactcaagggttgagttcagttcccagcaaccacatggtggctcccaaccttctgcaatgggatctgttgccctcttctggtgtgtctgaagacagcaacactctactcatatacatcaatgaaatctttaaaagaaagaaatgtacctatgtgggagtgcccagaagtagtacccagatgtgggaaagtggcacgttggactcaatttcagtttgctttgctgtcctgccaatgatcttactctattttgtcagggtgctctttcagccagccccaaccccttaccactgagt

SEQ ID NO: 18527 - DNA, 3632 bp, Mus musculus
actctagatgcaggagcaaggcagaatctctgggtctagcagttaggactgctatagcaaagaccataaacaggcaccttaaacaacagagacaaccgtctgagatcaagatgttgtcttgtcagagttctatggtttctgtcccatctccacatgtccatctagttttgcactctgtgtccagacttcctcttgtacggcaaccccagtcacctctgcagaagccctgtctccaaagctaccaccctctgaggtcctaggggttgagcctcaatgtaggaatttgcgggttatgccttccatcccataactgattgattagcacaatgtggtattttttatcctcacaggatcaagtgatgtatgaagctctgcagaggtccctcagtcagtgatgtttgcgctacctggcatggaggaggtgtctagtgtgtggaactcaccacgaatcacagttactctggagggtctactttcagcttgacaccaatgatcctttttttttttttttaaatcagaaccagttatctctttattttttggaaagtaagttggctgtgttagtaaaaccacatctgctagtgtgggctgataaaccatgtgctaggccccaagaaccctgagccactgtcctgaccctgctgactgacaggcaagggacagccacccaagcccaataagaggagtaaaaaaagtagcaaaattgcattcaccactgtctcccaggctttgaaaggtagcagtctaggctataaaagtctagaagctctgcatagggagtgttaagcctgcagcaaaacaacttgtaaaaactcaataaattatagatagacttgtaacagatatctattaacatctgaaccttcttacaggatcagtccctccctgggcacaggctcctgcctggaatacatagcaattagaataatctgtatgaaaaataccagttcaccttgaaatttttaaacatctcctaaagaaagttcctatataaatctaatccctcacaaaagagggccgaaggcaacaggaaacgctctctggcgccattactaactaggagagctagctgctcatgcgccaaggggctatgtccagcctggcagaggccagactcacggtctcagcaactccctaaatccagcatgaacctctttcactgttaataagttacaacttaaaatgtctgaaataccctgggactaaatgctgtaccctgaggttggggactggagctctgggagttgataaatatagctttacaaatatacaggtccagtacaaacaaaactgccatgccagaaaagtcccttgcttctcagcctgttcttgccagtttactagtgagccccatggagtatcttgctcccttgggcttcagctttgccttttttcatatagatgtgtgtgtgtgtgtgttacacaacatctatttatataaatatacattttcctctggaatacacctttctgatagacattatctcccccccccctttttcaggtacctgtaatttgtgtctgagaggcagggtgggaagcaggcagcctggagatgtcgagctatgacaccccctagatataaggtgccatgtaggagagaggcttgccacacagagcagagcctccctgcaagctcagcttggggcaccaaagaggccaaggcccactctctacaatggtccctgtaaggtagcagtgagaaatgagagggccagaaccccagggttgcacagggtgggcctcttaacgttctcatttggtcttcctggccctggccactcaggagatcactatacagcagtgcatgttcccaaggggcaggggcctctgcacccaggagctaaggataaacatgcaggaagtcttgtctattgttgacccattgcactgggctggctagggtccactgcacaccagcagtagcagggcgggttagggtccacagaaacattggctggggcttggtctgtgggactgcaggcctttcacatccgaggtcccccattattgggtgggggtagcaactcatgggtgaacaccctgtcatccctggacaggctggagctaggagtgtcccaaccacctggagaggactgctcaaatggcacggagaggtccaagtacttgtcagttgatgtcacagtgaggatgcggtctaaatcctctacctactgcttgaaggtgggcctctgaagacactgcatgccaatatccccacgtgaccatgtacaggccacgtgtgcagttgtggggcttgtccatgcagtggccctctgtaagtagcttgaaaagctcttccactgggatgccaggatacggtgagatgtcctagcggaggacaccaaagaaccagacatcactctggtgggtgaagactctgtaaaaaagggcctctgattccatccacttcacaggtagcaggccacttgtggtcttcttgtagtaatccaggttgtgcacgtcttgggccaggccaaagtctgtaatcttcatcacattgtccgaggtaaccaggacatttctggcagccaagtctctgaatacacttctgggaagccaagtattctgtgctccatgttacctggtaggcacagaacactagatccttgcaggtaagctgttctcctggcagcctgcagtccatgcctggaggccattatgccagaaggaactcttgaaaattgccttgtctgcatactccaccagcacatacagagcccacccagtgcaggcccagcagatcatcatctccatctcagataccaggtccaacagcatcttcacagtatcttctgccatgacagtctgtccaaagcagccttctcccagtcttaccaagtgtcagttgggtcctggatagttcctacttggggtcagcaggcagctcaagttcagaaacattggccataataggaccttctcctgaagacaccaagcaatccggataagggctacatttgaagttcatagaggaattagattccaaggacacctgtcagttaagcggggaagtgccttgggggactgggcagaccgtcaccacagctgccaccactaggatgaagaggaagaagcccaccccgtagtcgctgaggacacccgcacacatgctcctcagctgtgtcttcagttaggtccttcccatcttcattatctcctgaggatggagcatctgtcacatgcatactgaagcctctgagagcccaccaggatgcagtgggaaaccaccagttctgtaccattcttagcccagactgtgggacttgtgggggcacctctacatgtcagctccacggtgtcctcactgccaaaggccacctgctcctactggctaggttcaggccctggaacctctgccgctctctttacagctctggaccagaaggctctgaagtaggtccagccatcactgccatgcagaatactttttttaaaattaggtattttcttcatttacatttcaaatgctatcccataagtcccccatatcttccccccactcccctacccacccactcccacttcttggccctggcattcccctgtactgaggcataaaaagtttgcaagaccaatgggcctctctttccaataatggccaactaggccatcttctgatacatatgcag

SEQ ID NO: 18528 - DNA, 1281 bp, Mus musculus
tacattgtttctcgagtaattttgtcttaagtcagctgctttatgaacatttagaaatgaaatagaatttcgtgagatggatatttttggccaagtgcctatgtttgcattatctaaccctagcttaaaatttagaattataatatcaaatcaatctctcttctctctctcttctccccccacccccagccattttggcctcaaacttacatagtagctgtgggtgactgagtggcattggccactaatactgacctagaaattacttttatatttcttgattataattgatttttttatttcaccaaatatatgatgtacttagaaatatatctcatctagagatattattacaatgcatagttcgttaaattcactataacttagagaatcttggaatacttatttaaattacatgtaactttgtgtaaattcacaataacttagataatcttggaatacttatttaaactacatgtaactttgtggttcacattgttttcctttaactcttatctttaaaggatgaattgcaaaggctgttggggttgctaagagaccaagatcccctctcagaggaacagatgcaaggactgtgcattgaattgaacgatttcattgttgctctagcagaagtccagccttctgccaaaagggaaggctttgtaactgtccctaatgtgacatgggctgatattggtgccctggaagatattagagatgagcttataatggcaatattggtaggtatacagctatcagggccattggcattggttgtgagttaagatctaaaaaaaaacctgcatgcatgtctaccagattatgtcattaaaaaatttagaccttcttattttatgtgtatgagtgttttacctccatgtatatgtttgcactgtgtacatgtctagtactggtggagtctgaaggcatcattcctctggagttgacgttatagattattgagaaccgctttttctgggtgttggggaatgaacctaggttctctgcaagagtaataagtactgagccattgagccatctccgtagcccctaaacacatgtttaaaaatagagctttcctgagagtcagttcaaatataaattcagcttcagtttgtcatcttttttgttgtaactgtctcaacaatgaggcgtcgttctctcgagatgtttcatactcattgttttgtttgtgtttggttcgactacatagtgagttcaagaaaaacaaatttaggtttcactcgagaccagtgtgtgtgaaaactaccttcttgg

SEQ ID NO: 18529 - DNA, 1210 bp, Mus musculus
tgagtaggtttctctttctggtaagtacatattttatttgctctgtaagtatgtcccgcacaagctatttcctctacaatacacttgcaatacacttgcaaaacgcttaaaagtggataaaggaaacaaaccaacctgtgcttattgtctttatagtacacagcatagttcccaattcacagatattagcataagcttttctggaataaagctgggtatgtagttagagtagtgagcatttattcagtgatttgtttcatcttatatagcattcattatgataccatcagtacagattaatgtataagctttcaagtaaatataggtaggaatttactttttttttttaattaggaatttacttctactaatagtcgtggagtctgaattttttaaactatcttttctgcagaattctccaaacgttgtgccgaaaactgaggcttccggaaacttttaatttttgtcacttagcacacctaacaccaggctttgttggtgctgatctgatggctctttgccgagaggcggccatgtgtgcggtcaatagggtcttgatgaaacaacaggcgcagcagaagaaaaagcctgagattgaaggtttgccctctgaaggagaccaggaggaaaggctgggagctgagcccacttctgaaacacaggtgttctttctcttaccttgtgttcatgccttgacacgactaagatttagtcctttacggaaaacatttgtggtttcctgccaaagcattggcatttatatgacacttctggttaagtggtttatcataaaagctcattgtggcatacagcattgtgtaatttgggtatgaggtttccttactttgttaccagagacactaggtgtaagaggttgtactttgctagacctgcctggtctctcctttgcaaagctcttttgtttcttttttcttatttgaatccatcgttactcctgtcaaccatgatagatgcgttctttttataacatagcatacaattaggatttactttacttttctttgtttttttgtttgttttgaggtagatttggtttttttaacaatagttttgactaacttcaagtttcatcttctaatgtatggattataggcatgagctgtcatggccacaatgcaggattttagcctgatttgatgattggttgattcaaaaattcagtttagtaagtcaagttttctaatctgta

SEQ ID NO: 18530 - DNA, 1179 bp, Mus musculus
ttaccccctttcctggtttcgccatcctgtgggacagcattgctgtcttccccaggccccactgttgggctgttcccgttgtctgggcgtgccttgcacgtgacccctgtgtgctgtcactcatgctgctgctctctgtagaacttctgcctccgcttatggaaaccatactagctagccctttaggctttcctgagtattttcttccgtgaagctgccattctccagtctcttgctctgttacaatacttagtttatcgtaattgttattaaacttcttgaaatgtgccatgtttccttacttaactgctttgtatcctcaggagattgtgaattgctgctaagaaaggcaggctttatcttcacatttgttgcataaacaataaatgtttacaaatatttgtgtatcagactacataaattctctccaacttttaaatcatttgtgtaagcattgttgtcctcaaatatcagatgtcttgttctctgttttctacatctggttcttagatctgaataacgtggcagctacagctcgggtcctagttattggagctactaacaggccagactcattggatcctgctttgagacgtgcaggaaggtttgaccgagaagtctgcttgggtatcccagatgaggcagccagagaaaggtatattcttgtagaatgatgttgtttgtgtgccactgtgtgagctgagtcacatggagttgatgtctgttctttctttgtctcttcattgctgtgtgtgtgtgtgtgtgtgtgtgtgtgtgtgtgtgtgtgttgggaattgaacggaagacctcaaatgtgtttgcaatcaacctaccctgagctctttcccttttctctctcaaattgatttgaaaaggaaaacataaaaccctgttttaacagagtaactcaataggacatttgttttagtttgttcagtaatgataatcattgtgtttcttgatagctgtttgtctgatattcttgatgccttctgtgctgattggcttatcagcttaaggggcagtgtctgtaagtgtggagtagcattgggccatctacttcctgtactagttaggtctgagtgccattgcactagtctgcccaaggctgtggggctcaatcaaagattttaatgaatgattcttagtgatcgatgtagaaagagcaaagagctgtat

SEQ ID NO: 18531 - DNA, 1221 bp, Mus musculus
tccccaattttggtacgaaagattgcataatacgtttgtggggaagttaagttttatttaacctttggtctttcttttctggatatgtgcacaggaacttgacttgccgattctgaaagtggctgctccagagattgtgtccggagtttctggagagtctgagcagaagctccgtgagttatttgaccaggctgtggtgagtcagctgtgcttacgtgagcttatcgcctgctgcaccctttcagtagagtctgcctttctgtgctagaattctttcccacctgctgaccttccttttgtacgaacgttcagtggtcaaaatttaaagtgaatttaatggtatagactcttggctatgtcatgtttcatatgaaaccaagtatataggtgacaagcttatactgacaagctttgggctgccatacccagagttaaagttcagaacatactgtcctgaagtcacttcatttactttgtctttccagcttatgtctgactgaacaacttgcaaacaccataagaattatcataattataatacttagggttatgcaatcaccgtaagactcaggatcaatgctgtttatatgattagaggggtgaaaagaagattctcataacagagattatacagtttagaagtggatattgggatccagttaaagtccatcttgagcatatactacagtggttaaatgtctgccttctcactgggaacgaacgctaaggaccagttcagtgctctcacacaatgcgatgggaatggtaaaatacccagttttcacaatcagaagattcactcatttttccaggttgtgtgttgttgccatgttatctagcctgccttaaatacattcctgacaaccaacctttcaacctcagccccccaagtgctgtgattatcgatgtacaccaccatgcccaactgaaagaattaaaacctttaacattgtagcaagagtcctgtagtcatgacatttgcacttgagcagacatgagtcaccgctgtgactaaaactaaaaactggcagggtttacatcactcagtctggactcaagcttcctgtgtggctgaggatgactttgaactgcggaccctcctatttctatccaagtgctggaattacagttgtgtgccaccacactgggtttaatgttaggtctttatttgcatctaaagcacacaattgctcataaacataaccattgtaactacctgaa

SEQ ID NO: 18532 - DNA, 1274 bp, Mus musculus
gctgttctggaactcactctgtagaccaggctggcctcaaactcagagatccacctgcctctgcctcccaagtgctgggattaaaggctcgctcatgcacatgagtgcggtgcccgtggaggccggaggcattaaccccctggagttccagtagcttctgtgagccacctacatggtcctctggaagagcagtaagtgctcttaactgctgagccatctctcaagcccctatttgttttttaatgacagccacaaattggttttaaattttactctccccctctcatctccgtgtgtgtactgtttgagtgaaaacgttcgaggccgtccttcatctgagcactcgtctgaggcctattctaggactctttcacaggggactgcagcggctgttgcttgatgaacctgtgcatgcaggtctgaatgtattggattccaggggaaccctaaggaaacattagtaattccagcttcttctttccacagtatgattctagctttgataaatgactgaagctggagaagccgggttgaagccaagctatactacacactgcacaattgaggagccagagactactaaaccacccttagaaccatgaccagagcagtatatattttggtctttgaacaaaaaaaaaaaacctatttttgctgtatttttaccacataaagtatttaaaaaaaataaattgagtttttgtagatttctgatttctgaactccagcaaatgaaggtgttttgtctcctctgtggctgtttggtagaagtaggaatgtgtgccagctttgcatgccaaagagagaagggacagacctaaaagagccattaatacagtggttcccagcctgtgggtcaccaccttttaggagtcaaatgactctttcacaggggtcacctaagaccattgaaaacatagatatttacattgtgattcataactgtagcaaaattacaattacgaagtaacagcgaaaatggttttatggttgggggggttcacaacatgaggaactgtattaaagtgtcacagcattaggaaagttgagaaccaccaccttagtagatgagctgcactgtctgaaaagccagagccgaaagcaacacagcgaatctggatatatgaagaaagtcatgttaatgtggcttaaggattgggggcttttcagctatgactttcagtagtaatgacattttaaaatatatttatttgcagtatttgaaaccttatgagccatgtgcccaaatacaatgtaattcctgcttccagaaa

SEQ ID NO: 18533 - DNA, 1919 bp, Mus musculus
tgtgtgcttccccagaagattaaatttttaaatgttgcatgtctctgtttttttaattttttttcatttgtttattttatgtatatgagtacactgtccttgtcttcagacgcaccagaagagggcatcagatccctcttttgagccaccatgtggttgctgggaattgaactcaggatctccggaagagcagtcggtgctcttaaccactgagccatctctccagccatctaaatgtcgcctgtctgattgagtgaggagttggtagcagtaagtgccaggacactgagtcccctgttagagtgggagctgtgctctgaccaaacaggaaaagagggttgggagggcatgcaaaggaaacctggttccctgggcctctgtaaaagccgggaaatgctacctataataatcttatgtttctgcctagaaaagggctaagcagctgcaccatgggagttactttatacttcctcctactgtttccctgtagggcaccttctgcttcactctaccttccagtgccctcaccgttattcaagcttttcaaacagacctgctgttggcttcatagaactgggagacacaatggagggcttttgtctagaatgtttgagcttaaactgaaagccatggaactaagcacctttgggctgtcttgttgggcctaagctgcagaggaggactgactgagaaagctgccttgtctataaagacccagcttaactctgaaacactagttatgaatggacacctattcctcatactgcttgtgtgtatcaaagccaggaaaggagagagtcatttttctggggtttttggaggtaggagggatgcttttataaatgctgaagaagaggatgtgtggcctaagtggctacggctctgaagcttgaggtgctgctgtatggtgatgagggtgtttgcagaggagctgtgagatctgagagggggggggaggggggaatgactagaggttgtcagagttctcaaagatctgaacattgggagctcagctcggtgtcctcttgtgctctcttcctgcctgccctctgtaaaggctctaaggttgaaggcctggccagtgcagcctgctgtggaatgcagccacattgtgtcatgtttccttaggcttttaactgtagcagatgccttgtgtctagagctgaggaagcaaagcccaagatgcggcacccccccacccccacccccacacacacatctaacatgtctcttcacaagaagacaatgtagcaagagcccagaggcttccttctgacctgctctgactttaaacctctgtactgtttcctgtgggaagtactcgccactttccatgtggcatctcttgtatgcaaactagattgtgcgctcctagagggcagagtccactctgatcacgtttgtgttgtcttccttacccttctggcgcctaatacagtgccttgcacacagacacaataaatggcagttgaataacaaattaatctgattgttctattgcttgtgtctgacttacgtcctttagttcacagaagcagttacggaacaccataatcaaagcctaccaccctatttccttttcttcaaggtagttaactttagaagtattctttttttcttaaatggtttgttttcattttattgtattggtgttctggctgcatgtaagtctgtgtgagggtgtcagatccatgcaactggagttacagacagttgtaagctctcatatgggggctgggaattgaacccaggttctgtggaagaacagctggtgcttgtaacctctgaaccatttcaccagcccaatagcacattgaacactagcagtattgtaaagccatctagacatataaaagatatttttattaattgggtataattctgactgctgaaattgattttgcttacaagtaacattt

SEQ ID NO: 18534 - DNA, 5098 bp, Mus musculus
gaccccttccccccagtgacaatgtagaaatgggaaattctaattactcattccctttgtcccttattcagcatagtcacaaggttacaatttaatgtatcacctagaaactgggagagacaactgttgttcagtggttatgaaagtatcaataatttgttcattgttacttaagtctactgttcttgatgctgattttgaaactttctaactggtatctttttctctctttttccctgcacatttcatccggtcttcattcagaggaatgcagtagcatggatagttgatggcaaatttggagcagacgacttctgtttaacttaaaattagtcgtattttaatggcttgggatttggtgcaaacaaacatgattgatagctggacagacatgctcgtcatgaaaaaaaaaaaaaaagaaccattttgaagcccgattggggccaaacatttacaccttgcttcctagtaaccagttgatgaagcgcgtctagaacgttgttggacaccatgttgaattattccccatcggttgtgaagaactgtgctacattcaggcttacccattgaactcagtatatatattttttccctcctgccttttgtctggtgggacaccattcttgttgctcttctgtgtaatgaagttcaaatgcttgtttggaaactttatttaacagtttagaaggcttgataggaagaggtcattagtctgaagagtatacattggacaggaaagaatttcctttcgtttctccaaatctttccgccttatttagcgtgagatctttgcagcttggttcatggattctagccttgcccgttgcgcagtatatgctgatcagatgataaaccagtgaactatgtcaaaagcactctcaatattacatttgacaaaaagttttgtacttttcacatagttgttgccccgtaaaagggttaacagcacaattttttaaaaataaattaagaagtatttataggattaaagtgacttcatttgtatacatttggaatctaaaccagcttaaaaacagtgtcctctgtgactgagatatgcagtgtaactgatgctcttctggagtgccacgtgagacatggcatggtcagaaacagtgttcagaaggacacggcacaggaaagccagagagatactttcccctttttattttattcctgaagggacatcagtacctgatactgaagaaattcaagattcaaaaggaaaattttataaataaaccagtacagaagatcagcatcagtctaggttttcaagaaagcttgttccaagttctctgaacttgagggaatcgttttgatgtgatctagcagaagtagacatcagaagatagacctactttgggaatttatagtgtagttaaatcttagaggaagtcagcaggctacaaacatttatgtaaactggaattaaagcctgagtcatttctcctaattgcccttaatgtccaacatatagggacactcatttaaagaagattccttctcagcttctcagatgttgccataatgaacctcattcaaactggtgctgtggacagtctttccctctccctccccttttagtttacgggaatgtttcctttatggaaaaaaagtgacttgtcattttgaagaccctatatctaacataagcctgattgatgttcatggtgttttcaactccataattgctgggtctaaccagtctcccttgaaatccatgttttccaataggagataaccagggtgaccacagctcttggaaggaaaagtggaattaactccaatgtatcctgatgaacaacaacaacaaaaatctggtacaacttgcccttgaggccaagccaagtccatagcattcaccatgatcatatgcccctcgggatcctgagagaagagagaggcttgtactgaggggtcttcccattgtgggggtcgcagggagggaaaagccaggaaggcagtggtcattctcccaaagtccacccatcgtaaggaggtgacagatcggagtcagcagattagtaattcaaatgggtaatggaaaagattcctttaagcttcatttttcagagaccatcactttagaaaatcagagaaatcctgttttgatacttcttagttaaaataatatgttaccgtttatctggtacttcattttcttgactaaaattacttttcactttaagcttgaataaaaattttcattcataactgtatataattaagtggcaactcctctttacctcagtgcagttaagaccatcttttgattgatataccctgaagccattaatccatacacctcagtctacagtaacaatccctaacaccatgtgggcacagaactccacagctgtttacagatgtggttacagtgtaccacgtggcatgtgcatgatgctccctgagggctgtacccatcagggcagttttgtatccagctgcacctagacccgcctgttcactgcttctgaagtacatttaaaaacactgggaggtaagagcgtgccccgaaggtgagggccatgaccagaacataactcctgttagagtggagttacaactatgcaaaggtgttgatagtagctaggtgagttcggtttccaagtctgtcttaactggccgctccctctctagactggtacttgactgtgccaatttgctgtaagcatctgtttcgtatatttgccatgaagtgagtgtggtagaaaggtgaagaaagctagggtttatggtggaagaacctggtgacaggattacgtgaaaatctctgacattgtgataaactcgataaaggcttaagagaattctgtcaagcctgccacaagatgctaaccaatgtataaactgaaaagtaccaatactttttgcacatagatcaaaatagtggagaattttggctccaaaaatcaggttagtaggctcaattccatgtgcttaaaatgtttctgttgttaatgcatcgattaagggctagagtaagaatggaattaaatgtctttttcctctaaattaactggttattagtggtaaagtgttggatttggggggggggtcactgaggttggtttgtgggtggtgatcaaaagaattagcatgggagttaggggagatgacgaagcttcacacttggggtttgaattccattagtattcgtgccagctgtgtggcattgctcttcctggccagttaaatgtcctggtaacccaggtaagtagtaaaaacagggcattttacttgcaaatgtccccttaaattggctcattttattgggtaggagaacaaaaactagaattctccgactataagtaattaagtggacctgctaggcaaacagaagcagtaattccgcaagagcagttgatgaggagcagtctgccttaaggggcgtcctgtggcattaatagaaaatcctttcccacccctccccatcttgaaattttcttttctaggatgttggttcctgcaaacaagaactgaccctctgcctcccttgggtacacgtcttgcacatctcttgaacgggggcaatgcctatgtcgtttactttacagcagaagaatgggaggagaggagatacattgtcttagttgttcccattttaaaaaaatatatttttacttaattttactttgatgtctcatttagacatcaccaactctccctttgtgttgctggccaaagcattcccaccatttccaaaaccatacctgatttcacataaactgctaacttaaagggtgaatttgcatttacacttagacactttctaaaaacagggtgaaattaacctaaactttgcagtgttgagttattgttatagtcgctgccctagagttgcaaaaacaagctgtaaaagcccatcccctatctacttaatccagattgcctggatttaatgaagttaaaagagtgtgtgtgtgtgtgttttgtgtgtgtgtgtgtgtgtgtgtgtgtgtgtgtgtgtgtgtgtgtttgagtgtttgagaaagaacttgattcctaaaatattctagaaacaacttttaggttgtcatttttactgaatgtcttgtgcacatgtaaagtaccctctcttgagtttaaggcttggttaatacttgtctatttttataaaacttaaaactgtgtcccatctttaacttagacatttacattatcaggatcaacatgctagaattaaataacatttgtaggctcagtgagggtaaatgttattggcagagagagagagagagagagagagagagagagagagagtgtatgtgtgtgtgtgtgtgtgtgtgtgtgtgtgtgtgtgtgtgtgtgtgtgtgttttcctgagggagatcccgaaagcatgtatgtgcttataaaccaagctgtagagatcatgtaaagacgctgggtgttgctctggaggtttctgagctatggaaagggatagggcattgtggtgtgatgtagctaacacagagctcttggtatggagtaacagttaactatggactgatgtttccagacgattgtgttcttaatggggtttgcttttttatttgcctctcagattatgtttagtagtttaaatttctttgttttattatttcattaaagtataaaaacttcaggtctcatatttattttcacttgttctactaattatttacaagacactttttggttgacatttattttataaatgtgtggtatattaaatgtctttaattttttttgttttattgaaattacagtaactttgatttgctttactgggatttttaaattttattttaattccactttttccatgtcagtgcacagcacttgcccagtcctttgtatcccctttctgtcgattcaataaacagaatgagtaattaagtaattctcgttgcgttccatctcaccagactgccgaactggtggccatgacgtagggtttgtgaatggaatctaaggaaacatttttagtgtacctgaaggccattgagcacccagtcatggataaggtagattccaaacctgtacttaagtagaagcgcatgtgagactcagcttggagtagtggtgggttaagatttcaattttcaaatcactcattagagggaaaaca

SEQ ID NO: 18535 - DNA, 1118 bp, Mus musculus
tatagaatgtgctatactaacatgaactgtgtctgatggtgagggacggaagaaactaaaacgccctgtgctgcctttgtgccgagtagtgtgctcagagtatttgctctcacatatgttcatggtcttgtaagagaaacatttttattttcattttatagggaaggaaccaaaatatggcagagctcgttaacttgttgaacgctgccatttcggcaaatctaggtctggaaagttttccccaccaccttgatacttgaagatgaagaaagtcataaagctaacagatgaggacaaattcttgattaaatataatagtactagagagaagtaataaattttatgtaaatatcttttctttttcctcaaagagaacaagtaaaaacgtctcgtttggaaggaaatgacttacagattgttttgttcaatgtattccacctatacagttggtgtttttgttttgttattttcttgtgtgtgtgcctgtgtgcccatgctacctggtatgcatgctgggacctgaatgccagtcctgtgcaagagtaacaaatactcggaacttctaaagccatctatctctccaagcctctcacctaaataatttagtaagaaaaatgtccaacagttttaactaatgatttccattggagggaaggtagccttcttttgttttttaaatatataaatagagagatgaagctggggtggtgatggtacacaccttttaaggcataggtgggaggcccggtttacacagagaaacctatctcagaaaaccaaaaccaaaaaactgcacacagagatgagtgagaatggaagcaagcatgtgagccgcacgagtggcaatgctgggacgaggaggcaccttctcctggaggtgttcactgctgcctgcctgtcctgcgtgggacccaggttcctgcccaggcccactctctcagagccaattctgtagttttttattttgttagtcattcagaacgtgactgggagaataggaaagtgctggtcatgcggtggtggcagctcctgagagctgttgacccacagtgggctaagagtccactttgtactccattactttagtcaatgtggtaattcacatgcgtgggtttgcc

SEQ ID NO: 18536 - DNA, 1195 bp, Mus musculus
agacaggtttcggctccacttgcaataattttggaatactgttcttcacattcagaaggctttagtaacctcatgttacccacatgttaaaaaaaaaatgtatagttgtcttgcattccctagtggatctggtcttatctcagtctttctttttggctagctctcttttaaaaagccttttgtttttattttatttttagttagctcataaattatgtgtttcagattgtacggtgtacctttctggaaaggttttaatctcttgccatctctgtgaaccctttgtcactgttgccgaattgctaggcttgtttcttctgaagacctcctgtcttctccacagcccgattatgtggagtttctctgtcaagactcagctcctgccaggcgtgatggcacgcgcctttaatcccagcactcgggagacagaggcaggcgaatttctgagttcgaggccagcctggtctacagagtgagttccaggacagccagggctacacagagaaaccctgtctcgaaaaacaaaaacaaacaaaaaaaaaaaagactcagctccagtgaacctccttaggggagtgtctcccagcttccagcctttggtaggactatgacttgttaaggactccccaggaccggagattgcggatgagctcatccgctggctctcctgaggtcacttaaggggaaccttctagatctctgtctcctggctttatctcttctgtcctcctacaaaagaccaagctggggctaggactaagtcaagttgcctcttagggaaaagttgcatgtgtatttaggtgcttaattaacttctgttctactatatggggctctatatgaaagccctgtggtaggtgcaaaatggaggaactgctgtgtctggttctacagtgatggggaagcagggattttctgtgtgcacagctgatggtgtcactgagaagcagacgttttggttgtgccaccttgtcagggatgctgcaaagtctgctgctcagtaggttgttgaagtaattggcaccaaggcctttgccaggcttcaggttctcttgggactgtgtatatttgaggctgacagcgagggtacggacgtctggagggcagaatccctgtgtgttcatcttaaggctgtgtttttcaaactatgggtcataacccacttgtgaaatccatgtacttagccataatagat

SEQ ID NO: 18537 - DNA, 2070 bp, Mus musculus
cgagtgccctaccgcatattcccctacatttactgacctgtgctgcttgcctggcagctcagacctctcccagaaacaagggaaagtccaaatgaactaatgtgatgcactgacaggatctctaggtttgtttttgagtcaggactatagagccaaatagtacatcttttaatgtagttaaatttattcttatggcagttaaggatggtaaaatttgcttattaggaaaattttaatccctaaaaatcttaacttttatttttgttggttttttttttttcaattttttttttctttttgccatttgatttttcttaattgaaaactcttattaaagtacatctacgtttcattgtgcttagaacagaattctctttaagtcagtttattagtctataaatcaagcaaaacccagcccaatattggtgttatagctgaagaataagggcagattacttgcaggacctgtttaaaggaccattcatagcagtgactccacttcagcctttaaaagtgcatttggaaatataaacacatagacgacttttatgtaatatatggtaacttttgatttttctgtacagtttttgaatgtgagataattgtcagaaactaagtagttttttaacagaatattttcagtgttttaaattaagttttgtaaagtaattacaattcatttaaagttaaaacataggaaagttatttttctttatccaaagtttgtgaatttggctttgctacctcaatttgcaggtgtgtgtttgcctttataaaatgttgcaaatagaaaaaaaaatatatattttttgagtaacagcactatttaaacatttttacacacattggtgttggaaaaattgccattttaggctactatttttatatattttttgacttaaaattcaacagtgtttttgctactgtttagctaatacagtttatattaatttgtatcctttatgtttttagaactctctagaaaggagttctacctgatacaactttaagttttctctctgtttaatggatgtgtataagctgtttgtagccttcagtactagtgaggttggatagtttcccagtcactgtccctgagcaggacaagtggcaagttcactagacttttttattcaaagctacattgtcctcagagtaaacataaggatgcaatacatatagtgtgtacatttgggtttctattacacataccacatgtgagctagatgcaaaatattcaggtcttcctgctctgtagcttagagtgtcaagtggctgtgcccgtctgatcatgccgtgctacgctctgcattctgtcattctttactgttttactagtcctaaggtgttcagcaggtggttttctatcatgctttctgctggaatcaacatggtatgtgttaataagcttacaaggaaacaactttgggttctttgcctggttctgaaagggcggacagtgccacagtatctggacattaggtgcaagttgtttttaatttgatgtttggcaagctttgtaataaaattttggttggaaacaaaaagttgaaaataaagagttgctgttagagcctcatttctttgccacagctttgggattaccagcagcaagatggccaactctctgttttgtcataccactccccctcccccttttttccttttttgagtctttctgaactctaggaacccagggacttacttacttagcaaagcaaaaactgtagggcctgactcagtggtggctcgcccctgtaatggcagcaggccaagagggtgggtcaggaggatctccatgtgtttgaggccatcctgggctggagaggagaccttgtcttaaaaacaaatcccaacagtggaatctgagggcttaggggtagatagaattcctaaaactggtcgtgtttactgtttgctgtttaagaacaccaagtgcttaaaaactgctataggttctgtgacactttgaagcaaatgtatatgcatagtcgaagctttcgtgttctatgacagagtgcacagccactgcttgcctgttgaagtctcccacacctcccgccaggtttg

SEQ ID NO: 18538 - DNA, 1184 bp, Mus musculus
tgaagaaaaaaattgaaggcaaaatttaagtttttttcctcatgcttttctatttagttctcattaactctaagtatgtgactaaaatccttcagcagctctgactctctgcctgtttacttttgtcaagtagtaaattccttcaaaacaaaacaaaaaaacaggctgcaagttatttggttctgacctaagatatttttttttaagtttcctatggactgggtgtggaggcccatacctttaatctgagcacttgtcaggcagatgcaggaggatttctgtgagtttgaggccctcctgatccaaataaagttccaggccagccaggactacatagtgagacctcatctcaaaaataaaacaaaaggtcgtatgtttaaaaataaacctgtagtttccctagaggtgaagtgagctctcaagatcagtagcggccctggcttcccagtcctgtccttcgcttccccctctgcagtcgtctcctcagggagcagaggcccaaggtcagcacttggtgaggtaaatgctttctccttcccaggaaatgctgtctacgacttcttcattggccgagagttaaacccgcgacttggtgctttcgatctcaagttcttttgtgagttgcgccctggattgattggatgggtatgtctttttttttttttttttttccaataatttcaatggtatgacttcatcttgtatttagaaggaaatgtaggcaatttttaaagattatagttttccctaattgtgtcttaacacatatatatttatttatttttttactggtttaagagaacttgttacggattgttaaacatcacagatatttttcaatttttattacatatatctaggaagtgatagtgaagatggaaagtaaagccttatttgacccagtttcaggcttggaggacaattacagacatggaaccgagactcccattttctttcgccggattccttactaacagcaggctcagtcacagtcccgtcaagggcagtgctactgaggggatctgtaacccttattggggttcattggtgcttaactgttgctccattctttcatcttggtctcctctcactatgctggttccttaggctcttgtgacggtgtcgcccttttgaagagcactgttcgtaagaccatcattccgttgttctcctgatcagagacc

SEQ ID NO: 18539 - DNA, 3948 bp, Mus musculus
acagactccttcaaaagaaaattacatgtctaatacaggcagtgagtgatgttgccgatagatagggtgttagccggcgctgggtgtcgcaaaggaaataaaaccccagggaaagaagtgtgcatcgagtctggctctgggattcatccctgttgtggtgggaatacacagtgtgtatgaggtccctagtattgaaaaaatcaaaatgcagctttaatcatgaagtaagtaacacaggaacctttttcaagtttgatacctaaggaaaaaaaaatgtttgaaattcaatattctctagtcaattctgtctacccagccttcctataaagttttggtttgtttttgttttgttgtttttaagattttaaacttcttttagtagagacatagaagattgtcattccatggccaagtttcacctaggtgagttttggcatttgatattctaacttctggaatttctctgagtattttgatcctcagttctgaggtctgtctgtttgggggtggggcggttgtctttaaaccacaagccctacatgatgccaaagccaccaggcctctcttgtgtatcaggagtagaactaagttggcttagccctttggggaccaaccttgttgcgtagtgtgtggtaccagctttgcgctttgcctgggaaaactgtatctcagaaaggtaattaggaaggtctcaatatttaggtggtggtggtagggacaggttaaagtctagatacaatttctgttgaccacaagggcagggagcagtttcaggagtttgtctacttactctggacaccttgcttcatttgctgacagtgaacttgggcatctgtggttcctgtgagacatctcagatgtgtatcttgtctctgtgctcctgtttaactgtggatgtgagccctgaggcacccagccgttgacttgggactctgccagattacatgtgtgtaaggtcccttctacttctgggatgtagtttgagtttcttcattcacatgtcctcaagctgtgatcagtctgttatttcacccaagaaaacagaattcttctgtatgcatatgggtgttttacctccatgtatatatctgtgcaccacacatgtgcctgctgcctttggaggtcaaagaagggcatcagatcccctggaactggagttctagacagtagtgagctaccctttggatgctggagcttctgaaaatacacacaaagtgctgttaatggctgagccatttctccagcccccttctctctgaccttaaagagtagcttttgaatgtttagaattactagatcgtgtttggtgaaatctttatatcctatttatgagtgaagtaagagcaaatggccattctgagaccaggcagtggccattgttagtcccagctacgtcagctgtgtgctttgctgaagcactggggcagcttggtggcttcaggacaagcatgtgccatcagaaaggccagtgttctctgaggttcttctcttcttccgtggtaggaagcctccccatgtactcatgcctcgagctgtttctaagctagctgactgctgcactgctgtgagcagtatcttaaccctcctctttgccaggggagaatgcacctcagctgtgttactgtgtaccgtgtcactagcaacttgaaaaggtgacaatacgagtctgtctctagcctttttattatacaaagtccattcattcctagcttcttgtttttaaactccgactttactgcaattaattgacagtcccctctgatactgtttaagtgttgtgatctctcgtttgctttgtttgtttgtttgtttgtttaaggcagggtttctctatgtagccctggctgtcctcgaactcttcttgtagaccagaatagcctggaactgagagatccaccctcctctgactcctgagcactgggactgaaggtgtgagccactgcctccacctgccccactgcttgctttttcagataagtgactagaagataagtctgggcatcttgtcttcctagtgtattttactctgattctttcctggtttatgtattgagattcatttctcatagacagaacttgctttttattgtgtgtagatttggagggaaggatcaagttattcccgtaaatgtaagcaagctatcttgaggcatctgtagttgatacaaaatatttttataatatattaacaggcatggggtacttttgaggcagcctctgtaatctgtagccacccacttaatctccagggtcccccattggaagataaaaggccactgtatctgtagtttatctagaacagagcttcaggattccagctggaaagacttgagggcctaacccctgagagaggtccagcccctctgcctgatgcaggcctcctgctgccttcatgctttctggagggcctctggcagtcagaatgagtaggtcagtgtgtggcttgaaagctgtttctaacattgattttgtttgtttttcttttgttagggttttttttttccctgttttgtttgtttttaagagattttggttggttttggttttggtggggttttggttcgtttgttttttgacaggttaggaagtcagtgatgacccttactgtttcaagaagcagattaaattcttaaatacattttccttctcagacctcaacttgataaaccaaaaaacatacactaggatagcacagtgtgtgggattggaaggggcagtctcagagatgagctggagcactggagccctcggcgcaggacacgctgaactttcagtctcgtgtcctcgtcctttgctgtagatactagcaatgtgctcttccgtcctttaaacacgcccacagctggactccttggtaaagggtggtgaagatttgcagcctgccaactgggacttttataccctagagtcgggagtggactgaagtcagactttaggagttaagtagatgctcctccggaatggagagttgtgttgtaaatcatttgccagctggaactttgtgtaccatatctcggtgaatcttagggattataggccttgctaaagttcaggagaaaggaaactggccacagcttactgtaaggttttgctcaattgactgaaattatttgaaagtctgtctagaacacgatttcatcaagtaacaccttcgtccaagctcggcccacgtttgaggaaggggaagcgagggggcgagagggaaggcgggatgggtggctgaggatcaggtagcgctggagcttggcaccaaagtttctcatgattgcatatggaggaccacttgtgatccaccctcggaagactcgccagaaagtagcagttcctgctacacactacagtgccttccaacgacgttctgtgtgaactgcatgcagtttcgtgtaactccagagtgtaacatgtatgtgcatgatctgtccagaatgtgcagagctgggattcaacagaaagggctgcgccctgctgctgctgggtcagcaggctgctggggtcggacttgtgacttaggcttgcagccttggatcctggggtttgcactgatatggttctgtcatccaatcagatctgtctcccttttagctcctttcctactttgcagctttgctgattttaactgcttcattcttctgcttcttggtatctttcttttgaaataaaaagacacaatacctaattcaaaagagatttgtattcatttttccagttcctcttcatttacctcatgtatggcaacgatgaagcctggtgccctgttcgcatgattgtgagtggctcgcactgcactgcacttggcttgcccactcgcccactcttctgtattcccgtccaaggaggagcaggcaacctccttccatttcccaggatgctcctctgccccctttatctaacagtgttgatggaaactcagtgatacattcaattagtgcaatgatggggcctcagtgg

SEQ ID NO: 18540 - DNA, 3864 bp, Mus musculus
gttgttggaaagctgctgtatttttatcattggagttatttgtaaaaatgaaaataaacagatttctaagtgtcaagtgtagaatttggtgtaataataccaatcaggcagatttttctctccactcgtccatttccattgaactgcccttgtttttgagcccacagaaccagtgttcctgtcttaaatctacaagggagggagtaagtggacatagtcgtgtgtgattagtatctttataaattaaacatctgtgcagtgaagatgtagatcctgtatctttgtatgaaacagttagaacagaaccttgaaagttgttcaggagcgacccgttcctctgtatctcctctggtggattgactctggaaaccgtttcttccctgttgtagcaatcaggcaggagctgagcaagtcgaacactgcataaagaagcaaactacggaggggcaggacttgaatctggagaaaacaaaaattcctacaaacaactcttaacccccaaacttttaagctgtaagaagaaaatggatacacagtcaggagggaagccgtcaacctctgaaagcctcagacagtgactctggcgatcagctgtcccctcagtgtgctgctttattctgtctgacctttaccacaggatggagaatgatattggagttcccttagcagtactaaacccgtcaggcaagatcaccgtgcattgaaatattttcatgtctagatgagtctgcacgttttccataatccattgctaaaataaagacgagaaaggcttcagagatttttttccagagggcgctgatgaagaatttgatttagtaagttctgctgttgcgttgtaaatgtttctctcaggtttgtcttcctatcatatttgatattccgtgaacactaagatcataaaggatggaacaaacggagttgtatgtgctttcagagggtggtgtttaatacgaaaggtcccaaaatgtttagtcccacttgaggaattttagaatgataggaagtctctcgggttagccttcatgcaattttgtagtttaaaacataaagtccgtccagaaattaaagatttagatgccttcctaaattgttacaatgctttaccaaatctatgacttctacataaccaacagtggtcaaatggaaaacattctattatagatttactgtaggttttcaaccttttttagacatatgcatgtggacatttttataatgtaattacaatcaccacaaagttagcttttttaattacagacaataatgcatgtcacactaatatgtagtggccttttcagggcctagtcccagggaaaatattttgtagaatatagggaagtgggaggaagggaaggaataactttttatttaaagttaatttctgcactatcttttttttctcaattatctgcatgaattataatgaaaaatattttgtgactttaatcagtaaacatgttaacaaaaccaagtacttaatcttttacatcatgtcttcagctatttgtattttaaccagcaatttcaacggtctgaaacatgattctgagcgtaacatgtgagtccgtctcactgtggaactcacgagtttgatcactgaatttggcagttattttcacgcggcccccacagtgctgcagtgcttgggttcacgctcctgactctgcggctgctccttgacctttgctgtgctaaaatacaagaaatatcaataatggcagcaaccagggtcacataagtcactaggtaagggagaccaatgaggagttctgcagctttcttttaatagaactaaagtgaggcttaagtggtagggagtgtctgctgttacaccctgagtgtgtgtgtgtgtgtgtgtgtgtgtgtgcgcgcgcgcgcgcgcacacacacacacacgcacacaggtgagagagagagagaaagtgatcgagcttaagagtgtgtgatagatattatgttccacccctttataattggcaagattaaaataagggagaaaattttatatgttgtaatgttagctttttggaaaatctaggaaatcaaaaattctccaggctgtccatcatgatttatgcttgagttattaatgtgccatatttgctttggaatctttggctatcaaaacttttgctaaaaaaatagtagatacaatccactttgatttgctttctagatttcctatgtctcagctgtaaagcaaagcttgatgagagtagttttctaaaccctgcagtttgcagctaaccccactgcagagccgtgtgaatgaggggttttgttaagagtgtttgtttctgtagaaacttcatctttagattaaagtgtgagggatgagcggtcataagtcaattctgtggctttctctacccatcagtcgtcgtctcgcaggaatagtaaaggcattaaggatgcggcaagcatgtacgctgttctaaaagaagtatgcatctcatttactgttgaacgtttgattacgcaactactttgattgtgtacgtgtgtacatcccttacagatctgatcaaaaatcgcttttcattttgttgctaatgttaaatagtctgtagtacgtagagtactgggtctagatggtccaaagtgagacaaaaatgctgaagtcaaatgctaagtcctaaacaaagctggtttatgcactaaacgttttgtgccttggtctaatatttaacacaatgtctgtaaaaatgacaaaaaaagaaaaaaaaagaaccgacattggctcatgctgtatctgtatcctccatgatagtacgtcctcccacatgactaaatgtgctcctacctggatgcttcactgtcacccaggacagtcgtgtcgtcgctagagatttcagtgactacaatcgcaagctaaagcttgagttgttttcccaaaactgttccttggaaccatattgtgacggtgggtccttgcttctgtgtgttgactgtcttcagctgagtccagtttagggatcgtctgtgatgacaggaaggctctgctctcctcaacactgtgatctgacctgcgacaactctacaatacactctgaatggctagcacgtccatagcaaacaatctgaatgtacaaaccttagcgtggtgctgaaatctcttgagaatagtaaccgtgatctcaaagtctgttcaaaacgtgtcaatcagaactgaagatgaaccgctgatgaatgtccggtcctcatgccgcaggcgtgtttcctgtctaggttttcagttctctgctgttaccaccatagctgttccagttaactctcctacacactaacttcatttgtgcgattgaaataaaattgcagtatgtgcatgtttcttgtttgtgacacttagatggtcttctgcaatgatgtgttaattccaaaccaagtgatactgggtgtgaaatcagcaccttaggaagcccagggtttcactgtttacagtttaaacatcatgtcactgttctttaaagatttcatccacgtctggcgtagtggaaaacacgaagggaatatgtaatgatctttctaccttttgttttgcagtaagcgctgtgtgcctcttctgtcttacatgctcccagcacagcttgtagtcaatgtggtgaaaagtgttttactccattcttttgtcctataacacagtcatatatatatttcacttcatttacacggttcattttttttctttatgtaatttgcatattaaaggatattgccaagtaattaactttaaatgtagcagtctgtaccctctacagtgatctctttatgttggctttttatatatacttatatatatgtctcagcacctttatctattacaaagttccattttccaaacttgtaatttcctcattagaa

SEQ ID NO: 18541 - DNA, 2288 bp, Mus musculus
tgtgtgtgtgcatgcgtgtatgtgcgcataattttctaaatttgtataaacatttgtcttcaaatccctggggggggcggagctcattagttttattagaaaaagttgaatattaaatggttgtatgtgcaccttggctttcaattctaatatccttagttaaaaacaagtattatgtattaagtattatgatagatcattttgttcagtgcagtgtctgagtcacttacttgagcatggcattctgtatatctgcccgtgtaacccacagtgatttagctgtgttgttaatgactgtgttaactttccttcctctcaggccttgtcttgggaccacctgcacctccgccaccaccccctctcccatcaggccctgcctacgcctcagcacttcctcctcccccaggaccccctccaccacctccactgccatccactggtcctcctcctccaccccctccaccaccccctcttcctaatcaagctcctccccctcctcccccacctcctgcccctcccctccccgcatctggaattttctctggatccacgtcagaagacaatcgccctttaactggacttgcagctgcaattgcgggagcaaaacttaggaaagtgtcccgggtaaattaccaaattactgaccttctaaatgtgtgtcttaatgtgtctaaatgcctaaaatagtgacattactggcatgaacactgcctttaacttgactgattaaaagccaacataattcaacattttagaaaagtgtatcgtgaggagtttctgagaccatcggctcaggcttagcagtcagcatctgactgacagctgccttttgcttgctttgcctgtacatccttactacacctcagtgtaaatttggagggagtagcgagtgacttttaggccatggtttttctagttcaagatcatttgttaaattagctgtaatgtttgtttgttttttttaaatcaatgacagttgctcagtttctatcacctttaaaaacaatgacagttggtttgttttgttttgttttttaattatctttcagtttggtttatcacatttccccctcaatattggatttaaatgatatgtttgggatgaggacaaaccataacaaggattttatctttcccagtgtatcatgtagatagataatattgtttcatcccattattggtgatcgtaactttgataaaaattttcactgataaatgaagtccatgttattcactctcttggctcttcaaatttaaaaaaatatactgttttggaatcaataacatgttcttctgtgttgaatatattggcaaaagttattatctacaaaggaaattattatgtatatgtgtgctctcattaaggtggaggatggctctttcccaggtggagggaatactgggagtgtgagcttggcctcatccaaagcagacgctgggcgtgggaatggacctcttcctctagggggtagtggcttaatggaagaaatgagtgccctgctggccaggaggtaaggaacttaatgtgatgcacatgtccacagtcagaaagatttagaacaaaagtagatagatgatagccagaggtaggtaggtaggtcatataaaatctttaatgaatttaccttttcaggagaagaattgctgagaagggatcaacaatagaaacagaacaaaaggaagacagaaatgtgagtggatgtaaactaactctctctctctctctctctctctctctctctctctctctctctcagttcattcagagacgcatgtgaagattaagcatctgaatgaacttaatgtttgatcttatgtttgctcattttattcctaactacacaaccagtaaaaaatggcttgagtgttatgtattaaattgtaatctcatttttttttaaggtttatttatttattatatgtaagtacattgtagctgtcttcagggcgtcagatcttgttacagatggttgtgagccaccatgtggttgctgggatttgaactttagaccttcggaagaacagtcgggtgctcttacccactgagccatctcaccagcccgtaatctcattcttagtgaattgagttgaatctggggaggtgtggggaaagttgaagttcaaacctataaagttaacttgttcttatattcaccttgaagggagtgaatgaattcttacactggtgaaattttctaatgtgttgggtttctcaatttctttgtgctatgtgagattaaagaattttattaagtcaacagtttataggttaccttatacttttagct

SEQ ID NO: 18542 - DNA, 1616 bp, Mus musculus
ttcctttcccatcgtagtaaacatttcgccaggtttgaaaccacaactcggtttattctgctgtttataataattttgatgcagtttttagtggactaagtaataaacattaagactgttactatccttgtagaggataaattattaatccacatatttaaaagaacttatttcatcctcttttgggtttcgaaatgtgcttacaagttaagttttctccagtggagacagttatttgcctaatcccctggtgctaactgtcatccacgtttgtgcgttttgtctgatgctggtctcgggcttcactggctccctttttctctctccttttttatcctgtctttgccgctgctttccaccttatgtccagctccatcttcagacagctccctgtctagtgctccacttcctgagtattccagttgccagccgccttcggcacctcctccatcatatgctaaagtcatctcagctccggtgtcagacgccactcctgattacgctgtagtgactgctttgccacctacttccacaccccctacaccaccactgagacacgcagcgacacgttttgcaacatctctaggttcagccttccaccctgttcttccccattacgctacagttcctcgtcctctcaacaaaaactctcgaccttcttctcctgtgaacacaccctcttctcagcctccagctgcgaagtcctgtgcctggcctacttccaatttctcgcccctccctccatctcctccaataatgattagcagcccccctggcaaagctactggcccacggcctgtccttcccgtttgtgtctcctctcctgtgccccaaatgcctccgtcaccaacagcacccaatgggtcgctagactctgtaacatacccagtgtctccaccgcctacctcagggccagcagcgccacctccgccgccaccgccaccgccaccgccgccgccaccaccaccgccgctgccaccgccgccgctgcctcccctcgcctcactctcacactgtggatcacaggcttctcctcctccaggcacccctcttgcctcaactccctcatccaagcccagtgttctcccttctccctctgcagctgcccctgcctctgcggagacccctctaaatcctgagctgggagactcctctgcttccgagccaggcttgcaggcagcctctcagccggccgagtcgccaaccccacagggtaaggcttcacttctgctgctgactactggtcattctgaggagtgcagagcaactttgcctgcctagaagagtggctgggtcctatggatttcatgattgagcgtctctatgccaaagtgctatttggggttgtattattattattatcattatcattatcattatcattattattattattattattattattattatttagaacattaaaatgaaggattttgtttttttaaatcctgggccttagttggaatttagtatgggagatgtccatattaaacttaggttttagatcgtttgcagtaagtactgtattataggtgttttctaatatttagggatcctagtacttctacattcatcttaaacttcactaggagcacttgactgtttcatcttcc

SEQ ID NO: 18543 - DNA, 1149 bp, Mus musculus
tggacagtcccttacttcagcagttggagcatccgtcttcagcctactggccagggtcatctgacagacttagagaaacaggaatattaaggactagcctactgtctcggcagaatcaggatgtcctaacctgtaattgtgtccttcctttctttggacagtattatgtctgtaaatgaaatgaggcaatttttgcctagtggctgtttcaccacaactggagtaactcaaagatactcagtttcgtctttgaatccaagacagggaaaactgttaggagcagactggtctcaacaagtgaataaataacattaaacttgtggacttttgatgtttttgaaaaccaactatctatgtaaagtaatctagactgttgtctgttaactactctcagccatttgtaattaaaataactgaaagcactctaacaataaactcagagccatgaatttcctatttggccctttactctcaaggcttaaacagctcagatctgtttacaataacagcaatagaaggactgggtctaagccctgtgcttcaaaatttttagcatcaaggacaacctgtaataaccaaagcctcgggaactgggacgaagacttcataacttcaagatgaacatgggcggtgaaatatttttgaagagagggggaagggtagggaaaatggggaaattcgttggccacaccaatgattgtattagtctcggatgtttatgtcctgactgaatccggatgaaaaaccaagatatcaggagttcaggcaggtcagttcagcatgtctgatagtgaaattcaccaaggctgtatgttctgtaatctataaatctcaaaacaaaattttagtattatccagataacctttttgtttgattcactggaatctagttctcagggggtctccttctatcaaatctgatccatataagtctggaaggtgtaataccttaatcaccttttccaaaaacacaaagacaaaaccttttccccaaatgagcatatcctttagctggtaaccaggaaaacctgtagcttgccctatgtcccagaggaacaataaaacaactacaacactcaaaatcacacacattttagcctatttaggcctttctaatttgtcatgtcaggatattaacccaaaattcct

SEQ ID NO: 18544 - DNA, 1252 bp, Mus musculus
aactgaaaattacttcctgagttctagagacaggaagtccatgatcaaggtaaaaataggattggcgtcctctgcggcttctccccaggcacttgtgctaaccatcctattcccacctcctagtatgcccttgtgtgtgtggtgcttctcatccctagagtggttagtgtgtaaaaagtactggtaggcagaagctgtcctattcagttcttcagaaattaacaaccaggcagggtggtacacacctttaatctcagagacaggtagatttctgtgagttcaaggctagtatggtctaaatagtgagttccaggataaccagaggttctgtcttggggagggggtgtgtattaaggatcccatttttatgttgcctcttgaatctgttaaaagaggtacagggttggaatcctgatggtcattttttttctgtgtaagtaagccatcaaatgactcttaagtatgactgctgcctcccagttaaattatggctttggccctgaaattcccttgatcagatagctaactagtgatttctatttcagagagctgggggttggggggagttcaaaacccaagttattcctattttgaaaagcaagaggagggtgtgtgtgtgaaagctactctaggggctggagagatggctcagcaattaagagcatggcagcccacaactgtctgcaaatccaagatctgacatgctcacacaagcataggtgcaggcaaaccaccagtgcacataaaataaacatatatgcatgcacacatacatacatacatacatacatacatacatacgccagagtttaggtgctcagctgtcataccatttactacatctgctgacaattttaaaactacagttactgacagtgacttttcagtcattgcaaagccccaaaggtcacttatacactcctacatacaaaccagccatgggtttggaaacctgtaaacttgaggggaaaatgacttgaagaaacaggagcaaagtccagtgagaagaattttgtctactccttccttggttcaccatgaggaaggcaggaggccacagaggggactgaattttttcaggtgaatagtcatagtgtcttttggggaaggggctgtaagaaattaacaaaaacttcatctcatatatgtaattggcttttatacagttcatgagtgggttcctgagcagtagacaacaatgggttttgtaaggtaggagcacataacaggagacatgggctcgttactgtcg

SEQ ID NO: 18545 - DNA, 1241 bp, Mus musculus
aaatcaaaaaaatttacaaaatcaatatgttaactgcagaaaatattgggagtatagatctcaattcttccttttctacacagaattaaagccattcattattctggcttctacagatactactaaagtgatttagtgtttgtattatatacatgtatatacacatgcacacatacatatatttaagtgtatcatttatatgttttatgtatacatttatgaatagggtcataatttttttttctggttttgtctgtttgagatagggtgtcatttagccgaggctaacctcagatttactgtgtagctgaacataatcttaatctcccgaacctcctgcttctaccttccaagggctgggactaagtacatgagccactatagtcctatttctagaggatctgataccctttagcctatgtagataccagcatatacataaacatggcagatacacagggacagcaacaataaaaactcttgtttaaaaacaaaatagacacatcttgtttggaaagtgttgactatgggccttctacagagcgatgctggaggttagaaggctgttttgtgagctcttataagaatccagggaggaaatagtccactaaagtggtggcagtggaaccctatagaggcagcgtggaagagatctgggtgctggtgactaatgggagataactgcacgggaacagagtggggaacttagatttctatctggggaagagatataggtatatttcatctcgaaagggaaatagggagaaaggagcagttaggctaagggcgtaagttgggtaggaaaatgtgtaatgcctcaaaagtacttgtgtataagtacacagcaagtagttatctgtagcttttgagcacaggagaaaaatgtcgactggaaatactgtctgctgcaggtgttagcttgaaaccttgactatggctgtctttaagccttagtggtagatgtctttgggctttaatgtgaagccataatcaacacaatacttaccaaatcttgatcactgtcgtctttactgtttcttccatcagtttaatttttttaattgtatgtgtgcgggttcacatgtaaacatggatccatataccatagagtgcttgtgctggctgaagaacagctttctggggttggatctttccttccttttaatacaggtttaggggtcagactccattctctacactcagaagtcaagtaccttcacactgtccctcaagttgaaagt

SEQ ID NO: 18546 - DNA, 1141 bp, Mus musculus
tccatattggtctccgcctgaccttaatccaatggtttaagtatatgcatttgtctcagttgctggtagaggctctctgaggacagccatgccaggctcctgtctgcatgcacaatatggcttcagtaatagtgtcaggatttggtgtgtgtgcattggatggatcccaagttgggcctttctttctgtctctgctccatttttgtccctacacttccttatttgtagtagacaggaacaattctgggttaaaaactttgaagatgggtgggtaccccctgcctcaactcagggccatgtctatctactgaaggtggtctcttcaggttttctctctctactgttggacatttcggctaatgtcatccccattgagtcctggtagcctttcacatcccaagtctctgggtctttctagaggttctcccctgctgaatattttgattcattctcctggtcctctgggcgtccctcctttttctctccatgcctgatcctgcccctctttttcccctagcctctcccctctccacccagtttcttgccttccatgattattttgtcccccttctaagtgggtttcaggtattcacatttgggccttccttcttgttaagcttcctacggtcagtgagttgtatcatgggtattctgaacttttgggctaatagctacttatcagtgagtacgtaccatgcatgtccttttggttctgggttatctcactcaggatgatattttctatttgcctgtacaattcatgatgtcctcattcttaatagccgagtagtattgcattgtgtaggtgaaccacattttctgtatccattcctcagttggcggacatctgggatgtttccagcttctggctactacaaataaggctgctaatgaacatagtggggcacatatccttttggtatggtggagcatcttttatgtatattcccaggagttgtaccagtttgcaatcccaccagcaatggaggagtgttcctctttctccacatctttgagtttttgatcttagccattctaattggtgtaagttggaatctcagggttgttttgatttgcatttccttgatgactaaggatgttgaatacttctttgagtgcctctcagctatttgtgattgct

SEQ ID NO: 18547 - DNA, 1222 bp, Mus musculus
aaaaaaatcaatcaacagtatttactttcctcttttttgtttttcgagttggggtctcacatagctcatgctggcctggaactctgactcctcctgtctctgaagtgccgggattacagacatgctctgccttgtgcttctgtacccattactgtttctggttgacatctcatgccctccattcatctctgactgctttacactctgcacataagctcacctggacgattgcttctttatttctactcttaactctcatcctccattcatccatcagaatgatcttaaagtgggaactagataccattattctcctcctaatgccttcggcagcactgtagaataaaactcagtaataaaaattattaaagtcatctgtgacttgactttgtagttctgttcccaggacaggcctctgcaagggtgcagtgaacatttgagagtatattaaatgaagtaattactagactaaaaggaattaccgagttttgatatatattatgtaatagtacttttagagttccagtttccttatgttctggccagctcagcataatcagtattcttcatctctgtaagtctgataggaaaaggtcttcattgttttaatgtgtgtgtgtgtgtgtacttgtacataaatacaacattttggttgttcttaaggacactagtcttttatagtgtgtatttcttatacctgttaactactactctctagcccatgatctcaaaagtcttactaagactgctaggttggtttttcatttacttagctagtttcatctctgttgctgggttaaatatgatgaccaaaagcaacaaatgggagggaagaattatttaagtttataggttacagttcatcattgaggaaatcaatcaggaacctgtaggggtctcacttgttcaggttccttcttagctagctttctcatgcagcccaagaccacttgcctagggagtgatgccacctacagtgggctgtgctgcctcccctcaattaacagtcaagacagtcctccaccgtccagttggacttagcctcagtggaggtcttggatgactatgctgtgtcaagttgacagttaaagctaatcaggagagcgtatttcataggctatgtcttgtctatctgctgttctctttgtcccacctgccatttcatctctgaggtaggaataacagccttaattccagtatgcatacttacccaatctctcct

SEQ ID NO: 18548 - DNA, 1897 bp, Mus musculus
tccctaggttctctaattcttagcattaaggatttgattgcgtctttataatgtgtacatttcgtggccttcttgtgttgctgatggtcctgagtgcatctgtcagtctgtctcagtcttgagtcggtgcttacccaggctctgaactgactccgtcatcttaacatctggaatgctgccatctttctgctccagctgttaaatgaaactgattgctcctggtttcccataaatttggtgtcgattatgatgaaactgtttatatgtatgtgatctgtaggccatctttgttcatgaagaactgcagacggtctaaagggccatgagggaaagcacttgcccgtggttgtattttgtccctcagtctgtgtcacccatcatcttgaggtctcaataacacggccgcctgtctgtgttttcactcccaggtgaggaagatcgcaagtgagtactacgatgacctcccgcactacaactcctggatcaaggtgctctatgactttgtgacggatgacacaataagtccctactcgcggatgaagaggcctccgaaagggaacgagattctggagtaaatatcacagccaaaggaattcctgtccacggcttcaaaataggtgatagagtggagtttttatctcgttaggcttatggtcagtgatgctcggaagctgggctggcatgattgccaactcagatctcggtgtcatcagaggctcctcagccttcagacagcccgacgacgacgcttgacgctagcggctgctgtgcttgctcactcccctgcactcacgagatgttattactgttactgagggcgtctttcctcgtgtctgtcatgctgtgagcaaatcataaaaagcttatattatttttcactataaagttactttattaaagcacctaataaactgaactgttaatcatatatattaataatattcattgcattattatatttctattgtattggtatacttaccagagtgctagggagaactttacaatttcatccagaaatttaattttgttaaaggcttgacttgagttcatatagtattgtgtgagttccctctggattcaatcatttgttcttagtggggaatggaaggcttataagtctcgggaaactgatgaaattctccatcacaaagtccaaagggtctttggacaagggtccaaacatgaagtgctttctggaggagcttttgtttagtccaacaggagtccaaggatgcagattagagttttgtgagtttgctgcccttgctgggctaggcatttcattgttgtaactgcctctgagtaactgatgatcctataagtaaccccaataaactctctggtttactaagctagccttagtggaatttctttggtctgtctctggtaccccacgtgatatcaacagaagaacagtttgtctctccctgggaagcagctgacagactgtgttcttgcacggctgtggaaaccctgtggcttggtgatgggtagtttgtctcaagaaactaacatcctgtgctattaataaagcagtcctggttacctcaaaagtgtcactggagaaaatgcagtataaaatggggagatgtttttagcatgtgagctatattgccaagctctgtgggactggcaaccttcatactcccaatgtcacccataagtatttgaccttgggttgggggactgtaactcttggaaatgtttattcttcaagaaagccactaactgggcagtaggaacgctgggctctggagcccttaaaggcctgagagatggtgcagccagcagcttcgctgcagttcttcatctgtctcagctctgttcctcatctagggctcaaggcttctaccgactgcgctatcccactgcaggtcaggaaccacttcccact

SEQ ID NO: 18549 - DNA, 2234 bp, Mus musculus
ggttttggatatattacgccctctagatccatttcatgctaactctttgcatgtgaccacaactgccgacttaaagtgaattttctgttataaacccaagaacctaaagtaagctgaactgttcccagtaggagacaggaatgattagcccttttgaatgctgtctccacagttcccgggccatccgcagccctgacaacaatgcagctcttctccaagcaaaacccgtccagacaagaggttaccaaactgcagcagcaggtcagaaccaacggcgctggcgtgactgtcctcaggcgtgagatttctgagcttcgcaccaaagtgcaagagcagcagaaacagcttcaagaccaagaccagaaactgctcgagcagacccagatcataggcgaacagaacgcacggctggcagagctggaacgcaagctccgggaagtcatggaaagtgcagtagggacctcctcagggtctgggcagagtgaggagtcccctcggaaacgacggaaggcaacggaagccatagactctcttaggaaatccaaacgacttcggaataggaagtagattggaatatggctctagctccagaggacgacgtccgtggctgagagtttaagcagttactcctgtcaggatatcggagcaacatggtgtccttaggcttccaggcgatcagacacaacttatacttggctcttgtggttggcatcctttgcgcttctctggtggagctgatgcacagacccgtcttaccttgcaatagatttgtactaaccatgcccattctatcgtgtttgggggctaaccttgctcctgtgcaggcgatgtgttaaggttatttgtttctgcatatatgcacattacatacggattttaaacaaacccattcttgacagactaaaagttaagtttaatacataaaatgtcctgttcacttgaaagaaaaaaaaaatctactttttaaatggacactatcttgttttttgttttttgttttttttaaaaagttgactttttgtttgttataagtgacctttgtctggaatgtctgagacacggttagtactttggtattgaagtgatgggtgacagaaggactgagagtattggctgtagagggggctctacagtagcaactatttttataaactactggcaaggggtgtctccaggcgttaggtacatgctttcagttttctttggggccgtgtcctccatttgcatggatggatgcatgcattgcctaggcagcgcacttcataccactcctgcactggtgttgatcttgaacctctagacttctccactgttagagctgcgccgacattgatttaagcactcagcagcttacctgtcgggagagagttgtcagtccatttgtcctccagttttacaggcacaagagactgttagagtccattgatgtatctcttctctgtagggttcaggtgtactggctaagacagaacctcaaatccaaggctctttctttctatagacatcagacctctgatctgactcagctctgtgctcctgggtcaaccatgacttagtagggacccaactgagggaaagtttgttgaagaaaattatatcatgaaaaaaacatttcatttctggggcatgacctgagggaagctttttcataccactttcaagctctcacataaataactctgaacagagctttagtcttgtttgcactcctgttttgagcttgtaactggaaaagcctgtcttgcgctgtcagcctcctgaatggtcactttaacaacctccaaattgtataaaatggttctttctcccggttgtatatttttgaaacattcaactatcactgtcgtatttttattttaattatgtactaaattatgtagttttgttcttttaaacatctgttgctttggactttgtttatttatagtaaatgtaggtgtaagatggtaaaaactatccctttcaggtgaaagttgacccctgtgttacctgagggtttggtaaccccacagtgggagaaaagcacaaggttgtcatccgtccagcgtgacacattatgcatcctttaggttacttttaccaagtgacactctcctacgcactcttaagtgttgtcccttcgtgatcctgcccttgggttctgttcaaatctctgactttgaaagtccatctacaatgtagtatgtcttcagtgagaaaccttagcatggtatccaagtgtttcatgatttgtt

SEQ ID NO: 18550 - DNA, 1211 bp, Mus musculus
ccctgactctatggacctgcctacatagggcatttcacataaaagtagtcgtatggtgtgtgactctgtgtttttatttcattaatgtgctttcagggtttacctgttgtcttgtagttttaaactagcggtgttttattcctttttatatgctgcaattatcactgtgactcttgggagatgctgatctaaatacaaatttccgtctaaacttatgaaggtgatatggtttttatcatcctttggcgagttgcttttaaagaaaactgctccattgtcgttccttttatcagatgaaagggactatgacgaccgcctttcttagggtttgcggaatccttgctcgtttccactctaacaaggcagtctccgattttaaagagctacaacgaccacctctcttgaagtgtgcactatcttccctcctttccgatggacgcaccgaaagctcgcctctctttccagctgtcatcccacgagctcctccctctccttaagctcccccccccccaggaggaggaagtgacgcacaggaagtgtcccgatccccttacattggaggaaggaatcaaactcccaagatggcggcggcgtctgaggagcggatggctgaggaaggaggcggcggccacggcgacggcggctcctgttcggctgccggctccgctcagcgacagcccccggcgcccccgtcgcaggccccgccgcccgggtcccaggcacccgccgcgcccgcgctggcaccggaccacctgccccaaaacaacacactggtggcgctgcccatcgtagccatcgagaacatcctcagctttatgtcctacgacgaaattagccagctccgcctggtgagggccgaggcctggggaggaccggcgagggcggcgcgttcctggggagggagccccgccggctcgggacacggagcgcgcgcgtccccggcagccgggaagtggcgctggcgacggccggcggggtgcttgctgctgccgcgctggcatcgcgaccgccgggcgggcgaggctccgctctgcgcctcgccccgccccgagggtctcctcgcccctagcccgggacgcgcccgcctgcgagaagtaacggagcggggcttggtgccctccgcccggctggaccggcgacagggactcccgaaggggcaggcgcctgcctcgactgcccgctcgggctctggagttcactcccaagtgggc

SEQ ID NO: 18551 - DNA, 1163 bp, Mus musculus
tgaaaatggcaaaaattcaaactcagtgaagagactctgtttcagaaaataaggaaaatggaaagtctaccactagagaaagacatcctaatgttagcttcaggcctctaaatgtgtgcagaagggcacatgtgccacatgtgcacacaatctgtatatatctcactccctctcacaaaaggaaataacctgtattaaagactagattaaaacttgagctgagaccatttaattttaatttttttctacatgtgtctagggactcattgaacattaatattagtgagagtgggtctctggttatatagatcacacaaatctttgaaaccctcagaagttaaattgcatgcctgtagataataagaagccactgaattagactcttaagaccctaacaactggcacagacccattatttctactgctttatactgacttgacactgattgtgtagaaaatcagtgatatgtcaatattttgagttctgttgatggaaaaaatatgtgaaatacaaagtacttcctgtatctgtaacatagattatatcaagggtgtatttgcctttcttttgcctgtatataatgtaatttttttttcttttagaacgcccagttgctgataacgaacggatgtttgatgttcttcagcggtttggaagtcaaaggaatgaagttcgcttctttcttcgtcatgaacgcccccctaacagggacattggtatataatattctgtggatcgtaactagtgttggagctttttgttttgtgcaccgtaatagctggggcggaggcatgggaggagaagctggggagtcggtgggatgaagggaagctaggacattagagcaacagcgcggggttcttagtcaggatgtgactgacagtggagaaaaggagacacagtgtgcttgaagaaggtggaggcttgttttagtctccagtgtgttaggaaggagtcaaggaaagaagctgaaatggaaggaagaggaggcttatccagtacagcaaggtccctaaaatgtgtatctcacactgataggttctcctcttagataaaagaaggaagctgggtctcctaacaggaacaggaaagagatacacttaactctggtgtttcttacctgaaaacatgtaatttcctggggtggagagagagatgtggg

SEQ ID NO: 18552 - DNA, 1219 bp, Mus musculus
gtgtggcttacatatgtggttccagtacttaggagtgtgaggcaagaggattgtaaggctaacctgggctaccttgaaagaccctgccttaaaaaaaaaaaacaaacaacgacttttgcccgtcatgatgggtttccagattctggagcacacagcaatttacaagtagtcttcagcgtttggcttccctgggctgcagtgtggttgagcaaactgcaagttgagttcgtgcctggagtctgtgtcacggctctgtggtgctgttccagctgctgggccctcgatgtgatcagtgcagattcacttcctgcttccacagctcagtgccttcccgagttggtttcctgtgtcagcttccttgcccctcttcctgtacttattgaaatattgtaaaacttccatacatatgccacatgtaaatctttttttaaaattctcttgcagctatacccaagaattaaaccaagacaaaggagcttggcctgaaacttgagttaatgaagaattaatgagctagaagaaatactatgattatccaggaaaaaaaaatcagaaggcttactttaatgacagtatagctcagaagcaatgaagaatgtgccgtggaagaaaatgaaggaccgaaggactcggcgtgagcagaggcattgctgctgagcccgcaccaccctggctggcagaatgctcatggcggcgcagcataggaggcagccatctggctttgtcaagaaatgggaccatttgctggactgtgggaaaatcagtttcttgtcctgtgtagggtgattttggcactgttcccattccgctgacctgccagaaaggacctgtgccatctggcaccatctccaactgcccctgagcaccagcaggctttgggatccccggcgggtgctgtacacttgtgtgttatcagtgaagaactgttagctgcttgtcagtgagcagtaactattgtatgagttattgtagcatttaagaattatgcgtatatttgaaatactgaaattaaactacactacctaatctaaagtagatttagaatcttgtttttagattgaatttgaatctatatttattgtctttttgtatcttggaaattagagatttgttatagatttacctgtatttgtcaagatcatagctggttttaaaaatgattgtaataaaattaaactttatgactccaagctatttcctggttttccttttaatgtta

SEQ ID NO: 18553 - DNA, 1233 bp, Mus musculus
acatatcagagtaacatatttgcatattattaaaccaaatgcaaatgaattgcataacccttggtaaggtcagaggaagcgttacacctgtaaatagtatatcctttttacttctacacattgtcctggccatagcaatattaaatcaggaaggaatgcagagagctttaaataactgggcaaatagtaaaccaatctcagaggctacaaggccttgatgggaatatttgaagaaattttaacttttaaatgcagtggtggcacctgccacagcagcccagagactgccgcttgccctgagcgaactgagaaatacaatgacgaagtagtctgatggaggcatctaaagaacccagtctgatggaggcatctaaagaatccaggagccaggagtgtctgacacaaggccaacctgggctgcctagcaagacccgatctcagaaaataaatgccaatttaaaaaaagggcatgcttgcttccatcatttggttctaacagaagatggtttttatatacctttagcattcttaaactcaagtccttgaccatatttggccttagacacttaggtctgacaagtagtaagtaatgagatcactctgaccaactgagccaggtgtgccgtctgcaagaagatcgtgataaaccccagggactgtgcctacagctggggaggacagggctcagaagatcttcttaaaacaaccaagctggcttcttcatcctgggaaaatgctagcaaccatacagacatattgccttatctacttccaaacgtactgttaataaagagttacaacacagtcgcaccatgccttgtttttcttcatagagcatggcccccatgggagggctgaggagcacacaggtaacagctgggttctacttacgtgaggtctgctgctctgaaggttcagacactgagaaggcatcttgcctataattaaactatggaactgtacaacatttttaaaactctagttcagaagttctggtcactctggcagaaaggacaatcctaattccacctgcttggtctggtttaggacggttttggggaaaccccctatatcattgctggctccagagcttaggcctgctcccatggggatggggggccattgtgggagctgagaaacccacatagtaaatcactagtctagggctagacctgtcgctggtgatccttgaagaatcacaaaatgggaagggaagaaagaaggcagcatgat

SEQ ID NO: 18554 - DNA, 1136 bp, Mus musculus
ctgcaaagactgtcagtaaatcgcaggttcgcaccagctgcctcacctgctcttccatggcttctttgcggctgtggcaccaggcgcatttcacgttgcttatgtgaagcctcgtttttgtttttacactgaagtctagcagctatcagcagtgcatactgtatttcctcaggaacaccccattgcagtgactctgaactagagagcatatcacagcccctcccttgggactactgggtcatattgatcttgaacatcatctgtcagcgtatctcagagcaggtgaacaccattttctacccagcctggaaacagacagagcccagttcatgatcgtttacttacttgggtggacacatttattggcgttccgtgttgttacaacaaatgtggaaaatgtaatgtgctgtataacgtttattgatttttttccctgagctaaaagcaaagtttgcaggtgtcaccttggaaacagctatgactttggcatgcaggggtctagaaagcttcctggactcattacctgaacttgagtcggactggggacagctgctacagtgacagttttaactactccaggcctgcagatctcttgcagggcagaagtcgagtgattctgtacatatctacctgaaaccatagcctcttgcagaacaatagagatgatacagtagactgcctgaaggtgaggtcaacacagagaaccatggctcttttcccatcatgccttgctcttcaaggtcagactacagcttaagaaccagctcctttgctccttgcccctaggcttgtctacaaagtctcccttagcctccctaacgtcattgtgagtgtgcctcacccgggcattactctaacacaaaatttgtgattcagtaagttagggtgtgactggagtctgcacttctagactcctagctcatccaaagctgcctgctgatctgtggactccagttccccatagtaagggcttagtgaaagatcaagaccagaccagatactatggcagtgtagttcccatcctagctctgctgaagatgctaagcctgcatccagcagttggtaggtggagggagatcggttttccccaactgtctatcacaactgcacagagcagggcacattaacttggattg

SEQ ID NO: 18555 - DNA, 2111 bp, Mus musculus
gctggatataaaagtcacaaattgttctctagcggatagatggtgtacagggcggggagaagggacgctgttttatttgacctttaatggacacatggaacttaacgttttcctttctccgctgatttctaggatggagctgttttaatgaggcttgtaactccatgtagctttcagtcgaactaagcaaataaccatctcttgctttctttccagagatcccgctcatggaagaggacccatagcctggtgacatcctgctagtcccactgtcccctttggggaaaagagccttgaagagagaccacaggaggacagagcttggggaccaggggtcatttttaatctatctacataaggacagtgattcataccgtacatctccagcaggactgtgggtctggccaacagcaaaggcggtgctttcaaatgagactcaagggtttatcatgaccagcagggaaccaagtgcagaggggactctctctgcctcacccctgtgtcagagctgggtgtctcttgctacagagcgtgagactgtgccacacacatcctgttgctcctgctaacagcactccctgctcctctgaaagcatgtcacattgtataaatttgcttctaaaatctgctttgaactgtctagggactttagatctggacgggtcagcctctgtaaaaaaaaaaaaaagcccacgttgacctgcaaacccaagagcagatcctctctttgcccttcttagtaagggacgggctcccaaggaaagactctcatgtgacactcagaccatctcttacacctggacagccaatcaaagcaggatgtggcggcttgaacgagaaaggaaaggataaacaagccaactccgctttctgaaaatttcttcatgccaagcccctatgctctgtgctgccccctggtgacatgtttgtaggcgtggtctggcagtggacctgcggtgtggaatagacccgtggctttacacatggtgagaacacgttcagatgcatcttgtggtggaccccgtaacctggtcatgtttggttttggcatttggcagactccactcaaatttatctgctcatgccttcctatgtgggtcattgctgtcactctaccccgaccctaaaacctaaccattcttttattttccaaagtggaaagtttctgtaaacacggtctgcatttggagggagaaggaagcgggagccggatcttttgagaccactcccagcccctcagctctcttttttgtcctgctcagtccaaaggctggcctcccagccccaagccaccctgccctcttgctttcggggggcctttggccctgcctgcctgccatcccgtatttccatgagggtctcatggcacccactgggtgttgtgcctaagcaattgtttgattttttttaagagcctcgagtccagaagtgtctcttcaaatacatgttggtccatggtgtcgtttccatccctcctctgggttgtagacaaatatgaacaaaactctcatccaatagaatcactgtgctgctagagcaccgagggacggaggcttgatcgaatcctgttttctctcaacacagactgattaaaaattaaaaaagaaaacgacagtttgaagtgtgactttaatggtggggtggggtggggagggcaggaggtgggtgacgttggttgtgggtggtagaaataaaatgtgggatttagaacactcagctgaaggagacaccgtatcaaaagggtgggctttgccctgacgtatgcactgccaccgttagtggcagagtgctgctaagcctgagcttactgctgtgggcagttgcagattgcttgagtggcagctgcacgccatccctggtgaaactccatgtcctcagctccatttattaaaggagttgacatatggtgactgacatgtcactgccttgacatggacaacatccaggcagccacacctctgcactttgttctcacacctgttcccttccatgcctccttatttgggttgtgtcccagagacctctgggtaagagtcccatctcccaggaggcacacagagctgtctcaggccatccctgcctctctttgggaaatcctctggcagcaggat

SEQ ID NO: 18556 - DNA, 1199 bp, Mus musculus
atcccttctaggctgtttggtctcgacatcaaaggcagagattgtggcgatgaggtagctcagtggttcaccaactacctgaagacgcaagcctacaggttggttcagtttgataccagcatgaaaggaagaacaacgaagaaactttacccttctgaaagttaccttcagaactatgaggtgagcatacagtcttcctccattctgccagttactctgggctctctgggcttccttctctgtccataggagcccctcgggagacttcagctagaaagccttagcagtggcccagggcaccgcctacactttaaggccggagagggaaggagataagggctgtctcaatgctggacttctgctgtgcagaggcctgggtataggagatttgtggagggcggagccaggggtgacttctagggagatgagaacgccggaggaaattggctggaaactgaatgtggtggctgatgcctgtaatccagcacttaggaggctacaacaggaggatcgctatgaacccaaggccagcctggactaaaggccttgttctagagaggaaatgaggctggctgctaagtaagtgagattctgggactgaacatgcctctcctgatgcagactctccaggccaccttcactgcctgagtgcggtacagctagttcatgggcaggaaggcacctccttcgagagaaaactgtaatgagccacgttttaagacacatgcacctcagggattctccttccaagccaaggcaggcttatttattattaataatagtattaacgatatcatttatttgctttgttactccagggggctctgttccccacctagaacagtgtcaggttatctattggcgatcaataggttttgactgattgggtggtgttgatgaaattgttatagaacgttctagattagcagcagacgtctccctgtcatgaggaagttgagcaggctggcggataccagcagatgtagtagtgcacacctttaatcctgtcattctcgaggtagaatcaatcaggtggctctctgtgacttcgagcacagccttgtctacgtaaattctagggcatccaaggctaggtagtgagtccctgtctcaaataaatacataattaaataaaagaacaggaggcagcccaagctgcgacattgctctgtgagtggctagaagcctcgtttcagtgc

SEQ ID NO: 18557 - DNA, 1974 bp, Mus musculus
agtgtctgaatgtactggtgatacctgtgtggtcccgctgtggatcgcccatgtagaaattgtccttaatgcaataaggttatacatagttatgagctgtaaaattcaagtcagtatgagctataataatcgtagcttcaaaagtaggttcacatgtacaggtaagtatattgtgtatttctgttcattttctgttcatagagttgtataataaaatatgattgctttaaaacctgtatagttgtctagatctccacacagaaatgtacgtttaatgctttgagttgaaaaggatttcccctgttatttacattctggtgtgtttttaaaattcttacctccatcatgctgttttgaaaattgtgtcgaggattaaaagcgcacagaaatagtctctaaaattgtagcatgaagtttatagaaattattttaaactcacatttaatttaaaccagaagttgacagtgggttggtgtcccgcagtcctcctgctttcccagtctccgcctgggtcagacaaggtgtggttgggacttagagaatgtctacggcgtggcacccagacctcctatacaaagccgacacaagtcacagctctgccttgagctaactcagaagcgcctcgaggaagagttgagtctttaccaagcttacttggccctctggtttttctgacctgctaattagcagcagagactgaaagaatccgtagctcacccggccggctgtaatgaaacaacccagcacttgggtttgctgccttcggaagacgcagggtagctgcggaaacaggagcgtgtcgggacgtctcatagcacaagctcatccgtacagtgtcgatgattgcgttggctgagatatgatgccgcctcaggaattgacccgagttgggagcatctgccccagtgtcctcccagcctccaccctcccccaccactctcgtatctgtcagtaaccggagaggcctgtgagcagggcgtgctctccatgcccgttcactacggacttatgctgcctggtggttcactctgctccctcaaaactcctttgttttcaatattttgcccaagttctcctgtttcttccacatcattattccagtcatgtggagctttgtaactggtcatttgccttctttcataattagtgacgtatgcgacgtaaagccactagaaaaggcacatctttttaatactcattattttctactgactagccttggaggttgactgtgcaatgttatttaatgttgtaattactgtaatatcagcacacaggccccatctgcacactcctgagaaatagaaaatgtactcagagcttgtcattgaaaggaaagtaacgctgtggtcagtgcttgacattggaaaccgcactggaaagctgccggtggaggggatgtcctggtccacagtggcctccacacaaagatgctcttatcttctgtactgtactgtgatgtagctttcttctgtaacattctgttctaaatggtgtgttttcttgccttagggaagggcggtgttagcgggggggggggaagcaacaaaacagaactgtgtagcccctttttaacctggtgttcatcccaagcattcgatgcagatctgcattcgctcactggtgcacactgaaaccttacttgaacaggcctcataataaagcgtttgtctttggctctttctcgagctgtgaatcacctgtttgctgcttggagagccctccgagtgcgttcttccccgagctctaagtccactcggcaagccagggatgggccgtgtaggttcccaggatgttgttatgacaagaaagtttgaccttcctatgggaacccccgtcattgacatacttttcagaacagaaactttctatcctctgttttatatgttcatgataacattttgaagagtcagagggattttaatatatttgcataaacacctggctatatgatagcaggatttccttggctct

SEQ ID NO: 18558 - DNA, 1682 bp, Mus musculus
ttttcatagtaagatctggaacttcggaaggtttttttttttgtataataaataaatatattactttaaaatgtgcaatcctgtctaaattccccatcttcagcaaagactgaagataaactataaacacattaactatcctgtgactaatgcagatgctttattctttattttttcattcaaataagcagttttattgttaaactttggtattgttactggttataatttgcagattttgttcttagtgtagtagtctagttcctatccaaatgattccgtggggattaagtgtgttcacactgcttccatgagcacactagagatacagcccatgtccctttcaaacacacagagatgtcctcatggttggtcgtgtaccgggatgccacctggcagggagctctgggtgctaaccacttcctgtccagggtgctactgctgtcagaggagaaatggcttgagatcagcaggggaccggggaacttggggaaggacctcaagtctgttgtccttgccagacttaggaatcagaggtgtgaacaaagcagcaagatcagttattatgtaaattaaaatttactctattttgtcaagttccaaaattgtatccacatcaggtaattgtaaaaatgtattatcttgtaagacatgtttaaaaaaaaagaacaaagcaaagaaacaatatttaaaaattcaactttatttttcttccaagtgttcaaaactgtctgtttctgggacttggtcatgttgcctgtccgggaacaggatggggcactttgtgctgtcacagccttagcatacctacctcagctaggtggagaagatgagcctcggctagtgttggaccctgtagtgcctagagcagtccaagtgctgacaagtgtgaggaaatgcactgcgctctgcagatcagcaagccctggctgcagttcaagtgtatctggaatgtagccatatagtgcaattattgctgtctgccatggtcatggttgctcacagtacgtgtaccatactcattctaatcaagggaagaagccaactccattagaaggctgagaatactcttcagggactccacaacaaagtgacagacacccaggcgcacacaaatatcaattctttgtcattagaaagttagatctaaataagattgtgactggctaaaactaactccgctgactgtcaggtttcaaatcttcagagaaaaatgtttccgatgttgctcgggtggctctgaggagcagccagcttgtgcgggaatccctgcaatcacagcttgactgacatacataccatccttgacacagtcctgagtaggtccacttgccccaggaccttctgcagcactctggaaggcacaggatgtgggcagcttgccaggaaagcctcctgctgcaagcactgctaattgctaatgatgttggtctttttcctctaatcccattaagtcttttgggaggggggtagcttgcatttttggggggaataaaactgactaaatgaaccagaacacagattattaagtctttagatatatcatctaaaaagtttataaaatgcatagaattttaaaactaagtcctgagtttaacaaaagcaattaacagtctactacttcactaagggcttttaaaataattctggtaagaaaggaaaattaacatgtatgtatccat

SEQ ID NO: 18559 - DNA, 1938 bp, Mus musculus
cagaacacgttatagctgtgtacacacacagctgcgctgatgctgagtcacagagcacgttatagctgtgtacacacacaggtgcgctgatgctgagtcacagaacacgttatagctgtgtacacacacagctgcgctgatgctgagtcacagaacacgttgctctcagcctccaaacaatggcaagtggctttcattgagtcattggaggggatggttaagctttgccctctttaaactcctgagcttcttttccacactttcctgagcaacctttaccatttggttaagagggatgcaagcaaagacagaggccactgtaagagtgttttagaacacttgtattgcccagtattaaacttcagatatgtgctttaatgatacgtgttgtctttggtggtttcaatatatagaatttaggaatttttattgacagaggaagaaatttccaagtttttaaagtaaagaaaaggtagactgaattgagatgctttaaatatgttgttttactatagattgccgtaaggtaacttgtctctatgttttaactgttcaaaatggtacattgtaggactgtttagtggatgaaggcggaatgttcaccgatgccgcaggccctgaacttcagaacaaggctgtacttaaagaaggaacagatgtgggtaggtgccatctgttgataacgggcccggtaaaccaccatagtaacacaaggtatttctgctagaaaccaccaagaagacccctggtcactttttatccttccagtcagaacaaacgtcacttggttagtcatggttcaaaatgaagctttggatctaccatcttttgtgtcaaatctattcttattgcttatgcagatcaagatagtcatcggaaggtagtcatcgcaagtagtgtcctttggttgggaggggtctcagagataaccagcatatcgctttggttgggacagaaactgagcttgggtagatgttgcctgtgaaccagacattcccactccttcagtcagctttgcaaatagctgagcaggcaggcccttgtgccttggcttgcctttctgtcttcatggggttaggaggggagcagtttggagtctgattcaggtttcgtggagttggtgcctctgccacctccacaccaggcctggggtggggctcctgtcactggcacttctgcccaggtccagttcttcctagaagcctcaagtgctgtgagtttgttaagaatacttttaagttatggttaataggaaattttgtttaagttataaagatgcttcaagctaccaagaatgtgttgaaagaagagaacattgtgcacagctatccctgtgactggagaactaagacacccgtgctgattcgagccagcaagcagtggtttgtaaatatcacggacatcaaggctgcagctaaggtaggaaagaactcctgctctaagggttgggctggtcattaccaccataaaaagtatgtgtctgtgtgtgtgtctgtgtgtgtgtgtggggggggggggaggggggctggcggtaatggggctgaaggagagaagatttataattttttattatgatttattttcctaaaattgtatgcgcttaggcctaaaaagatctcatacttgattcttccatgtatgcacgtgtagaaacaaggctgaaggaggctgagtgggtcctcgggtcacttgtgtgtccagggttgtagacacagcccaggctaagggcatctgcagtaacagctgtatgacctcctaggacctcagctctataacttgtcctccagtccaaggcagtaatgtctgccaaaggagcaagtcggtttccacagcagtgactgccaccacatgatacacatttagtgcagtgttttgtatcccctgttgccttgaaattaagactgctaaaaggaagggagcaaaacagaattctggtcc

SEQ ID NO: 18560 - DNA, 1193 bp, Mus musculus
ccccccccaaaggtgctgggtggagttagtaacccagaacaactttaccagtacaaagttcattagatagatggctgttcacagatagaaaagttggggtaaggccaatgaaatatatatttttttaattgattctacctgcaataccaagtatgtaaagaaaatcagtgtagcttgattacagtataagaaaataccctagatacccattttattttcatcttaattctgaacagctagctgttggtcacaagatggttttcagtcctacacattagtttcagttacattgtttctctccctttttaaaaaagatttatgagccaggaggtggtcgcacatgaatttaatcccagcactcttgaggcaggagcaggcaaatctctgagtttgaggccagcttggtctacagagtgagttccaggacacccagggctacacagaggaaccctgtcttgaaaactcggagaggagaggagaggagaggagaggagaggagaggagaggagaggagaggagggggagggaggacgaggacagaggacagaggagagaggagagatgctggctaagacctcagccagccccactggacccttcagagcatcctttacattttctgttgaagccaggcttggtgacacatacttgtcataccagtgctcaggaggccagcctgggctaaatagtgagactgacacataaccagagagtggagaggcccagcactcaggaagcagaggcagttgggtctctgaattcaaagccacctggtctatacagggagctctcagcctgccagggctacgtagtggcaatcacatgcggttggggtttttcttggctggtttggtttgttttaaacagtttgcacacaggaccttgagtatgcgggaccaaaagtgaggccattccctggctcacccctcttgtgtacttatcagccctagtgttcaaaatagcagctcagcaaggccagatatattttaggtttagctcctaagacttccacgttgcgtgatacacgcctcacacttaaaactttttcacctgctgagttcatttctctgggctttgaaaggctttgttgactatgaaagagtgtgacagggtttaaggattaattctgaaactgtgcctttcccaagtcgttttagtgtgtatttattaaagaacccgtgcagttcattgag

SEQ ID NO: 18561 - DNA, 1174 bp, Mus musculus
gtgctgcgagtgggaggagcaggaaacaaggtacagagaagtgccattggctctgaagtatgctgtcattgaatgaaatgctgagcttataaaaagttgaagtacacggagcctggtggcacaggcctgtcaccgcagctcctcagaaagccaaagcaggaggaccaaaggttcgagcctgcctgggcaacttagtgacactgtctcaaagaagagctacaaaaagagctgtgaacaaagctttgtggcaggtttgagtccctgagtttaagctccagcacacacagaggaagtaaagtaaaagtgggaaagaggctacatattacagagtttgctactggcatctcattcaaaattacagaaatgtaaggtaaagggttgaagttatgtctcagttgtacaacacgaatgtagcatgaacaagacactgggttggaacccaacataaaaaagaaaaagaaagagtttaaggctcagtctcgttcagatgagaacagcacgttgcttgccaaggagctgagtgcccgagagccctcctggattctctgtagaccgtccttctatagactctgagcatgggcctgcctctgccttttctgcttctcccccattcttcagccaggcttccagcctgatcagagtatcatgaaatggaacacagttcaacctactacacccttgatctccttctctcattgtaccctggtgtcatgatgtcatcctggggacatcactcagcccttcaaactcatcacgtccagatggagctgtcacccttcttccactggcaccccacatgctgcttgagtgacacctccatttccataattgtaccggccagataccgagtccccttccttctgtacaccccaccaccctggcccggtacctctcctattgcctacctaagtggacagttgagacttatcatcccagagtactagtatagcctcctccaaaatggtccagctcttcacagataccagtaggcagttagatgcaaacaacagccaagtgtggtgctgcgtgcctacagccctaacgctggggagatggggacaggagaaacaggaactctaggtcatccttggctagaaatcatttgagacccagcatgggctacaggagcctctgtctcaaagaaaccaaataatagcagtcagtagtaatgact

SEQ ID NO: 18562 - DNA, 1529 bp, Mus musculus
ccctggggtttagttctctccatcctgtcccccaaagaatgaccctcgaaacatcctgatccagctgtccactgactgtgatgttcttctgcagggaagttgacagacatccatgggaatgccctgcagtacaacaaggaggtgaaacatatgaactctgccggtgtcctggctgcactgaggaactacgagtactatgcaagccatgttccagagtcggtcaaaaatgcgctcattccatgaaggggtctcacttacccagaggccttggttcaaaggaacacatcttaatactgattactaattgaacaattggagctctgcctgcatttatcattgatcagcgatttattagtagttagggatagaagatggaattaaagaattttcttcacatcatctaatacgcttaagacttaagtatatgatacgattgtcatttctcctgcctaaaaacaaattagccaggtgtggtggcacttacaatagtcatagctactccagtggttgaatcagaggattgcttgagcctagcctccattacatagcaagatatgcctaaacacagagaaggaaaacaaaaaaggaatttaattttactaattagctaacaggaccagttgtttttttttgtttttttgtttttttttttttcctttctcttgttgtttgggctttttgtttgtttgcttgtttgtgggttttgttttgtttgtttatttttttgttttttgtttttgttttcaagacagggtttctctgtgtagccctggctgtcctggaactcactttgtagaccaggctggccttgaactcagaaatccgcctgcctctgcctcccgagtgctgggattaaaggcgtgtgccaccaccggccggcattgtttttgtttttttgagacagggtttctctgtgcagccccagctgtcctggaactcactctgtagacaaagttggccttgcactcagagattcccctgcctctgcctccttagtgcagggattaagggcttgccccaccacacctggctcaaatgttactatttctaagtgaagaaatgaaaaagggttagtttcaaatgactgtccaagtcatttgtgcagtcaacattcctgctgataaaccagatttcttcagggcacagagtcttaagttactccagaatttcagttgttttgttttttcacagtaatttttaaaatttctgattccaaataagaatgcatataatgatattatttatgttgatttatgggggaaagtttctctaaaatacatagtcctatcttttcatattatatatcagatttttttcaaaagtatttgaaaattataaataatgtgaggattaatttattctcttgttattaaaatctataattggaaagctgggtaattgcctttattccttcccctgagagaatgtacaatcagtttgattgtcaccttcagtagactgagaagccctacctacatcaggaaacagggctcccaggaaggatgagctgagctggaaatgtaggcggc

SEQ ID NO: 18563 - DNA, 1109 bp, Mus musculus
gcgggaagacagcgttacagcgtgttttagaatttgagatctgaaccgtttgacttgcattcacgtgctgactgctgaattagccaaggggactgagcctgctgtttaccctctgtaagcctcagcttcctcttgaggttgctagaggattaaaagttgtgtgaccatcatgcatccagcagagtacataacatgttgtattgaaatataaaagccaccattctaatttcttaccctcttctagcggaggaaaggaatttcatgccactaactggaagctggacacggttacgagcaagttagctgtattacaacaggttctgacttgttacttctctaagacccaaattagactttatggtgggcaggagtcgggggcatggagggctgtcacatcttaacaggacttaacattggattgttgattcatccttactgctctgtgactcaggttataaatactatcttttgaagagaaataaatctttcgtgctgtcatttttagaagctctgctggcggtggaacatgtgaaaggtgatgtcagcatttctgtggaagaagggaaagagaatcttcttcgggtttctgagtaagtgcttatttatatacaccttttccgttctgaacagcatttaaaaatacatagcactgaattttctgggtgtattatacttgccaattaggtggagtgtacctagaaagatgtttcatctcgtgtgtgtgtgtgtgtgtgtgtgtgtgtgtgtgtgtatgattgtgcatgtgtagaggctagagatctttctacctcagcatcctgagtattagaattacaggtctgcactaccatgccaggctgataactgtcctgataactgttaaaggggaaaattggggctgggatatagctaaggctggtaagaatattttcatattttgcttgagccatagtggcccaccaccacgaatgaatgaatgaatgaatgaatggctttttttttttttaaatagaccttcacaagttattgagtctgaatgagagactgaaagtctccaggttggtcctgtcaactgtcagctgttcatttggtgaatgtggcattggaatatatagttcttctttgggttg

SEQ ID NO: 18564 - DNA, 1188 bp, Mus musculus
aggaggatcttgagttcaaggctagtccaggatatgtgagaccctatctcaaaaaaccaaaatagcccgtgagttagctcagcggctaaaagtttgtttccaagcctctgtactgagttcaagtctcagtatccacgtgttagaaggagagactcagctttgtcctttgtcaagttgtcctctgactccacatgcaagctgtggtgtgcttgtactcaaaataagtatatataatttaaaaaaaatttgtactcaatataaacatgtaaaatacaagataaatataattaaaaatgctaaagaaacaaaaacctaaaggatgaagtatcatatagaaaatctactccgaagtaaattaaatttaggtggatattttagaacataatggaatttgatagaaacactacgatcaaattaacacccccccttttttttataactatggtagaaaaatggtaaatgttaaggtttctgtttgtgccattgtgactcttaagacttttgcagaagcaactatagtttacataatgcttcaattctaggactgtggcattcactgacgtgaattcaatcctgcgctacctggctagaattgcaactacgtctgggctgtatgggactaacctgatggagcacactgaggtaagcgaggagtatttcttttcctgtgtgtcttgtgctttctctgtttgggaacactgttgtcctactgtgcgttgacatgtgatattagtctttagaaggatgtgaacagagtttaaccataggcccagggaaggaatgtttgtgcttggtttgctttgtaaagcagagacctctcttttctgtatggcccaggttagtctgtcagcttgtgtcctgtgctgctgcttcactgcatgcttcttttcagaaagataaactggaagggtagctaaagtagatgttttatgttggcatgcgtgggatccccagcactgcaaaggaacagacttcagctcttagggttcacggtctccgtccagccgagtcagtcagtgctgtcttcaccttcctggtttgtgagcatctcatagacggattgtgctgtccagctcatgccgctcacctttcccagttacagagaggacagcaggcccacacaatgaagagattggtgcaggcttgcacacaagtttgggagttcattttctttcttaagttaatgat

SEQ ID NO: 18565 - DNA, 1236 bp, Mus musculus
gagctcccattccaaaaacttagttattgttgaatttacttaaatacctcatttttatttgaataccagtttaactggaagcaagatttcttattgccatagtcttaagtttatgaatgaaataaagctgcacaggtattgtaaggtgtggttttctagcctcatagtatctgtacttgagggactgtaatacagtcactgaggggctggtggcgttggtgtcacagtacagcggctctcggtaaacagctccaccttgagatccagtttcccagctgggcgtctggaagcactgagtgcactgagcgctttctcctcctctgtcctgcactgtgcatcatctgcagtcttctcaggctgcttaaggctgatggtgctcattacatgtgcccaaaataagtatcattggttgaatgtgtataagaaaatgacagacacaatgctgcttacagtgaatttggttgttttgttttttttactgcaggtcatcttggaagatgttgcaatgctgcatattaaaccagatcagtttacttacacttcagatcattttgaaactataatgaagtatgcagagaaattaattcaagaagggaaggcttatgtggatgacactcctgcagaacagatgaaggcggaacgtgaacagaggacagaatccaaacacaggaagaactgtacggcacagtttgtatcagagtctaatggatacgcttgctttctttttttaatgagagatatagcttaagacacattgaaggctgtttctttttctaattcttatgcctttctgtttgtctgagacggtcttgctgcgtgtagcctagttgggttcaaacttgctattttcctgcctcagcctcgtaagtgttaggattacaggctgtgtcgttggccccgcttgcattcctccttttcttgcctgggatctaacccaggcctgcacatgttagaccactgagctaccaaacccagatcctggtgcagcttctcagagctgtatctgcactgcacctgtgttcagtgtcctgtctccagcacctcactgcttgtatacagtttcttgcatttatttcatttgaggtattctttctgtaacatttaaagttattttaatttaaatgcttaccaatcctgaagtgtttgaaaatgctgtgagcactagcatatacatgtgtgtgtgatttctataatgtgaaagttcattatcctcccatattggtgcagtgtcacgtg

SEQ ID NO: 18566 - DNA, 1175 bp, Mus musculus
cttagtcaaacatttaaagtagatcggccagtgttaataatgatttttactttctagttattattgtgtgtaacagatttcacagcatttaaatttactatgtttaagattcatataagttctgaaatcttaattatgtagtcaataacgtatacttgtgagtaattgttaacctaagcattgaaggcttataatggtttaatagcccaggtgacattaaattcctgagtgtgtttattttcttcaacagatgtgtatagatctgtcgtccagtgaattattagtattcccaatgtagtttgtggcattcatataattaatgtctatcatatatatgttaaaaattaaaatagatgtttgattggaatttttttccaaagagaattctttattcacttactacagaataatattacatttctagcagtttactttcttttctcgttttaatacttttcaatcttttgtagaaatgcagatggaaaaattacatctctagatgcaaaattgaatttggaaaacaaagactacaagaaaaccaccaagatcacttggcttgctgagagcacacacgctctctcgatcccagccgtctgtgtcacttatgagcacttgatcacaaagccagtgctgggaaaagatgaggacttcaagcagtacatcaacaaagacagtaaggtaactggaagagaccaggtctcctttcttacacagatgttagcattctgaaagctaattttaaatgttttagtttcttaggtaaaatagaaagggcttgtagaatttattaaactataaagatgtacctgggcctggtggctcatgccagtaatcccaacatttgggagggtgaggcaggaagatcgtgagttcatggccagcgtgggctacatagtaaaattgtcctgaaaagcagatagcctagcatgtacaagaccctgggttgaacttctgtactgaaacaaaataaatggaaacaaacaaacacaagatgtaaagagcccagcagtgatggtgcacgcctttaatcccagcactcaggaggcagagacaggcagatttctgagttcgaggccagcctggtctacaaagtgagttccaggacagccaggactacacagagaaaccctgtctcgaaaaaaccaatacacaaaacaaaacaaaacaaaaagatg

SEQ ID NO: 18567 - DNA, 1202 bp, Mus musculus
ttgaaattttactagtaaatttactactttagtttttatagccgggcatggtggtgcacgcctttaatcccagcactcgggaggcagaggcaggcggatttctgagttcaaggccagcctggtctacaaagtgagttccaggacagccagggctacacagagaaaccctgtctcaaaccaaaaaaaaaaaaaaaaaaattatgcgataggttaggttgtagcaaaattacagtcatatgattattttctaaggtctttttactctgattactgtatatcgctcaggcatttttttcctgcattccaaatttatagacacttaaatgtttctcagctgattacttttttgttgaatatcttccttaagtctcacattggcttctttagccttcccacaaggtggttgtttgaagtactttttcacatacaaatgagatagtatagattgacaagcctgcagtgaataagcatgctgtaaatgttgttacaggttttacagatccttgagttatatgctcgagtatatgaagagctcttagccattcctgttgtgagaggaaggaagactgaaaaggagaagtttgcaggaggagactacacaaccacaatagaagccttcatatctgccagcggacgcgccattcaggtatggaagtactgtgactactcggccactgtaagcacagcccatgacagttccagcagtttttgccacttttattagtatttggaaaaccagtatagaaaatggtattaaggttttaaaaataaaatcaccagtgtgtgctctagtaatacctcttccagtgacgacatcacttggtaaaaaacaatccacaatccgcagaatatttagccataaaaggaatgaattctgtcatttgcagaactatagatgaaattggaaatgtgtttgttaagtgaaataaaccagatactattgcatgatcttaattgtatgtgaactctaagaaagtgattatatataactaacttgataatagaattgtgtttatttggatgtcggagagaatatgagttgctcagtaggcattacactttagttccatgggaacaaaacgttaaactgtggctaatgatgctagcagacgcctataattccagctctctggggatcttgggtctgtggccagtgtgagctgcatagtaagacactgtctttgggggttgagggggaatct

SEQ ID NO: 18568 - DNA, 1124 bp, Mus musculus
tgtgaataaaaaaataatttctggggatgcagtacagtgcttctctaatgttcatggagccctaggtttaattaccaatgctccattaaactgggcatcatggtggcacgtgtaactcacctacaggtggaggcaacaggatcaagtatttgaggctgccctcagctccatagtgaggtgctacacccatctgggctatgtaagacccttcctcaaacccaggggaaggagcaggagagagggcaacagtggaggagagcaggtccaggcatgagatctgggaagtctagcacacagttactcctgaaaggggcttcccggagcaggaccgtggtggtttataactcatcctgctctcttgtcatgccaatcctacttgtattttcagcattaatgtcagaaaattagctaaacagtacatgtagtgacattctacagtgtgtgctcttgtagtaattgtcgtcaaaggcaaaatagtataaaattaagcctctgtttccttattttagggagcaacatcacaccatttaggccagaatttctccaaaatgtgtgaaatagtttttgaagatcccaagacaccaggagaaaagcagtttgcataccagtgctcctggggcctgacaacacgaaccatcggtgtgatggtcatggtccatggggacaacatgggcctagtgcttccaccccgagtagcatctgtccaggtgagggaagtgtctctgcttatcatttcttttgtaagattatagaccacgcttacaaaggaagtttgaaagggtagatttctctgctacagaaataatagaaaattcagcctaggccactatattgtaaaaatatgtgtaaatttgtattatttattgtctcaagaattttaaaaattacttcattgaaaacttttaaatttgtcaatacatttatcattttattttctgtatgaatgttttgtctgcctgtatgtttaaggaccacatgcatccttggtgcccaccaaggtcagaagagggcatcgaatcccatggaactggagttagagatagttgtgaactaccatgaggatgttcttaattgctgagccatctctctagccctagaactttctttagaaataatttttggat

SEQ ID NO: 18569 - DNA, 1190 bp, Mus musculus
aaggtctccttaaacctgaagggcttcggtcccctcagagatagatcacaatgcataagacttgaatatgtaaggagtctggcatgtagctccttcttcagttccctgatggaaacctcaaactttatcccaaagccagcaatctgagcagcccttaacctagagtaacaagaatctgaggtgaggcctgcaggggattctgatatattctctagttgcaggcagagtacaggttcactaggaatgagtctggggtgtaccagtgactaacccctcagtgtccgaggtgtgtctggtttcaaggtgtctctgtcattccgtgtaccatgtgccattccatgtgccattccatgtgtcattccgtgtaccatgtgccattggtgaggaaatgggattcagagtagatgaagccatgatatagtctgcatgcaacttgagatacacatgcacttttaactgcctgttttgttttacagggagttccagtcagacttgaggtggggccacgtgatatgaagagctgtcagtttgtagcagtcagacgagatactggagagaaactgacaattgctgagaaggaggctgaggctaagctggaaaaggttttggaagacatccagctgaaccttttcacaaggtagctctataggctccctgtgtctccttcctcagtgctcactactgccggagtcacaaacagtgggcattggtgcaacgaaaagcagctttcccttccagtcccaggcccacttaatgtcttattcttcctgtacattggacttggagtaggctttcctaaatgcctgttccctgagaagctgtgctctgtcttgaaccaacaggtttacttaaaaaccaggcttttgtaacatcaatgtgagggtttaagtcatgggttcttaatcgcccgtgcagactgatagaacccaggaggcttgagtaaatagcagcgctttccctgagatactgcttacagtggcctacagagaagccagcagccatagtgctaaaagctcccctgtggtggtaggaaggctggctcagtgctgaagagatcaatgggtactgttcctgcagaggacctaagtttggttcccagcagccatagcaagcagctcacagcttactgtaacttccagctccaagggagtccccaggtgcgtctggacctcttggggacggatggacac

SEQ ID NO: 18570 - DNA, 1148 bp, Mus musculus
actttggacctgggttcagttcccagatcctgtgtcagaggccacacagctgcctgtgacgccagttccaggaaatctgatttcctcttacagagatagcgcacacatacaagtaggcgctcacaagtgcaccgaagtgtttaaaacatgaaaagctcctcaggggatttgagtagccaagactaacaactcctcttgattggtttgggagaatgagatagttgaggcattgggctggcctatcctataagaggatttctcccctctgcctacctgaagcagtaagaggaaggctactatcactagagatagaagcttggtccaaggttaggggaggtagcccatgttatattcattctgttgccttatagtactctatgcctaatacatagtgggtttagtgggtttatttattgagacagggtctcactatgtagaccaggctaacctcaaattcagagagatccacctgttgtcttcactgtctgagtgctgggattaaaggcatgcaccaccattcctggccacattgcgtctcaataaatctgactgggagagagtagactaattttagccttacctttggtgcttgattgggtgtttctaggcagctagtttatagctttctctggatttattcataaaagtatctttttttgtttggttggtttttgtttttttgagacagggtttctctgtgtagccctggctgtcctggaactcactctatagaccaggctggcctcgaactcagaaatctgcctgcctctgcctcccaagtgctgggattaaaggtgtgtgccaccacgcccggccataaaagtagcttgaatagttattttaggatttgtttggtttctggataacatgatacgtttagtgtctctgcactgcgagcgggtagtgttgtgggtgaggcattgggaagctgcctgccctcgctgctctcagtgcttctctgttctcagtctcctggaacttgaggcactgagagtgctgaacttcatacctagaaatcctgactgtgttgttttaagataaatttctggttggttagggtttctctcctgtgattcatgtcgtgtctcaggatggaaaaccagcatcattagtgacagaagagcaattttctcgttttttgttttgtt

SEQ ID NO: 18571 - DNA, 1152 bp, Mus musculus
tgttcttgagcttttccctccatccacagcacaggttctcctgtgtattctagaccgcaagacacgaatcctcctggtcatttgctagattcagtgttagggtgcatggtgtgccttgcactgtgctacatcccagcctccttcctatcagctgtggttaaagaagccctgcgtgaagtagacagacaagacgcaggcctgtggccagctttcctgttctcccatgaaacagtgtgaagtcggcctacaggcccagtgctgcgcttctcaggaacttagatcaattgattttattggttctgtcgtcacctagaacttagtgacaaggacagacgatcacagccatatcaaggcagtgctggtgggtgagggtgcaggagcatgccctgccctcaagcttagggtaggacatgatttttcctacaaaatgtgacagaaaggggaaaagaaaaaacaggtaggtttgactgacagctagcaatggctaagagttcacaaggtcttagacctgagattcagaaaagaacaactgtctttttttcctcattactacgtgtgtgattttttactgtagatgaaaatattacctaatacctgaggctcttacatggagccaggcatggtgatttacatccagtaatattagctgaagcaagaggaccatgtcccaggccagcctgggctacatagtgagacctgaggggacaggagtgttgggtggtgtaaaaatacctttgatttgtgtctgcttttctttgttgtgatatattcataccttcatggttctatacttctgctacagtgttactttttttccagttttgtagaaaggaaaagtagatgagaagggtttgaaaaataacagacttccacaggtggtgtaagtgagagtcaggactattcaacaggaataacaaaatagcctattgtatatgtggcaagcttcccacacctctaggctcaagcggtactgcaaaaggtagctggcttatctgtggccgccgctagtaagggggtgaatactcacagtgagttcttctcattttcacttactagttatcttgtttatctcgggacttaaactgtcacatttataagaaaagtctcgtattttctgatgtattttggcagggcttctgaagaccttaaaac

SEQ ID NO: 18572 - DNA, 1154 bp, Mus musculus
ttaaataaaaaggtttcatttactataaagatagaattagtcacttttatgtaacagtttattagagacattaatataataccatatatataaaaccaacattcataaggtattagtgggttgtaaattttagtctaatattaggtaaattactgtggggatttcacatttaaagtggagcaggggtattttagtttcatgtttaaagaatacacaggacaataaatagagtctggtatattcagcagtcagtgccttctcctcccttgctccatgagggctatctcaggtgtgctgaataaccatcaaacagcctttgaaaggatcttaggaagttaaagttaggtaaaactttgcttgcttcctctctgcgtggtaaagagttggagaggctagagtgctcactgacttccaagtgtggtcttcctcctcctcacttagtttccttgccgagattatggtgctagaggccgagtctggggcttcaggccggctcagcaaagctaagcaggagcttacactggagctccttgttatctcacagtgaggagacaggcgaggctctaggtccctggtgagctaggatgtctgaactttggatgttcttgcctcagcccttaagtagctagaattatctccctgtgccaccaggctttgttagaataacttaggaatccaaatacaatttttccatgtattacaatcattattttatatgttacacaattttataaatgtacttccatacattttgtttagaaacctttagatttgcagctctcatacagggaaatgactgttactttagtttaggtttcgggtcttttgtctccgttttcatggccttgaactcagaaatcctcctgcctctgcctctcgagtgctaggattaaaggcgtgcgccaccacgcccagcttgcctttgatacgtttcagaaattagactagcacaggcactgaatgagcagagaaacttgatcatgggctggcgagatggctcagcagttaacagcactgactgctcttccagaggtcctgagttcaattcccagcaaccacatggtggctcacaaccatctgtaatgggatcagatgccctcttctggtgtatctgaagacagcaacagtgtagtcacataaaataaataaataaa

SEQ ID NO: 18573 - DNA, 1396 bp, Mus musculus
aaataaaatactaagtcttggttctgcccattattaaccagtccaaggaaaactgaaaggttgattttcctgataaaaaatgatttttgtcttttataagcttttgtactttaaaagtcattcacttcctactgacctgttagactcgagtggggtcacgggccgcttgcctggccattagcagttgctgttaccttgccttggaatcactttattcctagtcaccccctccctcctcctgtcagccatgctgtgggcctgtggggagctgcagcagacctcaccatgtcacggccagttatccagacactttagtgtgtcgcacatgcgacctgttttatgactgtagattttggatggtgtaaaataccatattttgctcttttgtgtacttctgagccaagttcccagcgtgtttgcagaggtgcctttgcccccaaaaccctgggacactgagcccttttgcttggagggtgaaaagagaactcgggtcctctccaggagctgtgatggcagagtgtttttcctttccttaccaggttgcacagattccattttgtggggaaattgactgtgaggactggatcaaaaagatgactgccaggtaagtgtaaccctgactccctgcaccgagaagggcctagtacacagcaggatgaatcactactgtctctttgattccagggatcaagatgtggaacctggtgctccatccatgggagccaaaagcctttgcattcctttcaaccctctgtgtgagctgcagcccggagccatgtgtgtctgtggcaagaatcctgccaagttctacaccttgtttggtcggagttactgatggacaaaacagaagccactctctctctcgctcatctttttttaaaaccactgatacgaagatcttctcagatgcaatttttctttttcattttttaaaacttctaaaaaaggtcatgagataaaacagctattcttatgcctaaattaacagtggaaaatacttttctgtaaacagccagggtaataaaaaccatgaactaattgtattttatctatttggttcatcctgcaatagcggaattatacatacagggatggtcttcagaagcctgctaagtgcagggtgagctctgtggttctcaaacccatcctcacctcagaaaagtgctgtccttttctcgtctccctttgactttcccatctgccccatcatatacttcactgagcccagcgtgcacatgtgatcctgtatcgccataccacactgatgctaaggacctctgtgcctgctgtgttccccaccacaccaacccttttcttagctacgtctttcattgacttctttcttcctggctacctcttcagattgatgtgccaagtatccgtacttggcctcctc

SEQ ID NO: 18574 - DNA, 1200 bp, Mus musculus
aattataaatattccaattataacgtaaacacctccatcatgtgctaaatagcatcaacatgcactcagcaatcttccagagactagattaaagaacagttttagtactgtaacattccttggcactcactcattgaagccatcaaggtgctgagctgttcagttagttaccagcatcctataatgcagtggataagatcccttctgtgtcttgcctttggtttctactttagtttaagaactggtatggcatcaaacccagcatcaccacctttctaatcctgaggattcttgtctgtgttcttccgtgtttctgtgcttggtgctaagtatagatatctctactagaggtaaccatggacaagcaggaagcctgggaagggaacaggggaggagatgctacccaacctgcaatcttaggaaacagcaaggagaagtcatggatcccatcattctgccatcagcttggtctcccttaatccctaccattgtggcaggaaattttctcagtacctaaagggacaaacagataaataaagcaagctctgtatcacagatttcttcctctaagttacttaaagaaataactaatcctactgggctgcgacgagggaagtactaactataaaatggaccccttgttctttctgtgtaacaatggctagggttctgacctacgagatgatgtgtgtaatgggactgtgtctctgagattatagtttcaacctttgacactttgtaaagaatactgtttgagatctgatgcagataaggaaaggcccatcctttccttgtgtcattttgattgatgacattttattgtgttgaacttagctaaaagcaggtccttatattgtatgtgatctgctacctctccttgggagtcgtcgatcttgtattggaatggtatttagactttttatgcccaagttgttaataaaaatgtaagtgttagagtagtaacctttctcagaaactctaatgggttagactgaagtcaaacactctaatgcagaagtattgtttgagaaatgagtggaagatgtggggcaggtagtatggaggcaaaaatagatcttagtggttaagaacatcttcttcctagaaaaataaccttctgtcttatcttaaagcatggaaaggatttggtaaacaagggagaaacctgttccattcccaagaaacagtgcggcatgcatc

SEQ ID NO: 18575 - DNA, 1208 bp, Mus musculus
tgacattaaaataaatgtttttaacacattaatacttgagtacttagaataatcttggttagtctcttcagtgagctaagaactgagttttgggagcacttagcacgggccctcactgctctcgccagcctcacagaagtgacgtggagcagctgttggatttgtctactccctgtcagtgctgtgggctggtgtccgttgctgttagtgacacagagatcctggtgcccctcatcagtgttgcagcccggagcctcgggggctctggcagtgctctgcctggggcactaaagtgtaacttacttttgctcttgtgctctgtaggaagctgtgactcagagatggaccactcagatgatggagctgcagaagcagacagtgaggacaatgttgaatcctgtgaggaagacaatgaagacgccgcagagtcgagtgctgggaccaattcaggctgggcagatgccatggcaaaaatccttaacaaaaagactcctaaaagcaaagccaccatcctcaccaaaaacaaagagctggagaaggagaaggagaagctaaagcaggagaggctggagaaaaggaagcaggtgtgtccgtccgcctgcctgtgctgtctctgcttagcagcagtcggctttgagggcttgtgaggcgtgggtaagcaggctcaactcaggagcgcagtcttatgggtccactgagcaaaccagcgagcactactgcataaacccgtgataccggggggtgcagttcaggagtgggcattttctgttcataactgaattcttgctctggttagttgctcctgatagaagtcagtctactttaaccttgattacagacctaaatttgcatatgagttggctgttacatagaaaagaaactatggtaaggttttgagggcccctgtactacaagtatcactatgtcaaaaatatttccttataaaaataagtattttctaatgaaagaaaactaacctttcatatttgtactgacaatatagaagtagtaacttccaaggagtagtttccaggtacaaatggtttaggttatactgctcttcatgtctggcagtgcctacatcacgtctttgcttgctctgcttgaaagcagggcttgagggccttgccctgaaacacagctgtgctgctcacactcaggattctttttgttaagatttttgtctctaaacagaaagcttttcagct

SEQ ID NO: 18576 - DNA, 1484 bp, Mus musculus
acagtatcgtggtgtatcatataaaactgaagtcaactaacttcattgttttagcgtagttttcctttttctttttgagacatgttctatgtttatataacacaagctggcctaaacattctccagctgcgccaccctaaagcgtgggattaggcttgtgccaatccctggcatagtgctgtgccaacggcagtgcagatataaggaggtcgtctctagtgagtccctgcttgcatttaatagacttgctctgggacgttgtaatttacctcgcctatgaaatactgatacttgttttgcaaattgtaatttttaacaaaatatttttattagttctctaagttaaacagtcttgtgatactcatttcacagctgcttttaacttcgtttatttgaactaaatctgtttctcatatatcatcctcagctaaggtttagacagttttgcatatattttgcttcatggttgcagtttccattttaatattaagagatttcacaatcagaagtcccttaaaagggacagtgattgtttacgaatgaaagctctcgtcacacagactgtcagcactcgcggctccttgggatcttaggcacagttagtgcgcactttcaaatcttccttgtttcttatttttgtaagctatctacattcaatactttaatcatttttatatgtttgtctctttatagctcttaataatcccttaagagaaagataaaaacgttgccagtccctgatcttaagtggatttaatggtcattgtaaatgacctgctaggttccccttacaacagcagtgaatacttgctgttcctgaggtatctgttgccatgaagaactgactctgtggaccctgacgctgactctggtggatttttgtcttctcccaggtgatgatgagcagagtgactggttctatgagaaggagtcaggcggagcgtgcgggattgctggagtcgtgccctggtgggaaaaggatgagccagcagagctggacaccaacctgcccgaccctgtgtttgagagtatcttaagtggctccttccctctcatgtcccatcctggcagaggaggtcagtagttgtccctgagtgcttctcctgttagcttatggctcctcctggctagactgactgggaggacagaccaatgtggaggcaggagagacacaggtgctggagagaagcttgctgggccctagccatctcctgctgtgacagcattgaaagtgcttgccctcttcctgcattcactcatcagggtggggaggagggtcaccaggtcaccaggtggtggatggagggagagttcttagctttgtaatgcgagccttagagccctgctgggaatttcctcagctcttttaagtatgaatttcacatttcctccaataatttccgtggtgttcacaactatcagcaggctagttttacttctctgatgacagacaggatcttctgtgccccagcgatcacatatct

SEQ ID NO: 18577 - DNA, 1357 bp, Mus musculus
gactacttacttgatagaagtgttgtcaggctttaacgaggctcaggtccatctttgacccatagtatgtagtaataagtgataactgctgttgttattgcagataataaacatagctggtagtgcaacttatcatgaatccaagtgtagaatttaaccttcaacttttcaattcatatttcatatataatttgacattaccttaatagagtacattattttatagatctttgggttccttttgtatcttatttatgtttaatctgacttctgtctatggtatagtctgttctgaatgaatttttggttaacaagtctcaaaattgaactggtcagctctaaggcctgtctctccatgcctcctccatctcagaccaatcattaagctattcttttacactgtttacaaggtttgaatccagttttaatccttaaataagtatgcccatgtatatgtgagattatatgtcttgagaagttcctgttgggaagaactacttgtctggccatggtggtatatacagttccaccacttgagaggcagagaccagagactcaggacttaaagatcatccttgataaaataacaaatttgaggttagcctcaattatgagactctgtctcaaaaatcgcaaaaagaagtactgctgttgtctggttagaaactccagtttattggtgccctgctaaccagccttttaccatgtaattttcggagaattgttatttatacggaatgtgctggggttttaccttgcttagggttttattgctgtgaacagacaccatggccaaggcagctcttacaaggaacagcgtttaactggggctgggttacagggtcagaggttcagaccattatcaccaaggtgtgagctgcaggagctaaaacttgtacatcttcatttgaagacaaacaggagaagaccagcttctaggcagctaggacaagcgtaaggccacattggcacgcttccgcaacaaggccacgcctcccaatagtgccaccccctggagcaagcctattccaactaccataggcagtcacccagaagatagagcctgcactcttgacgtgtgtagactattcattaagtaagtttgcagcgataacacagcgatgatgctggaacctagcttgaggagagtgtccttgcagcatggctcagtaacctcactaaagggcagctgtccatttggccagaatgccctactcttcggttttttgtttcatttttgtttgatttttaacagagtctcactgtagccctggctgcatggaactcactatgtagtcctgaacctttgaactatgtaggctttgaacctgcctcttctcagtgctgggattaaagg

SEQ ID NO: 18578 - DNA, 1200 bp, Mus musculus
gtggtattcttgaagtctgtctcccacagtctttagagtggaccttgctaataaattttgaatagtgtgaaaaatgaagttctaaagacaaaattaacacctttaagtgcttgggctatgaacaactatttcaagaacagcgttgtgtagaagccagcagtactatagtcagggcgaatgctcaggggtaaagtgatggctgcgtgtggttaaggaaccgagttccttttcctaacaccagggaagaattcgaacatgctgtctcaggtctaagcccagggtctggacaggaaggcaggtgccctgtgagtcacgtggagaatgctaaggacaccagacgttgactgctgcttcctcacaaatatgcgcgtgtgcacacacacacacacacacacacaaacacaaagagcgagaccatgggcacacactaaaaagccaaataaaaccagtttccagcattttcgtgttttcaggatgatctcttcctcttgtcttcagcaggcatccctgccctgtagctgaggttttctgtgtaggctcgggagaaggtaaaccctgatagcagtggagtgaaacgcatgagagcagagccgggagagcaactcagtcagtagagtggtttaacgcgtgtgcggacatggctttaacatcccgacagaagagcagggcctggcagcacgtgaccgtggtcctggtgctgcacgggctgagacacattcgtgggacgccaggccagcaacaaaagacctcatttcaaaacagaagactaatacttgcctaaggaactttccctgaggtggatttctggcctctacacatggacacacacctatgcacacaagctcacacaagtgataggggcaggcagggggaggaattttactttttatttttttataaaatggtaagctcacaactgtcctgagaataaaacacagaagtattggaatttattgaattcattaacagggataaggcagctgttactgggattggggacgaaaagccaggcaagcgcaagtggaagagccccggtttgcaagtgagcttgaagttggcctgcctggccagctgctcggcccgagaccttcactccgccttgctgtagacaggggctgttacttgttccttctgttctttatacttgagagcctctccccccaccccataggagtgtcccaggggaattggagctcaatg

SEQ ID NO: 18579 - DNA, 1166 bp, Mus musculus
tgctgggacaccacagttctactttcacacaagaaagctccttactcacagggttcatcttctactagtgtttatctgttcagagtggatgaccagctcttacagaagaaccgacaggccccagcccaccgccagctgtccacaggtacccttcagcattcaagtccttataaagagcagcaagatgtgacgtccctggcatacctgaccatagctgagaagtaaacacaattaaaataggaaatgttcatgtaaatcagatgtctgctcgggacatgaatcccactggtttacatttaatagagattaataaatcattatcagttcaaatcagttcatggtgcccacatcattggagttcatgattttaactctatcattcctatcacctttaaatagtcttaagagatttcttctacttcctcatgagtccaccctgttgttctgcaagccagtcagttagggtctcttcccttcccatccactccctacggtagccaaagaatcggagcatagctgtgtcagcagtgtgactccgcattgtgtgtctttaatgtcaaccaggtgtgggctgtagtcctttcctcccttcttccctcccctaaatagaatgtataaggctgaattcccttgaattcatttctttttgtttttaaatgatctagtgacttttaaagtgggcagctatgctaacacccacccagaagttggaagattgaggcaggactgccgtaagtccaagaccaacctagactgtgtagtgagtttcaggacagatggtggcatatggtgatacccgtgtcaaaagtaaatatcaatggaaaccacgttagtaagtgccccttacctggaaattgggcaccgtgtttgagcacagcagtttgggactggctgcaatgattatgcagacagagttgagacagcaggttaaacatgcgtgcttgagtatgtgtgcacgcgggtgcactgcagccgtgttagtttgcggtggacagacaggattgagaggttctgcccttcattcatgtttaaccaaaaaaaaaaaaaaaaaaaaaaaatgtttaacatttccaattggtattccgtgaatttcatttggagcaactgttttgtaagcgagtaatcgttgaagtacttttgaaaccattttaacttgaattttgtct

SEQ ID NO: 18580 - DNA, 1194 bp, Mus musculus
tgagccatttctagtactcagtcttgagttttctgacatagagctgagaaaatggtgccatgcctgctttgagtttgaggtagaaattgcctgaaatttaaattgaggttactaggaggggaaggaaggcctatgtctgtgtaagagagcttcattacacgctggaaccccagataggctttagctgtttgtcctagacactggctacttactgcaggcttgtcctagctcttccttggagctttaagctctttactctgtgggagagatctggggtggcaggaacaggatctgccatggctgcaccatctagccagtaacagcttacttgtggtcccaaccttacaaatgttccctgcacacatacaccttttccagaccagaagagacagtgggctcttaaggttcccccaaatggaagagcactggctatggggctgccggtgggacgtgccagtagcagcattgcatacccttgtagaaggctgccagccctgcaacagtcagtctgtggaagaaacagagagagcgctatctcagcagcatagctttataaacttactgaaggaggctttggagccttcccagttatcggctcctggactacgatggcaagaaattcctgtgaatttacagtggtgcaggaccaggtgcaggacaagctgctgctagcaatagagcagacagggccatcctgcttgggtgggaggctgggggtgaaagctccattggtcttcctgcctgtccagtagctgtagcttgtacctccttcccccatctggttccacctcagctctgctctcgggtaaactcctggtcactgcaaatgccttaaccttggacttcaggatcacacgacacaggagcagagcagtacacagggtgtgcagtctctgaacacgcgtaagtgtctcattgagccatggagagtaactcttaaggcaagagttctgagggatggtggcatcacgcatcagttatcttggaagcaaaggaaacggagtacctgggctgaagtccatgcagggacagacaagaggacatgatggctctgagaaagaggaaccgggaactgcgggggacgggtgtaggtgctgagatcccactcttagtccagtctatgcctggtgactcccacctatccacggactgggagatcctggcagagaaaaggccaccctgacccaagactcc

SEQ ID NO: 18581 - DNA, 1278 bp, Mus musculus
tctacatgaaaaacaaattttcctgggtttcagtacattggcttttacatcaaaaactaacagggcacagtttgacctgtttagtgtattctgggccgagtctctgaagcaggagcagagcacactcccgggattcagggacatggtcctcacagctcggaagtagctctagtcctgcgagcaggcacttggaacagcagtctgtaagcaggagtcattgccatgttgccctccctgctggtgttactgtgttcccttagagcatgtgggccagtgggccacattcataatgcagttgcccaaggcctgtcttgcagtggtaccttaaagttaacctcataatcttggaacttgggctccaacccttatgattgtggagtgtttactagatacataatgaggtgctaagttgtggggaagtctcatgtaactcagaacactatcctggtcccaggctacactgtgcactacgtctttagggttgtttatttcactgcgggtcattttctgattcttgttgttgggagtcaatatagcatgcgtcaccagtgtttggtacccaagtcgttccagtgggaacaatgtctgtttgagtaaactaagactgacaggggaatcggggtgctcacaagcgagtccctccagctgctttaggagccgctgtgttcctgctgtgtcttacaggactggagtgctggattcggagttaaacgcatcaatatgtaaaattgttgttttggctttattttgaactctgggagcaaaagaaaaatttttgtacattttcttcatttaatcagaatggtttacatatttctgcaaatggagaaaatgtaaatataaacccatgaccatttactaagtgaatgatgtatatttcccattatcagaagtataatgaagttggaataaattctttaaagtttactatgttgccagtggtttcacacaaattcccttgtatttatttgttgattaaatcaagtgagaaaggttaaagcagtgtgtcttcagttatttaaggaaccttatgctgtgtaagttccacccacatgagtgtgtaaaaaagaaacactgtacttaccatgtcagaagaccactagagatgagaggagaagttgggactaaaatttaataaaaaggtagagtgaaccttaatctcaacctggtagatggaggccaacctgggctatatcatgagccagtgtctcaaagacacatggaagagtggcttcccaaaagcacggactgcagcattctactggcctagcctcgtct

SEQ ID NO: 18582 - DNA, 1187 bp, Mus musculus
ttggctcttgcagtgcggaggctgctgctgtgtgaggagctggagaggtcatcctgcggcagcgtcctgttccacggctacttgcccccgccaggtactgcagtcttcagaaaattcctcttggcactgagcataagcataaaaataagaaaactgttggttatttgagtttggataaatctggacctcatcagaccgtgcccttgcatgagagtgaagctgcacggtctgtagagcagggctggcggcttctctgtcagggcagggaggagctccgtggcctcactcagctgccatgtataccactggtccttgtgtgtgtgggggtgggtgggtgggggatggcacgggacctgagcctggggctctgcttaggtcaccgtcccctcagttacttactagagttgggcctttgtgcaccattgtgagagagaggtgtggtttttgaaaagatcctgtttgaaagtatgaggaaattcaagcataacagataatatgtgtattctcctttgtaggcattcccagtcgtaaagtaactaacacagctaggtcctctgtggatgctaggaatggactgaactctatggaaggagaagcccggggaaacgggacacagcctgtgcttgcaggaaatggagaagacactattcggctgggtgagtgacaggacacagagaaggagagcacacgcatgctcagctggcagggacacagagttttgaatgttactcttttgcacccccccttctctctttccctccctccctctcacagtcttacggtttgtgtgttgagcctatggcaaaggggctgagtgctgatgtactgagctacgttctagccctttatattcgtgttaaatccagattcattatttatatattggaaaatctcatttaacacattttttttttgatgtgtaataatatgatcctctgtttttgttttctttctgttgtttttgtcctcagaacagttgacaaactttctgttgagagctagctagtgagctcccagcttaggctcctgggccatgtggtgtctattgggactacttaactttacctctgcctggcgaaggcatgatccatagctgataagctgtgagcatcatgctctgtccgaccaccttaacccaaacaggtagaagcatcaaccggcctctgagccagagacttccaactcag

SEQ ID NO: 18583 - DNA, 1235 bp, Mus musculus
caggtaatgcgctgtatggtgttcaatatcttttcatcgagtgtacttagatcagtctgaataactgcgaaagtttcttttttacctaaatcttgtgctggtgaagaggcaaggggcaaatctttcctaggccatcggtggcagaagacccttcgtccagccccgcccatcgccaggagctcctccctctcaccagccccgcccactccttcttcgtaagcgtgaagcgccggcgctacagctttttgtccctcgcggcgacccgtcctccagatggttgtggcggccgccatggaggcgagtgggctctgaggagaggccgggctgggccggcggcctccagccacgagcggcggaggccacgaacacgtagtgggggaggctggagcgagccgggccgctgcgggaggctcggcgttccgagtgtgctccggccgccgagccgccgctcctggctccggctccggctccggccctggctccggctcccgccgcagacatggcgggcgggcattgcggcagcttcgccgcgtcggcggccagcagcggggagatcgtgcagctgaatgtgggggggaccaggtgagcccgcgaccgcgcgggaacagtgggtgggacgcccgctgctgtaggagtggcatgtgccagcctaggtgggataggtgttacagccggggcggcgtctgcacggccaggtggggtaccctcggcagggcagggtggcatctacctggtcaggtcgggtacccactgcagggcagggcggcgtctacctggtcaggtcgggtaccctccgcagggcagggtggcatctacctggtcaggtcgggtacccactgcagggtagggcggcgtctgcacggccaggtgggggacccggagacaggtaggtacaattttgcatgatccaagcagccctatgcactcttcagagtctggttccaggtcgagtgtatagactgttaaaactcagtctttattcccccgggttcctatggtgtaagtaaggccacaggaacacagttggcatggtgggcctgcctgaccaagtgacttggggcctctggagggttgaggcatgctgacaccgagctgtcagcgttgcagctggttgtcgtctcccgtgctagggcttgagttgttgcataggagcaaccggttggactgttgagtctttagtctctattagaccttccactcccattttgttggagtggaagtttgttggcaaaaca

SEQ ID NO: 18584 - DNA, 1174 bp, Mus musculus
gtgaaggttaattttgtaacccctagaatccaggagacactgagaggccatgaaagtcacagcagcagacagagttcctttgctgtggtttctatcatcatgatacatgacatgtggcagggactgtctggtgtgtggtgcattccatgttcctttcttatatatgatgttgctttatgcagcctctgcagacaactatgatctaaaatcaaatggaactttgtagatagtcaccgcataagttgtacacagctcttatcatcgaacattgttaaaaaaaaaatagttgggcgacgtgggacagccgcgccatggcggacgaagaacttgaggcgctgaggaagcagaggctggccgagttgcaggccaagcatggagatcctggtgatgcagcccaacaggaagcaaagcaaagggaagcagaaatgagaaacagtatcttagcccaagttctggatcagtcagcccgggccagattaagtaacttagcacttgtaaagcctgaaaaaactaaagcagtggagaactaccttatacagatggcgcggtatggacagctaagtgggaaggtgtcagaacaaggtttgatagaaatacttgagaaagtcagccaacagacagaaaagaaaacaacagtgaaattcaacagaagaaaagtaatggactccgatgaagacgacgccgattactaagaggacgcgcttagacagacttccggagcagtgtctaggacagtcaccaccttgtaaatgtttactttgttccctgtctatatatgccttttgaaaaataaacttgtacctcaaactcaaaaaaaaaaaaaaaaatagttgggttttgttattagtcagttgttaatctcctactctacctaacataaaatcaaactagaactgttctgtctgaatgtatcaagatctaattgttgtgggaaatatttaaaaatgaaccagcgtgttcctgcacctgtgctgtcaactctcagcctcactgtggttctgacagctctgtctttacccaccaactctccggcaggtcctgagctcctgagttccttttgctgccacaccagccccatgcaatggctgtccaccctgtggtcagccaccacagcatccagcaacctggtagacgcaaaactctagaagcgtataattaacaagtcagatgtata

SEQ ID NO: 18585 - DNA, 1997 bp, Mus musculus
gggagcaaagtgaacctctatcaaatctaaaggaaaaatagggctgagaatgtagctcactggtgggtcgcttgcctaacacatgtagtgcctcggttcagtcccttatagaacaaaacagtgataaccatcaaaaaatatggatgcatttttgagcctctaacagattatttatgttgcaggtcaaggttgttcaggagagctcagcggattcacacactgccttccaagaactcccagcaaaatctctcacagccagtaatattcctgggagaaactctacagagagccccagggagggcctgagggccaagcgggcctaccctgcctccagcccagctgctgggcctgatcccacgaacaacgaaaactgccgggtccagtgaagtgtccactcagggttctggaaggtggcattactcaaaggagcctgcctgtggggacttgtcttgagccaaggacacattatgtatcactagagaatacctgagtctttatgctgtgtgtgtggtgctcaggtctcccatatgtaagactgcaaacgttgaaagcacccattacctagtagtcctaatccttaaccctaagtgtaaatagcagtggatagagcgagagcatttgctgcagttaaatgggaagcgccatgatttgtatgtgcattttacacttgctactgcagtgatttgattaggatcttcctgtgtagattgttaggcatcaaatcgttgtagatcaagagttggagctgagttaagtgaggacagcctgtgtgcacagtgtgtggtatggtcctcctttctgtgtgtttcataacttcctgcttctctgacctgtccatagcgtgtggggagtttgcagtgtgcacttactactagttagtctgattgtttcatacacttttgtggtggtgtagatcatgtttactgtcactgttttcctgtcatcatagttcttttggtatatatttctgtgtctggtgatatattaaagtatgtccttgtaaacttttttgtaaaagttatttcctaaatataaaaacattatgactagcaccactatgtcttcttaactaaaaccacctcccataaaagtaaaaatgtttgaacaaatgatacatgtctttgaatgtgtgatactagtatacttactgaacgtgagacatactgtagaatgttggtcatacagatggtttgagaatatggatatattaaactagtatcttgtgctcattaaatactattagcaaaggtacaagaatgttcccatctgtctgttgataatagggcttgaaaagatgaaggcattttgactcaataacaaatgaaaacacttgactaagcctctgtgccgttgaataaaggtgaaaggttttccggctttaagttagtagtagatgatctgttcttggctttcatttcagattggtatcaaatgttcacaaacacagtcattttagatttgaaaactgtctcctgctggtggtttcactgttggaatataaaccactccatcccctgagagcgatgctctactctctcaggttgctcctgtcccaaggccaccatgtgctccagcgctgaggtcaggccagcagctttaagggatgccacaagagatggaaagatcccatgccagggtgtcaccaagtactttccagcgtccttaggaatggcgtcctcttcttgtaggccatagctcctctgtgacatgggatacttgcattcccagaagcaatggactcatcttttggttgcgtgccaagctgagggtaaagaatggcttgtttgttgctgcaaatgaggaatatgtagacgatggtccttggagagcagtatctgaatagaaagcaaaaggctttcattggtgaaataccaggcatcatgtgtggacacatttctgaacatgttctgtgtggggtgagaaggtaatgacaggttcattgtgtagcctggctgccacaggtctcatctgcctgcatctgtctcccaggtcctggg

SEQ ID NO: 18586 - DNA, 1142 bp, Mus musculus
agtaagcaccatgcagacttgcttaaggaccgagttgagaaccttgaacaagaattgatactatcagagaaaaacatgattttccaagctgaaaagtccaaagcagagatacagactttaaaatcagaaattcaaagaatggcccaaaacctccaagacttgcagttagaacttattagtacaaggtcagaaaatgaaaatctcatgaaagaattaaaaaaagagcaagagcgagtatctgacttagaaacaataaattcttctattgaaaacttactgaaagataaagagcaagaaaaagtacagatgaaagaggaagccaaaataacagtggagatgcttcaaactcaattaaaggagctaaacgagacagtggtttccttgtgcaatgaccaagaggtctctaagaccaaagaacagaatctgggtagtcaagtacaaactcttgaacttgagaaggctcagctgctacaggaccttggtgaggccaagaataaatatattatttttcagtcatctgtaaatgccctcactcaagaagtagaagctggcaaacagaaactagagaagggggagaaagagatcaggacactgaaagagcaacttaaaagtcaggagcagcttgtgtgtaaacttgcccaagtggaaggagagcagcaactctggcagaagcagaaactagagctgagaaatgtgactatggcactggagcagaaggtccaagtgctgcaatctgaaaacaacacgttgcagagcacctatgaagcactgcagaattcccacaagagtttagagagtgaacttggattgataaagttggagaaagtagcgcttgttgaaagagtaagttccattacttattttcatgtggaagtatggtcagggaaggaggcactttgtgtttacatggtcttgactacagggacattgagtcagctcaggcagcagtgattgctttaatgtgcttgtaagggacatttttgttaattagattaggtttttgatctgaccttcacatcttgggtttgatgtagttagttctaggttcttatctacagttgaagttcatcacggtaaaacagctccttatccagcagagaaccactgtggcaagaacgtaacagattagggtcagaagacat

SEQ ID NO: 18587 - DNA, 1860 bp, Mus musculus
ctgaagtttgttagcctctcttatttgataaccacaaaaaactactcttttacgcttcctaaaacattaaaagctatgaaagatgtaatttccacattagatgtagtgaaataaatgtcctggaggattaatctttatgataaatatcttacccagtgctttgcacataggtagagcccactgaatgttcatgttgactatcaagacagcagggtggaatgaagtgttgagagtgatgctatttggagggatatacatagcagtacccatatgggcagtttctataaaataatagttaaaccactgattctattttgattcttctaaaaaaataaaatgctttcttggtttatattatgtttataggttgttcggtgccaaaacgataattatgatataaaagaatcagaagtatatatttcagagactacagagaaaacaccaaagcaggacactgaccaaacttgtgataaagatattcagcaggaccttggtctggaaacttcagtcactgagagtgagactaccaggctcacaggagaggggtgtgaagagcagcctccgaagaccaattgtgaggcaccagcggaggacaaaacccaggactgctcagaatgcatttctgaattgtgttctagttccaatgttttggtgcccatggatgttctggaagatcaggggtctatccagaatctccagttgcagaaagacaccttaaatgagaatttgagattacttcctgaagtagaggactgggacaaaaaagttgaaagtttgctaaatgaaattatggaggcagattcaaaactgagtttacaggaagtacagctcaagatgaagattgcaacatgcatacaattggaaaaaatagtcaaggacctcagaaaggaaaaagctgacttaagtgaaaagttggaatcccttccatgtaaccaggaggtatgtctgagagtagaaaggtcagaagaagatcttggttttaatttagatatgggagcaaatgagttgttaagtaaatctactaaagataatgcaaccaacacagaagacaattataaggagaagtttcttgatatggaaagagaactgaccagaattaagtctgagaaagctaatattgagcatcacatcctatctgtggaaactaacttagaggtggttcaagcagagaagctctgtttggaaagagacactgaaagtaagcaaaaggttattattgaccttaaagaagaactatttacagttataagtgagagaaacagacttcgggaagaattagataatgtgtcaaaagaaagcaaagcactggatcagatgtctaaaaagatgaaagagaaaatagaagagctggagtctcaccaaagggagagcctccgtcacattggggcagtagagtctgaggtcaaggacaaagcagatcttattcagactctgtcctttaatgtgggtgagctaacaaaagacaaagctcatctccaggagcagctgcagaatttgcagaatgactcacaagaattatctttggcgattggtgagctggaaatacaaattggacaactgaataaagagaaagaatcactggtcaaggagtctcagaacttccagatcaagctgactgagtcagagtgtgaaaagcagacgatctctaaggccttggaggtggcactcaaggagaaaggtgagtttgcagtgcagctgagctcagcccaggaggaggtgcatcagctgagacgaggcattgagaaactgagcgtccgcattgaggccgatgagaagaagcacctcagtgctgtggcgaagctgaaagaaagccagcgtgaaagcgactcattgaaggatacagtggagactctggagcgg

SEQ ID NO: 18588 - DNA, 1181 bp, Mus musculus
ctgcccttgggctgctgtttgctcatggattgggaggcctggacttgtgcatttagcatccctggttgccacatctatcctcagtctctgatactctgttttctttggtttgtttaatttctttttgtagtgtgaacatttgggtgtgtctctggctcatttgtgtactgtgcagttaggcctatgatgttctgaaaacttatggactctttcttgttattttccttaataaagtaagtacttatacagcacccatgggtagtatagagatgatgcaggactcacaggaggatgcgcctaggatgtaggcaaagcccacaacattctatatatgaggggataatcacccattttctctcactctgtctgtgcctgtctctgtctttttctctctctctcatctctgcttctttgtttttcttaatctttaagaatggttgattatttgcagaaaacatgcattcagaacttggttattttttctcttttgtaggtcacatcagtgaagcagcagttagaaaggaatttggaagaaattaggcttaagttgagcagagcagaacaagctcttcaggcaagtcaggtcgcagaaaacgagctgaggagaagcagtgaggtatgtgagcaggagggtcaaggaagagatcccacacaggataaaaagacaatgtctttcttgggaaaacagtgtgtgttgtgtgtgtgtgtgtgtgtgtgcacctgtgtgtgtgcacctgtgtgtgtgcgcccgtgcatgtgagtcacagcatgctcattggaggtcagcgtacaacttgtagtctctcttcatccttatgtgggttcccaggatcaaactcaggatagcatcattgtgtgctaagtcatctccctggtccaaaaagggactctgtattttaatttatcagcactttattagtaccatacttttttttctttttcagatgttatgtgttttatatatgtttaatgtccttgttttccatttttttattttgaaatgataactcatgcattttgcatgaggaattaagaatatataatccaaccagaccctccagagctcccagggactaaatcaccaaccaaagagtacacacatggagggactcatggctccagctacatatgtagcagaggatggtcttgtcggcatcagtgagagaggaggcccttggtcc

SEQ ID NO: 18589 - DNA, 2132 bp, Mus musculus
ctcctgtgcagcccagcctgggtcagtgatgatatcgaccgtgttcgatttgaagtccagtttcctgcttatgtccaattttgctcagagtataattttctaaactgtgagtttgtggaactgaatgtgtcaggtcttcctccacagttacatttttccctatttcctgagctgaaaagaccaaacagaaagtgtgtgtctttgtggcttctttctccaccccctagtgagtgcttatgacagcagaatccccatgaactcctctggaaggtgagccaagctgtcttcacactgggcaggggtggtgctggtgctgatgttgatacagcatttgtgggttcagaatctgtagaagaggtgcttccatcctcccttccgccatgcagattgaaccaaggagtctaagtgtgcaagccttgtggatctggtgcactgtgtaaactctgacataggtattttggggaaatgttacagtgttaagggtgggaagtcttgtttcacttcctttgatgatgtttctcctttacattcggtcccacttacggtttcattatgcaatgaagaacgctgctgatcctctcctgttgtctctgagctgtagtcggtcagaatgtatctccctcgggcagcaaggagatatgatgccactttgcacgggtcactcgggggctgtttttaccctgtgttagcagaacaaggtgcagggaagtagcagaacaaggtgcagggaagatgtcggttggctacccaacttcctagtgtgcatggtgagccctaaaggagaacattaagtgtcccgagtacgtatgtgttccattctcagacaccattgcttctggttcttcagtaacattccaaattcctttcccatccctaggaagtccccgtggatctctggttaaattatcatcaggcatataaagtggcatctgcataatgattgcccagagatgctttctatctgggaagtgagccaaggaataaaccttgaagtaaagtgtattaaattagttatctggttaggccttttggaaagatttcctgtgatgcatgggggccagagctggagttgtcagggcccattgccgcagtttggatttgaaggaggggaaaattaaaacaggagccagtaagtcatcccatctcacagcagagcagtggactgcttgctcgatggccctggtttggagttttttccagtggtaccacactcttttacttacactcatcggcctacgtccacctttgtcctggttcaggggtctctgtatcctggctgcttaacgtggtgtcttcatccctgagatcctgagttgtgttaaagatgaagctgcggagtttctggctgggctgtggctggtcttaggtggctctgcagtaacttcaggtggaatcccaggggtcagggggctgcacatccatatattctcctttttcagtaagaagtagaggagaaaacaggattgggcatgtaagtcgctttatggaggtgaagactagtgggttcctctgatcacttggagatgagccgcagatacgatactagggaggctgggggcatctcacgtggaccgtatcgtgtaataagccttgatttaatgcgcttactttgggagacttgtactgttatgagaaagggattactcacgattagaagcaagccgtcatcccgttccccccaacacccactccagtcttgggctctctcagccacctctgcttcaggacatggtcctcatgggacacagccaccagcttctatgcaagccataccctgccctctctcagcttccacttttcagcagctacctcctgaactggttctttgtgaccctgctacctcgctgtgctggccttgcatctggtcaagctgggaggtgcccctggatgctgacaggctgggatgacagatgtgttgccgtgtagtcttctgtcacccccttgaagctcaggccggcctgcttatcgatgagccatttaggctctcccctttttagtggcatgtctgatggagagagcgaatttagttaattgattaatgtttggagatgtgccagttacttgaggtggagaggggaagagtaccaggtcattctagaataaactcaacgaacatgattagccttgacccc

SEQ ID NO: 18590 - DNA, 1149 bp, Mus musculus
ctctgccctctgtttatccagtgtggcctgcccctgccctcctccctcccgggatccttatcagctgtttgttcaaaaaccatcacccacctgcctgtactttatactatcaccgcatccttttatcttgtggatgatgtgccttgatattttgagaaaaatttccagtaacagattcgatttacatggacagaaacttgagcaaacgccagactagcaggggggctattattctgttctataaataagtttagaccagaaaacactcacagaaacctgggaatcaacatgtttgggtctaattgaggggaaaagcaagatagataaattttgaaatgcaaatgatcaccttctgttgtttaagaattgcttctgccaactttgtgatcttggatttaaagccacagacctccagccatgtctacgaaggctcacaagttcctgcaaaaaaaactaagaacttgaaaaaaaaaatcgccttttatgttaaagcaaagagatccagcgatacaaagacaaaacccatggagctctgtctgtctgtgcctgtgaaaaagccggcccttaaatggctacagctgcggctctatcaagaggatcttgagaatacgaatttacagagcagacttagccctcttctcaaagttggacttttcgggttcgtttcgtatctttggattatctagcaaggtttttattaaataaacctcactcatggcaaacggcttcctttcatactgcatacaaacagaatggcggggagaaagaggaaagcagggccgcagtgggccaggtaggcagagggtatgcagcactgagtaggtctgcagcactgtcctctctcgggcacaccctcaggagctcctggatgcactaggacaggtagtgatcagaagccagggtgccgctcacttttctcttgagcacatgctcgtggtaatttgaattttatttccaatgctatagaaaccagagcttcaccaagtttttgacccaaggatttgaaatatttctccacttagtagcatagaataaattttgctacaacatttttagtgttatagaaaaataaaatacaatgtcagggactgtagttaatgttttcatagcagtatcttttaccatcaaaggcagctagaaataaaactt

SEQ ID NO: 18591 - DNA, 1328 bp, Mus musculus
aacgaagaaaagtaggggattgaactgtatggaatctaagatggtgtgtatgggtgtgctcttggtaaaagcatttatatatctctggaaactcattgtgttctttgaagtgtcttaaggaaggccttgtgtcccctgagcctctccacatgggtggacttgaaattttattaagatatgggtctgctttttgtttttaacatcacagatgtatgtctgtggccgtccaggcctctgttggcatccatagttaagcatatccgttgagtttgtgttgccctcttgtcagtgcagatggggtgctgtttaccccacagcttgcccagtttttctgagcactaagtctcagaaaggcgcagagttcactcatccctcgcccactggctgccaggggtctcaggccgagggagtgggtgggctccactgggtcactgggtgcccacatgggctttcgttggtgctggctcactgctgtgctgctcaccttgcttagctcggctccacaggaaacgatgataattaggaataaaaggctttattgtttttagggaaccttaccttggtgagagttgctgggctgaggaaaggcaggttttcaacccaatgcaaattccccaactttcccccaaacaagcacttgtgaaccgatgctgttatgtagttaatgaataacggaaacgttgtagtgagactgtttgctcttgtgttcactggtgccactttctaacgtggttaagaactcacatgttaggttccagctagcatggctatatttgctaattacagtgaatttggaggttttagagtccaccttagacctgggaggagagcctgtgagtaaagtgtgttctgtcctgaagtggggcccagtgtgccacggagattagagctgagtgtcgtgcgtgcatgcttctctccgaagcagtggctgtggggctgtttgccatctgagcactcacaggccggttctcctttagcatatgagccttttgacatgatggaataaaactatcccacacaaaccctcagtttcactcactgagtttatcagtttccaagtgtactgttccaggttaacaattaattccaagtaacagttttccatgttcaccagtttccaagtccaggctccaggaatgccattcctcacatttgaccagcaggtggcagtataccattaatggattcttcgatttctgcagtccccttccaggttgtccttcatagtgtttgggggaaaaaaaatccagccaaactgtagtctaaagagaggctttgttgtgattgtttgtatgaaagaattgcaccttccagctgcttaactgctc

SEQ ID NO: 18592 - DNA, 1243 bp, Mus musculus
ccaccttcccagcccatggagtgtgcctgtgctaggcactcttctctctccagcaggtcgccatgggccactcccactggcacatatggaattagcataaacgctttctgcttctagctcaggtttttgaccccactgctaatacagatgttctcataatttctcctcttcatccccctttttaaataaaaaaagagtagagaagagaaaattacatgagtaattataatattaaattactagagtaagccatttgaattctttaaaaattctcttttcaactttaattttccatcgctgtcttgttactagtgagcctcttacatggacgtgaccgggtttggatacagtttatttatcaggtgacattgctgctccatttcctcagaaacattgtgaggctttgatgtgatgtgacgtttccacgataagcgttgcagatgggcagtgtggcctgcggtggcttcgctccctgggcctaaaccgtcacagaaccaggctgtgttagttgtccctaagtgtcgactctcactgaattctagggcggttcgacaagacggtgattgaggagcgacggcagtgtgctgaggacctgctgcagttctctgccaacatccccgccctgtacaacagcaggcagctccaggacttcttcaaggtttgtagtcttcctgaaagcacgcttgttccatgcagttcccgctgggggtaacgtgcaggtagctctcttgcttctgagctttgctatttcccaggcggcagaagtttctgctcagcatccattgcctgtggcacagctgcatttctggtgtagaaatgacaggttttcaatttacagactttagaaccttgatgagaaggctcggagagttgtgttggaatacattggggagatgaggttccatgggccccaggagttccttctagaggcatccttgaatggcatttctgaacactgcgatccacactctttctttgtacaaggttctagtggaagtggtcattgcagttttgcaaagggtctgtgcagattgtatttctaggtcattggctgtgtgtggtttatgtttcttgacatgtggcactgtggctctgaccctttcatttgtttggatctgaaatgagcctcagatgtcagcggcaggccccccttttgatcctgctgcctttgccccccaggtgctggtgaacaggcatctccatcattgttaacatgaacttccttacttgtttgactgtcact

SEQ ID NO: 18593 - DNA, 1194 bp, Mus musculus
tctggcctcaggtctcatgtttgatgtggtatataattcatgccagctcatatgcctgctcatgacataagtgagtaaacttgaagaaggattggaggataaactgtccaagttgttttgtgcctgtaagtgtgatatttgagacagtgttagtcatgtaattaatttccgggccaatagtaagtggtttcatgaaggagagaatatattttatatagcacagaccagttctgtaccaggttgaataatttttcaaagtgtataaaaagactttcagaaagcggatttaagagcctcaagtcaaatcaacagccttagggagaagtgctgcgttagctcttccgggaaatgttcgcatcagactgttggctctgcaggctgaagtacatacatgtttgctttgcatggtaatttggaatagttaaagaaaacattatttgtagcacagagacagaatggttatcctttgagatgtgcatttagttttgttttcgtttcagataattgtgtggaggagatacagtgacttcaagaaactgcacagagaattatggcaaattcacaggaatgcatttcgacactctgagctatttcccccgtttgctaaagggacagtgtttggtaagtgccgctctgaaactgtagtttaatggccctcttcagccacaccccacccccatgtcatgagaaccgcacacttgccaggcaggttctctgccagtgagctacagctcaactctgcagctgtgatgtgagtgtgattagctagtgatggtctgtgccgagaccttccccctcctgtgataatctgtctgtccaatttagcaagaacttgacactgttccccaagcttccagtatagttcataccaaatacatttcctctcctcagccatggggtagctgcaattctgtccagacagagtaagaacctaagaagagatgtattactcacacatgtaacttggttggttggttcttgccctccaagtgcttttcccgtgtcctcgcccccagtgtaaatacctctgtgattttactggtgtctgtaatgataggtgcttcacccacatcagccctgtttgctgtacgatactctaagtgcacccactgtttttcatgtctttctcccccgccactccctacccccccccacttcccagccccctcaccccaacctccactcccctcctgc

SEQ ID NO: 18594 - DNA, 1996 bp, Mus musculus
actctaaaacctttcatattagttttccggtgggcttcggggttctgtttcagtgttttgttttttaaaaaacttttaatttgtttaatgagtttgactaaatgtgtgcttctttaggagctgaagttgctttggttggtggcttgaaacttctagctagactgtcacttctaacagagcaagacttgtggactgtgaacggccttcccaatgagcacaactcctcagatcacctgcctttgctggccaagttcaggcttgagctctgactgctgctcattcacgggacttcctgtctgtattcttttcgaaggatgtaaaaattttaagtatttgtatgctgttcactttttgtgatgtggggttctgaatttctgttatatgcttgaaacagattggaagaaacaaatttacaacttttttttaaatgaaatattttcctgacaactgatgtttaaagaactttatggtaaatgacttctaagtcctgttaaagttgacagcatttttaaaatgtagttcatcttggccctgaagataggaagtcagtgctttttagttcatccggtggtcctgcccggacctgcaaagctcagcatgctgccttttctggagacccagtttcattgggagaagcctgtgcgtgttcttagaaatcactgggtcactcactcctccacagggtccaagcttctgaagaggcttgacaatgtgtatgctgtagagaacattggcccatgtcactgctgccctgagctgtgggatgtgcctacattttgtagtggaaatagttgagaagtatagatcactctcatacgatacggtggtgcacacctttaatcttattagcatttggctgatggcagcaggtagctgtgtaaagccagctttagcaacacaacaagtgtgagggcagcctgggctacatgaaaccctatcttaagacaaaaaaaaaaaaaaaaaaaaaaaaaaaaggtcaagtcctttatatatgtccactcctgcctggaaaaggttgccataaggaaagtagatgagccaggtgcatccacaaacacccttaatcccagcatctgggagacagaggcaggaggatcactgtgtcccaggctgactagaactacacacaaggccctgtgtctcaaagaccagcaaaaggtggcagactccaggttgtccctctgtctcctgtacttgtctttctgtttaacgatggtgaaaggcccttgggtcaggagtgacatttcgttgagccggttttgtataaatgtattagagaagtggtctttggaaggaagcgagagctccgcagctgtttatcatttgcctctaacatgcaggagtcatcatgggagctgtcacttagacccggtagggagcctcgctgactgttgactgtacagttgagtttggtaccgtggtacagcagggtgccatggcgcttgcactgttctctgcagcctcacagcagcctgaccagccagtagcttgccctgtacaagtgtccagtagtaaaattctaaatgtaagtagaaatttctctgctttttaaaatagtagactcagattacaggcatttttactaagtcattactgtgcagtaataaatgttctctacagtgagttttattaatagaatgttttatattagacaataaatctttgcaatttaaatttttactcatttattccagttgttttatgtgtagtagactactgcctcagaggtgtgcaggctaagaagtgcccagtgagcaccaagcaagccgaccctgctttccatgtagagtatgaatccaatgctgagatggcccatagtttgcagtaagcctctctgggtgctaaggtcctggttggagacataatcaatcattatcgaattacagtggtgattgtcttcttaatatggaggatggcttgaggggatttgtacagacatcattgtaggcaaactaacattcataaaaacctttgtaaagtttttatatcctgatga

SEQ ID NO: 18595 - DNA, 1238 bp, Mus musculus
tgagcaggttcccaggagcccctcattaactctttccagtggggagtgtggagaagggatcgacctgtaagtcaggtagccttggaacagtgtggccatccagagccctgcacttgtggggacgcgaggagagtgctgcagagctcattaccacgctcttctccaaatcaggaatcctggccactttgctctctatctgcatttgagattaggaggggcctcaaagggtatctaggaggcttctgtttaaagtggactgaggtgagcgggtaggggacagtctccccggttcctcatataccctgcttcctatgggacaggattagggaagaaaggactcatgctgccatgcaggagagggaaggatgacagaaaacacaagtaaaagaaaaactggagagcaggaaccacaggagacatggacactccaagctgactcctgctgacgcatatatttgccataacacaagctagaccagcatcagaagctagaccagcactgctggctcccagacataggtcaacaaaaggctcttctgcccatagcctccttcaggcaggctttggtccagccagctagtcttgctttttaaaagagacaactttgatcatgccccggtggcttcagacactgggttcaatgagctggtctgcatcaggaaagtctcttggatgccattgtcatgctgttatctctttacctaaggccagcaagctgtttctaaatctgctgagtgctcagggaggaaaataaccacagttggctcgaggctgtcagctgggtcccatatatggttctaggggcttacgctaccctctgctcacatctggagccacttctagctccacattcctctctgtctttgcacttgcctaaataatccctttaggaacatctgtgtcactgggttgacacaacattcagctgagtggaatggtaagagtgacttcaccagcctcaattaagatcaagtttctaaagggagacagccttcccctctcccaggggcgtgtctctgctccctcggagtgttttgatcttattattatcactacatttatgtgtgtaagaacaccatacatgtgaggggcagaggacaacctgtatgttcttaccttccatgtgggtcatgcttggtgacaagtgcctttaatgactgagctgtagtctccctccccctaatgtcaggagcaccttctacaaagaacagtcaagttttttacctctcaactctacc

SEQ ID NO: 18596 - DNA, 1911 bp, Mus musculus
tttgtttttttatgggtgtctagttcctgtaagacatataagagtgtgcaattcacacataaacacatctggtacattcccagtcagttgtcacctgactgtactgaccatgtcagggtcacggttagagtcacagtgtgaatgcagagtcccatgagaagcactgacccactcggacagggctggggttagattcccatctcttacacacctgtgtattgtgacatgttctgtcccacaaaaacaaacaaacaaacaaacaaaccaacaaaatggttttatgcacagattaagtccattatactctggttagctaggtagctgagacacacacagatcatctgagatcttctttgtgctgccttcatacaggtaaacattaatgtactacaacttgtagtagttttatgccctttgtccattttcactctcttaaaagaaactttcatcatctgtgttacgggctagctcgtgatttcttacatcacatctaattttgcctcgaagatgcccaagataaggaagtctgtgataacttcagagagcccatgtgtctccattctgtggagagtccttgaaatactagctgctgtctttccaggatcattcctctgtctgaccactgtttttaaggactaccagcccttgcacatgtcctgtgaacgctgggagcaggttctgctgcaccacaccgtgtgtgtagtcagtactctgtggacactatctcgtacacactcaggacaaggcgagtgggaccaagtgtattttcacagtgcctaccactgtgtcttgtttacagtgagaattaaatgtctttgatgttttgactcttaagcttacattcatgacatttgatcaatcataatatttacatagtgtgattttgaaaattttacaaaaaatttacataatataaaatgcacacagaaaaagtaatcatgtaatgaatatggttgaagcaaatgcaactttgatttaggcaaaatatgcattgacttatcttgatattatattctgtttcatcagattactataaattatgtggaacttgacattggaaaaatgtactgaaagaacttagtatcactcaggatcaggaattctggttttgtgtcctgggcatgttctgccttggtaactctggacacatcatttaccctctccggcaacattttcctgatccatgaaataatgcattcacactgatctaaatgatctttttaaaatattgtcattcatcacgaagtaggccaaatcatggtaccacaggaatttagaaatctaactgcaatctgggcagtggtggaacacacctacaccctgtcttgaaaaaccaaaaaggaggaaggaaggaggaaggaagtaatctagttcgagtaaacaattgtgattggttatgtagaggcagagaacttcagctctgtttttaactccttagtcagtctgtaatagttcaggtagaatctgtatcatcagcaacttcttttagtttttctgtcacaggttacaaatgaccaaaaatgcactgtctcccccagctgtttctgtttctaaattgacagtgttgtttacaagaccatatacatgttacttcctgaagctttgaacaaattacagataaaagttggaatacttaatgtctgaaaagtatattcttgttttgttttttattgtttagaaaagggataaagtctgacgtaataatgcaaaatgaatcgatgatgttctcagtattttaagtggatgtatgggtaatacatcagataagaatttgataaaattctatgtcatgggtatagaagtagtaattatcatcacctgtgtctgccttcatcagatggtttcagaagctgttgcatctgtaaatgttgtgacatagcttttgtctattgagattgttggagtaatatc

SEQ ID NO: 18597 - DNA, 1828 bp, Mus musculus
attgcctttctgctggtatggaagggtggggcttctacctctccctaggaggcctgagtgttaactgtagctgacctagaggcctcgagtgactacggtgaattagtgccatgtaataccacgcgtgtcacagaagccacgggcattgtaatgctcgctccccacaaagccaccaaccagtgtctttcctgagcttcccattaaaactgctgatctctctacagagagaagaagaaagaactggaacgggaagagttgtggaaaaaactagaggagctgcagctgaagaaggctctagagaaacagaacaatgcttacaacatgcacagtattcgcagcagtaccagtgccaaataaagatcagctccccctgctgggcggtcgttttgtacacttttttttttttttgaatatataaaaacttcagagcagacctcatcagtataatataattaggaggccagtttttcctggcaagcgtaaaagcgaaagaattatggactaaaacatagccctgtgctgtatcacggccacagtatattgtaaactctgtctaatcatggattgtgtcactgtctctgttgagtgaggtgatcgtgggagtggcaagcgtgtgttgcgacttgagcccggttgtgctgcacacacagatgaagccgtcctctgcacacttcctttatcatgtgttttcaccgtgctgcacaccttggtgctgcacaccttgagtacatctgaggaaagagcctcgtaagataagcggaggggttgcccttccctcacctctcctagagaggtgtgggcaggggacaagagcccagcctcattaaagacactgccatactctgggttttacaacatctgacatttccaggcttctgaagcacaaagtattaaagttgggggggggaagtaaaccaaaattctgatgttcccaaatccccccttcagcagcggctccccggagcgtgtgcggagcagcacaggccacgggtggacccgaggctcacctccttcattcctctcctccaaggctggaggcagggccttcccagtcctcaccctgccagtccccaggcctgcctgcctgcagggtggagctctgggtccctcccacagtgtgatgcagactgctagctgtcactgcctggctttatttaaaggaactgcagcaggtgtcctcagagctgactatgtagaagctttgtctgtttttacctggtcaggtatttttcacactgttgttaccagtaccattccagcctcttgccttgcagttgtatggaaaactgttttataatgagagatctttactgaggattgagcagcatttaataaagtctatgtttgtattttgccttatgtcatttgctcttttgtctctggaagatatttatattagagaattataacttacggatgtactctaattagaattaggttgcttgtggtccagggattaggagtctagccatctaaccgatcttttcataaaatcccaagcttcttgtccctccgtgttctaggacagtttaacattaaagctagttttaactaaaacgggaaatctcagaatccatggcagtagcagttctgggaaaggcagggagactgtaacatggtttcaactaaacaccagtttagaagggtcacaggggttttttgttgctgtgacagcagcctccatgacctctggacaaactcccttgtaatacagtggcctgtaatttttgctctcttttcaagcagtgggcatcccagggagggccattgttgcagtccaatgaggctgctccctttaggcctctgcagaatagccctgggcgaccca

SEQ ID NO: 18598 - DNA, 1194 bp, Mus musculus
tggctgtatcccaggctggtctagaacttggaattctcctgcctgggtacctccaagtgctaggattgtagacgtgtaccacacacccagttgttgaattcattctaaactttgctggtttttgtaggtgatcagaggactgctgaaattttggccaaaaacatgcagtcagaaagaggtgggttttaataataataaaaataaatgtatttacattaggactgcaatcttgacctgctctgtgaactgtacccatttcctaatgtaccgatttgccttgtctacattagcatcatttgtaaattttttaaaaggaaaaaaaattttttttaaacctaggtgatgtttttaggagaaattgaagagatcttagatgtcattgaaccaacacaattcaaaaaaattgaagagccgctttttaagcagatatccaagtgcgtctccagctctcatttccaggtaccagcttcctttctctgtgacattctgttgttgtgccatcctttttcctgcggattttgaggtttctggtgtctttttaggttgcagaaagagcactgtacttctggaataatgaatatattcttagtttgattgaagagaatattgataaaatcctgccaatcatgtttgccagcttgtataaaatttccaaagaacactggaatcagtaagtttctgttgttgttgggttccatttaacatacagtctcagtagcacaggctagccttgaactcttggctcagcctcagcgctgagatcacaggcgtgtacttcacgtgtctttactttgctagttgaagcctggacagatctgtaacctatactgaaggtgagtgtcatagttgtagatactgcttatccttataaagctgtctatggatgctcctcagcaaatggtctaaccagcttgcggtccagtgccatcggctgagccagctgtatccggcctccccaagctaggaactgaggaccaaagggagacatggcattcagacattccgacttctgtgacatttttatcttgctacccagggtctaggatgagactacaaaactcacatgaagagaaccagaatattgtatctacataggaagagggtaaacattagaatctctggcctgtgagactagactgtttccactttagttctagcatctggcattaattatgcattcagtgttgctggcct

SEQ ID NO: 18599 - DNA, 1234 bp, Mus musculus
ggccagcctgtgctcttcaggagccccaagggctatggtttcaccaggatggagaggcaggcttggttgtattgaaaggggactttaagcataggcagctgtactctgacataatacagaggcttcattttctaaattattgaggatctcattgagtacggtagtattgattctcttaggaaagtcttaactttttaagtagcttacataataaatcaaaaatgaataattagttatgaatgagtagccagttgtgactgaaaatctagataagggatgatacgcatctaaattgattgaggtgatcacaagaaaggtatgttaggatcagtaatatccgattgattgattgtagacagcaagaacagcctagtgtaaatccttgtacgaaaatattacagctgcctggatttactactcaatcgcttagaggactgtatacatgcaaatagcatctacaaaatcatgttttaaaaaaaaccacaaagtaacattcaagttggtttattcagagtttttctctttctatttatagatgccacttcaaatgaacagcaagagcttttctgccagaagctacaacagtgctgtgtactgtttgatttcatggactctgtctcagacttgaagagcaaagaaattaaaagagcgacgctgaatgaactggttgagtatgtttcaactaatcgtggtgtaattgttgaatcagcgtattctgatatagtaaaaatggtaagcctctagatttctattcctcagattaatgtaagtgcaaagatctgaggcgtatgtacagtaactaacatgcccaaaagaatgttcttaaaaacttccccctggggccaggcatggcgcacaccttgaatcccagcgcttcagagactgaggtagtcaatctctgtgaattgtaggtcagccttgcctacatagtgaattccacatcagtcatggtgactttgtgagattatgtctcaaaaaagcccatttgaaagattatctgtttcattgatatggtcattggttataggagtttgagaaattggtaggtattgtggctcttggatacctttttggatacagtagaccttaaacttagaacgcaatgtaggctcaagcatactgttcttgtataggactactgggattcagttcccaacctgcagctctctgacttttaatagctcagctccaggaggatacctctagcacctacactgaggtgcacatctacata

SEQ ID NO: 18600 - DNA, 1265 bp, Mus musculus
cagccatcatgtgagccaagatttgtgcacacaaatacatccaagagccatggaagaagaagcagtgtgacttgatgtactttcttctctgtccactgcaggcaataccggcaactctgtgctacacagggcctgataaaactcgcagactgagatacaaggttgagcaagctatgtcatgtacagggtttgcacggttcctaagggtgtaacgtaggcaaatctgtccatcgtggtgttgaccagctagcttgcctaaagtctgttgccaaggagagagctggatgccatggtgagacctgaattcttttttcttttccttttttaagatttattttatgtatgtgagtacactgtagctgtcttcagacacaccagaagaggatatcagatcccattacagatggttgtgagccactatgtggttgctgggaattgaactcaggacctctagaagagcagtcagtacccttaaccactgagtcatctctccagctaaaaataattgtttttatcttgtgcttttcaagattttgtccttgcctcactctaagaactctgactgcactgagcctgtagtttatgggtctcctgggttttatccttccttttggttttttggtttccagttgtttgctgcatgtgtgtatgggcagtgtgtggatgcttatgtgctacagagtgcgtgtggcggtcagaggataacttcagaagcccgttctctcttccactgtgtggattctagcttggtaacaagcacatactgggtgagccatcttgctggcctgaattggtccttcttggatttcaccgagctcgttggttacaccaggttagaataatatattcaatatatttgcagagtagttgtcactgcttcaaatgtcttttttctgttccttttctctctccttctggtacttccattatgaatattttagtgtaatgatagtattctatagggcattaaagctctgttcatttttttccatttttaaaaatagaatcatttattttattttatatgtgaatgtttttcctgcgtctatcttacatgctataccctgtgtgtatctggagcccaaaagaccattggattccctgaaaatggggtaatccatggtggtaaatcaccacgtgggtactggacttgaacccaggtcctctacaggagcagcaatgccagcccttcttctatctctttttttttttttttttttttttttttttggtttttttcgagacagggtttctctgtattgccc

SEQ ID NO: 18601 - DNA, 1281 bp, Mus musculus
cacagcatctccaaaagacaggtttttcaagacagggtttctctgtgtagccctggcagtcctgggactcactctgtcaaccaggctggcctcgaactcagaaatctgcctgcctctgcctcccaagtgctgggattaaaggcgtgcgccaccactgcccggcttgccctgcactttgacccagcgtgcgtgcacgtcctcgatccttggccagcccttcaccagtgtcctcccggcccctcccttgtccctctaggacaggctgctcccaccctccaagtgagctccgcctgccagcccaatggcccaggaagagcaggagtccagtggcctctcctgtcctgcctgctcaagagaagctaaaagccccttgtttatgtacctgctcttggatattgtgggcatcttgacaggatagggaggttggtaggatggacagggccagccagaggtgaggaagatgagtggaaggagcctgcttctcctgttttccagactccagagatcgaaaccgcctttcctctctggccagttgaccagctggccctgtatcctcatcccaaactctctctgagctgatacctgaagagccaggcatcagaggctgagcaggtggacattctgggctctgcctcctgcctacaccaccatagccagtgccagcacggcctccagcattcccaggcctgcgcactcctgctcctgcctgtagatttatgctgggagaagacacccttgccccctctccctcctcctctgcacgcagcgctctcctctgtccatccccacttctctgtctcgtctccgtgtctggtcaggaacctgtctgcaagtgaagcaatatcttcgtgttttgtatatacaaaaaaaaaaaaaaagaaataggttctcgggagctggtgagatggctcagtggttaagagtgccgactgctcttccaaaggtcctgagttcaaatcccagcaaccacatggtggctcacaaccatccgtaacaaaatctgatgccctcttctggagtgtctgaagacagctacagtgtacttacatataataaataaataaataaataaataaataaatcttttaaaaaaaggaaaaaagaaagaaagaaataggttctcttagatcatgtaaacctaccatagtcagcaaactacactgactgacatgaccaaataaaacctagtaagtttctttacaggaaagtgaatcaaaataacatttctaaaacttttcattactcactcaaaaagctcacggaaacaaagtccttcagcaa

SEQ ID NO: 18602 - DNA, 1199 bp, Mus musculus
tcgccgagatgtcgtcgccgtcgccgcccgcaccagttgcctgcgccgccatctcggcctcggagaaagtggacggcttcacccggaaatcggtgcgcaaggcgcagaggcagaagcgctctcagggctcgtcgcagttccgcagccagggcagccaggcggagctgcaccccctgccccagctcaaaggtaacccccggccgcccctggcccgcgctcccggggcaagccctactccccttcccacctgcgcgcttgccccgcctgcccttgccttggcgatttcagggtccccagaggtacctgcgctcccttccctcgtccagtctttcgactccctgcctcgctgagcctcaaccctggttttctccaagcttagctagttcttctctttctctgtttgtccctcagttgtcacatccagggtccaaacaaactgctgccgagttagctggcctttagacgtagctatatagaactagcttaaaaccgggaccaggtgacagatcttactgtctcgttagacgtaaatgttatacctcagaagacctcgattgtctttggagaggttatgaaggaagagtaatttctttgccgtggaacgggaacttggttagcgcggctatgcttccaaggactttgtaaggttttgtaagtaattcagattggtatccgtgcctaatgcctcgcaggagtgcttggcactccttttggctctcttttctcacccggtttggaggcttttcatgagttgtttactggcgttcttgcttattctttgagaattactggcttttaatttaataattttacgtctttgcattttatgagctagatgtcattaatggaaaagatgtttatgttcctagatatttaagaaattctttgcaacctgatagaaacctagagaatgagtcacaaggccaagaaataaaagaaaggctcatgccaaaatagataaatgatcagcagatttttcaattcttttgacaaagatccagcatccctttcaaggccaatctggttgtgatttgtctttgagtctatgaatcctgacttagtttggcaaggagtgtaaagaaaaccctagatcaaatcaacagttgaccagcaacagcttggaaccccatttaaactctacatctgcctctcggggtgcttctgaattaaggatataccactggtagaatcacacagac

SEQ ID NO: 18603 - DNA, 1118 bp, Mus musculus
tagatatcgcgcggggactgccaattacaacagctccgattctacagtggttttaacagcagggcctggggtcgaatctacaggggccgggctagagcaacatcatggtattccccttactaaaaaaaagtgtgtattgggaggagagagagggaaaaaatgaaaaaaaaaaagaattaaaaaaaaaagaaaagaaaaacagaagatggctttgatggaaaaaaaattaaaaagaaaagaaaggaaaggaaaagaagagaaaagaaaagaaatgaaaagaaacatactgtgaaaggtggtagaatcccataagtagctgaggagggtcctgctttggtaatagggagaggcccagggcgtggagcagaggctacatattccctgtggggatttgccatggacgcatctcatctgcgaaagctgctccctgcttcccggctcccctccatcctctctgggcctgctcaagggtaggtgggctcgggtggtaggagagctcttttttacccagggctctggaaggacaccaaacttctcagcttatttccttccctcctcttctccctgccttttgcagtccctgcctgcctgctcctatcctaccaggtccttctttcctcccgctccctgcccctccagtttgcctggaaatctgttttgtttgcttttgtgtttctttttctgttttgagtgtctttcttggcaggtttctgtagccagcttcctgcgactcaggggtaaattccccttacacttggggggaatgcactgctttgttttggggagtttgggagtgtttttgtttttcaggtgtttttggtttgttttaatttttttcttcaccttttccccccttttatttggagggaacgggaggaagtgggaacagggtggtggcttttgtttttgtttgtctcttgtttttgttgttgtttttttttaattcatttcgaggggatgggaattttttttaaataatgtgtcatgaataaagttgttttattaaaaaaaaaaagaatttggagcaggatagtcctgggttagatctgaatctaagaggcttctactgttaatttttttttttttcaacttgatataagcttgggtcatctgggaag

SEQ ID NO: 18604 - DNA, 1382 bp, Mus musculus
gataaagtaatttcttacttataaaagttgatattgctttaaaaagaaatctagaacctggaaaataagctttttttttttttaaacaaaaggcaccagctgtctagtatattggtaagcaaaacataaagagcactttatctcgacagttagtgcagaggttgtgtctgttgactctaaattgtatttgaaatgctgtaacttttctttcccttaaatgctacatgttggtcctcatgaaatgagcatcatatctccctttgcagactcttagaaagaaactttatgttggagaaaggcgttcccttatagttagaaaagagtttgtctcattcaaatctctgggggctagctaaactttatttcaattctcgtgatttttaaatattttattaaaaacgtttaagtcctttgagattgtaagttaagcttataaaacaaaccaaactgagaaagttaaataagtgttgggtttctgtagtcattacagtcaaaccacacacacatgcagcagctttcgctgagcgctggggagtcttcagtgatgttagctttttgagtagtgggcagtaggaaggaatttttaatgatgtagaactgccaataatgttaaatatctgctgctttgaaagccagtggtggtggtcagtaaagcagatgatttgtgtctctgtgtctggccacactgccaagtgaagctggggtaagtggctgtcagaaacttcaggctctgcttggaaaacttggtaccacaaatgggtgtcaaaggtcatgtgtaacaaagtagtaattatccctgccgtgtgaccttgagctgaccctgaataatcagccttttaccttgtctgatattgtcctttcctatgatttttttttacagtgacctgaaagcaatctacataaaaggaagtaatcttagagtcccttttgcttgcttgtagagtaaaatgtgttatttccaaaggtataatctagttcaaactgaaagaggttctaataaacgtcttacttcatcaaacctcaaatgtttaagatggcttgggttacttgctgtgctgctttaaataagaatgacccgtagtctcatatttgaatgattgaccactaggaagtggaaatgtttgaaaggataataaaaaaataagtgtggcctttgtggaagagtgtgttactgggggtgagctttcaggattcaaaagcccatgccaggcccagtctccctttctaccccccagccccctaccccttggcctgtggatgtagctctcagctactgttccagctccaggtattgtcaaagcctagctttgacatccaggtaaactgaggtggaacaagaaaatggatggaccaaaagctgttagctcctggtaattcgggcc

SEQ ID NO: 18605 - DNA, 1260 bp, Mus musculus
ggaaaattgctaggggggtatggtagaaatggaatgattttagctatttactgacaaaccaacccttagatgatgatgttagatatgccccttgatgaaaaaaatcaaggactttattacatcattttctttctgattttcatgctcttcttcattttcagtaacggtaccaagtagccagagtactcctgccaaagctcccagagccaagagcagtccatccatctcctctccttcgtcagcagcttgtactccgagctgtgcaggagacctccctcttccttcaagtacccccacattctcagtcaaaaccactcctgccacgacccgttcttcagtcagcagaagaggctccatctcttctgtgtctcccaagccactctcatctttcaagatgtcgcttagaaactgggtgacccgaacaccttcctcatcaccacctgtcactccacctgcttctgagacaaagatctcatctccaagaaaagctcttattcctgtgagccagaagtcatcacaggcagatgcttgctctgaatctagaaatagagtgaagaggcgtcttgactcaagctgtctggagagtgtgaaacaaaagtgtgtgaagagttgcaactgtgtcactgagcttgacggccaagcggagagtcttcgtttggatctgtgctgcctttccggcacccaggaagtccttagccaagactccgagggtcctaccaaatcaagcaagactgaaggtgctggcacaagcatctcagaacctccttctcctgtcagtccttatgcttctgaaggctgtggaccactgcctcttcctttgagaccttgtggagaaggatctgagatggtgggcaaagagaatagctctccagagaataagaactggttgttggccatagcagccaaacgcaaggcagaaaattcatccccaagaagtccatcatctcagacacccagttccaggagacaaagtgggaagacgtcaccaggcccggtaagcttaaatgtgggaggacacatgtcctatttgaaggggactaggtgcagttctcaagattgtctgggaatcaggttaataacttcgccctgttactccattaatccttttgtctgctcacattcttcagtcttactgcttgactcactaaagccttcctctcaccatccagagtgtcgattcaaaaatatctctcctggtagacagtatgggttttttttttttttttttttttttaggtaaactttattcttgggaaactt

SEQ ID NO: 18606 - DNA, 1457 bp, Mus musculus
tggagcaatgactgtcgacatgtgacctccagcttccttttcccgctgccctgggatgagtgtcagtgactcatcactgggtcatgtcacatctgtttccctttgtacgagctataagcttgacactggaaacaatttcatatgaaatagttaaattgattggattccagtgagttgttctccgtgtacctggcagtgtgccggaggacatagattaaaagtcacttcatacgcgtgtaagtaacattgttaggataggtgtagactggagtcaaaccacccctttcccagggtcacaataagaccatctgtgtgttagatgtttacattatgatttgtaacagtagcaagattacagctgtgaagtagccatagaaataattctatggttgggggtcactacaacacgcggaattgtattaaagggccatagcattaagaaggttgagaaccactggtctagatggtttatgaagtatttgtcttgatttttagaataatcaaagtatgggatttgcgcaagaattacactgcttatcgacaagaacccatagcatccaagtctttcctgtacccaggtaccagcactcgaaagctaggtaagcctttgtagaatttgggatgtaatgaatttcccttagaaatcaaaaagacttaaagtgttaatataaggctaatttcagcaaaaacttgagaaagagttaaggacatggatgtcaagataaaaatcttaataaagttttcatttctttatatttttgaaacagaattatggcatgaactgcttttggccccacactttaacctcactgacagtctattattaacttctctcaggatactcgagtttggttttagactctactggctctactttatttgctaactgcacagatgacaacatctatatgttcaatatgactggcttaaagacttctccgggtaagttgttattcaaattctcttttgttaatgatatgactattcaaatctctcttcaaaagacaaaatcagctgggaaatctagctcttgtacttgtctggtgatctaggttcaatccccagtacaaccataaaaatgaaaggaaagaagaatactttatggcctgcaaagatggcttagttggtaaagtgcttgccacacagacatgaggacctgagtttaatttagatcactagcacccacgtgtaatctttgctggggaagtcctgggagactcctggggcttatggccagagctagccttgtagaattggcgagcttcaggttcagtgaaagagacttatctaaggttggcaatggaaaagacacctggtatctttgacctccggcctccacatggtgtatatacggctcacaggacacacatacacgatgtaaactaaccctggtgcattattaagtgtgcactcttatgtatactttcctatacacatggtgtatatacggctcacag

SEQ ID NO: 18607 - DNA, 1828 bp, Mus musculus
actcccagcagattcgcctacagcagcaggcccagcagcctttgcagccacagccacagccgcagccgcagcctcgcagtgcctacacccggttttagctgtgctacaagcatactactgccacactgcacagccatcagactacaagaagagtcttccgcatgtgcattaagtgtcaatgttacagtgtgaaatccagtattcactgatagctgtaatgtaacattctggtgaagttgtttttgttgttgttgttgttgttttcttaaaaatttagtgtaagaaataacctggctctcagccaaaataaaagtgcttttttttttttttttttttcgagacagggtttctctgggtagccctggctgtcctggaactcactctgtagaccaggctagcctcaaactcagaaattcacctgcctctgcctcccaagtgctgggattaaaggcgtgcgcccaaatttcttaaacccagtcttctgtctcacacttagcatttttgttgtattattctttgtggttggtgagcttttcttcttccaagaatagtcacagatcattggtaaatttgactgtgtctctgtctaccagaattattgtgctgactggcccgacctggggttttgaggcaggcagggagtactgttgagtcgtgcagtgcttgtcctgggctggagaatgaggccttcacagaggccgcacctgccttctggtctgtgggagcctgtgggccacaggctcagcggcctgctgcattggcacctcttacccaccttctgtcctgaagcaatgttagtttattgttttggtctttgattgacccaaaaaacagctccagctagaaaggttggaaatgaatgtgttgttttttctggtatgtgactagtgtggacttctgatattttttttctacaaatggaatgtggttcacatatgtcttcctgtttgatgtaaagggaacagatccttccccgctctggtttctactagatgacgtattactctacacctgatgtctagacagctatctccgagacgtaacctcagctgggatgctcagggaacagactctggctagccagaaaagccctttttctacttgagtcatggtcagaaactacatgacaacacactgattctaggtttgatttaacagttgactatggctgctcagtgcttttggaccacggttaatatgatgagctgagcctgccgataccccctgtggtcattggtgttgggtgcagtgggctgctaagggcatgagccctggatttccctgtgtaaataaatctcctaatttctttgcttgtgttttaccttttttttctcttcaaagtcatactgattcataagaggacttgactttttttaaatggagtttggtttttgttttttcctgtcgcatcaccccagggactgagaagtgatcgacaacttgggttcccctgaggtcactttgctttgtgagatgttacctctgcatagcccattctgcttgtcatagtctgtgcaagtctactgtatccactgtaagtgacctccccccccagccacctcagtgcacatggtgcacagtcggcacttggtcagcgtctggggactgatgccagagtgcgagggaagacccgtgcggagcccgtgtcctttgctggatatggaaagagctgagtcaatgttccactttgggctcagcagtgagtcgcgtgtctctgtagagtcagcctcttagcaaatgactgaattaggctaggtctctccactctaactcagctttatcaggcaactggattaaaaaaaaaaaagatagtggtgaagaaaattgg

SEQ ID NO: 18608 - DNA, 3825 bp, Mus musculus
gtgtccactgtccacatgacatcactgtgtcccttgaaaggctagctcagcccagtaccatgtttacatgtgctagtgctttccctcagcagaggagagcacccactttctcttttgtatagaaagcatatcatagaaggataattgtattttacaagatgcacttttatcagatgcaaatatagcaaaggatagtaacctagcctgaagcaaagggaagcctcatccgtgagcaggctcccaggaggctttcctgtctgtgcttgcccatgatgctctagtaccacctccatcggccacctccctgaacccactcccgttctggtagctggatcccctccctctgattttgatatcatagtaccaagtgtatttgggggcggttaaagcaaattaacataaaacatttaaatgaccagtttcagggaactagagtagcttattaggaaataagaggtagaaccagatgttggcttgcaatattgacaaggcttcttgtgggccctggggtctgtatgttctgtcattatgtcaagcagctgcctctctcagggtggcaggacctggagacagcagctcaaaaacacttcccagtctcttccagtcgtcttctaagagggcaaagccaagcaagtttctgttcatcgtagaaaccttttgaaagatttgtccttttgttcatgtgatttacctcacaggagaaccagactttacaaaaatcagtgttgagacagaggatgggtttggtttaggacagtgaaactcctaagcttgaaaaacagtaagtcagcagtagttttctgtggcatgaacgaacactagattcccctattgttactaacaacacaaataacaattctgagaaataggttgtaaaacaaaaataaagactaatgttttctgttttcaaataaaccaaaaagagaaaaaggaaagatgtgaattttccccagttgtacaggaacagttgaccaacaccaaataaaagcccatagtagcttcatctttagcaaaccccaagcacgtacagaagagagagacgttacctgaaatacctcactggtaccacaccactgctggtaaactgaagaaggcatttgatttgttagcagttgttataaaaacctaagcactttactctggttagcagggacagtgaataagggaaagcagtctcaatccagaaacgaggggaagccagagagaagctacgcagtgcctctgttgaggcccaggaaaaactgttcagtttcaggatgaattgaattgagacattagttgattgtctgggggagaagttgctcattgtcaagtatagcatgtagtcctagctagcagacccatttcctcattgcaaagcaagccacaggctacagtggccagttcctataaggatgtatatatccatatatgtgcgtacacagaaatgtgactggcccacttttaccactgctgtgctccagaggaacatgacagttaagtatatgtacatgctgagttcactcttctaagatgtgttactttcaaatgcagttttgtttccacagtctctagagtgacaataactgtagacttgtgaactgacttctgatagtagagatgagctataaatagatgtgcttggtctgtctatcccacacctctccagttcaacatgtcttctgtgtacaaacaatcagacatgtttgttgagagtattggcagtgcttccttgtcatagctggagtccacctgcttatactagggaactggaagagagaataaataggtgttctttatggccatctcaggaagccacacaatgccattgtagagagctggatagaactccccatttgtatttagtgtggaaagtgggatgcaaggaagttattgattgtattaagtcggggggcagggggaggtaagcaaagccatgccagtttacaccggcgtcctttaggactgcagctctttttgccctcagctgcattgcctggcttcctaccacacacaggctgggcgacaggtgggaccaagcgacagctcacctcacttcagaaagggctgtgtgcgatgacagagaagcctgtgagcagaggaggcaggaacagcaagaacgcctgtgagcagaggaagcaggaacagcaagaacggaatgaaacttgaacagataaacaagttagacgggaatttaataggaaggttgaaattaatagctgtgggttcagatctgtcatgtgattagttcttaatttcctacagtaagaaactagggaatactgaagtcatcaattacagggtagttaatccagtattaagtcataggaagccaaaaattcagttttctgaaggaatttctgattttttaattctcattgaacttttccttctgaggatgcttactactttaaacgttggctttagttctttccctgactaatttctgtctgtgcattatgcctgtgttaatgggtagttaagtaacaagaagtcaagactacaagcaagaggagaaacaccaaagccagcgggcttaacctgaggactgcaaaagacaaaagttggtgcagctgtaattgtcccagaggtagagtcctaagtcagccattgtggccctcgggtgcagctgtcacgttgctgaggatgctctctcactcacgccttgtggattccttctcattaatttgtcttagtgatgtattttgacaatcggtaccttaaagacttgctcaactagttgttcctagttataatcacagagaatagtctttgatcataggttgtcttctgtatcttgagtatgttttaaaagaaaatgtttgtttgcattaccgaataggaagggttaactgatcttttctgtggttttttgtccttttctttgaagtcactacacaacaatgaacacaggatatcactcaaaagttgccattacaaaaagtgtattcggctctggttcaaaaggatgaatggtaatggcctttgatgggaattttgccctccaagtgctctgggccttatagctatcagcaggcaagagagaggcagatgagactgtgtagcaggtgtgctagttcccggcatgagggtagagactaatgtgtttgggaccaaaagcacctaagttgggaatttctggatcacataagagcctggggtgctctgaagcagccactggctggtgctggttgatgtcatgttgcaccagctctcagtaatctcaaagtgggctctgagactactctgcaagttcccagctgttgggggagaagggctatggtcaaatgaaagatgcactgtggagttttctgcagaaattccatctgagaatttttacatttaatatttttttttaaacaatctaaagagcaaaaaaaaatgtacgtgtattctagttgcaaagtatgcaaatgcttcagatggctttgtttttattgtgtaaaactgttgaacacaactgtggtgcacaaattctttccatgtaaggagtctatgcattttacaggaacatatcttatgattgggtaatgagacagttatacattcaactgccattatttttattaagtgctttcactttctttacagttattacaaagttatatttattttctacagatgggtttctgttttcatgatgctgtaatgtttacttcagcttgttgagctttctttgtgatctgcatgtcacaatgtgtgctctaaggtgactgtcaatgctgtgacaactgtaacttgctttgtaaagggctggtcacctgtggatctggtttatgaatgcatcgggatgattttaccagatcaccttttcagaaatttagatgttgtaaacaccaaaagaag

SEQ ID NO: 18609 - DNA, 1148 bp, Mus musculus
gctccttcctccagtcttctcatttggtatgagctcttgggaaaatttatgtaaatgtacatccatgtataatatattttgctgataacatatttaatgcaattagcaaataataaaatataagtaattgatccttacaatataattatcattgctgaaccctcggagccaacctgtgacaatatcaaccatgattgctagcattatgccctgataaactaaccatctccagataaactcatttagtctagtgtatgatttatagtaaacgcttacccttgtacagaatctccttttagtctcagcattaattggaagtttagataatttatttttaatcctattaaaccctagaattaaatgatcagctcttagagacaagctggagctaccgtcatcaccacagtcctggtctttgtgttttgatttgttttaattactagtgttgaataaaattctcagaattgatttgctcactggtccaagaaaactcctatcattggcctttgcgggttttaaaatggaaaaggactgagagcacattgagcgagggagcgctctatcctggaaagtctaaggagatcaggggcacagggccggtacgctgcgttctcagagctgagtaaatgtgtacacctatactgagatttttttttttcttaacattaaaaacattgatggtttagtcatttgtttgtagaatgtttgacccattttgaaaacttttaatgtgttaaaatgtcttgcacaatcctaccaaataagttgaatagttacagttgagtctacctcttcttttcttggctggatttaggctgctggttgggtgaggctgcggctttatttcccctctacagtactttatgtgggagacagatctagggcctggaagcagacttgaagcgttttgagatctgttgctgaccagccctcttccccgagagtctggggaaagccattgtttttaatgcccacttaatatgaaaatgtttgttttaaaaaatgtttcttgctggtgaaaaatgtatttttaaaacgaaaaaccaaatcctcttttggtctgagaagtcagctgtatgagcaggtgtgaccgtatcataacatgctgatgtcatagaaatcaataaatttttacctctcaggaattg

SEQ ID NO: 18610 - DNA, 2323 bp, Mus musculus
cacacacacacacacacagccctcctgcctgcaactccagctccgaggagtccctgatcacttgtcccagagagcatctcacaggaatcagtggataggtcagctctttgatctgtgtgatgtagttgatctcaggtaactcagatccttttctttctctttgtaaagaacttgatcttccatcctcagccatgaagaagaaggttcatttccacggggaaagcaaagagaacaccgcaaggagtgagaattctgagagctaccttgccaagtccaagtgcagggacctgaagaagaggcttcatgctgcccagctgcgggctcaagccctggctgatattgaaaaaaactaccagctaaagagcaggcagatcctgggcatgcgctaggccggcaaggcatggagctgggtcagtgttgatactgacaacccactagagattggtattcagctgctgtcgttttgtgtgtctggttctgtgggcgggaacctttgtgtgtggtgagctcgtggcattgcttgtggtctgcaaatggatgtgtgtgtctgcttcctaatgtccctgtgtgaaaagcaagctgtctttgctggttggttgggcttttgatcctgtgtgtgattactacttggaatatgagatggggcactatagatactatagatcttaggagaaaataatgttagggaaagaatatttaacctggagggctcagagaggctcacacgctgagtgataccgccttcactgtggtttccaagtgaggcctcagcgggtccatgacctcactgctaacgggatgcgtatggcagggcccacagggttgcatgtcagaggtgttgtaatgttacagggagagacccagcctctggcctgacctcctgatgagaagccactcaccagcattcccattccaggacgctcactgtgccagttaacatcagattagaagtggaggggagggcgagggctgaagcttttacctaagaataggatttgccttagggaagcgcgtgccatggccctcaacacgctgctgtcctgcatcctaggcaggcactggggacaggaggctctgggagccccgagagccccctcctgctgtgtgcagggcctgtccccgtctgtctgtatctgacctctaggtcagttgatgacattagttaagtgtttctgtacctacaagtataagccaaaaggtcggaaatgcctcagagtcacacatgtggtctccaaacatttaatttctgaagagaactgtcttcagaaagttggtctatttaaggtgactggggaaaaggcaggtctcctttgctctctgtccacagtcccttgagatggcttcagaagagaacagtgttcagtgtgcgttattgagggccctgtatgccttcacctgtgtgagggccagattgctgtttgtctacggtttcttgaagacctcagctcagcagaaaggagttcatttgccctaacaagtactgttggctgagaggggaggtcagaagcatgtaatgccattcgtttcatggctaaacacacagactccttgcattttaaaattctgtgcctttacttcctggagctataataacgtgcttgggtgtgtgacttgccgaggttggctttcccaatgctttatgtaaactctgctgttggcacttgcagctgtagaagctgtcggagggattacttacttacggttatagcatctggggtctcttgcagctgcaatgcctgggatcttttgcaactctgactttttcagtagcagcttggaatgttaaaatatggtgagcctcttctctgtgaaggaagggcctgacaatctgccagcagggagtcctgttaaagactgggaactcagtgcagtggttttcctgcctttcccttctcctttggtctatagtgatactgacagcaatacaaagtaaaatctgtgtatataaaaatcctaagtatgaggtcttaaatgttctggaattttagaaaaaacttaattggatgcaattgtttataattaacaagtcatcttatttataaattttccaatataatataaatctattttgtggaaatttatcactgtgatgtttgtattctctgtgtgtgtgcgcacatgtgtacaaattcacgtgtgtgtgtgcaggtgcaggtagcatagcacctagagggcaacctcagatgtcattgttcaggaaccgtccaccttgagttttgataaggattctccctggcacaggatacaacagttttgccaagcttgctgtctcctaagtcccagggtacttccctctgcctctgcctccctaatgctgaggtta

SEQ ID NO: 18611 - DNA, 1140 bp, Mus musculus
gaacccttgtgtgggctgtttggagggggaggggcgaccagaatacaaaagaagatggtggggaggcacgaggaaccaaacacccttgctgagttggctaaaactctatggagttcgtcctccaagcgagaacagtggatgtgtgcacatctatgtgggtaaagccccccacaccccaatggaggctataatcatcagagaggcctctgttgagtcgccaaacctgcctttcgaaggaccctctgggtaccagctattgcattgagatattcatggcccactgtgttcttttgcatgaaaaaaatttccttttggcttttctgaacagtttctgtgagtaaaccctggctgtgctggaactccctctttagaccaggctgtccttgaactcagagatacagctgcttctgccttctgagtgctgggattaaggtgttcgccaccaccgctcagcggaaaatcctattccaagattgcctctcactttgtacaccttgttctcatcccagcacccagactggaaagctaggcgggtaagagaataaatagaacctggtgacggactgggtattgggcggcaagagagctaaaggggaggattaacaggtatgtttcgaagccggtgagggaaatcctgccttaagtggcatttcttgggaaatgggaaaacagtgaaatccactttgagatgctgaatttgaataagcatgatagcagggcttagattggactctggaactccagtagtcaccccatgcgcacaaagtgggaagcacagcttcaaactttctcccagcctgcctatatagaagtctaaatttggaaggcacttaaagtatccttaagtcactgggcagctggggaccgttttgcctcctacaatggccctttattgagacagattcctttaaaacagtggttctcaaccttcctaatgctaccctttcattgctacttcacaatgattttgctactgttacgaatctgaatgtaaatatctgttttccaatggtcttaggcaacccccatctccccatgaaagggtcctttgacccccgaaggggtcgtgactcacaggttgagaactactgctttaaacactaggtaaataataaggcaggtttcccttgccaactgggt

SEQ ID NO: 18612 - DNA, 1590 bp, Mus musculus
taaacatgtttgccagtgttgctttctttcaaagactggtattagcaacattgagttaaatggttctaaatgcatgagtattttttgagaatgcaggcttgtcttggctccttaactgcaaactattaatcttaaattatgtcttaaagaaacttccatagtgacccatcagatggaatgaatacatttcttcatgggcagccaacacagtgtgtgcttagccaagagccagtgacttaaaaatgaaatcacatggctcatgcaatttggatattactttagaaagcaaaaccagtaagaggaaggcttggatctttagccaccgtgccttggcatgctggcttgcaaagtgctttctctgcaggactctgcactttgcacccaggaagtcattcacggctgctccattgccacagatttcaaatccaacgcagacatttgaagatttttaagttattttttccagaaaggttaatgctttgtgaaggaaatgtagatttttgtcttcaaaagagtgattattaatatcagttatgtatagctctatttttctaggaacaaagtattctgactacttcaataacttttatagctgactacttttgggaaagttaacttttgggatttgaaataattcattgcttaataatctgaaaatggaagtgttagagtatgacagttactttaaggaatggtcgctcccctagtgtaataagcctgttgctggcaatgggcctacataagaacagctgggttttctgataagaaatgtaatttttggaacatagtttgtaagctcacatttactacactgggccaaccttcaacctacataatacttgactaatatgtgatctgaccccttggcaggtggttactttgactttaacaaaacatttgttttttaaaaaaaacatgaaattgagagctctgtgagtggtgtgagcgggagctccagttgtctcggatggtactgtgcagaagggttcagtgtttccacaggggtacaggaggccatccaggaggtggccttcagaacctctgggcaggtttatgtcatggggaggagggctgtgtcagtctgattttcagaagtgctttaaggtggtggtggcctgggttaagtgggttctatgtataaaagtggtaccgtaggctttttttttttttttcaaaggtgtttgttacagcaaagtccatgggcgccaactcaccttgaggttttagagaattatttatttctttacaatgcactttctaacccattttttagctatattagcattatctttaagaagaaaagatgtttttatatttaaatgttgtgggatttgagtgtcttttccaaaaatagcatatttcttgaaagaaaatgaggagctaccttggcctcttggggactatcccattgtttaaatgtgcttcctctcccaagtcagggctgcaggggggttggggtgggggttggggtagggggaggcttccctggttccttctcacttgagccaggtcagtgtggagctgagtgaggaagcatacactcaaacaggatccttccaagccatgtgcagccttggaacaatggacttg

SEQ ID NO: 18613 - DNA, 1488 bp, Mus musculus
gggtggattatctacattgtagatggacaagccagaacatgaaaaacaattctggaacattttactgtattttcacacccaaaacaaaatgctgggtacctttatcctaagaggcataatttgagcagggagggtttccatcaagtttaccttggagggtctcgggaggctgtttgtatgtgtgtgtcttgtcagcatctgttattttgagttcctgaaaattttgagggaaaagaaaacctaatgtgaagtatttggtaggtaaactgtttttgagtgtttttactgttttacaagcagataccatttgaacaaaaaaatgtcattaacctgctgtcttaaggtagtcctacacaaatctggagagcggattggcaataggaaatgtttattttagtactgcatttcagttaagtggttaacagtgttaagaggtcttgggaaagtggagaaggcttttgttgtcttcgaaatcgaaactgccctagtgcttcacgacctggaaaatgggactgtaatcacactattttgatacagtgctgcatatatacatatgtgtatgtatatgctgatcttgttttgttttactaacaagctctggaatatttagcagtcattttcactggcacaagagccttttgtatattaatcaatttaaacttttaaaccaaaaatgttaaggttcagtgtcaggcaaaaaaagatgctgaggagaatgtaacatagaattgatatgtggttatataaaaagacacaaatggccatgatatgggtctgccttgaaacagcacaatggggtgtcagtgtgtctgattctctgagacgctctcgagttggtcctgtctactgccgcctgtgctctgggccacaggcatagttgatggggctcatcttgaactcgagtgcggcaaccttttccctaacttgtgtgtgttttatgactgtgtgttatttccaaagctgttcctacctcaccatgaggctttatggattgttatgtactataaatgttctatatgagacaagactactgtgtttcttctcatttattaaaagttaagtagaaaaataaactaattctaatttctattttgtttgtgcatgtggccctcccctcttatactgcagtgggtaaaagaaatggacttttctagccttcagaggacaagggtgtggaagatgaatgttcaaagtctatcataggaacagaaaggttcactcactgtggggccagtagactgaaaatgctttgttttgagcataaatttatgggatgtcattaattttaacctgctcctattggtgatttatattctgtattcctcccccccccccaagtgcctggattaaaggcgtgtgccaccacacccggctttattctgtagttttaagcaaagttatgaataataattatatctatatgacatctaaaactaatgcagaaggtggcacctcagtgcgagtctatttcagggtagcatagataat

SEQ ID NO: 18614 - DNA, 1142 bp, Mus musculus
agagtctaagatgggataacttggcctctccccctgaggagtcaagggtcttgcttcctagagctgggttcttgtctgtatgacagggtcctcctcctaggggcacagagggagctgtccagggtgctgacccattctgcttcctgctggtcacttccaaactggcagggtttttcagcctgagattcttgttggctaaagccttctggccaatttcagaataaaactacaagcattcttacttagaactgggcacttgtgccaggcagctaatgagatttatcagttcttccttgtctctgaccccacttgtctctgctcggtgataacaagcctggtcatgtcagcgaaacagcacggggccagcccagcagaggacgcctgtggtacagctggggcctgccaagttggcaatatctctttggacattgcacagctatctatctatggactcctggaggcaagagagaaagtcatgggatctggagcagatactagatattacttggggcaggtgccttatacagcagctggacgtagaagtagcatgggaggcaacagaggttgtggggcgggcaggggtgtcaacactgcctcttaccctgggtggagtacctctgcggtgagggctgatgtggtgctgtcctgtcctagatcagtagctctggcagaaatgagagaattgcccgtgtgctgcaataggggtgtgtgtgtgtgtgtgtgtgtgtgtgtgtctgtgtctgtgtctgtgtctgtgtgtctctgtgtctgtgtgtgtgtctgtgtgtatgcgagcagtgagcataaggcttgtggtctgactaccaaaataacgaaactactaataggttgatccatactttgggacaatccagtttgtaggtgaacaatgggcagtatggcaaacagataggggctgagagatgagcttcaggaaccaaaaggaaattccagctggctttaggatttttggtagcatcagtatgttgaaggtattttaagtagcgagactgggtgtagtgataggatgaaaaaatatggatatgaataaggtcaaaatatagattctaaaagcaagaatagatgtttattgtctcggccaattacacaatattaatattaaatgccaaaataccagacag

SEQ ID NO: 18615 - DNA, 1217 bp, Mus musculus
accctccactccaggacagtccctgagggaccaccctccactccaggacagtccctgagggaccaccctccactccaggacagtccctgagggactaccttccactcatcttctaatgaagacgcttcattccaggactggcagcttcatcaatcacagtaaatacacaactcaaacttctagctctggagcctcagagatttgtcgcgtcccccccagaagcttcctgacgcacaaggtacagtccagagcagtctcaggttttcctgactatacctgtgatatttgttcccatgaacctgcttgtttttttttttttttcttctctaccaaagcttaggtgtggcagatgtgtgttttgatatggaagtcctggttagggataggcttgccatccttgggatgtctttctgagaaattctgagatactttgatgtctcctttctatgtgctgccctgggggctctggactaaccttcgcatgaatggtccttagacaggggatcagcagaaccatttcacatttcaagtggcccagctagagtgggtgatgtgcagctggggctttacaaagagttctgtaacttgaactttattggagagtccacacagggctgctgctttctgagacttgtagccatggaggaacatggtggttcctctcacagctgttctgcacagaagtggagtttaaaagccagagaataagatgtccacatgcaggtggtgttgcgcaaggcctctggggagagtgacatcccaaggtcccatgacttttactcagtgggttttattgccttattctcatttaaaaaaaaaaaaaacagaacctgtttttgctacatagataattctgatttttttgtggtcttattttggatattttttaaataaaaattttgagatctaaacacatgtgtcttgatacttcatccttctagacagctgctgacaagtgtcactgtggttctgtttggctctgggttcgtgtgggaggaggggaggggggaagctctaagttctgaagctctgtgtgtggaatttggagggaatgcttaacactccagctataggaactatgaccctgtgaccgtcaagggaaagatcagctgggctttgtgctgtctcattttctaagtgatagtgtcccgaatcgtgcctaggaatgccagttcaatggaacaggtgcccttgcaaggcacaccctgccatcaggg

SEQ ID NO: 18616 - DNA, 1214 bp, Mus musculus
gccagcatttttttttttttttttttttttttgtcttaaggccacagaccaaaccttgacatgacattctgacagatatgattgtttgtcagttgtgtttgctggaggtggacattgggctaatggctgttgagtagttagttgtgtatacagtctgctaagtctcttgtggaccacataaagtcttttttcctggtttcctggagtgttatgtttggagcggagggttggacctagggtctccaacatgcaaggcacatgctcaaccaccggccacactgcagctatgctgcctgcagtggttgccactgggtaaatcctttgttctcaactcttattctttgtagcttctctcctgggggaagccgtctagtccaggttccccagccagctcctctgtcaggggctggtgccatcttaaccactaactcacaggctgttccctctctcgtcgctcttgcagagaaggtggtacaagacagagaacgagtattacctgctccagtttacgctcactgttcgctgcctgtactacaccagcttcagcctggagctgtgccggcagcctccgtctgcacaacctactccatctgcgcaaggtgcctcccattcctacccgtggctgctgacctacgtcttctattatcccgtcttccacaacgggcccatccttaacttcccggagttcttcagacaggtagagtcctttggggaccgggctggtgaaggtccctacctcttagactgtgagatgtgacccccaaatggggtggcatactgaatatggggttcacaaaagtttgggaacagtaaaaggtttttcaatgtacgatcaaaagtaactcagagtctaatgggtgatgactggtgttttctggcagtggttgcccatcttgtattattgtgaacatagaatagtaaaatggctgcagtgtggctagggccatgttataatatgacatctttcaatgccagagcacctcgctcagatttcaggctctcctgaattatgagttgcaggtttgaagaaactgaatggtttgattatgggaaacaaagactttaatatcttcctgcattatttcccagcatgtgagtcctgagttagtctttggattaacttgtgttagaatgtttgactttaaatttcttatttatgtatttgtatgtgtgtgtgcatgtgcttgtgtgtgtgtatgtgtgtgtgtacttgt

SEQ ID NO: 18617 - DNA, 3168 bp, Mus musculus
aatcacattgctagttgttcttcacaggttctttttcttactttctttataatccaagattcttctcttcatctgtcaattgcatgtggccatcggtatcattgttgccagccaatgatactaaaacaagatgaggcatgtggtaaagcaccttaaagccacaggctgtgccctctacactgacagtactgatgatggttacagccataacttagtaaagagctaacacaagaatgtactgtcttatttgactcacaaaatatgaagaggcaagtaacatcatcagtgttttattcatgaggaagttgctgcatggagaagctgagctgaccccctaaggctgccccctcttaagaaaacccagtagaactgggattgctccaaacccactcatgcgcattgtatcttaacccagtttattacgggtgagaggaacagcatcatattgggcaattcttgcccagcttatctgaatggcagagagaggcccaagagaacagagctgggaaagagagacgacagtgcagggggcttgccttctcaggacacaaaccatacttcggtatcatagtttgtatttttatttaaggacttgggatctgtttgttgtgtctacactgtacttcgattctgaagatatattaactcacggtatttccattgcctgtatacacctttctatgctgtgaaatgacaggatgtctgataacctgtacttgtgtcaggggtcagaggagagaatgttgccttcctgagcacacttacccaagtttgtttctatttctttgttaaagtttgttaatattagacaagattcccacctaccctctttcccttcactgttagtgattactatgtcctagagtctttatgagccctttggctgatgagtaaagtctctatggtagaatcaacactaccattgtgaaagtcttctgtgaaccttgtctactgagtaggtttctttttctcctaatgtatgaggaccccagctgtgtgccatgtgctgcggaagaggctacaggttggatgggcagtcttccctcatcttgtattttgatgtactgagacagcatcgggtggtgtctttcattgtaatatatgaggtgtagagagaggcatgcgcagggcattggggttgagtaggaaagttacatggtgagttctattagaagacaagaaaagaaatactgttttgactcccatcaaactcccctttattaaacacagacagtggctcccaagtagtaatgtacataagaattctgtccaggttctagccagagattctgtctcatttggtatagaggaaagtctgagggtctagatctgaatgagttccctaggaaatcctagctgggcagtactgggaaataatacttttgtttcttatctgctgttgctggcagccgattctgtgcccatagattaagtcttgatgtggtggtaggaaggtttgtagtctctggtatctatgaggaagcaagcctctatcacattttctccttctgatctctctcaggttgcttaacacaatttccaaaactataaaaccgagattttataaagtcagaggaaggcctttttaaaggtgaggatgacattttggcagctttgttgaataaatactgaggatattaatatgtcccataatgcaccaacatttgtttgccgggggaaatgaggacaattttgacaagtgtactgacactgtactcaagtgttgtgagtgattatttcaagcacagctagacatgtgtggtgatacttccaaataatttgagtttaccaagagaaaaactgtagtagtaacgtattttataatttaattttttgtgtttatacatagctatactacaataactttagcgaaaacaatatagcaattctgaggaactttcgagctgatatgaaggggacagcctttgcctgagctggcagtgctggagatgtcccagcaacttggctagacttatacctgaattctgaaataagcaagtatattggttctgtttctcagtgctggagctacgatctgttagagtctgataagtgttgtgacctagtctttttctaaaacccaagaggttcatcactactccggggcattgcttctcaaaaataatgtactttttataggaaaactcaatcagtggatctttttattcggtatccctcctcttcctccccagtccctcctctcttcctttctttgagtttttgaggcaagaagcttcctgaatagtctagtttctacggagctttcgtacttatttttctaataataggtgtagctgagtgatgatgtttaactgctctgtgagcagaattctcaaccaacctgaagaaacatgctgcctatgggtgtttcctttggtctcaactgtgtctgacctgtttgctagtgactttcacccatgaatggactttgctcgtgtgcatagtatgtccatgtacatagtatgtccatgtggtcatcagcagtgctgtgttgttatcacatatttatatgcacttggtcaaaacagaagctgatgagtgtgtgagccatcattttgtagagtgaacggctgaaccccctttgtgtcattggagtcacgttgcgcgtctgttgcctttaaactctcataccttcttttgtactctacaccgactgtcgcggtgcctttttccttttgtataattgtattacattaaaaaattgctgacctgtgtgtaaaatgttaaaactacaccagtccaaggagattttaatggcagtccagttttccagagaataaatttttgtgtgcattaaatgttacgtttcttcacatttatgtgaaaacaaaaattgtttccattttagtactcagtggagtgggtaaacatccagcatgttagatgatgattcataaaactcagccctaattcaaactgtcaaaaaagtattactatgactgttatacacaatgggccaatgtcacttacatacagaaataatcaagtgggtctgtttgttcccaggatcatgtctgaaaagagtcacatgtgctgtcaaactatctggatcatgttttcttcaccacgagtcagatctaacctcaaaaggaaaaatagactccaggcaaacatttttaatgactccttgaaaagttcatataaatcaagagtggaaaaagttgcttt

SEQ ID NO: 18618 - DNA, 1326 bp, Mus musculus
tttcatgaaagtctctttgttatgtcaggaagccataactgtgtctgatcagagctaacaccagaagagaagtttccattgcagaggagaatggatggattcccagtagatagacaaagttgagcaatgccagctgtcagattaagtccaatgctcttccacctagtgtgctgctgttttctgtgtagggaaaaatttccatattcctcaactaagactgtgagcttagtccattttccactgtagctttggtcgcctattttaaattttgacttaaagaaaaatggatttactgcctagttcaggcatcaccctccaatctgctctcaaacaacttgaggacaatgtggatagtcaaccacaagccaagactgctgacaatctaaacacagctatgaagatgtgctgcagctatgtgtcaggataaagtggctccaagcacaggcaagggtgcaggataactgaagtgtgagctatagaaaaggcatggaggtccccccccccgccccccgccgggcatcgggacggggtccggtgcggagagccattcatcttgggaaactgggtgcggccggaaagggggccgccctctcgcccgtcacgttgagtgcgcgtacgttgtgtgggacctggcgctaaaccattcttagatgacctgcttctggggtcggagtttcgaacgtagcagagcagctccctcgctgcgatctattgaaagtcagccctcgacacaagggtaaaaaaaaaagaaaagaaaagaaaagaaaataccatactgagcagtgtgactttactatgcagacaattagtatgtacccttctgcctgagggaaagaacttcagatagttcctcaaacatcttatcattggtagaaaatcctggatgtggttgatcatcattttgtatgaaggggaaagtaaacaaagtacattttgctttttcaccagaaagtattttataaatcatgatcatgtcttttaaagacatatgaagtcttacatctcacattggtttgggatgttctatggctgttcttattcatgaaccaaatggcacacgtcacctgaatgtacaattctctcagagatgttgtcactctgagaccaaacaaaatccttaccctgattataagacttttcaccacatatggtgagttaatgatacagagagagagagagagacagagacagagacagacagacagacagagacagacagagacagagaaagggagggagagggaggtgtatgttatgtgtagtgagtggtgtgtatgtggtgtgtgtgtgtgtgtgtgtttgtatgtgtgtagtgtgtggtgtgca

SEQ ID NO: 18619 - DNA, 1174 bp, Mus musculus
aagtggcacccatgcataagccatgcctgacaataatacactggatcttgagcctgtcgctgcaggggcattttctttgctctttgacctccacattctttctcttcacccttggctcccatcacttcagctacctcctggctgtttacccttttccagacttctctctcacaccccattcatcatcctgggtcagatttttctagtcctcactggggagttctttttatccctcacaaccccaggttctccagtggccctagactttgatgtgtctgtctagagatgataaagcctcagaggtctgcaaagtatgtttctctgctcccctcactgtaggtagtgaagggactagatacctgtgtatttgggcccagatgaggttctaaagcagacagaaatctgccaggaatttcacctgcccttacatttttgactagttacttttacttagctttgtgatacctcctctgctgggatgtgcatgtgaacttgtctgctacctaagacaggcttcttggcagtatctgttctccaagagtctgtcttaaggaaaaagataataagaactgatggtgggaaggaaggcgctgcttaatcagcttccttgaggaaaacagttgactcctattctaagactgagtcttggtttagaaaaaaaaaaaaaaaaacactggggaagagaagctaggaaaacaggatgaaacaggaatttctttactcatgtaatgagcaaacactatatggaagaggttggggaatgtgagattctgcctgctgggctgccatctcagtacctcctctgcctctctcttgtgatattgacatctaccatcttgtttcatttagagactgtgagggtgtgaaagggagacccaaacatggtgcaacctgaagacttccaggaaaggtattagagatctgaggtcattaggacagagagaagaagactcagagcattgattcagttcaagagggctaggtccctaaagcaaagtgctaggaggtaacctcttacccagtctggaacacagcatcttgatctttgagaagtcacccatcgacctttgaacagccacttatgccagtgggatggtgaacagtgtttcttaaaaacactgtgactggtgtttactcagagctgtatagtttacaaaacaattcaaatctttgt

SEQ ID NO: 18620 - DNA, 1148 bp, Mus musculus
taggaacagaagacaggataactctggctcgcctttttttccatctcagcaccgttaaagactttctgagcagctgctactgctcaggctgatgtcgagagtgctgttcatcaagaagtaaaaaaaaaagaaaatgttttacatccctttcaacagtatcttacccacacccttttcagtgtgcctacctggtatatcccagcagccacttatggtacccgttcactgcctctggcatgcttcactgaagatgtttggagagtatggagagaatgatgggaagagagcaaatcaaagaatgtagatgaagggagaagggccaacctgaaagatagtctagacactttgctaaggattccatgagttggacaacttgggctgaaaaagaagagtggccaaggggcacaattatagaaaaactaaggaggaaaattcagctagagagaggccatgccatgccaggagggtgagttattgtagagtcttgctctcattttagctttctacctatcattccaccagttctttgctttagtttactagtcactgatagtctactccctggtggagaggagagaaagttgattggtcactgttcttgctgttatccaacttgaagatattttggccttttgtttaaaaagaaaaaaaaagttaaagctaccacccttcccctcaaaaagccatttatctttggggaggcatgaattctctcttaaacctacctagctttactttatttcattgatctacacaaaaggcaattctctaggaaaggaataggactgcagagggtttggcaagacagagttctagaggactgtattaagatttatccctcaactgaacaacacctcttgccttctgtgtggatcaggcacttctgtgtctgatgttctacctctttctgtggtttgaatctcaaaattacttctgatccctctttctttatagagtgcagtcattgaactcatgggcacactgtgatcataccgaaagagggaactgtgtccttcactcattcatttggagaacaatcctaagtactaatcgtctgccaagttcttaaaggtcctacagaccagggtgaataagacctcaaaggtccttctttcagcaaatgcagattctccaagctgctagaccta

SEQ ID NO: 18621 - DNA, 1198 bp, Mus musculus
catttctcctctctcgcctcttcacgggaactctccggaagactagcttttctaagctaccacttcttcccaggaaactttgctatttttactgcttcttcccctactttatggaaaccaaggtattcactgacatgtgctcccttgcaagggtacagccagaaaagtgctattttaaaatacatccttaaaaaatgcatcccttataacttcaagacactgtggatttagtcaccaacttctatcttgttcacctgttcctgaatgtctgtctacagaggccaggacaactttctgtctggagtctgctcaatgttttagagcaacagctcaatctgatcccttgggcccacacagaaatctcattggttcaacctagacaggacagtggaattagactttgaactgagcctctgttttttgttttattttattgctggggtttgaacccagagcttcacacagcttctttaggcttccaagtagcttgagctaccaggcccagctgagctaaacctcctgacctgagctcttcaaaggaatactcttgctctgaggcccttggccttctctaaattacgtgacttcccccttcctctgactcctgggggagctgtggcctcagtcccctggcagattcctttcagtctgtgcctttcctagtccaaaccccttcactattttataaccctttgtgatcagaggttcagaatatctacaaagactataagcttcctctcctggggttaaggggagaacaggggtcctgattttaatgatggctaggaacaaaactttccagagatgagaggattgggtgtattctcttctgaataaacgtgatgagtgaaaatgatgtaattaaattgatgatgaaatatttgatgtggccctataatgctgactgtgctaactgaccgactggtttccatatcaggcttgggaagattgtatggcagtatgggggaagtcaaccaaggagaagactgccataggagagggacacaggtaccagccagggcacccagaacttgtaactttatgaaaagttcctttccatgttgagaggcagagaggttgaaagctttccatagtagggagaagggcaggctgaaatgttctttcaaaggggtgaggcatgttaggtattcagaaacatctttctgagaagataggcatataagcagctgcatgcaaa

SEQ ID NO: 18622 - DNA, 1256 bp, Mus musculus
ctcacctccccaaaagatacccagagccacaggtgtgggtcttatcagtacccacgggaggaatcgggtcaatgtccacccaagccaaggttaaaagcccactcatctacggatgagaaaatcatttgatcacctcagttaagcattgccttattttaacttaataggggggagagagattggagacgtactattgaaagggcaagcccttcactgcctcccacccaaataaaaaagccaattggccttgtactacaagagccggtcgaactccttctccctgtttcccacctatcatccaaaaatgcggaggaatatcaacttagtgttattttcacatttgttcagtcaaacttagccagagttccaacgccctacttaaaattcaactagaaagttacctaccaagtactaattagcattataaagtcagagtctgcagctccaggcctttcagttagttgtttactaagaaaggacagtcttaagccagatacagtttaccataagaaaagttaaagaatcccagtgaagcaagttttttctttagccctagattccaggcagaactattgagcatagataattttccccccttaggccagctttttcttttttttaaattttgttaataaaagggaggagatgtagtctcccctcccccagcctgaagcctgcttgctcggggtggagcttcctgctcattcgttctgccacgcccactgctggaacctgaggagccacacacgtgcacctttctactggacccgagattattcggcgggaatcgggtcccctcccccttccttcataactagtgtcccaacaataaaatttgagctttgatcagaatgaatttgtcttagctccgtttcttctttcgccccgtctagattcctctcttacagctcgagtagccttctcagtcgaaccgttcatgttgcgagctgctggcggccgcaacactacctatctaaaaagctagacctggttgccagcggttggccctcctgcctaaaagccattgctgcagtagccctgcttgttaaagacgctgacaagcttactctgggtcagcatgtgactgtaattgctccccatgctctggagagtattgtacagcagtcccctgaccagtggatgactaatgcccagatgacccactaccagagcctgttgttaaatgatcgagtgactttttccccacctgccatcctcaatcctgccaccctcctccccgagatggatgactccac

SEQ ID NO: 18623 - DNA, 1131 bp, Mus musculus
gtctgggtggactctggtggacctgcccaaacttcaaacccttcagtactggtcattttcctctgctggtctttataactggaaaactagccactccccctttctcagaggatccccaacacctcacagggttggtggagttccttgtgttctctcatcagcctacttgggatgattgtcaacagctgttgcagatgctcttcacaaccaaagagcaagagagaattttgttagaggctagaaaaaatatcttgggagccgacgggcagcctacacagctacaaaatgagatcgacatgggattccctttgactcgccccagttgggactacaacatggccgaatgttggaagagcttgaaaatctatcgccaggctctggtctccaaggtccctcaagacagcccactaatttgggtaaggtaagggataatgcaggggccaatcgaacctccctcagtgttccttgaaaggcttatggaagccttcaggcggttcactccctttgatcttacctcggaagcccagaaggcctcagtggccctggccttgataaggcagtcagctcccgatatcagaaagaaacttcagagattggaaggtgtattacaagagggtgacagttaagtgatctagtgaaagaggcagaagaaagagaaaacaggagggatcgtagacaagagaaaaatttgactagaatcttggccacagtggtaggagagaaagaaaaaggcaggacctagaatcctgggcaacagaagctaaaaaggctcaactgagtcagactgagattacttatttggaatacacccttcgagatgggaagcagtggctaaaggaagccagaaaaaagactaactcagatccccaccccaactacaccaaggcaagtaagagaatttttggacaccgctggcttctgcaggctctgggtttgcgaccttagctgtcccgttgtaccccctatccaaggaaggagaggtgtttgtgtggaccccagatcaccagaaagcctttgaagaaattaaaaaggccctactgatggccagccttgggcttgactgacctaaccaagcctttcactctttatgtggaagagagagcaggggtcgacagaggagtccttactcag

SEQ ID NO: 18624 - DNA, 1167 bp, Mus musculus
gttacaatgaagtgttttaattgcaaccctgatctttccgagcttgaagtggtgaagcctgaggacagtgggatagaagcttcctacagtcccgtgtgtttggaaccttcctgtaatgactgtgttagaaaccatgagaggttgtctttcatcgactcaccaattgtgggacatgataacaaggaaaatcaacgcgtacaaaacacactagatagttcaaacgaaacagaagagctagaggccagtagactgtatgaggacagtggctactcatctttcacacaaagtgaccgtgacgatggcatccttatcctggagaatttcagaaacagtccccaggcccgtctgctgccatcacagagcccggaccagcatcccaacaaaaccttgctgcctgtcctgcattttgaaagagtggtttgctcaacactaaaaaagaatggcaagcgaaaccctaaagtggatcgagaaatgctgaaggaagttattgccagcgggaactttagactgcaaaatataattggcaagaaaatgggcctggagcacctagacatcctggctgagctctcccgcaggggattcgtgcacctgttggctaacattttgactaagctcagcggcatggacttagtaaagtgagtttgagggtgttgcgcactgcatgtatagataacataggacctggttgagcagaccaatgtaaagtggtcttagtgctgacttccttttaatgtttggttgacatttgaaatggaagaaaatctatggaaatctgcatccagtcttgtcactttgaatttcatagtctgccattagaagaatgtattctatactgaattatctggctagctgcaatgaaatgggtagataaggtggtttctattagtgggtggtttctgtattcagcattgtgaggtgtgctatttcagttgatgtaatagatttttcaaaattggttacaagttagcctaatatcctgtcacactaaggtggaggtgtatacattgtactggtgtgaaattgcttatcctaatagatactcaagacaaaaatggatatacaacaagcttggtgggagtttttttaaaaacttaaaaagttttggctggctctttggtagtctggctaagcactcataactgggctctgtcattcccagatcttaat

SEQ ID NO: 18625 - DNA, 1147 bp, Mus musculus
ggtaatgggtatttaatgtctgtattggaggcatggttctccttcctggtttaataacaaattcaagatactaaaatacacatggatttctttttcttccaggtggcaaagacattgaagaacaacgaaagcctcaaagcctgtgttcgctgtaatttccctgcaaaatatgaccactatttagagcgagcagtctgcaaacgggaaagctgtcaatttgaatattgtacaaagtgtctgtgtgcttaccataacaacaaagactgtttgaatggcaagatcctaaaagccagctgtaaagtgggtcctttgcctggaactaaaaagagtaaaaagaacttacaaagattgtgatagatcaactgtagatcttggctactttaaaaagaaaaaaaaaacttcaactttaatttaagaaagtaaaaataattatgatgccttttgtgaatagagaaattaattgtccataaaaatgccaagattgacttatgaaaaacaaactggatatctatcttagatactaagataaaattgagtggacttttggcaagggagggttgtggtctttttatggagtcttgagaacatttgcttcagtattcgagattcgctttaccaagtttgtatcatacttctatcaacttgagtctgtccatttaaatgtttgtcaatgtgagttttttttatatctgtgaatacctgttttcaaatgccaaataaaataatacacataattttgtttagttaaaataaatttagaggtgtaatgatgtgtgcaggttttttttgttttttttttttgtttttttttttttgtttttttttttttttgttttttttttttttgtttttttttttttttttggttttttgagaccaggtttctctgtatagctttggctgtcctggaactcactttgtagaccagcctggccttgaactcagaaatctgcctgcctctgcctcccaagtgctgggattaaaggcatgtgccaccacacccagctatatgtgcagtttttatgaatgtgttagacctggaaataaagtgtgttacgctgtgaagggaattgggtggatcatgtcccagagggcttgtcttagcctccctgccttctcccaccaacttatagtcatacaggtaaac

SEQ ID NO: 18626 - DNA, 1630 bp, Mus musculus
ctgagcatgactttaattggatagttgagcacatgaagagcagcaatctggagtccatgtccacctgtggggcctgctgggaggcctatgctaggatggggaggtgggcttaccacgaccatgcattttggactctgcctcatccatattgtgtgatgccccaggtcgcccctgacttatacgctgaactgcaaaaggcacatcttattttattcaagggagatttgaattataggaagctgatgggtgacagaaaatggaagttcacctttccgttccatcaggctctgagtggcttccaccctgcacctctctgtagcataaggacattaaagtgcgagcttcaggttggtctgcagcctgggcaggcggagcagctcacggcctctgatccccactggctgaccactggcaggtatggaatattgcagtttgatgggccactttgacgccactcaggagttcctggttgcagagaacattctgagtctcccttcagcctcagtgcatggatttaggcctggcttctcctcagcgtgagcagcccctttcctcagctcctgtgtatcttacgtacagtagacgaggcttccttggaatggtttgccccgctgcattggtttgggtttaagctagttatacttctgtcactattctaagttaaatgcaaaactttcaagtagttttaatgaactaatttttaatttcaaagactataaaaaatgtaagtgaattttgctttaaaagttaatttaaatgttagttaatcctgtttgtgtaaagcgaatgattgtttactagctaggaaccttaagtgttattgcacttggtttggctcttgagttagtggcccagtgaacacatgccttgtacgagctctcccgggaggcgtgtgcatgatgcttgaacacacagaattacctcagacctgaactacagcctgctctcttgcatgcttaagttttcaaagcccattttcttgcatagatttgtattttgattggcctgtggaatgggtcaaagcacaaactggacatcgtaaagagtgactgacgaagtacgagtacagtggtgtttcattgtccctatggctgccatgctgaagtccccgccacagtgatgtccagatgagcccagcgtcagtctgcagcagcagactgttgagtggaggtgactgttaagtgttgttttagacactgccaggctgagctcagtctccatctcacactgtgtgtccctcacctcagatgttgtgacagtccataaattcagggtactttgtttcaaaacaaattggaaataaaattggaaatgctttcttatactggaataataaaatggattttacagagagctctcactggtttttatttgcttttgggataagtgaagatgagcagcttaaccctgagatctgcacaacacactaccttagctgttacctgcagtcactgtgcggcgctgtgacagtgatgctgcaccctgctcttctcaggttgggttcttcagggtacgtgaagccctccgcgatgtgctgcttcctcgttcacatgtctgttttaagcatcaactcagcaagctgtaacttcatgcagacctggcattcagaacataaatgtgtggattggct

SEQ ID NO: 18627 - DNA, 2914 bp, Mus musculus
tcaaacaaccgaagctgtgaaaaaggtcgaagaaactgtggcaacttcagagatggatgaaagtttggagtgtgcaggtgcgcaatcattaccagctgagaagctctccgaaaccggtggctacgggactcttcagcatggagaggacaccgtgccccaggggcctgagtctcaggcagagtccatcccaataatagtaactcctgctcctgaaagcatcctacattctgaccttcaaagagaagtgagcgcatcccagaaacagagatcagatgaagataacaagccagatgctggtcctgatgctgccggcaaggagagtgcagcaagagagaaaatcctcagggctgaacctgagatcttggaacttgagagtaagagcaataagattgtccagagtgtcatccagacagccgtcgaccagtttgcacgtacagaaacagcccccgaaacccacgcttctgatttacagaatcaggttcctgtgatgcaggctgacagccagggagcacaacagatgctggacaaagatgaaagcgaccttcaagtctccccccaagatggaacactcagtgccgtagcccaggaaggacttgcggtttctgatagttctgaaggcatgagcaaggcttcagaaatgatcaccacgcttgcagttgaaagtgccagtgtcaaagaaagtgttgagaagctgcctcttcagtgcaaagatgaaaaggaacatgctgctgacggcccccagcaccaaagcttagccaaggcagaggcggatgcctctggaaatctaaccaaagagtccccagacaccaacggaccaaagctaaccgaggaaggagatgccctgaaagaagaaatgaacaaggcccagacagaagaggacgacctacaggagccaaagggagacctgacagaatcctaagacgtgaggtaggtaaacttccttctggatggctagtcctcctccacccgtttccctgccccatctatgcaattacacagacagataactgattttatacagaaccaaccttcagttggaaataattatcaactacagttggatctagggtggatatttgaattttttgtttggtttggtttttttgtttgtttttttttttttttacctcatcagaatcccaagtcttgctgatataatgaaaataatggcttaattttgctgctgctgttgttgttttgagcccaggtctcactatgtagtcctggctgtcctggaactcaccatgcagaccaggctagcctcgcctctctccttcccccactgagattaaaggtgtgcaccatcacacccagctcagccaaaacttttaacactttaatttagggcctggagctccccatacccagagctccccattcctgtggctcttgggcagttatcctgttgtccatacaatgaggaaagaaaggggaattttatctcttctctctcttctttctccagttgctcattgtaaaactagaatgtgaagtgaagtcacggaacaagatgctgctgttgggaccttgagaccaaaatttcagagcccttgaggtgcagagagcagagccgtccaatgatttcaaccctgcagagcaccccgacaatcctgaggctgcatcgggagctagagccagctaacatttcctcttttcaagactgcccttgatttgccccttggtgccatgtatttcagagttaaggtcctgctttctccacctggaaccaatgtcggcaatacctagtcccacttctcaaactggagcctcctcctttatgtatttatatgtatgttttatgtagtcctcctcctgtacctattgtatattttttttctaaggtttaagcacatgccttttgtattatgcagtatataatgggtgtgcagccatagcgaagctttgagaagccccaagcctcaactgtaacctgcagcaaacagagaaataacattcctggcaggaagatacaagtctttttaaagtttactgatgcttaactctgtgggctcgtagtcctctgaaagtggttgttttcctatgcacagtgagctcagaaataaaaactccattttgagacattcagaatgtcccaacattacgacaacattttttttttttttttctaatccagtccaggttggaaagaagtctccttagtgtcagattaagccccatctcttaacaatatggacagatgagtgtgccatggccatgagctatttcctaacgcagaaggaatttgttgttactttttggattgtactcttctaggctggaccgaattcatatgcagattgaagtgagacctgctctttacagatggtattttgatagatactggagtttgtctgtattatatctgtgccccttcttttaagaacaatgttacattatgttcctttggataaattgtgatttgacaactgatttcaataaaaatatttgcttcacttatattcactgtttttttattaaatactgaggggcctggatcacatacttactataagatactggcaaggagaagacaatgagagaaactttcttactagtcaccccatgaagacattactttgtactggtttgttacagaattagaagaagtcatgacggggtgggttttgttgaaggaaaccagtataaccaggaggtggggtacaaacctgtaatcccagcccttggaaggcagaggcaagagaattgctggaagtttcagactagctaaaaatgactgaggctttattttaaaagcataaagacaaaacaaaaaacaacctgctgaacatggtgaagaagagacaggtggatctctgagtctgaggccagcttggtctacaaagagtttcaggacagctagaggcgttacatagagaaaacctttcttgaaaaaccttaaaacaaaaacaaatat

SEQ ID NO: 18628 - DNA, 1757 bp, Mus musculus
ggcatccttcaaaaagatggtgacacccaagaaacgggtccgaagaccttctgagagcgacaaggaagaagagctggataaggtcaagagtgccaccttgtcctccacggagagcacggcgtctggaatgcaggatgaggtcagagcggttggcgaggagcaaaggtcagaggagccaaagcgcagggtggatacttcagtgtcttgggaggcgttgatttgtgtcggatcgtccaagaagagagcgaggaaggcatcctcttcagatgatgaaggagggccaagaacactgggaggggatggccacagagcggaggaggctagcaaagacaaagaagcagatgctcttcctgccagcacccaggaacaagaccaagcgcacggaagttcctcacccgagccagctggaagcccttctgaaggggagggcgtctccacctgggagtcatttaagagattagtcactccacgaaaaaaatccaagtcaaaactggaagagagagccgaagactccggtgcagagcagttggcctccgagatcgaaccaagtagagaggaatcttgggtttccattaagaaatttattcctggacggcggaagaaaagggcagatgggaagcaagaacaggccgccgttgaagactcggggccaggagagatcaatgaggacgaccccgacgtcccagctgttgtgcctctgtctgagtacgatgcggtagagagagagaagctggaagcgcagcgagctcaggagaacgtggagctgccccagctgaagggggctgtgtatgtgtctgaggagcttagtaagactctggttcacaccgtgagtgtcgcggtcattgatgggaccagggcagtcaccagtgccgaagagcggtccccttcgtggatatctgcttccatgacagaacctcttgagcacgcagagggagtggccacaccgcctgttggagaggtcactgaaaaagacatcactgcagaagcaactcctgcactcgcccagactttaccagggggcaaagatgcccatgacgacatagtcaccagtgaagtggattttacctcagaagcagtgacagccgcagaaaccacagaggcgctccgcgctgaagaacttaccgaagcatcaggggcagaagagaccacagacatggtgtctgcagtttcccagctgtccgactccccggacaccacagaggaagccaccccagttcaggaggtagagggtggcatgctagatacggaagaacaggagcgccagacgcaggccgtcctccaagccgttgcagacaaagtgaaagaggactcccaggtgcctgcaacccagactctgcagagagcagggccgaaagcactggagaaggtggaggaggtagaggaggactccgaggtgctggctaccgagaaagagaaggatgttgtgccggaaggacccgtgcaggaagctgaaactgagcatcttgcacagggctccgagactgtacaggctaccccagagagccttgaagttcctgaagtcacagaggatgtagaccgtgccaccacatgccaggttatcaagcaccagcagctgatggaacaggctgtggcccctgagtcatctgaaaccttgacagacagtgagacaaatggaagtactcccctcgcagattcagacactccaaacgggacacagcaagacgagaccgttgacagccaggacagtaatgccattgccgccgtcaagcagtcacaggtcactgaagaggaggcag

SEQ ID NO: 18629 - DNA, 1531 bp, Mus musculus
tggagcactacatctgagtctcgctgtgtgtctgtttgggggtccacttatatgtgtgcttatacacacatgtggacggggagtagaagactaacgttgggtctcattcttcaggtgatataccagggttttgttttttggttttttgttttttgttttttttttaagatttatttatttatttattttatgtaagtatactgttgctgtcttcagatattctagaagagggcatcagatcccattacagatggttgtgagccaccatgtggttgctgggatttgaactcaggaccttctgaagagcagtaggtgttccttaccactgagccatctctccagccctgatataccagtttttgatattggactgaagcacactaaatagacaaggctgactggccaggaagctctgcctaattctctgccctaattctcatttcttacacagaaaacagctcacacaagaatcccagcctttaaaaccacaacacaagtaagagtttaacaccagaggaaaagacgacttggctctgagaccccaccccctctttttcagagtcttcaaacaaaaaacgtctccttgcctttttgctgcagttggagaagaaaatgaattttgaaatcttgtgatgcaatgctggagcaatcctgagacaggccaaagaccgcttcctcatacaagattaactctgtttccagccaagtggtgttcaacagaaggacctgcgccacatctggaaggagtgaagttactcttggttccgatagtgtttacaccatttctgctgcttatactttagaaagtttattttatggggactagggctttgcaagagtgtgaactaaaagctaatgcttccgtctttggagttttctctttcatcttttttattcttcctttcctcacctgtgttgaggatgggatgtcaggcctctgcttgcaccgtccagcgctgtgctgccaaactgtatttgtttttgtctttgaactgaaaataaacatgtgttctagaaaaccgtgttcagctagtaaagccactcactgatgtcactgtccttgtgaagccttgggttgtcacctggcacatttgtggcagagattgcaagtgcattcggagctttataaatgacaagaagacaatcatattgagagaaatgtctaggcagcccagactgtggaagcctggctggtctcctggagcaaagtgcactacctatccacaatgacttccgggtctctgtgaagtctctttccctaaccctaacctcttccaccatgaatgaatatcaatggccattcaactttctggtcccacgggggtagaagagtgcctcttaaaggtcaggtgtttggcaaatgtttttcctttggcccaaatgaacacaaactagagaacgttctatgacccgttccctactttttgacccttccttgtccctccattccctgccttgcaaaaatataaaattatgtagaacttaaaacaaaaccaaggattcagaaacaaacaataagtgattgtcctcg

SEQ ID NO: 18630 - DNA, 1180 bp, Mus musculus
cagaaatgtgctggcaaaggaaaggccttaaatttgtaattttacatgtatttatttattgagtgtgtgtgtgcatggtatgggagtggaggggcacctggttgctgaggcatatagtgagattgaggctggcttgggatacctgagatttcatctcaaaggaaaaaaaaacaataaaaaaaaataagtggtacaatgcctgctgggtaattcaaggccctgaattcaatctttagcactgtaggatggatggatggatggatggatggacggacggacagaggacagacagatgggtgggtgggtggatggatagatagactagtagatggatagatggcatagaagcttgcattgcagatagtgacatataaatgtgtattttcatttatttattgattcatggtctgcaagccatccagtggcagggcattgctgtgtggttaattctttaccccacactggaaccggatggcaacctgccatctaggattcaccattcactccttcctgcttgccagagctgtggagataccagccaatgtactccgtcgtaccccatgttttgctgtctttttgtgtgcctgaggactgcgggggcattataaacgtgggaagacttgagagtcacatgtgcctagtaagcttgttctagagcatgacaccatgaaagggacgcgcaacattaaccagacaactcagccctgactggggccgttggccacagaggaaacttctgcataacctaaatgacagctacagtacagatccgatggcagcccccgtgtttggttaagaaagcttattgtggtccttctatgcacagtaacgggcacgcttgcaggaccacactggagtagaaagctccattgtggtttgaggaggaggatgccttttgtctggtgacccagctaagggaacctgagccaagatcatatcggtgatggaggtagaaacacctcaggatcttccagtgttgtttttcacttttttttttgttcttggaactggttcctaatgctagcagatctttggaatcctgaggcatttcctcagggctctgagttgcagctttgggtcagcgccctcttgaactgccggtttcattacaacaaccatatgcttccctactcactccctgacctcccccccttcctcctctctcccacaccctaaccct

SEQ ID NO: 18631 - DNA, 1196 bp, Mus musculus
gttctctagtgttactgtggaaattaaacacacagagtcaatgagcacctgtctggttttgggggagggggtattttggtttttcctgttctacccagtgattctgtctgatagactgaatgaatgatcaaaaggaggtgttatgtaacttcttgattaaaaacccataataaggttgggtgtggtggtgcacatacctttaatcccaaacgctccagaggcagaggcagacagctctctgtaaatttgaggccagcctggtactacagagcaaatccagaagagccaaggtttacacagagaaaccctgtctcaaaaacaaatcaaagaaaacaacacttgagtcatgttaaaggggattctttctacatgctttttcatcgtgtctgatttatttaaacacgtgaccacttttgatgttctcaatatattcagtgttagggagtgaagttctatataaaccgttagtctttctctcaaaacatcactaagtgaatacagatgcagaatccacaaacgttctcatcaccaggacggacacccgtgcagagattgacttggtgtgtgagctcgctaaacgggccggtgcctttgatgcggtcccctgctatcactggtcggctggagggaaaggatctgtggacttggcccgggctgtgagagaagctgcgaataaaagaagccgcttccagttcctgtatgatgttcaggtaagtcgcatctaccagtggagtggcagctctcgtatcttgtagaaggccagcgcttaaagcactgtttatatgacccatcttatgtggtcttcttggagattcaacagtgaaggaagctcatgactaaaggcgttagccatctgatgtgcccttctgctttcaaacattgggcccaagggaggggatggctctgggtgggaagctatgctcacagggattgaccttccaacaacaaggcttttgaacagtatcaaagctactcaattacaaggcatgcttcttgtatctcctatggttcttttgtgtggtgtgtgtgtgtgtgtgtgtgtgtgtgtgtgtgtgtgtgtgtgtgatatgtgtggccacacacaagtcacagcatgcatgcaaaaatcagaggtcagtttgtgcaagtcagttctggcctcccaccacgtaggttccagggatggaaccacgagcaggcgagactcagcagcaggc

SEQ ID NO: 18632 - DNA, 1201 bp, Mus musculus
tgctgaggttacaggtgcacacagccatactaagatttttttcatcaatgtggagatttgcactcagttcctcatgcttgagcaacaagggttcgctctcacccactgaacccccacagtaccatttctgtcaactggaaagaagtctaaaaaaatgaatatgattctggaatccagctgccacctttctcacatgccctgatcagtatccttaagccatgcctccaacttgaaatctgctcaccaacagaatggatcaggggcccaaaaataagaaaggataacgtatgcttgaccctttgataaagtttggagcacatcttccattatgagggaggtgccaggtcacctctatgtaggcatgggatacagcaccttgtagtggccttgtgtggcaggggtaggggccgttgtgagagcttgtacttttattaaacattggttgctgtgttctgatgataagagctcattccctacctgtttctgtacagtgactgaagctggctttggggctgatattgggatggagaaattcttcaatatcaaatgccgagcttctggcctggtgcccaacgttgtcgtgctggtagccaccgttcgagctctgaagatgcatggaggcgggccgagtgtaagttcttgttttcttcctagcttaaaaaaaaagccgaggagtggagagatgactctgtggtaaaaagcacctgccagtcttagaggtcctgggttcagttccaggggaccttacaccctgttctggattccacaggcacctgcaaaatcacagtgctcataaacatacgggtttcgtgcacacataacacataagtagttaaaacatttaaagccatatatgagctgtagaattggctccatggttaagagcactcactgactgctcttccagaggccctgggttctataataaccaaatagtgtctcacagctctctgcagcttcagttccaaggggtctgacaacctccatacaaacaaacatgcaggcaaaacaccagtgcaagcgagcgagtgagtgagtgagtgagtgagtgagtgagtgagtgagtgagtgagtggatgaaaagttatatgcatgtatgtataatttgaaatgttctcttcctcttctgccatgcccacatttaaatttaaacagctttgatcctctaaaaggtttaaagtctgtttggtctgattggatc

SEQ ID NO: 18633 - DNA, 1324 bp, Mus musculus
tgtggtccccacctttgtggccagacattctagtgataaaaatgctcagaagacagaaaatgacagtaacactcttggggatgggagggaaccaaacctggggcttcatatatatcagagctgtgcccctgttcttcattagtacttaattgttagactgaagcagactacagtggtgtgttacattgtgccaccagtttcacaggccttaccctggcaactccttgacagaggacagtagacaatgtgggcaatctagagaggccatatgctgtgtctctaggaaagccactgttcgtgtgagctggcccacaggggatagcccccaactatgactgctggaagtgtccatccagtaacgtgcctcagctgaccacaggatctgttttgctgtctgcaggcacagtttgacattgcagtggccagcgagatcatggccgtgctggccttgactgatagcctcacagacatgaaagagcggctaggaagaatggtggtggccagtgacaaagacgggcagcctgtgacagctgaggacttggtgagtgctgctgagaggctctgtctcaaaataaaaaggaatgtattttataagcatagcattctcacctggtttgccttgaccagcctggggtgggacagacatgggcaaagataacaattccaggggcgtggtcagtttggtgatgctaatctaggaaacagtaaaggggacaaatcagccatggtcccagttctcctgatttacgtgtctttttctcacctgtagggggtgaccggcgctctgacagttttgatgaaagacgccatcaagccaaatctgatgcagacccttgaagtaagtagttttccttttatttttttatttattatttttattgatttttttatgtgtatctagggtggggtgccacatgtatgtatatgcacatatgtggaagtcagaggtcaatctctgatattatccctcagcttggtgtttgagtcaggtgctgttcactggcctagagctcactaataaggttagatgactagccagctagcactcacttgggtccacctgtctctgcctctccagcactgggtccctctcctcccctcccctcccccccccctctctctctctctctcctctctctctctctctctctaacttctggaattcaaactcagatccttcaggtcagggaccttactgactgaggtatctgcccagccctgttttttggtttttggttttttttttatgattgtttatagcatagcatttgcctttgtcggacttactgtagattacaaggcagtatgaatactcctggccaat

SEQ ID NO: 18634 - DNA, 1144 bp, Mus musculus
tctattttgttcaagtctacctcttattctgctctaactcctctcagacgctccacccttcaatcttccttctaattgcatgttctttaagaaaagaagacctactgagtacaattagtgttcactcaaatgcatgtgtgctgtccactgtagcatggccagcctaccaggggccccactcctgaagaatacggacttgctctatcctggtagctatcaaccgcctgtggcttcttaactagaagtggggccttgcaagaccccgtccgtgctggactgttgagtggattggtcctgtgctagcaaccacagctcctgggtgaagccgtctgtcacctccagaaggcactgttttacagcaatcttccctgacctctaatttttatcatattcccactctctcttctgaggtgttctccaagaaaagccacttagaagatgttctttcagctaaagggacctgggaggaagttttcggtggtgtgagttttaatatcagcttttctttggtcggtagggatcactttggatggaaagaaggtcttggtcgtaggggcgcacgggcccctggaagctgccctgcagtggcttttccagagaaaaggatctatgacaatgagctgcccctgggcaacacctcagcttccagacaaggtaggtctctcgtgggcctctacgaccttggcattctacactagagaagagggaaggctggggtgtgtaaagtgagcactagacaggaagctagaggtagaggtagatcttgaaggaggaagacagtaaaaagcaaagtctgttatcgtggctcgtttctgcagtcgaggcaggggcataacaaaattgcagagagagtcaatgctcggacccttgcttgccagctttctcttcttacactcttctggactcccttccactctgcctagggaatggagccacctatgatgggctgggtcttcatacactaagactacattaaaaagcagcaaaagggtggttacaaattaggggtggttacggcaaacatttagttagtggttgctgtctggtaaaaggcttagaaatcaataagacagtgacaatctatagaaaaacagcagatggccatttataggcatatggtaatagctgcctagctccttatgct

SEQ ID NO: 18635 - DNA, 1177 bp, Mus musculus
tgtagaacctacagagatagggatagtattgtcatttctgaacattttcctaaccctgtacacaagacataaagcatagcacgtacctctaagcctttactgaatgcattataataaagttattggatggcatcttaaagtttcaagcttctttttcctgcttcctcctgtgtcaagagcccagctgtggatgcaaaggtgacagatgatgatgggtggacacatccatctctccacacaccctcctgctcatacaccccttcttatctagcaaaacctttcgatcttcccccaatctactacccttcttccaaatcgatcaataagcccttctagtgttagggttagacatccatccctacccaacgttcctaagattgtttcaggggaaagtaagaagtatcatggctggctctggactttcagacccttacagtccacgcaatcgcctcttcctcacctttgcccagggcctgatctccatggggtagacactgtattcgccactacccaaagtcttgcatccccaacactccttgctaagcctctatttgccggagatgttagatgctcctccaggtaagaagactcctgagttgttctttcctgccagtgtaggctgctggtctactgaggttaaggtgtgctggccctgggatcccaccttctcatgaacaggcacttgctgtgctcattgaatctgaaacacaggataagcattggctcctgctttctgtcaatagagtgtaattaagatggacctcaactcttcatagatgggccagaactcccttggccaactattcatgggtcactccttcctggtgattcctcagagatgtccctaagtcaccacaatcttaacaggtccaatgtttgtgtgttatctttatcctcaggctaatgctgccttctggtccatccccttagggacagaatgctaaggtgaccaagtagggattcagtcagaggcctgggattctaagccagtcttagcaggcatagccattccccggcatgctatacagaggacagtgactacaaaacagaagccctactcagagcttggcccctgatagggacagactacaagccggagctatgcaaaaccctactatctgcatgtgacaggtcaaaataggcattgttcctctcaccacaaatcttcagagatgtt

SEQ ID NO: 18636 - DNA, 1186 bp, Mus musculus
ccttacagcctgatttcatcaagcattcagcctccagcaagcatgggtggcagaaattcatcaatatgaagaagcatattcagtatatattgtggctttggtctgatttgggaataatgtgtgctatgaggactggacagtcaatgatgggcaaccagatttcggagccatatcaagctaagacagaggtatatgccaagaggctgcggtttgttaataatacaccacagagccatgtttgtgcaaaataaacacaaacaagctgcatatattctccttgatggataagaatggctcgggaaaatctgagatttcctaaaacgggcagccacctgccaccataactcccaggcagaattatagagcataaataaattttatgtctcagtccagctatttttattatataatcagagaggaaattgtagcctcccctagcctgaagcgggctgatgcaactgagaatgagaccacctggggtgccactgagaatgagaccacctggggtggagatggtctcctattgttctgtcacctagatggcgtagcttacaggctggctccagacaccaagaatggactggcgaggggggggggggcttccctctttataagcacagtctcttagtaaactcatgggccttgatcagaacgttgtcttggcttcattatcttttttccgccatctaagtctctttcagccccagcctgcctcccaggtgtacccggttcatgtaggccgcgggccaacatacaacatgtgtgtggtgtggtggtggtggggtgtgtgtggtgtgtgtgtgtgtgtgtgtgtgtgtgtgtgtgtgtgtgtatgtatgtatgttcgtgtgattgttctctatcttactttttgagacagggtctctcagtgaacctgcagctcacctagctacactggctgcctagtgagctgtgggatcctcctctatctacctcaaagtgctggtatcacagacatatgccaccacatctctctctctctgtctgtctgtatgtctctctctgtcatctgtctctctctgtcatctctgtctctctctttctgttttgtttgtcctcatagccctgggaaaacactgtgcagcccaggctagcattgactttgtggcaatcatcatgtttcagcatcctgagtgttgcagttacatagccacctcacccagct

SEQ ID NO: 18637 - DNA, 1238 bp, Mus musculus
tacaatcttctgatgctttccttctcgtggagctccatacaagacagcaattccctcagtgtttccccaccgttccaatcaatgtccctgatttgaactccaatctgttacatgccggcctacatgaaccaggtacacctgggaggcaggctggggctgaaagaggattagactgcgagaaaagataatgaagccaagacaaggttctgatcaaggcccatgagtttactaagagactgtgcttataaagggggaaggcccatccccccccccccccccccccccccgggccagtccattcttggtgtctggagccagcctgtaggtgatgtgcaggataggatgtatcctggagaagagcagcgacaggtgacagaacaatagagccatctaggtcagaaggctccaccccaggtggtctcattctctgtggcagcaatgttttcatcagcccgcttcaggctgggggaggctccacacacatacacacacacacaccaccaccaccacacacaccacatcacacacccatacaccccataccatatacacacacaccgcacacacaccacaccacaccacaccacacacaccatacctcgcgcacacacacacatacaccacacacacacacacacacacacacatacaccacacacacatacaccacaccacacacacacacaccataccacacaccacaccataccatacaccacaccacaccacacaaatgggtgtgggcattcacacatacaactgcacagacacacaactccatttaaaaggaaaagaatatgtttcagtattctgataagatatagatgaggggagggatggagagagaggaagtggggaggaagaaggagagggaaagagacttaaataggcattagcaacctcatacctgatttggaaaatagaaattttcatgaatttcatatctgttttgtcatgcgtggtgggcctgagccacaggattagaactgagatttaggagtccacccaaaatttgccccccccccacctttagcctaaacactggttttcatctttgatcaacccagactctgaggctaacagaccgtccatggacaggcagaactggggctgttagattccaagctgaagaggttaggggtgtctgagctcctatcaggagaacaaagtttctttctttgtcttggtcctgacacttgtaggccacttaatcctttgaaaatgcctctcatgaggat

SEQ ID NO: 18638 - DNA, 2233 bp, Mus musculus
ccagtagcaatcactgttgccaatcacttactgtcacttttttttttttccaaaccttgcacaggtgcggtgctacctctggcattaggtctggccatcactgttttgttgcttctcatggtgacatgccgactccgactggtgaagcagaaactcaagaaagcccggcccattacatctgaggaatcggactacctcatcaatgggatgtatctgtaacaacgctatttaagcagctcggggcaaggatggctatcactcacaatctgttctttgggttctatcattaagatgttttgttttaaactgtgctagaagacagtgcaaacacaagccttgacttatcatgaaataatttccctgggatgtacaatgtcttcaaaggtagagaggaattcataagactgaagcttgtttgctgagacagaaagtcagcatgtgacaaggtgacagatggaagtcctgccttttatttgtgaggtgccaactgctggcccctatcagctttcttatcttctggctctcttctctccactgagttctcatgagctacactttcttttcctctgctaaatacctctgaaaaaggatcttaagtgaatttaccctcagtgagatgttaccaatggcaggtctgtctggatgttataagcatgctgattagatcagtgatgtcccacaggggaggaatataggttctccacccagccccaccctatgcttctgaccaggccaaggtggtagctgccacacctggctgaccttagaagaatcccttttggctaggggcaactgtaggtggttatgaaatgagaacaagctggcagcagaggagagggacctggcaggcaaaagcaaatagaaccccagccgtgggattcgtaaggacaatctactcaatgctgcttcatggaatggagcggtgtggctgctttacatgtgcactggttttcaacatgagcctttctgatgaaaaaacgtgcgaattatcaatccaaaaggtgatgtctgggtgtttgtaaacatgttgccatgtccaggtatcacaggcttttcaatggaatgggtcctgatgcttcccttcgtgtgtcttgcagggctggaggtgggacccaggagcctggttgggctagataagtgctctaccactgatctacaccccagccctcactgttctttatgttattaaaatgttataatgtacaatcagctaatgtcaggatgtatttccagagcagaaagcacttttgcacaagttcccctttgcaggaaactggcatccagcttaacacctttaagtttgtagacagtaaaggcagaccttcccatcaccacttagtgccaggttgtatactctagaggctactctgaggggactgcagtgtggtgcctgtttataatcatgatgttcctagttctttaccctgagtggcaaacgttacaaaacactaaaaaccactgtagtctcattagtttagactcaatataaagtaggtggttcctttaacaaggggtttgattttggtgagggaatataacctattgaaatgtattaatcaaagggtagttctagaaaaacaaatgtttgcttttgtctcttgagactctaactccagcctcttactgactatttagagctaatcaatggtgtaaatgttacagtagcagtctgagagatgaatgttgagtgaacttacctacactctgtgatgctgtgcggctcattttcatagaggtcacctatagccatacccagtaaatagaaactgataaggcatgtttctttctgcacatcttttatatacaaagaagttatctacaatctagtattgctattgttttgaagtacttgagaaaagatgccttgtatgtaccagtcctttaataaactattttattcttatgcctttaaaaaaaattctttcttataaattatagattactaaatgtgcccaaactctagtatttggatttagtcatgccaactctgttttcacaaatggaccctgagggttgtaggaaagtgagtcaccccaagccacatgaagtctgctggagatcaggccctacttggtgctccttatctccagctggacaaggcctctaagagtcgtcttgtcagtgacttagggcacattggggctggagaggtggctcagcgggtaagagcactgactgctcttccagaggttctgagttcaaatcccagcaaccgcatggtggctcacaacca

SEQ ID NO: 18639 - DNA, 1146 bp, Mus musculus
ggaaggggcgggcctgaggagcgcgcagtgtgctttctgctgaaccttcttgctggtttcagcatggaggaaatttatgctaagttcgtgtctcagaaaattagcaaaacccgctggcggccagtgccttccgggagcctgcagaccacagagacctttgccacgggctcttgggacaatgaggtaccgggtttgggcgggccccggctgctctgctccacgccccccgcgctggcgcgcgaaagcgggcttgctggtctggtttagctgcccgctacttgagagccctggtggtgtgtctgagcctgggatctggttttaaaccctcaccaagtctgtagtcataccgtccaaacttggccatatctctgatcttttcaactcttaaccatatcgtttgtctgagatgctattgaagcaaggtcgcccgaaaggcaatctgaatctgactttcctagagttgatgttttcgtcacctcaagctaaaactgtctgctttgcaggaaaattgcgtttcactgtggtctattggagattttggaaacttggattctgacggagggtttgaaggagaccatcagttactgtgcgatattagacatcatggggatgtcatggatttacaggtaaatctgattgtctgccaaagctaatttaggaaatttgagactatttagaggtaacaaggcaccttatagtttgtctacccttacccctgatttacagcactaatctctatgaatttaaatttgccatgccatcatattaggcacttagtctcagaagtggggctgggaaatggaattcaggtaaatcagtttgaaaatgaattgcccaaaccgggcatggtggtacaagcctctaattccagttcttgggatgcagaggcaggagggatctcaaagctagtcagggctacatatacatagcaagaccttatcttaaataacaatatttgtccatctatgtgccaaacgatgtttggtaagttttatacaggtatgttaatttagactacatgtctgtgagtcaggtttatcatttcatgttgggatgaagataatctcagcacttatgagagctaggcaagaactctctgctttgagtgtctgtatccccaccctcaagtaagactcactgcttcgc

SEQ ID NO: 18640 - DNA, 1438 bp, Mus musculus
ctaaagaaaaatccaagtacagatgagcagaggaggtggacaattgtagcaggtctgctccggcctgagctggggcacgcagacgcactcagtgcctgccagcacagctgactgcggtttcgatgttagcgttgttgcctttcaggttacactgatggtgtggggctctggaagagagggaggcattttgtgtatactttttatacaaattttattgttgtgcatacatggtaacgttcatatttgacatctttcatagtttcagtcttttaagaatgaatcatttcatatcacagaagtccataaacttgtatgtaaagcataaaacagaaaatgtacctggctgcagcgcaagaggtaagagtgtcactcactatgaaagctccatatatcccttctccttgcaggaattattctgagttgtgtttaccctgctgttaattttgtatgtttttgaattttatacaaatggcacaatgtatattttccttctgtgactttctttttttaagagtccatttatttttattgttacatagttgtgaatgtactacgcttgatctgttgatggacttttaggttgtttgttagtttttgctatctgaggaatgccactgtgaacatttcaactgagcatggcactttctggccatgtggtttgagttttcaatgcatttatagttatggttgctgtaatttacctggtatgtgaattgtatggggtcaggggtagccacaagagtagttagtctaccatacagctcagagcacatttgctccattattgtacatagttttgactaccaatagaaaaggcttaactatatcaggagctagcatcttttctagggagatggctcagtgggtacagtgtttcctcatcagcacaggactgagttcagatcctcaccacatacccagtgcatgcgactaataatccagtactggggagacaggagcgggggaagctccaggcagttcgagtgaccgaggaagacactcggcactgacctcttgcctccacatactgtacaaactcgtgcgtgcaggcacacacacacccgaatacacagctgttctgcatacagaacggtaggtgttgctcacacagatgaacctaaaacatggtctagaagaatgagcagggacaggctggaagcaacgagaagtcatccactgactgcggagactcgatttaagagctctggagtattgaaataggaaaatgtatgcaccaagcgtttcaaggaaaacatatccttgattccaaatgataagaaaccgttttatttttcctatgtatttgacagtaactatatgcttatgggagtgtaatatgtttgctatatgttaatattctggaacaagtaaatccatttgcagacatatcagcttacttttttctttcttttggccaaagtttgctctcagggatttt

SEQ ID NO: 18641 - DNA, 5293 bp, Mus musculus
agtctatggacagtgataggacttgatacttttcaagcagttagttaccagcattaatttcttattgtagtaaaaagtacttagatttcactcagttccatagaaaacataaatgaaactttatcactgaaacctaattctgaagtgtggggcggggagggaggatagaaatatacaaaatgtaaagagaaaaaagaaacttaacgaaaagtcttgagtcccatttctgtgtttaatccagcatccattaaaatgaacaatgatggacctttcttaaattgatgttaaaatgccgtcattttaccttgttacgtaaaacagggatctgctgctaattctttctgacaagtgttgacgtcacttcttccctgcgatcactggcctgtgtttatgagtactatcttatatctatgttctaagatatgtttttgaagtcttatatgtaatttgaaattaagcgggtatcatctcaagcatttcttttgcttatttttagaatttgttgctttaaaaagtaaaattaagtatttctgagctataaatattgatgatatagttccttttgtatatttcaggaccacattttaaccccagcgctattcataacttttatgacaatattggatttgtaggccctgtgccaccaaaacccaaaggttagtgcatccattaaatgtgagactgtttggaaagcgaaatcctagaaaatgtttattttttatgttctcaaccttccacttgggaagtgtttccagcttgggcattctggcatgggctgactcctcagggaggtgtgtgtttgtttatttacactctggggtggagagcatgcaaaggtgtgacgtatgtaactttttaagagtatgtttgagaccttagtacccactgtggactcccaaaatagaaagtttgggtttaaaactaagtgcaacgattgtgtctttaaatttgtaaactgtgataaggcaggcactttagagaaattcagttttttgagaacattgttttgtatatatcctgaattccaggtaaatttcaaaaatgtattatcatctagaaacattttccaccattgaaagtgacagaatatgtgtgtaccaagctaagacatgaaataagcctgtgtatttgagccaagcattaggatatgtatacgaatgaaattatgtgcaaaaatctgactggctgaagttaaatatataggcatgtctatttaggtcactattgtcactactaattatgatgcataatttgcttttagccctaagagaagtaaaattttagatagctttcattaatatagtgttaataatctattttactatgagttactgttctttcaatatacctaatttataaattaagctttataggtatttgtgttttaagaaaaatgtagtatttatcagattcagtattagtcatagtttcaagcatttactgttaaaaactacttagtgaattcattaacgttgcagtatacaaaatcatcccacaaaaatcagttatttttttacagttatgcaaaagaaattcatagataccagaaaaatgtttcattcacagtaacaatcaaaacgttaaaataggagtaaactccaccaaagaggcagaagaattttataccagaattataaacactgaagaaggaaattatcagaaacattcatgttcatggattacaaaaattatactgttattacctacaatatctaagatctacagtttgttttgttttagtgtgtgttgttttgtctacctgtatctgtgtgagggtgttaggtcacctgtaacatgtgagctgtcatgtgggggctgggaattgaacctcagtcctatagaaaagctgccagtgtgcttaactgcgaagccatctcttcagcccaatctgcacattctaccaaattccaatgtcagtataaaaatgagaaaaatattataaacttcagacaggactctaaataggcagagccaccttgagtgaggatggagctggagatagcacactcctacttcagagcggatgacagagttacagtgatcagaagagtgcaggactggcctaagcatgctctctgacacacagcagtgggacagaagagggacaagcaaggtgcgtcagtgctcacctcctctcacgggaccagttagtaaagtggagtcgccacatgcagaaaaatggggctggcccctctgtatccaaacagtgactcaaatggagccacacgaaggttgagtgctaagggctcttggtgctgatgacctaaattcactccccaggctggctgcacatggaagaaagaaagaaacaacttccccaaggtggccactggcctctacatacttgctatgatacatgcattgctgatacatgcatactcatgcatttacatatacaaaatgcataaatgtaaaacaaattaactagattataaatttaaatagaagctgacactgggtagatggaaacatttggcattgctgagggtggtgacttgcatatggcatctaaggagctgtaggactgaccactgcagggagctgtataccaaaggactgaacactgcagcgagctgtataccaaaggactgaacactgcagcgagctgtataccaaaggactgaacactgcaacgagctgtataccaaaggactgaacactgcagaaggctccctgctattctaaaccagattcagggctctcttatgccatgtctgaggtttaaaaatacaacaagaaaatgggatgattttttgactctgtcttactttttcagcatgttactgccataagtgtaaactataaatgttagaaagtagttgtttcaagtgtcatagcacacaggagatgaaggcaggagggttggtgacagtcagcaggatccttcagtctgacatgacagtcagtggggatgggaaggagtgttcacccttccttcccttgtacttggaactatgaggctgtgttctcccttaggccgtggaagtgtttgtgtcgagtcacggtgctcttcccgctaggggaagcatggtcagttcagcagttgttttatctggtcaccatttggtagattttctgattttttttttttaacttaaaattgttttttcttttcttccttacagatcaaaggtccaccatcaaagcaccaaagacccaagacgcagaggatgaggaaggtgctcagtggaattgcactgcctgtacgtttctgaatcacccggccttaatccgctgtgaacagtgtgagatgcctcggcatttctgagccaaaggccccgccttcctctgaaaccacatctaaagttcaagaaggtcgcctgtcatcgggaaagtgtttcaccgccacaggagttagtccagttgaaggtgtgacgagacagtggtgtgctgtgttgagtgtcagcccacagagctaatgatacctcaatctaatgtcatgggcagtgagattcatcacctgaaaggcctgagagaccgggctgcctgctgcctgaccatgtccagtgtcacgtgtcagtgcctaggtgttcccaggactcctcccctcttgtcaccactgatcctgacgggaggaagggagagacaggatgattgctttttgtgttgttagagcttttggtgaaacactacatacacaaagagaaggaacaaggtttgactgagaactctgctgccacatagtgccagtagatgtgggaaacgccacaaatctggggtacttttggccctgtcctctgtcttctgaggacatctctgtgaagccagcatttaggtgtgagataaaaggaaagctgtgtctgtctgtacatccacagtgcgctccccaagcctctcctactgtacagatgtctcacgtctgctttgatttctccattatcttcttatatttctatatgtatagtgtaatagacttgtgttaactagtgtccttttcccttttagtaagcacgatcatgctccttttaagccttacctgagaaaagcaatgccataaggtagaaagcattaatgaaatgaaactgtgcacaacataactccctctccccttcctcctcctgtcctttgtcccttggtgccaatgctctgagaagacatgcaggtgctgcatgtgagtcactgcaagaaacactgcagccatcggacggtcgaggtcacgctgtacactgacttgagcagtgggtgaccaaacatgtcgttttgtcttctccagcagcttaaagcagaaagtatttaaacccactgccatcttgccccatctgtgtggtatcccatagaactccatgggaggctcttgttgggaaaatgcagttttaagaagcagcctcagcagccgttcccgcagcctcttcttcccgggaagaagtgtggctgtcggactgttggcacagtcatgtgtatttataaagcatagtcatctttaggacaactgaagaaaagctggaaaaaagaaagaaaacaagcagacttgaacactgaagcaacctcagacatctctttattttgatgatatatttttgtaaggaaaataaatattcatatgatcaggaatgtatataactaaatgaaatcaagaaaaaataaccatatgcattttaaaagaattatgaaattatcagtgcttggaatggggctaagggaagtgctgaaatataagaaaaaaataggaaataatgtagattgtcccactgtaaatgttcacaagtggctatgttttaaataaacaggattattatgaatgagcgttaagaaggtcagagcctggccttccgggctttgcactgtgagtatggaaagagatacggcaaccataggtcactaggcaacagaccccaaaactcgtacatttgatgcattgtgttttaaaagtaggccttgtttttcagcttcctctgcagttctatgtgaagattgataaatcagtttttacttgttttattaataaaacgtaatttggatatcttgagttgatggttttgtgatttagctgggtaaactatctttgtaacagataagttatttataaaaattaaaaaaacttatattctaatgtggattttgtggcttgtctttgaagtttgtgggacagtttgtactcagcatagtgctctatagctggctgaagtcaggaggcaccaccacccccaccaccacccccgacccttctcacgagctcccagcatgccctctgtgagttctgtccattgctgtagaccggtttcttttgggcgtcttgattgattggctacctggtttggtcttgtaagcagagtctctctcactagataagacc

SEQ ID NO: 18642 - DNA, 1137 bp, Mus musculus
aataatttgccgtcttaaattttagatcagtttttaaaaatagattgtttgactaagagaaaaaacaaaccaatacacacatttagtgatttattttattcaagaaaaactccactgggtatttaaatcatgtaggtatgaggctcttggaagaaaggttagggcatgaaaaaaaatcattaaaagacagtagagatagcttttaaaaatagtgttgatggcacccctcactgcttaaagtactgcccgtgtgcataacagcgagacactccactcatctttctcacctcataactttctgacacatgcaatctggatcacaatgataaaattaggatccaacatactcatttgtaacccatcttcagggctctttgaaagagataacatcctcagatggcgccaggaatctagaataaaatgggcaagtgaaatcctaccactttgggctttaactgtgttgattcaatggttggaatcaactgttaccccttggctacaccctctaggaactggctcgtgaacatgtctgttgcgagttgttttcaatgaaaggctgggctctgacatttgaagtggatggttgtgaatggccgttcattgcatggaaaatgttgtggttaagggctggcttgttttcacgcagactaatgtgattcagtgcttgttttgtggtatttatgttgtaaataatatatccagagtccatgtagctgcttaatgcctgccaactagccatacctacttcaagttgtcttaggtccagggcatcctgtttaaatactgaaggcagtacctttgatttggtgaatgttttctcatcttcagtggatatgtggtcagaggacaacctcaccttctaccttgtttcaggggtggggaaagggggtgtctctcttctggtgtctatcattgcctatgccaggctagctggcccacagcttccacagatgctcctatcaccccttcaaccaaaggagctctgggactgaagatgtgcaccactgtacttagctttccatggactctggggatttgaactcagacccctagcacttgcatgtcaagcacttatccattgagctgtccaacatgggcgctgggaactgaactcaggtcctctggaagagcaccaag

SEQ ID NO: 18643 - DNA, 1438 bp, Mus musculus
acggtggccatggtgttgtgagaggctgtcacggtggccatggtgttgtgagaggctgtcacagtggccatggtgttgtgagtggctgtcacggtggccatggtgttgcagtatttatgtgaaatcctaacctcatccatccccaaatccattcatcaactatcagatcacctttgcagaaagccattgtaagttgcatatttcagaaagatttttttttctaaaaagggaagtagtttactcatttaaagttctttttgtttgtttgtttttaattttttttccattttggccggttttattatctctcatttgttatgtagataattattttaattcaagcaaaggttcattatggagccagataaaccacatccgctgggtgttaaatattgcatattttcaactggtttttccaactttgatttccatgtgatctgccctctttttgtctggcgtctggttttctagcagttggcacacttagacaggtgtgcctgatccattgcttacaaagtgttttttcttcatattcttgcaagcacgatgtgaagtctccagttatcgtggaagcattttgaatacaaggcccggatcagtcctccgctagttcatttgggttattacaatttgattcccctcagaagagaagggcaagcggttttatgaataacaacgccatcctggccttatggtttatatagctggtccacgtctctgaggaacatctcaggtgattccccccaccccacacacattttagtgtgcgctaaaaaataataatattgcttggtttcctcacttcccttcgcctactataaaatgccacgtggagaagttgaggcagtttagaatgagaagagtaaaggcactgggttcctattggactcttaataaagagctcacggttagcttccagggtcaggcataggccacccaatgggtgggggtgcagggttctctgccagtccaggacccagtcacatgctgttgtgggggttggcattggaaaacaggcttcttctcttgcttttgaagtaaccctggcctgaccgtgcaacagactgccctttgattttagctgagcgaagagagagagacctcgcaaaagtaacatcggaggtaaccagggaggaggagaaatcttttgggaatttccaagtttcagttcattcttggtgtagggttttctgttttaagtcaatcaaggaggtcttgagaatgtcaaacagtagcttttttctctctggaaattgtcgcctttgcatggagaattaaattcagggaccacgagtttagtgtgaatgtctgatctgaaggggctgaggcttcttatccctccctccctccctccctccctccctccctccctccctccctccctcccttcctttcctttccttgtatcatatttgtttggttttcttttgctttgaac

SEQ ID NO: 18644 - DNA, 1224 bp, Mus musculus
ggtgcttgtgcaatcttcatgacatggcttttcttctttatacagatcccgagtggtgggctgacggaaatctgcagaaagcccctctctcccggctgtgttgcgtccatgtcggattggctcatctctatcggcctgcccatgtacacgagcaccctttctgacgcagggttcagcacgctgagccaagtgccttccctgtcccactcttgccttcaggaggccggcatcaccgaggagagacacataaggaaactcataacggcagccagactcttcaaactgccaccaagccctgaggctatgtagccaggccggcgtggccctccctagacaagagccagcctctcactgtgcttaggaagccgatacaatccctccacgtctgctggggttgaagaaaagtattctctcggggctcacgaactgcaggattgggactcagaaccgaggcccctctcttccggtaaagccctcctcccctgcccctcgaggaaatcgaggtgattctctttgatgcccaaaggcaagacacgcacttagttccgttttcaggcactgaagagccaagacactacaaacagtgtgtgtccagtctgtctttgtgctgtcagagggctaggaggacgaggcagccggctcgtgtctgatcgtgcccttgcgcatctgttggtcacccgatgcccgagcccgatgggcttagctaggccaaagcaacagactctggagttactgtatactattgaccatgctcatttgttcaaaagctacaacagctgactctatcaagaacagaacggtcctcctctcctgtagataaacgaccagagacattttaattgctttctagcaattagcttttatttgccttaatataaacttttaaccagttatctatctagtgtccacagcccttacttaaccctagttccagattttcagcttagactgccatctaacgtgtttgggatgtttccagcaaaaatagcctttttttttaaaaaaacagtctcattctaacatggcttattttataagggtgactaccaggcacacgtttcatgttgacttttagtttttgaactaactataatttagtaaaagtcgatcgggactcacagaggggcacgtgtgtgtgtagtgactgcccttcagtcttctgcctttagtgagaggctgtcacagtggccatggtgttgtgagtggctgtcacggtggccatgg

SEQ ID NO: 18645 - DNA, 1115 bp, Mus musculus
tacagtttgtatccagcgaatgaggattttgatctcatctctacttgccacccgccccatgttaatattctttgcttctccgactatcgtgctctaagttggtattgtctgagttcttcccagagaagcgcctcactcactggctgttactattccacattacctggggttacctgggtcggctgtctcacgctgacagcctggttcaaggtagaatgccaaacagacacaggttgattaacttggatgcattaaaaaaaaatctgccatggctccaaagcatgaagctctcactggcagatctctgtcttgattttgagtcttacaagatctggcaaaaccaactgtcacccttgccagttggaagtcaccaactacaggagctctctactggctgcccctccacctgggcgttgagtctgactttgaccgcatctcccaccttccctgtgtacacagatctgttttccagctgccaagcagccactgtgctgtggtgttgatatggttgctctgatgtacatactcttcttcacttaccctacagacgttcctgcggcaaagaacattcccagtgctgagctcacagacagacgacctgtagtgacaccgatagtctaatttttaaatagaagtcctgtctagactgggtcttttattaatcagtattgaaaaatggtatccattttctattacgtcagcagagagatgggaaagagcacgggtaaagattcccccgcctccgttacgcactgttgggccaaggtccaacaggttaggaaggtttctgtgaaaatcccttaaaaccaaggccctctagtaatatatatgcattgtgttttctttcctaggtaccctctccataaatcaaactcagaagacggctgtgtaggtaggtaccactgcccttgatttaaatatttaactgaattatttcattttcatagcttatagaggatatctagacatgtagagttatagacctcgctgaagtcatcatcattatcatcatctgtcaattcagaaatagatactgtaaaagattatgtatgtgcgtttgtttatatgtgtgcgtatgtgcatgtatgtgtatggttgaggtgcacactagatgt

SEQ ID NO: 18646 - DNA, 1162 bp, Mus musculus
gtgagctttgtagaatacgctggaggcttcagtttgcctatggctctgatggatatttacataggtgtcatttacaaggatattcccaaggggcaggcaccacagaaggtgtttccatttatgcactcagatcatctaccaacagcctagtaaggtaggagccattttactatagctactttacccagcgtcatcaaggtgtgaatatgcctctccccaaatctgcttgacttcacagcatgtgactcttatcctgggatgggcttgttgccttggatttcacactacacgaggcgccttgatcatttatggaggtgactttttactttgttaagcagaaagccagaaactacaggccaaagctgagaatggtggcttgtacctacagtcccagaaatctgggacctgaaggttgctgtggatttgacaccagcatggtccacagtgtgagatgctctctcagacaaaacaaaaagccagcaagctgaactaaagacaagaagaagaaagttctagctgagaaaggactctgaaatgaaaaacaaacaaaacatgtctgaataagagagtgttttgactgggttgataaaatatgactggtgttgctgtttgcagtagatgtttatggagttctaagactccgggggagaattactctccctcacagttggagaattgactgcactgagatgtgtgtgaaatgcagactttccactaggaaggcccacggttggcctcaagcaagagacttacgcaggactgagcactagggggcgccagcctctgtctcttcccaaccttgaaagtgagcgtttccttactgcccaggctttctgtctctgacctcacttcagtcttgtccctgcagctgggtgacctcttgagtttttatggcaggtagtagatggtattagctgaatattgttccgtgtttatttctattaaatagagaagaatgttcacgagataaaaaatggatttgctatcttatgggtaatattcattaggccaggggcgatggctcagtttgtatattgtttgcctaccgtgattatggggtgggtggcgccttcctatagtctcagtgcttgggagatggaggcagaaaaaaggagaaattcaaagccagtcttcagccacatatcaagttagaagccagcca

SEQ ID NO: 18647 - DNA, 1202 bp, Mus musculus
aaatttgtagaaaagtcgaaattggctaagtttttaattttgcttgaaattttataaaatgtttaaccaaatgtacccttgcattatttaattaaaattgctaaaacagcagtgttttatcatttcagtaaagtgctcagctcccttttaaaactgccctccattcgctcacagttccagtacactcaggtgatgagccagtttaatctcagtgcacacactgctgccgcatggagagctgcagggctctcttgtccagttatccaagagtctagtctgatgagctacaaaatatctcccgtagaaaacatcacgctcctgtacatatccctttgacatactaaaagcaaaaaggaaatgttgacagcagtcagtcatgaagttttttctgtaaccaagagtggtgtgcattggagggcagcagacactgagtgattggttcttgcagtagcatgacagcctagagaggatgcagcctgtactgcagtcaggggctgtgattgctaaagccacaaaggaagccgggaagggaaggggagtgggggtgtgaacttcacacactgtctcctgtggacgtctgtactgggtcactgtccttacgtgcaggcagggcacagattcctgcgactcgggctttttcctgctctgtgtgagaagttaagtccctgtaggtcatcctcacttctcagcctgccgcttgcccctgtctctttcattaataattcttttgtttacattttataatgtgcactactggatatcaaagtttacatcaaagtttactttaaatagcatagtaaggattaaatatatgtgataaagagaactgatcaagataaaaatgtttttaaactataatcattttttaaaatttctgaatctgtagaaagtgaaaaaacattcgtttcatgtctgttctctgaacattcggcaatttacaaattgcttaatttgcattatatattgtccattaaacccatgttccatggtacctcactggaagaattgggtcctttcttaaaggtatagttttatgaatatcgatagtcgagagttttaaaaagttgaaaagtactaagtacctaacacactgcttgactctgtgtggagcctcagctgtttaatttgttgggttgtttgcatatcaggttcttttctaccgtcattttaaccgctgtaaatagatgagtcaaagttgtgat

SEQ ID NO: 18648 - DNA, 1219 bp, Mus musculus
gcagcagcatgctgaggacatgaccgcagtgggcagtgtggacgtggacacttagcttgtttagttacattcagcacaaataaatttgtttatcttttcatcctatgccaaaacttaaaatggaagatacgtgaaacatttaagagtagcacatagttttaaataaatgtaaagggatagttaaatataaatttgtgcataaatttgtactccaaatcctactccagagatcctcaaagtagatccaaaactcacacgtagctcaacattttaaaatacatttttcttattggttcagatgaaaacttagtttatttttaacctggacatggctctgcctgtttccattgattctaagtcttctatccagtttggaatatagagttaaagttgtaacctcgaggaaatgcatgataagaccagcgtttctactcttaaatataaaccttgtaatgattcgggtggcttctacgtttgctcagatggaaggattctccaaggactcaactctgttctcacacaccaaggacacatcccaaacttcctagggagacctggctctaaaccacacccatgacagtgtgcatagcagacaatgcgtcagccaggctcccacctgcagcttggctgtgtctctgtgatggttgttagtggtggtctttgttgttgcagcctgactatcttactcttagcatttatagatgctttgcccatatccatatttacttcctaattgagaaataaaggaaaatttattataatttagttttctttctggtaaattaaagtctaatgatgaaaaatagattgaacttttcgctgcccgcggagacaggaatgacacggacaccaaggcgggttcatacagcaacttctttacttcgggctttttcccctacagctctcttccccagcagcttcttcttcccctgtccttcttgcagcttttctcttacagcaaccccacttaggcaagggctacaacaactctcctatactcatgctgactgacctcatctcgctccacaccacctcatccaatcagaattcacacaccctccaggaacgagctcaggtcggtcaccgataggctgacaggtctggatctcaagggacagtcgagcctggcaggcagctcacgcatgctttttcactgcgcataaggcaaggcagtgaacaagtggggttcacagacctggcaatgggccagggcgccatc

SEQ ID NO: 18649 - DNA, 1225 bp, Mus musculus
gagagagtagttccagaaagtgttgcccagagctgtatgcatataccatggtatacacgtatccacatgtatacacactcacacacacacattcacacacatcataccacatgtgtgcacacatgcacacacataagcaaataccaaaattttaaaaattgcaaaaagggaaaaagatccagaactctttgcccacctcagatctttcatgctttgctcattgcttattttgtaagcatgataggaagataagaaaacatattcccattgttcataaaacttacaggaatagcaaatttgggggaaggagaaacaaacaaatagtaacaaactctaacaagtttgtgtaagtgcacagattgtgtgtgtgtatgtgtggaggaggaggaaagtgaatatgaaagaaaaaatttgaatttgattttgattcaagatagcatttcagccttgtgatacatggcacagtatgtgttcctgagaattttttctggcttttttaaacttaattttataagtgtaagaatatattttcctgtccaaagtgttgagttcagttcagggcagcttccttgttctgttaattaaactttgggacattgaaattggctgagaaaaatgactgaatagagagtattactctattcatatacttctagcctacacaaacaagcaaacaaatgaataaataatgcacactaaggggcctgcctgccgccatgcctcgtagtatgggcaggggaagacagggagagtcctgcctgcagctacactacaccatgctgcacaagtgagcagaagacacctaaaggccaacccacctccacatggcccaggcttgctggagacacccgagcccgcctgccgccataccacatggtgcctgccccgctgccatgttcttaatagcgttctcacgcccggccaggaagaacacaacagaccagaatcttctgcggcaaaactttattgcttacatcttcaggagctaggagcgcaaacccccagccccaaaagcgaaagccaccccaatatagaaaccgaaacccctttcctatttaggagagttatatttcgcctaggacgcatcactccctgattggctgcagcccatggccgagctgacgttcacgggaaaggcagagtacaagtagtcgtaaaatacccttggcacatgcgcagattatttgtttaccacttagaacacaggatgtcagcgccatcttgt

SEQ ID NO: 18650 - DNA, 1200 bp, Mus musculus
agtgtttcatacagtctgaggcaggaaggatacctcatgaatgatagctgggattgctctgctccccacaccactggcttctcacacccctgctgagtcgctccatctaccgacctgctcacattctttcccttttttccagttgaaagaaagtatttgtttcaaaactttttttgttttttgtttttttcgagacactttaccaaatcattagctcctctgagttaactgtcagttgcatgattggtcgtcccaccagtgctgtcacaattgctctgtgatatttctattcgtgttgtttatgtcacttggctcccacactaaagcataacctttctccagacagttgtgcaatctgtctatagtatgtatggccaaaagcaaatttagaaaggcctcaattcagtaggaatgtaaataaatgagtatttctttggcgtgtgccagggttttctgtaataactcttggtgctgcttatttcccaggtatatcaaggagtgaagaaacacggcttcttacagcctcattttttggcagaacaagatatagttatcattacctatgatgttcttcgttcagaactaaactatgtcaatatcccacatagcaatagtgaagatgggcgtcgcctgaggaaccagaagcgctatatggccattcccagccccttggtagcggtggaatggtggaggatctgccttgatgaagctcagatggtcgagtgtcctacagtaaaagtaagagtctgtacatcttacgagtgcagaggaaggacgtgaatggatcagtagttgggattcagttaagccacagtactgatggtgttggcacatttgttgctaaatactcttgtgttattctaattgtctggatgatagttttgtatggactacttggatatctgtgtgtatgacacagttcaaagcaaactatgcttagggaactttaaatcttctcacctaattggaaggttaatcaagtgttctccagtagcctgtagcaaatggctaaaggaaatggcccttacatattgatttttattatagctatctctgtgtatatgtatacctcaggcattcctctgttactcttcaccctgttgtttaagatggtctctcattagatctggaacttactgagttagccagctagactagctggcttgccagacgcagtgatcaccctgccatcatttccca

SEQ ID NO: 18651 - DNA, 1129 bp, Mus musculus
ttgttgtatcctagccttgtgttggaatataaatgttcttgtttccttccctttagctgttgaaatcaagggaccctcaaggttcattagctcctacctaactgtccataaaactgtactagaagtagttcctgggtctcctttatcccgtgagctctggtgcttaagctaaggtgcattttcttatccaggtttataggtgacaggtcagctgaagaagacacgttttttgggtgcttattctttagttgaagggagatatacattgattcttttatatgaaattaaacataatatttttacagctcttttacattcactaagagcttttctgtgtattcatgtggttaatattcacaacagtcctgtgaaatggatatgattaatgatattcctattttgaaggtaaagatctaatgctcaggaggaaactcgcctatgatatgtagcaaacagacagagcagtccaggccccctggcttcatgtctactgttcttccaccgagttgtgtgccatgctggggttcagaagccttgtgggtatgacttagaatgggattgtgtaagtacttatttttgtttcctaatatttcatgtgctatgttctaggaaaaacaatttgatatgcttcaattagaaaataacatagatatctatactgatcagtattagaggaaaactattcttatttatttcagtaagatacctcaattaaataaatattttagtggaaaatgaaattatggattgttttatttctaaggtttagatcatatgaactttggtttttattgactcaacagatagtatcaaattgccaattctacactattccatattttatttacatttgtcatgtcttctaaacaattatgataatactactacttcagaactaatgagtccacatatataataaatacccacatcttggctgcaaacaaaagaaattttagattcctttctcaataattttatattctctgaaatatcacagtatggcactgtgctagcaaaccactgaggatgagtgaaatgcccagtccttacagtttaaatgtatttctatttagggaattgtttttcaagtaactccagatgaatttactaggactgaagatttatctat

SEQ ID NO: 18652 - DNA, 1182 bp, Mus musculus
ttttgtcccgagacagggtttctctatgtagctgtggctgtcctggaactcactctgtacacaaggctggcctcaaactcagaaatcctcctgtctctgcctcccaagtgctgggataagacattattttaagacctttaaaaatgtgaaaattcaaagtgtttgtaaaataacgttaagcagaaatctgtcttggttgataatatttgtgaaacatttccagttttgcttcacatatttctcagaaagtaagaattgtctcttttttgtaaacatcaagtgtggtaatgaaatagtcaaaaaacctataggcttccatgttcacataatgtgcttattaaagaaatgaacatacattgtcagcatttagaagtaagttgtgaagacagggacattaagtgatttgtccagttaaattctggcattggtaagcggaaatggttattaatgtgaaacctcaagtgtatattttctttctccgttgttttgagagtactctgtgggtagattcatatgtcccatatattagtcagagtgggaagctgattcatatgtcccatatatagtagttagggtgggaagagggtcttccctgggcattactgatgaattctcaattgcttgtgatttgttttgacaaaatgtagcagtaaagattaatcacttgttttgcctcacctgtcatttaacttacaaggattcgtcatttcagtgcttaaatttctttttcaactgtgagactgaattgcatttaaataacaccaccaccacctccatctttatttctgccaaaaggtagaaataagaatcaaatatgacagaatataacttttctgaagattgtttctatagttaggcaacacaagcaattaaccttttgttttatgtttgtactttttaaagttcatggtttgtaagtttaaatctatttccagacagttaacattttttttacctttcttgaatgagatggatattttaataatagcatatgtacaatgaaaactatttctactttttattctgttcaaataaatatttttttcaattaattttgggtcaaaaaaacaatagttaggtactagacatgtatctccaggcgaggcaagcatagtctagctgctttctttagcctgttattcatgcagtcagttttagataaccagaagtgtggatgcttac

SEQ ID NO: 18653 - DNA, 2260 bp, Mus musculus
gcaatgtgagcatctatccagccagccaacatttcccgaccttcagtattgccctcttctgcaaatgccaatcccaagacccattcaaccccaaagctccgtggctccacgacacaagctgttgagtgcttactgggtgttctactgagggaaccaaacactgactatccaaagagaaaaggatattttggttttctaataacgtatattattgttttcttctcccctttctatgcaactgtaaattaatgaacagagaagtatttggaggtggtaaagcatttgtcactgatttgtataatatatacagccatgggaaagtgggtgggggctttctaatatgaaactgtctttttaataaccaagagaaaaaattgcataagaattagaccactttacattattacattccttctgctgttcacattaaccttgtacaataacttcacttattatttgactgttttaccattatgttttggttatttataaatttatcagccatacaaacaaatagattctatgtatttgtttctataatctggccaaattcctaagttcatatatttgaatcaaatattttacatatgtggagtaggcaggcattctgaagatactatttaactttagttgacgtcacacacaccatcctttagtaaccactggatgactacactaaaaatcctgtggactttaacggcaagctgctggggtatttttcctcctgtttttattccttttttgtaagtagatcttgacgtctttatttatttcatcttgcaatctctataataaagaagactgtattgtaatagtctcaaaaaattattttaccaagggttaccatttaagcatattttcattttgattcagaaaccaaagttggtacaacctctcctagtacttgcaaccttggttttcatgagaaaacacacggcaggctttgcccattgtgaggagagcacacatcatgctcttcagtttcctttgaatagacttttattgttgtttttgtatttttcgagtcctgtgtaagttttgaaagctctggttgtttcctttgtgaaagcaggcagatacttattggctgtctcatttgaagctttggagcagatagtcagatgtctcatgacccctcacttggccagcagcacatccgagaaggatgtcactcacaagcctacaccacggcttctctagaatgaaatcagtgctcggatgattgtatccctgcctctacttctgagtgtgttcaactaggtattggcttctttttctttttcttttcttttttttttaatttaacacttaattgccgattttagagaaaccaaaaataaaggtgaaggtaatatgttttgattcaaacatatatgcttttaaaacatcaggacatgctaactttgggttctctttcactgggatctggccagaaggaggctgaaagttagaaattgctattcttttaggatcggttgggtgggttggggggcaagggtgtctatttgcagcatagatattttgagacgaagaaaattgttttatataaggggagagccatgatcacctttctacctcagaaccaccttcctccattgtgttggacatagctttatatgccgcagtgtgcaaaacctagggctgtagtcaggcctttccatacccaggaagcacctgtgtaaagaagatcaacagaaactcccggaactcagaaccccaagttgtagatttggtgtcgtccttgttcttgctttgaggagtcatgtattcttttatttcctgcctgtatttgtatgcaaaatgatctctatctgctattacagaaaaagctacacaaaacactacattgtaaccttctgagtaataaataagaggaaatatattacagtaaccatgatgagaaataagtgtattgttcttttgaaatatgtggttaatcgcagactgtcatctaatctgttacataccgtatttttcatcctgaataaaagtaattttaacacaaaatgactttgatgtttggctgtgttcactgatgaaatcagatctctgaatgtatgtgatgaaagctaactataagatgatctatattctgataaatctaaatattttctgaaactctctcttatacattaatctagtctccattcactcattatctctctctcctttcttgcatataaatatgattatatatttttcaatttcctgtacaaatcagagtcttattactagggaaaatggatgttataagtacatt

SEQ ID NO: 18654 - DNA, 1204 bp, Mus musculus
ccttggattttttattttttctttcatagaaagcaacaattttcaacctgtgcacctctatactcttgagagtcaaatgacactttcacagggttcacatatcagatatcctgtgtgtcagatatttatattgtaattcataacagaagcaaaattacagttattaagtagcaatgagaataattttacagctggggtcaccacagcatgtggaagggtcacggcatttggaaggttgagaaccactgatagcccgcctataatgtctgtgtgaacagtggtctcttggaccattgctgctcttcagaggggctctaccctgctctgccatcagctttgtcttctagactatactcattttaatctctgaattgtttttagtgaagatcacaagaacaaggggtcatgaacatgatctcagtgaaaaatggacctgacaaagcagagatctagaaaagtcttggtagtgccagttctccgtaagcccacgacatcagcttctttgtcatgggctccgatgcaaggataatgttgaagggttattagcaccctaggctaacttctgtgctctttactgaacccatgtaaggcatcactgttgatccccgttctgaagactgctgatgaatgactagccttttcactgatgcaaatgtaccttcttcctacagctttcagcaagggtgtgccaaggtgtgcagaaaatactaattccctctaaggacccttttggtcagaatcaaactgtatattcaacacaacatataggctctcctctgtacttattatacaaaagtcaaaaaatacatggcatagttataaaatgaagttttcagattttttttctcatttataaaactaagaccttcctgaatgttttattttttttttccattttttattaggtatttagctcatttacatttccaatgctataccaaaagtcccccttacccacccacccccactcccctacccacccactccccccctttggccctggcgttcccctgtaccgggtcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttggatactttctctagctcctccattggg

SEQ ID NO: 18655 - DNA, 1192 bp, Mus musculus
cctgaagtccgtggagagggaagagcgtggggaactggagcggatcattgctgacttggaggaagagcaaaggtgagctagacccgggagaagaaaatacactactcgctccccttcccttccttctgtcttttcagagatgttatctaagacatcacaatgaggtccaagtttgagaggacattagcaggctgggatgtgggtagggcctcgtgcatctgtgatttaatgatggatcctggaaaaactcttgcttgaagcccattttctccctcctagctcttcgtgctaataaatgtttttctatgagatgaagagtatcaaactaaatttggagttcccaggcagtttgggggagataattatctgataataattctggttaattttatatttttccctttccatattagaaatctgcaggtggagtatgagcagctgaaggagcagcacctaagaaggggtctccctgtgggctcccctccagactccatcgtatctcctcaccacacatctgaggactcagaacttatagcagaagctaaactcctgcggcagcacaaagggcggctggaggcgaggatgcaaattttggaagatcacaataaacagctggagtctcagctgcaccgcctcagacagctcctggagcaggtaggggtgtggattcctgtgcagcacctccacaggacccacccacccacccacccacctcactgaagcctggacccgtcaattcatgagcaacacagttaattctgtgtatgagtggaatctccactgatacaaaattgtctgttttcctatctgactcatagaaattctttcttcttttgtactaaaatatcaccttagaacagtttgactttaaaaaaaaaccagaatcctgtggtagccacgagcctgactttcatcaggaaagattccacagagaatagggacagcaggtgacctacaatcttcaatctaacactttcttccagagaactaggactaagaaggtacctcagaaatcactgtctgtaaaacaacgacgacaacagcaaaaggaagcagaggaacaggtggctgctagtttgccactgtcatttcttacacgggggatgctctgctatagcagtgacttggaaactttcttgacaacaagcagtacaattttcattttgaggaaaacgtatgtttctgatgagta

SEQ ID NO: 18656 - DNA, 1192 bp, Mus musculus
ttcctcctcaatattcgcaactttggtgtttctatgagaatcacttaagactaactttagagaatttaaaaagcagttagaaagtgagctaacatgaggtgaccagtgttgttacttgggatattttaatgtttggaataaatttgtagactactcatttctgtactgaaaaacacagagcgactataacaaggatgtcaaaaagaaagaaaaattcaaagaccaaaaatttgtaaaagatccaaaagctacagcgtctagatgaacaggcacaaaggtagagagaatatatttgatctgagagaatgaaaatgttatctcactaacagctgaagttaactgggaaggatcagttcatgagttggccagtcaagctaaaagctggagaataggagtgctgggcttcaatgttgttgggtaaggcgatgcctctctctaatcctttctcctcattcaattagtggatctcttagagctgaatacgacgaatgaagttttcaagcagcacaaactgaaccaaaatgatcagctcctgagtgtcccagacgtcatcaactgtctgaccaccacttacgatgggcttgagcagctgcacaaggacttggtcaatgttccactctgcgtcgatatgtgtctcaactggctgctcaacgtatacgacacgtaagtgtgtcatttatcctttaaatgatcactagtgagcgaagcacattgataataaactgggcactatcatcatcgccttgttgttgttgttgttgttgttgttgttgttgttgttgttgttgttgttgttgttcttcttcttcttcttcttcttcttcttcttcttcttcttcttcttcttcttcttcttcttcttcttcttcttcttcttcttcttcttcttcttcttcttcttcttctcctcctcctctccttctcctcctcctcctcctcctcctcctcctcctcctcctcctccttccccttccccttcccctttcccttccccttcttccccttccccttcttccccttcttccccttcttccccttcttccccttcttccccttcttccccttcttccccttcttccccttcttccccttcttccccttcttccccttcttccccttcttccccttcttccccttcttccccttcttccccttcttccccttccccttcttccccttccctttccccttc

SEQ ID NO: 18657 - DNA, 1232 bp, Mus musculus
ttcatcctttggttttcaaatgagaaggttttgtttttaaagaatgcatcctttaagaactttattcttttccctgtaaatcttttctgcctcttcgagtttactttctttcctttttcttcttctctttcttctttgtcccctcaaattgccctaacttgaacttttatgtattgcttcattttatatgcctcacaaacgtggacaactttgggtttgttttgtttgttatcctctcgttggctttgaacagcttctaaggcttgctgcagcgggacacagtggtgttctgactacagagtgcttagtgggcacaggtcctctgtggtaaacagatggggagtttagtgtcgagctttgctcctctattggcgagctgcttgagaggggattatatgataaaccaacgaaaggactgtacaaagagaagaacttccactgggcgaaaatgtggcagccaatatgggatgtttcatcccaggatgagaaagctctgtgtgcccctctgtggactgatatttagtggttggtttagaaacagtttgtatttcatccaagggaaaccactgtgagtaagctgtcttgcctcgaacatgaacaggcagtctgtctgtctgtctgtctgtctgtctgtctgtctctctgcctctgtctctctgtctgtctctcactgtctctctcttcctccctccctcctcccctccctcccacagacattgaaacacaaatgcttaaaatacattcttcgcaaagcccagtaacttattaaccagcacaggtgtagccctcataaaagctactccacttctcctgaggctgctaggaatgaaattttcatctcacacataacattttacatttgtgtaaaatataaaatataggtgttatatttagcattttacagatgtctcgaaggcataagtatttagaggagcttgccttttaatgacactgtttccccctctctggagtctggctgccttatgtgttggttaaacttattggcccttctctctagacttcctggcttaggatcctaaattggctttcacttattattagtgtgtgtgtgtgttagtgtgtgtgtgcatgtgtgagtacgtgtgcatgtggtgtgggtaggtgtgtgcatgtatggttttagagatgtgtgtgtgtgtgcacgctcgtactggtgaggctcagtctggtatagtcagagtacccactattttggtgctttcccgtctcac

SEQ ID NO: 18658 - DNA, 1211 bp, Mus musculus
tcagcttgctttcttatagaacccatggggtattagaggccctgggaatacatgtgagagcattgtggatcccttgtcctgctgacatcgaatgttctcagtatttttaccccattcagtactgtcttcctgtccccagtgacctgctcattgctgtccagtgtgacactgttgtcagcaggaggacattcagggagtcactgctgcagagagtcagtccggagggtcaggagttggctctctgggtgccacgcaagctgccctgctgcgttcagcttcttcctgcccctcctgctcctgccctgtgtatggctgtcattaggagtttctcccttagctcagcacactggcactgcttacatctgagagcatggtgggaatccttgtctgttttgtaggcagaataaaatctcagtgaccaccagtgattttctttctttctttcttttatttaatttaatttttttttacttattcacttgacatcctgttcacttccccctcctggttactccctctcctacagtgtttcccctatcccccttccccaacaaaacagtgattttctaatcagaattgccctcactgagacccctcagccctcagggtggtcctcctgcctctctcctcctccttcctcacctcatgctctgcagaaagttgccttttgagattctggaagatgtttcctaccttttttttcttgaactttatatatatatatatatatatatatatatatatatattttctctcattcccccctcccatgcgcgcgctctctctctctctctttctctctctctctctctctctctctctctctctctctctctctctctctctctctctctctcattcaccatactacctttagcctatcctcattgaaagctgtagttttctcatctgctgggcaatcagctgagtagcccctactaacttgtcaaccttataatttgctagatgagcataattagaagtcttaaccagctgagtgcacttgatattcttgtgatcttgtccataatgaactgttaccatctgccacctcccagactagaagtggacagggtccccttagccactgacagaccattttaaagagattaatttgatcttaattatttaatcagaatacttgggagtggaaataagatattccccattattttaatcagaaataccttttgattatgaagagaggggag

SEQ ID NO: 18659 - DNA, 1161 bp, Mus musculus
agaggcccattggtcttgcaaactttatatgcctcagcacaggggaacgccagggccaaaaagtgggagtgagtgggtaggggagtgggaggggagggtatgggggacttttgggatagcattggaaatgtaaatgaagaaaatattaaataaataagtaaataaacaaacaaacaaacaaataagaaaaaaaaagagttgccatgttcacagtgtctcttttcaacaataaaatccctaaggcaaaacaaaaccacacatggtaggcactcactgataagtggatattagcccaaacatttgaaatttccaagatacaattcacagaccatatgaggcctaagaagaaggaaaatcaaagagtggatgcttcagtgattcttagaagggggaacaaaatactcacaggaggaagtatggagacaacgtgtagagcatagactgaagaaaaggcctccagagactgccccacctggggatccatcccatatacagtcgccaaacgtggatactattgtggataccccgaagtgcttgctgacaggagcctgatatggctgtctcctggggggctctgtcagagcctgacaaatacagaggtggatgctagcagccaaccatgggactgagcatggggtccccagtggaggagttggaaagagctgaggggatttgcagccccatgtggggagcaacagtattaaccggccatattctcagagctcccaggaactggaccactaactgaagagtacacatggagggacccatggctctggccacgtatgtggcagaggatgatcttgttaaacatcagtgggaggagtggcctttgggcctgagtgtgtttgatgcttcagtgcaggggaatgccagggtgggaaggcagaaatgggtgggtggggagcatccacatagaggcaaggggggatgggatagggggtttctgaagagaagatctagataggggataacatttgaaatgtaaataaagaaaatatccaattaaaaaaaacccaaaacctattttcaatgatattttaaatgattaatgagctctctgttaagtgttcttttaggtataattttcaatcataaagataatatttacagatgaaataatgaacagctgggtcttgattattcaagcttatctcttca

SEQ ID NO: 18660 - DNA, 1202 bp, Mus musculus
gttcatcttggcattttgaaaactggtgtctgaatatttgtaccctcttcatctttcacatctttcttttgtctgttgtatgggtatcagtcatttataagtaagtgaaaaacgactggaaaattgtgcacagtattcttattttgagttttatttatttgtatgtatttccccctgcctatttctcatagggaaagggacagggatgggcagaacttggggaaactgtggctctgagtaacccccctccaactgtacatggtgttgtattttttgcttttaaaggtgtttctttctggttatacaatccctaaaatttgggcaggaaacagaaacacattggctgctgacttgagaagcagcagcattgaaattgccctgatgacctcgagccaccccacgctagatgctaatttctcctgatttggcttagatcacttagcttctttaaaatattaatgactctagaggataatttttcctctattagagcacagtggacacaaagctggatgtaagtgacttttaagattgctactgactttaacttgtttgcattttgtgattatcttggcctgttttcagtctttgaattgaaacctgattgaggttatgttgagttagagaggaattttataatcccacccccacccccaccccctcagggacatttttaatggcatatttaataattgacgtggtaaaaagtagattcttacaaggtagattagtgggtgagtcatagaacattgaaaaataattagtattataaattgagtccttcatgacttcagcatttttattgatttagctaattattttgatttagttttatgatttttttgtgctgccagcatatgtatgtaaaacagtttcgctgaaataattttgtgcccaaacattttgtcatgtgtcctatgagttaaaatattttaagcatcctggtgtatattattaattcaaggttgtgcacaggtgccatgaagaaggaaacagctgttcaagaatcatagagtgttgatttgttcgtgtggtcaatattgtcttcttactgcccagactgattcgccccttcattctgtgcatttttctcccaccattggcttattagtaggggacaatgacggcttggaaagccagggatgacaagtgatgtttaaacaaaatcagtttctcctccctgacgtctgtatatatgtttg

SEQ ID NO: 18661 - DNA, 1099 bp, Mus musculus
agcatcttacctactgaactacctactacctctcagctctgtgtgtggtttctgttggtgatccctgcaaagactgtagtgtgttttatgacctcacatcccagtggaaggggatacagattcctgttagaagttagcgggaataccactttcttcttcctgtctgaattcatgggcttcctgccaggtcataacccaggataaagatgataatatcaagtgcatgctggtttgctcagagcctggcaatagcggccgagtgtttcagaaaacctttatagcagaggtgactgtttgacatggagttgactgttctgtgactgtcccctactgcacaatctgtagcaggcagagcaacagacttccaccaccatggtgtctggactcttgaatgtgcccagtagtcggaaaaaaaaaacaaacaaaaaaaaaaacaaaaaaaaaaacccctaatatcataatatacagatagttgcttagctgcccagttgatacatattctgcagtgttctgaggggaatcacgaggcggctgagataggctgtggaagttaaggaagagctccttaaaagaatcatcagctccaggacttcatgcttgccaggtttgtgcagagccaggacaaagccagcaattgtgggcaaagtgtgctcaaggctgtgtgctgaggttggccaggctgcacttggcattttattcaagaatatttgtcatcctgatgggacaggagtcctttacctttcagtcagagagcaggtattatttagtactttcgcggatagatccctaaaagctttagggattcatatggattaccaggggctaaacatttaattgcaaaaccgagagagaccagattgcaaaatttgtaagaaactctcttgcaagagttagaaactgggagaaaagtatttgctggtctgaagttccttaatgtctttgctcagtcagttttgtctttggcttgaatgaacagggaagcctaaggtggcaggagaggcgaggtacgggtgtgtgtgtgtgtgtgtgtgtgtgtgtgtgtgtgtgtgtgtgtgcttgcctttctgtttgctgaaccattagccctgtggtgtttgta

SEQ ID NO: 18662 - DNA, 1203 bp, Mus musculus
gtatttatgtggaggagatatattttgagactgatataccccgtcaagggcacccgtgaattgcattatttaaagtaaattctgtaatcacatagatcgatgtgtgttctcttattgggaacactgggctttgagcttcaggctgtgtcagagtcgccctcctggattctgactcaggaatttccatgagccctgagagtttttccttcctagtgccttggcttagatagtgaaagtcaggcctgtgggtctcagccttagagagcagcctgagttcccccgaagggaggaaagggagagtcaagtgttgtttatttttactcagaaacatttcctggtaaatagatttaaaaggtaatggctttcatactattggcctttgatggtttggtgtctcatagtttggagcttgggtttggctgagaggaggtgaaactcaggaaagtgggtcaggggagggctgacagatgctgcttcagttctggggcatctgaactggaatgtccctcccaaatactgactagggctgtctctgtccgctctgtactatagtcacacctcagcgtggttagccctttcctgaggctaaccttggttaactttcctgcccacagctcctgagcaaggactgctctgattgcttctttgtgaaagctttcttcttttcttttcttttggtttgtctgtttgtttgttcttctgtttttagagagggtttcactgtttatttctgaccatcctggaatttgctctgtagactgggctggcctcagactcactgagatcatcctgtcttggccttccgagggctgggatttgtgttgtgtacttggatggctgcttggctggttctctccaccccgactccacctccatcgccctttttgagacagggtctcatgtagcctcagatgcccaaagttctgagacgacagatgtatgccaacatgcctggtttatggagaactggggatttctaccaactgaggcccctccccagccccttaatatgactatatagtttctaagacattacttcctaaaagggtgtatttgtcactggtaatgggaaaagaaaaaaaaaaaatctgtgctactttcctgattttctttatgctcacagaaaagttgtaagtatatttgcctctctgctttttaaagtctaagtacgtgatgtttggtgtttctgctccctttgagatg

SEQ ID NO: 18663 - DNA, 1228 bp, Mus musculus
ggaccatcatgcaacactcttcgaagtaggcgggctccgtgaggagacggcccagtgtttcctaggcaactccaatcccgcgacagacggcacttccgcttccgcctaggaaaagactgtctactcctgcgtctcggtggcgtctttctcccgcgcctgcacgaactgaggttttgcgtggcggcggcggcaccggcagcggcagcgtctctcacttgaacgccgcgagcggcagcttctcgtctgtgtcctgacctcggagcctacgagcagagcggcgcgatgacggaccggtacaccatccacagccagctggagcatctgcagtccaagtacatcggcacgggccacgccgacaccaccaagtgggaatggctggtgaaccagcaccgcgactcctactgctcctacatgggccacttcgacctcctcaactacttcgccattgccgagaacgagagcaaagcccgcgtgcggttcaacctgatggagaaaatgctgcagcccagcgggccgcccgcggacaagcccgaggagaactgaggtgagcgctgcccagtcttccccgtgtgccggctgcgagcctccttgctcctgcatctcgaccattccgtgttggctgtgtcgcctgacctgcgtacctgtggaggattcggaacaagtcatggagagactgtccgggtccgctccttgtgaactgtgcagaaggagtgatcccagcatcggcaagcgagggagaagactgcacgagagtgatgcgcatttcgagtctgcttttcgatagttgatgtcttcttgcctttttaaaaaaccatatatatataaagtttagggtttgctctattctttggtatggattgctgtgttctttgggaggttattaggagagggttctgtggatcaaggttttgtgagagtataaataggaaatgggggcagaagcacagggcaagtccttaagtcgtcacacacacttttatgatattatcccacctcaatagtcttcacgcgtacagtgtgtctggtcccaaagaaaccttgaagcgcggagattgcccatatccctttcctacccttccctttatgcgctaccccttacccctttttcttgatgattaccctttgtgtcttcagaaatgataaactggcaaacaagtggtatcacgtccccatcctgctcagcgccccattccccccacccctcttcccttttcaccagagcattttc

SEQ ID NO: 18664 - DNA, 1255 bp, Mus musculus
atttcctatgatttagtataaggaaagcaccccttcccttgttcccttgttcccttgtgcctgagtacacaaaacttggagacagatgcattgcacaccatctaaattcttacacactgttctgtcatggttgttaccaggatctgctgatgatggaacaggtgaaagactttgctgctaacgtgtacgaagcgtttagtaccccccaacaactggagaaatgattgttttctttccagaaaactacagcggactcatctacatcaaaaagtactctgaataaatcacctatacaatttgcaaccaaatgcctaataaaatctgttcttgagcaaagtcttcatttcataatgaagtagattcatttagcaccttactgtatttttaattcatcagcagtctacttcatcaggtgtatctaactggtgcacaaattacatcaggatcaatcatgatttcttaaagtctggatagctgatccaaaccaactaggtacttccatacgtatatggaatggaatgtggtgtcctttcacacatagaatgagggaagatatgtcttcaaaagtagatctaggagtggtggactctgaaattaggatgtttaactaactatgaagtttcctggactctgaagtaagcaagagcaagccagattctctccggccaccctgataaggcacatgtgatttgcttgaacacacgtgccagagggcttatcaccaaggaatcagtgcatttgaacccctatggtcaacttttctttactgttgtttcttcaatatttatttgcagcattttctaaagctttgttagcaaccctcagaaggttgtatatagattttcaggctaatgttatgtcgcttactcacaattattaataattacagaagtttattcatttgtgtataaatttaataactttgtattgattttgagtatgataacttgttgcaataaactattttaataaaatatagctttgtttagttaatgctttttagccattaatttatttgtcctttagtaatatttttgctgttttttttttttttgtgagaggttgctagtttaaagttttaactggtatatagttggtgctttcttataacttgtttctttttttcagaaaaactaattaaaaataaattatctcttgtctctagcttacctgtggttcttcattgagaagggcattagagcagaagtgactgaaccacgtgtcagcaatagattatctacatctgctaataaat

SEQ ID NO: 18665 - DNA, 1160 bp, Mus musculus
gctcagggactggtcggattctgcttcttgtccccggtcttggggtcaagtcagggtcagggtgttttagctttggcccttttaccctacactggcttgtcattcttagctgtggacgcgatttgttccactaagaatagtttaccagtccaaggcatatagcatcccatggttggagaaatatagcaggtaaaactatgagcacctgttcagcatctcatttaatcactacgtcaaacctcaagtccagttacacagcacggagggtttaagtagtgctctctagcgtagtatttacactacagtttaagtgattagtattagtggttgagatgtttggttcaggctgggtgcccattctcttggaaatgtatgtccttagtcgtgcttttatttgtcccaagtaatgaacactgtatggagtccccgtatgtcgttgtaactgtgtatgtccccgtatgacgttgtaactccccactgtggagacacataacccacatccagtcatggctgacgctcacttcacgttcctcccttcatcagtgcatccctgggtaccgagctgaggaggctgtggagctcctaaagaccttctacaaacaggagaacccaaatggtgagttttctcctggtggagtgtctcaccgaaacacgactcgctgtgacggaagcttcctatcccttgcttttcacttagctgactttttttttttcctttcagcgccaaaatcaaaagttcggaaaaaggattgtcagaaatcctgattctgtaatgatcaacgtctagtacagtttggagacctggacagaattcctgaccgagagccgctgacgtcgctggtcacgtttatatgttattactgtgtgtaaaaatggtgtcgctcgtcatttgctctgttaaaggaacaaattagcccttttaaaaatgtctggcaatgtaaacaaccgtgagctcttccaccaagctgaaagactatttccaggaaggggcgggattaaggttgaggtcccagagatccgcaagcagcgccgcccttcacccacagcctcagttagctctggcttaatgaagctttttgtggctgtgaagagggccaagtggtgaaatgcttgccatgcaaccatgaggattgggtccccatcagtgccaggtgggtggt

SEQ ID NO: 18666 - DNA, 1134 bp, Mus musculus
aggacaatgtctttgaggacactgtgttccagaagctacgtgctttacttcgggtttcttgaattcactgggggcaagaaaactcatgaacccatgagcatcgatattgttatcgatggataagagtagaagcagtggctttaatgtccacacatgttcaatggcaaggacagatttatagaaagtatgctctctggcctgaaggaaattgattttcaaactattgtttgaagcatccttaatatgtcagcacatagtggttaacattcaaagttttaagtcctatgtctaggtgcacagtcttttaaattatttattataatagaaaaccatctggaaaagatctgattcttgactgctcccatgaaaggatcattagaagttccatgatactttggttgctcagcaattggctattcagccttgcctgctttcatggctgacctcatgtttctttccacatatttattattttagccatcagttttccactcatcttgtcaatcagccaaaagatggggccaaccattttcaaagagtgtggtgctctagtcttgaactgtcgtcgttatgttggtagggtggtaccactgtagtagagtgggtctatttaagtataatattctttatttgtatttgtaggtggcgtataaatgtgtgtgtgctcgcccatgcataatgggtctatttaagtataatattcaatattatgtgcaatgtctctagtcatggaaatagacatatgggttgtcatgagaagaacctgggctacaacaggtgaaagatgttattctgggctgttttggagacattaagatccaagaggaagagttaccatggaacaaaacccaacagatcactattgacaggggctggtctgaggctgggaaggtggctcactcagttaagcaatggctgcacaatcatgagattatgagtcctaatctctagtgttgatacaaaagctgggtacagaggcatgcacctgtaaccccagtagggtggagacaggtggatccccgggtttcctggccatccagttctagctaaaataacgaggccaaggtctgttgaaagagcctttctcaaaaaagttggagtggagtgtgggcgtaaggcacttgatatggattt

SEQ ID NO: 18667 - DNA, 1109 bp, Mus musculus
ttaattaatgtattttaatcttggcactgtgagttattctttagaacagatgcaattagctaacatttctgcagaatgcattttcaattgtttttactaatgacaaaagtatttgtaaggtcttttcttaagatgtctaagtgaattaagtctggaagtgtgctgtataatttctataatggtcattagagttagatacagttagaattacatatttaacaatataaaataatatatgggtcattctcagtaacacaggatttctgtgttttattttctaacatttaaagccttaataaacatgtttttggggtcgggattaatatgttggcagaggtatgagctcactggtggagagagggagcagccattaacttcaaagtacattgaactgccaggaagccctgggtgctgcttcttgatggctaagaaatatctttccccatcccttgaaatataagagacaattctattcaaagtacccactgtgttcactaagttgttaaaatgcttagcccaagatttggtcctcagagtttaagtgacggataatgaccagaaatatgaaaggatgcttttggaagcctggtacatccttgttgactcttgttactagtatctaaccctttagactcccattttaataagtctgagaggtgcacccatgtgaggaatgaagactgtagaggatgttggcatccaagaacctttcgggaaggaagtagaacagagatgaaggagggctcagtgaagtcctcctttttgcctctaagtaagaattttagcagtctccagctgcagactccctgcatcctgactcttggggcaagttcccactcccggatcagctgtggtttagcatctggctagaaagcagtggtagatgcccagaggggcagggcatatgtgcccagggtggtgtggcatatgtgttgcccccttaattcctcagtctggagctgagtgatcatggtatatagggaaaaaattaaaaatccctgatggagcttattttctcactgttggaagaggagagtggattgtaagccaagtttagtttgagtcttaagaactcataactggggagaaactcttggctgccaggattt

SEQ ID NO: 18668 - DNA, 1194 bp, Mus musculus
atatccaaggaaaagtatctagccgacatctgcaagcaagaatgagtatgtatgctgctagcatctgaacactgaggaagccttgactcagaattggtcatctagggagaatgagtacagaggggcgtgctcattgggatgttggctgcagacacatttggctgcaatggcatcgaatgtctgcaactaaagtgtatctacctctcacatccacactactgtcatctgttcttcctatatctgtgcccacatcccctccctcatccccaccccctctcctttctttacccatcagcttcattctctaacaaagtgaatgtcctgtgtctctatctcgctttcctcagaaagaaaatccaactgaggaagtctgtgatttggttcccagcaggtcagggtccacccctggaggcaagctgtacaaataccatcattagtgttgcagaggaaacagacactttcaagagaagctttgtgcctggagaatgtcatcaactgtggtacaaggggtggagctctgtcctggagggaaggaaacaagccatagacttagctggatcagctagtatctttctttccagaatttgaagctagaggtacaggtcattcattcaagagtctgatgagatatgtcttggtggacttaactgtagatattccccacattagtgagaagagctgttgtttagtccgtggtaagaccttatgtctactttcactgtgcagtgctaggtgttttctttttctgttggtttctttttcaattacacttttgaaattataatataaccacgacatttcccccttcccattcctccctcaaaccttcccatatgcctgtttgcactttccttcaaatttatacttctttttagcttttttattattacatgcatacatgcatatacatatatgtaaaatatatacatacaaatatatttttccactgtctcttctgcaatatcctctgagctttacatgtattttatagatttcttttgtttccagaggaagtatggcttgtgctattatttaaaggaacacatcttcgaattgcttgaaaatcttaacctgaaagttttgtttaggccagagatgatgctacctctgatggcctgaggaccacaatatggtaaggcagtaaaatgaagcatagtagggaagtctgaggaagtaggacaagatggtagaagt

SEQ ID NO: 18669 - DNA, 1188 bp, Mus musculus
tgattgttttcatgtttagttgtatgttttaatgataaaaatgtggaggtggacttaagtgtctttccatggatgaagcgaaatgaggaatattttaatgcttaataaaggaaccatgttctgcatggattatgtttacccccccccccaacacacacatacacttttattggaggagatatttatattctagctcaaatgagggctgaagggtttagtctgtttgtggtgttccatgaagagagcctcagcagtctagggaaataccaagctgctctttgtgtttcacacaaccagatgttttggttttatttcccttcacagttaatttactaaaatacagactcctggtttattacttattgatagaaaattatatgcatatgagttatttttattagtagcaaaacaaagattggtctttttacgtaagtataaacacatcgttttgaaataggtaggtaagtaatagcacaccgtgatgtaattaatctgtgctgtgtcggaatgtgcttctcttaggggatatccgcctgaccccggaggacttcgctagagctcagaagtactgcaagtatgctggcagtgccctgcagtatgaagatgtgggcaccgctgtgcagaacctccagaaggccctcaggctgctgaccacaggcagggagtgaagcctctgttcacggaagccagtgttttccgcatagagaactaacagtccgttacactttcctcagccttcaggagcaggggactacagaaggcctcagttccccgaggaagacaatgactcctgtgtggttcagaagcatttaccagctgcctcagccagttgtcattgagtgtgtagagctgatgctagcatcgaacccgctgtgaaatgtccctgtagaaaatcatgttgggtataatatgctttcttaatttatacacactaaaggaagtttttgaaagatctgtaatatttggacaaacaaaccatattatgttgctttaatattctaaattaaacttttaataaagattaccagaatagtccgggttggagatcctgactttttcttcccttaggatttgcaaggcaaatgtgaacatccaaaagtggtaaatgataagagagattaaatgcactttatattcctgttttaatataactgtaaaaatcaaagatcacagaaggaaacaccatgt

SEQ ID NO: 18670 - DNA, 1161 bp, Mus musculus
taaaaatgtattatcattgttggagagtttaaaaacctcagtcactgattaaaaaaagcaaacactttctttaacaatcagtaaaattaaccagacaaataaggactggccatggaatgtttagaatgaagaaaaaccagacctttcagacttagcttagtggaaatgttagatgttacagctgcttagtggaaagaattggcagattttataaaattaaacagactcccacctttttacccagcaattccttttctgatacttacccaagagaaataaaaacatatgtctagaaaaagaacttgctcattgaaaacttacttataatagccaaaatcttggcacaacatagatatctacatctgaataaatattaaacaaaattgtgatgttactcaatataatacagaatcagcaacttgtagcctagaatatggataaatcctgtagatttgctgatcaaaagaagagtcaagtggtgtactgtgcatggttgcctgtatataatgtatagctacagacaagttcatagtaataaaaaaaatgaaaaatacttttaaggtatttttagggagtcaagagaaatggatcacgaatgggctgtaaaaagttttgcttagttgtaaattatatatattgagaagcttatggtttacactggcatctctttattggctctataatttatatacttaacatttgtacatctcaaattatatatcttattgcaaaagtttcatcattgaactatgtctaggcttatttggagtggttatacagcagcttactctgtttttgagcaaatgggtaaatatagaggaaagcaggtctgtcactggaagaaattaagcccaagaagagagaggcaggtggattgtgttgcaaaattaaaagatcttaattcatgcttctgaatatattggtttctattataacgtttgtgcatatgtatacatagtatgatttatgtctatagttagcaagttttcctgagtatatatttacactgggtatgtaatatgtgcaaaaatgtatacaacctagttcctatttctcaatttcaagacagtctaataacaatgaagacccagaagcagagaacaccctgagtacctgatttgtttttgaataccagtcttttctaacatgaaccagtgctct

SEQ ID NO: 18671 - DNA, 1190 bp, Mus musculus
caatggaaaagagctgaacaagagcattaaccccgatgaagctgttgcctatggtgcagctgtccaggcagccattctatctggagacaagtctgagaacgttcaggatttgctgctcttggatgtcattcctctttcccttggtattgaaactgctggcggagtcatgactgtcctcatcaaacgcaataccaccatccccaccaagcagacacagactttcaccacctactctgacaaccagcctggtgtactcattcaggtgtatgaaggtgaaagggccatgaccaaggacaacaacctgcttggaaagttcgagctcacaggcatccctccagcaccccgtggggtccctcagattgaggttacttttgacatcgatgccaatggcatcctcaatgtttctgctgtagataagagcacaggaaaggagaacaagatcaccatcaccaatgacaagggccgcttgagtaaggaagatattgagcgcatggtccaagaagctgagaagtacaaggctgaggatgagaagcagagagataaagtttcctccaagaactcgctggagtcctatgccttcaacatgaaagcaactgtggaagatgagaaacttcaaggcaagatcaatgatgaggacaaacagaagattcttgacaagtgcaatgaaatcatcagctggctggataagaaccagactgcagagaaggaagaatttgagcatcagcagaaagaactggagaaagtctgcaaccctatcattaccaagctgtaccagagtgcaggtggcatgcctgggggaatgcctggtggcttcccaggtggaggagctcccccatctggtggtgcttcttcaggccccaccattgaagaggtggattaagtcagtccaagaagaaggtgtagctttgttccacagggacccaaaacaagtaacatggaataacaaaactatttaaattggcacaaaaaaaaaacaatgtggaggtaactgaagccagcagacccacggggaatcacatacaaacttctagtactagagatatctgtcatctaggtggtctatagaaaccctctaataaatagataatagtacactgaaggttaactactgacaaataattttgacttgagaaacacatttcttgtgtgtaactgcttctgaacttcaagatattatcatacagtggata

SEQ ID NO: 18672 - DNA, 1109 bp, Mus musculus
ccttccttccttccttccttccttccttccttccttcctttctctctctctctctctctctctctctctctctctctctctctttctttctttctttctttctttctttctttcttcctttcttccttccttccttccttccttccttccttccttccttccttccttccttccttccttcccctccccctctctttcttttctgttttctgttttctttttgcattttccagtgctaagaaattagtatctaggttaacataaagacaactaaaggcatatatttcattctggttggaagagttatgtttttaatataataaaggaaaggcaaatagacatgtttgaggcctgatgatatttatttatcatataaaagttcatgattttgttagtgattaataagtgtaagaaattactttaaaactgaaagcactgactctgactctatgaaacattgtgagtaattattttttttttgagataggacatttgccactatacattctatatatttaacaccttctaggtgttggattatattatttgataaatcctggctgtggattccatgctactctccccagggttctggagtgttcctgaatgagacataaacacacagcctttatattttgatattccttaaacagcacagtagctgttctattgtctcacctccacatggttaatccatttccctcccataatcccaagttatcacttactaaattctatattctaccttggctggcctagacccctttgtgcatccctctggcccacactctcctgactctcacttggcaactattcctctctgtccttcacttttctcaattgtggtgcctcctctcctccacactctccaggtaccacagatctccttctcttccagtctctgcgtcccaaacctaagaatcctaaagttcccactctgcctgcctttcccagccatttgttgctggcatctttatttaccagccagaatcaactgggagcatgggccctccatgtggactatgagcaaacaattttggggacctaaattaacaaaaatacaagcagcataggccaaatccactacatccaggtttgagtaatctttg

SEQ ID NO: 18673 - DNA, 1213 bp, Mus musculus
catgatttctaccatttatgttgaattaatgtcagttactagaaatttatagtaaaactcccaaagacatagtttttctttagtattgaaaatattaaagaaagggaaaaagcaaagaagaagaagagcttcgtttattctaaactggtagatgacagctggacattgctgaaaaaaatcatctgacccaacaaatcccctgcagcctcttcatggaacctgaaatatcactgttaagatgagcactttcctctctccaggtgtcttcatcagagtgacatcgtctttaaaccccgcgtggcaatacctgacgcaccaccttgatgcccagggaagacagggcaacctggtagtccaactacttccttaagatcatcctacttttagatgattacccaaaatgcttcattgtgggagcaaacaatgtgggctccaagcagatgccccacatcagcaagtccctcagagggaaggctgtggtgcagatgggcaagaatactatgatgcacatggcacctggagaacaacccggctctgaagaaactgctgcctcacatccgggaacgtgggcatcgtgtacaccaaggaggaccgcactgagattcgggacatgctgctggccaataaggtgccagctgctgctcgagctggtgtcattgccccatgtgaggtcactgtgcctgctcagaacactggtctgggacctgagaagacctctttcttcaaagctttaggcatcaccactaaaatctccagagtcaccactgaaattctgagtgatgtacaggtgataaaaactggggacaaagtaagaaccaatgaagccacactgctgaacaggttgaacgttgaacatctcccgcttctttgggctgatcatccagcaggtgtttgacaatggcagcatttacaaccctgaagtgctgggcatcacagaacagaccctgcactcttgcttcccatatggagtcgcaatatggccagcgtctgtctgcagattgcgtacccaaatcttgcctgagtgcgacattccattatcaaagggtacaagcgggtcctggctttgtgtgtcgagactgaatacatcttcccgcgtgctaaaaaggtgaagaccttcctggctgatctatctccatttgtggctgctgcccctgtgggataggtgtgtttgtgtggtgggggtggtggtggagaggtaaccaggaaataggaa

SEQ ID NO: 18674 - DNA, 1252 bp, Mus musculus
gtccccgcggcaatgctgccgcccaatgtcatagacactgatttcatcgacgaggaagtgcttatgtccttagtgatagaaatgggtttggaccgcatcaaggagctgcccgaactctggctgggccaaaatgagtttgattttatgacggacttcgtgtgcaagcagcagcccagcagagtcagctgttgactcggttaacctcgcaggcggaaagaaatcaccctccccaccccacccccacccccaacttcttcggtgtgaattaaaaaaaaaacaaaaaaacaaacattcccttagacgcagtatctcgcttttcagatcctgaaagggttgagaacctggaaacaaagtaaactataaacttgtacaaattggtttaaaaaaaaaaaagattgctgccactttttcctattcttgtttcgttttttgtagccttgacattcacctcccttatgtagttgaaatatctagctaacttggtcttttttgttgtttgtttttactcctttatttcctcactttctcccgtgctcaactgttagatattaagcttggcaaactgcttaatcttgtggattttgtagatggtttcaaatgactgcgctgcgttcagattcatgagtgaaaggaaacattgcatttgttggctgcatgatctttgaagggcagatattactgcacaaactgccatctcgcttcattttttttaactatgcattcgagtacagacttaagttttcaaatatgctaaactggaagattaaacatgtgggccaaaccgttctggatcaggaaaagtcataccgttcactttcaagttggctgtctcccctcccccatatgtacagacaataatagggtgtggaatgtcgtcagtggcaaacatttcacagatttttattttgtttctgtcttcaacatttttgacactgtgctaatagttatattcagtacatgaaaagatactactgtgttgaaagctttttaggaaattttgacagtatttttgtacaaaacatttttttgagaaaatacttgttaatttattctattttaatttgccaatgtcaataaaaagttaagaaataaacttgttttctaaaagtcagtcatttggggggggttgtctttacattccacttgttattgcgagtaagctttcaaaggataataagtttcaggacactaaaacaggtcaccgtgagcttaagggaaagcaggatttaggataattgacataatgctgctg

SEQ ID NO: 18675 - DNA, 1945 bp, Mus musculus
ataatacttacaaatttgtctccgaagcacaaagctgtaattaggaattagctgtttccctatgagtctgttgtacactcaagtttaaaattttggtaagtttctattcaaattcatatttgtcttcgtgtttctgattcttttaaaataaataaaatacttgtaatgcagttctttaacctggtgacgttttctagtaaaatttcactgtgttattgttccgaagtcaatctattcactgtaccacgtgagttctttaggttaaaagacactgtggagctgtaagccacattccgttcttgttccttagattgatttctgcccctaaaaggaagaggtcttatttcagttggataacatttgcatttgatgctatgttgatgataaagtgaggactatgtatatggtcttacaaaagaagcatgagccctgcattccaatacttaccttttgccttttagtgcattaatttcacttttgtctggaagggaaaatttggctggttggagaaaaaaaaaaatacaactaagcatacaatacttgctataaaggtaaattttactttggaaatcttctgaccttaatgttttcaccagtctttgcctgaacacgttgattagaattggtctatgtcaagaaggattatcatttctattgtagttgggacagtaaagggtatcagtcacctaggagatctaacttctgtttctgatgagtaactcatagattcagtaactcatagattgactaataatttaaagtgatttttatctactttaatatctttagtcatttatttttaaagtgttccatactttgagcaagtaaaattgcttcagttttgagacaagctaatttctgatcgtattttcttcaggccatctcagctctctgctgtttctgattacctgatcacatgggaagcccttacagaggggcttctccaacatcctttaatttccagtttttgaaaaagggattcatttttctaagtaaaagaaattttcatacctttttgggaaaaattagctcatgaagaaagagttttatatgtttaaatgataaaacttaacagattgagtcataacatgctagactaccaagactacctttctgagttcctcgtgtcgtcctacaataccagtgctttttctgtgcagtctgctttgtgcctgttttctaaccttgttgatttttttgttcaagtccttgaagcagttgttgaataattttagttgggagattggggaagaggtgaggaaaaagcacttttctttagggtgtggttcccatgacaggatgctgcctaacctagttcatcttcataccttgttgactttattattttttcagataattgaaagagaatataatgaatggacaccatgaaaaccagctcaaaaatatgttgttgtctacaaagatttcttgtcaagatgtcttggattgcacttttgttgagggaagccagtgtaaatacttaaagaatgttgataaaaattgaagcatttgggttatggaatcatgtgtgatgttagagggtttctgtatgtgaaaggtgtgtattaagaataataaaattttagaaacaaatattaaactttgcattttagattttgttggaagtttttgagaaacggggatgtttggtaagaaaagatagtagagaagtagggatattctcagagtttaaaaaaatcccagaaagccattccaaaagtactactgcaactaatccaaagtgaaaattccagagtagcaagatggctcagtaaataaaggtacttgttgagtttgatccccagaccttacatggtggaaggagagaagcagctcgagaaagccatcctctgacagaacatgtatgctctggtgcatgcacatgcatgatagataaatataaaaaaaagaaaaaacagggacaggacccacaattagaaattct

SEQ ID NO: 18676 - DNA, 1443 bp, Mus musculus
atgatgtctgtttccccaggcccgtctgaattgcaagcattgtggcaagcctgtgatcgacgtacggatcgggatgcagtacttctctgagtacagcaatgtccagcagtgtccacactgtgggaacctggactaccatttcgtgaagccattctcttccttcaaagttctcgaagcttattgatgaaagctttgctttagtaatagctattttattgatattattactttactacatatcttttataggggaacattctgtgacattaatttcttttctaatttgaagcagagtttactttgtatatttgtgccactaaaatggggacttcctcttgccctttcctgattcccaaatgtcaatgtgtgggtaagactggaggccagatggggaattgtgcaggtttggtagggttttagtctcatgcagagtgtctgatggagttctaaggtagtaggaagaatgggtgccatttaggggtgggaatctggctaaactagaggtgtggtaggagttgggagggagcttttactaaatgttagctttcttgagactcactgttagttctctgggccttggggaaataaatgacaagtgaatgtacacctgagcctggacagccagtactgtattaggctgtctggactctgtttttcagcacaggttgaggtgcaattttctcccactgatagatgatttgagagtagaactgagtgctctttctttgactatttgtctaatttaacagttttcatactggaaataatatccaaattatatgacacgtgaaagctgttgctgtgtaggtgagctgaatctagcaggtcttgtgaagcaaatttggaaatgatgcacactgaatcaggcaggcagaaagacacactttggttatttgaactgtatctctagaggtggtcagagagtctacagaaaatctgtatactcggtggttttgatgggcagcatttacaggttgcattgctgaagtgctgcctggtatccagagctccttgcaggtaaacctctggcctgcctgctgtgctgcagaaccacctgtgccacacttccttttcagtatatctagtgccacatagtcagagccaatctgaagaaggaaggcgacagttagaatgatgaatagtttttattcttttaaaagtaagttcagttttgggagcagtaatgcaaaagagcatatctgaaaatagatcatcctaaagattcccatgatccctcactgttggttaaagcaaaagtagcatacagaccaagtattccaaaccaacctctgtgcaggagaatgtggaaacttcaatatgctgaagacatggcctgtacagttagaattagagacttacttcttatgaagcaatttggtattttcaagtatgatatagaagtacatattaaaagaatactaaatcttacccatttatgactag

SEQ ID NO: 18677 - DNA, 1171 bp, Mus musculus
gtttggctctcagcactcacatggtggctcacagccctctggatttggttctcgtacacacatggtgatttatagcagtctgtaagtccagctccagaggatctgacaccctcctgtggtctctgtggacacttgtagacatagaagtgagcaagacactcatacacagaaactaaaaatacataaatctaaagaaaattttaagaaagaaaaaagttaagatatgccaaattcttttcacatttctagtcaaaaatatataatccaaccactgagagataacaagtaattaatattttaatattttaagggctggagagatggctcagcctttaaaggctaggctcacaaccaaaatattttgacataccttctttcagccttaaatttcttttttttccaaccagaaagtacttgagatataaaaaaaagcattgtaattagaagaattaagaagatttaatatagaaattaagtacatgaaaaatacaaaaacaaaagactcaggtttataaattcatcttaaaagtagcctgtgttcagtggtaatcctcaccgcaagatttgatcatagtttgagactttttaaatttacattttattttatgatatgttttgtttccatgtatgctgtgtaccacttacatgcctggtgtctgcagaagtcaaaagaagtcattggctccccagaaactggaattatggatagttgtgagctgccacgtgggtgctgggaatcaaatactggtcctgtgaaagagcagctgatgttaactgctgacccatgttgccagcaccacaattctttttcttttaatttatttgtgaagaaaaatatgtttgtgattagatgaaatgtttattcataaaaaaaatctattacagaattaagaactattaacggataattgataaaggtcattaactatatatacaacactattggtcagctagtcttattctgtttccttctttagttttcccaagggaaatattaaatcatacctttagcagagtagtcaagtagaagtcagtggtagaagttgtatagttggccttgagtgaggaagcactggtcctttgtcttaccatttattgtattgagattatactgtaattccatcatttcctttccttgctccaatcttcctgtacacccttctgtgctctc

SEQ ID NO: 18678 - DNA, 1117 bp, Mus musculus
cccatacattactttttaaataataaaatatttaagaacatcaagaaacagggtgaaagaggacaatatatgggggagtgatttttatactctcagaccatttgtcaatgtctaacgatattctgggttgttataaaatgggagagggaatggttttgctggcatgtagtgggtaaaggccagagatacgatttaatagcccagagtgcatgtataacaactatctgcctcaaaatgtcagtattattgagatttgagacctggcacggactctgacaggagacaggaaatggctagagtttcaggagttattctgaaggcaaacttggttaagtgtggtctacttggcataatttggatgggagagatggtggcaaggatgggggcctggtgtagagaggaccgctgaatgtgactgcaggccttgcggatgctgctcaccttcatcaaggaaacagacgtcttattatggtgaaagtgggttctgttcacgtgttggcagtctcttcctcacgtatatcgagggcagggagccgactggttcacatacacgttgggaccttgattggtccagtatttttcaacattagttaataaaagtcacgagagagggctgagtcatctggagaaatgaggtagagaacaaagaacagagggcctggagctgaagcaggaaggggctggcgctgagcgcccaggcgagctgtcctcttgcaggagctctgatccctgcccagccctgggaagtgggcatcgggcgttcttatcaacaggagcttgggaggcaggaagttacggaatagtgaatgtccttcccttcccattatcccttgccaccttgaagctggttcttcactggagctaagtcactccgacttgggttggcttgcttttgagttatatgtggtctttttcttttgaatagagaagagtttaatttataatgaggcctcaaacagtcacttcagagagaggtagattcttgtgattgttttctgggtgcagactgacacagttttataccattatatattatatgtattatatatatgtgtgtatataatgtgtatacaagtgttctattagtatttagagagactattgtgaaccattatac

SEQ ID NO: 18679 - DNA, 1115 bp, Mus musculus
tttcactgtgcctctgtttagtgtctgttttgatgacccatccactggtgagagtagggtgttgaagtcctccactattattatgtgatgtttgataagtgatctaaacgttacagatgtgggtgctctcgtgtttgaggcatagctgttcagaattgagacatcatcttggtgaatttattcctttgatgagtatgaaatattcctcccattttttttgactacttttgcttgaaagtatattttattagacattagaatggctattccagcttgattcttgggtccatttgctggaaaacctttttcctgccctttactatgaggtagtgtctatctttgttgctgaggtgtgattcgtgtatgcagcagaatgatggatcctatttatgtatccagtctcttagcctgtgtctctttattaggaaattaagtccattgatgttgagagatattaatgtccagtgattgttagttcctattattttgatggtggtggttcgttctctctctctctctctctctctctgtatttctcttgttttcttttttgtgagattaatttcttgtgttttgttgggtgtagttaccctccttgttggagttttccctctagcatctctgtaggatgggattagtggaaagatattgcttaaatttggttttgttgtggaatatcttggtttctccatctatggtgattgagagtttttctgggtatagtaatctgggctgacatctgtggtctcttagggtctgtgtgacatctgtctaggcccatgtggccttgagagtctgtactgagaatgcaggtgtagttctgacagttccccctttatatggtacttgcttttttttcccttgcagcttttttttttaaagatttatttatttattacatgtaagtacactgtagctgtcttcagaagagggcatcatatctcgttacagatggttgcgagccaccatgtggttgctgggatttgaactctggaccttcggaagagcagtcgggtgctcttacccactgagccatctcaccagccccccttgcagcttttaatattctttctttgttctgtatatttagtgatttgattattatgtggcaggag

SEQ ID NO: 18680 - DNA, 1580 bp, Mus musculus
tgcttctgtccaggtgtgacattttattggaattgcatttttgtttgcttcattctaagtatcactgcaatcattgtttttatattttgctgttgcagattttacaaatgcaagttcactcttactaaaaaataaatcagaactctgctctgtggggtttctaaacgtctgttacccgcggaatgttctactatgttttagctgtttttatttctgtttctaattccctagtgacattttaaaagatttctacatctgggaatatgtttgcttggctttcttagcacatttttcataactttctgttgcttacataattgctatcattatacatatgtttgtttatatactcaccatgcaaaaacatattcaataacctgaccataacagtatgtagtttgctgacaacttattaccttgaagaaagtgaagtttactttgaaggagaagtaccttagcacccttggtccgtgtgagcgatagctagaccctgcactgaggagagctgtttcattgcaggaccagacgacagtacggactgtagcctcagctgcaactgccaatgagatccgtaggcaatccagtagttatgaggatccctggaagataacagatgagcagagacagtattatgtaaatcagtttaagaccattcagcctgacctaaacggatttatcccaggtgagtcgttgaaaacagaagctcttctagatgggctaggacagaggctccattgcagtattgacaagcagacatgttctgttgatcctagattttagttattgctcacattatttgtctaaaaggactttatagtcagtgggaaatagaacgtaactttttttttaacattatatataatgttacatctcccagcctaagacaatattacctcctattcttggatctgtgtgttcagaacaacattaaacaaaactgtcttcatatttcaggatctgcagctaaagagttttttacaaaatcaaaacttcctattcttgaactttctcatatctggtaagtatggtacatcactagttggttcatgtgggttgtttcaaaaggatttctggcaccttaaaactagaactggacttgacctctgtagcgctggtggagaacccagtatggctgaggacagtgagcctctctttctaggaaagaaataactgagactagttagagaaagtcttgggagctaaaactaaagctgtgtttgttggcttcctcctgttgctatgtactgcatgaaaaaggtggtcactttgcctgtgtcagtttctcctagttctcagcaagtttatatctagctagaaaagtaaaacagtgcttagctctcgtgttatatgtagagtaagactctccagatggctgccacataattggaattcatccttagaacacaaattataaccctaagttacttttcaggaggcagagatgggaggattgtgagtttaagaccagcctggttataacatattctgtgctgcaattcttggagttgtttaaatgtgtcagagctaataaaaagcagttagtttttttttgatcttattaaaaaaaaaagggggggggg

SEQ ID NO: 18681 - DNA, 1191 bp, Mus musculus
gagagataaaagtgcacagatttgttgttgggctaagttggatagacactgaatttggattattaagtattcgaaggctgaggcagggcgatttctgaaagtgcccagcctgggctctagcattagacctcgtctcgagttaagatgagaagggggaacaggaacgctttcctctttcccatggggcctgcagcagacttggagagactttttctcaatgttatttactatttcactgtttctaaatgcatggtctattgtctaaagtaggttatggtgtcagtcataaatgttttctattcagtatgtcttagtatgatgagggttcattattacatttttataatttttttttgatgactaaacaaatctggacattttgaatttgattttagataatactatttgtgtgattatatggtctatagttactggtagctttctgtaaaaggaaagagacaatagctgttgagtatacagatggttttcttaaactcgaagtgactaaaaggtaatgggctgttacactcccagtgagcctaattgtaaagttgtcatcgtcctcttgtccgtactcttgcctaagctttccttcagatgtggtaatgaaaggttatactttaaggggaaattatggcagaatttagctcttaagtagccatttatctgtaagattgcatttggtctcctaagaatgcacacagtctgtctttctcatcacgacctagacagcgggaagttaccctgaagcagttacacggtcatttcctccagagtaccgtttcactgggcgaattctaacccagtcattgctaattccattagaattttaggatgtgggttttttctttttatatgaagagtgctgtgagtattctgatcggggttacattgaatctgtaaattgcctttggtaggatggtcgtcttcgagatatcagttctaccagcccatgaatgcagtcccttttctagtgtctttctcagtctctttcttcagaaaggaagacagagggccttccgctcattggttagctttactccaagatgttgtgttgtctgggatgctgttgtaagtgggtgagggggcctggtctctgtctcggagttgcttgctgatgtgtagaaagacgactaatcttagcgcattaactttgtctcctgctcctttgctaaagctgttgctttttct

SEQ ID NO: 18682 - DNA, 1148 bp, Mus musculus
tgtgtatatattgtatatgtgtaagtagatgtttccctcagagggcaacttatcatttttaagaagcagatttagtaatagttataatacaactttgatgaaaaaaatctgtactgttactaagatctcaaatggaatttcctacaattaatgttgacttatcattccacctgttttaagaggtatgatatttctttgtgtacctctcttagaaagtagctcttcccgtgcatctcctgtgtataacacatactcaggcagctgctcgatgtgctctcgtggctgcattctcacttcctagcatggggaggggcctgattggcagctctgtcttgtgatctggcatggccctgtttgtagtgctgatcgcagaggttgacttgctacaaattgataaataagctaaaacgttattaattccagaatgtcttgcatcttatctgttatattttattaaatatgcatatgtataagatatgtgcacgttcataatggactcatctttcaggggtcgcactggcaagtcgcactgaatgctccatgctgattagaacctgagctcctcggcttctgtggatcagtgttgtaactggggtttgagcaggacctgagttaagcactgttctggtccggacgaccctgtgcgtttctacctggttgccatttccgtcacctatgctctgtctcctttacggtgtcttgagtgttaattctgtacaagttttaatctcatccatagagattacattaaatttttactgtacatttgcttatgaaggtgtttgccttctgtttataagatggcccagcacagataagtatgaagtgattatgggaattacaaactacagaattttgtcgatcctgcgaaatgcatcttgcagtgcagcctctgaatgacttgctaagtcttctccagtgcatctactgcatctcccgtgctgacgtgtctctcctctgtctgtccagcagtgggagacatttagtgaacgctcttcaagctcacaaactctgacccaatttgattctaacattgcaccagctgatcctgtaagtcaatcacttagcttgcttgtttgaaattaattttattaacccaatatccatcattatggtttttactgatatgcatgattcagtgtagtgct

SEQ ID NO: 18683 - DNA, 1102 bp, Mus musculus
tgcattcctttctatataattttaatgaggtatttccatgtatggctccattacagcctggctcctggctttcagaggtttttgagtcattgcttgcttgccagttactttatgtcatggattggtcattaacattataagcatttcgaaaatgctatgacacttcttatggtaacctcatcatttatttaactgtgtgttgtaaattaggactttagtttcatgtttatctgtcaagtgtctactaaatggctttgtggaaaatatcaaaatgaaacaattccttttgagcagtaggtatgcctatcttgactttttagtaaactttgtgtttataaagatatctgcacaatgaaaattagttattattccacatgacgggctatatgcgaaagtcaacgtatgtgctttgagaatttagtgaagttaaccctaatacagatggggccttagtttgtattttaactccttgcccaattagccttagaaattcatttttgattgaaaaataagggccgtataataggaagaggaggagctgataatctgtgtttttattaaattcaacacccaagtaaaacaagtttcattaacgtaagtccatctactaagaagactgaagcaggaggaccataagtatgagctttgcctggacggtagagtgagattatgtctcaaaaataaataagtaaatacacatgaatgataaacagtgaatcatacaagggatggtttgaggaaaataattaagcattctaaatatcacccatttataaatcgtatcaattctatataattcttatatacctgacaaagtttatctaaatacttttgtttaataaatattttgaaatagtttaaatcagattattgcttgaatagaaagtaatcattctaggttcttgtattagggaaagcattatccacaaagtgttaaggattcaagtctttatctttgtggttgaaaataattgaggatatttcctttttgttttccgtgacaatttaaaattatgcacgtagtttgtttaattcagatttcagttacactttaaaactccatctctacaaataatttttccaaactgtttcaatagctgtt

SEQ ID NO: 18684 - DNA, 1886 bp, Mus musculus
tctcttctctttagccatattccagatcatctccctggtaatctaccccgtgaagtacacacagaccttcaggcttcacgataaccctgctgttaattacatctataactgggcctatggcttcggatgggcggccaccatcatcttgattggttgttccttcttcttctgctgcctccccaactacgaggatgaccttttgggggccgccaagcccaggtacttctatcccccagcctaatgtgggaggaagagcctgagaaaagcctgctgcaagatggatctgaggaggaaactgttctccaaggcacaaggaacctacgtttgggcaatgttcatatgatcagaaatgttagaataaatgctaaagaaaattcttcataattagtgttaagtttcatgtatgtcgtgtggagttaaaaagacttgaattctgtttgctaagtatatgctaatttttccttatgtcaattctataccatttaagcttcatttgttaaagaatatgcctgtgaaacttgataaggtagaaatgcagcagcctctcatttaataatctgatggggcttctgtttttccacatagaatgggttgtttctgctaagggctacagaggaggaaagtcactggcaaaacttccatgaccaaatatcctgaaattagtttgtttttttttaaaagaccttattttgagttttcagttacataaagaagcagaagcagattggtttcctaagtgagcatcatttgtgagaatttttagtcagtgttttgaacaattattgtttttctaagcttcatgttgactttctctgatgcgtagaaaagtgttctaacgtggctgaggttaagccgctgtcattactgaaatgctaagaattttcctcttttcccgtagtgtagaggggtagggtgtgggcagaagccgtgttagcacatctgtagtattgtgtgtgtatgcttagaaccagcgtagaccggatgggaggatggactaggcctaatccctcccaactggtggatgtgaagaggtcaggtaggaaggcacaggagggtcaccactgtcacagcagtgccatgcagacatcctaggagaagacatggcagtgtttcttctcagtgcttcttcccttaactgagctctgctcacagacagctagaatagattttaactgaaacagaaacctaaatgtaattaaaaacctggtcttccttggtaagcagacttaaaatatctgtatagtacatgcaagtggaaaatttgggaatgcgtgtctctgaatacataccggaagggctactattacctttttcttaccatttatacttacctaatggaaacgagcttgttttaactatcagaacactattttgtaaggtgctgcaaagacagttgaagttttcattaccaatttccccaataaaccaggtgttcaaatcctgtgtctgctttgtagtttttgtttgtttgtttgttttttgttttttggttttttttttgctgttgttgctaaatttccatcctgagtggggaattaaaagtgttttcaatgctagcatggctgcctttcaagaggtccaaggagcagctgactacagatgcagatacttttacccaaccactggactgaagctggggacccctgtggttaaattaggggaaggtcagaagaaacctaggaggaggagggccacctcataggaagaacagcggtctcaactaacctggacccccgagatctctcagacactgagccacccaccaggcagcgtacactagctgatatgaggcccctgacacatatacaggagaggcctgcctggtctgccctcagtgagagaagccacacctaaccctacagagacttgaggccccagggagtgga

SEQ ID NO: 18685 - DNA, 1194 bp, Mus musculus
agagcccctgtccacagtgacagctccagacagccccgaagcagcagaacaggaagaactttcaaaagaaacaaaggctctggaggctggaggaagcacgtctgccatgaccccagacagccctccaactccgacacaaagacgcagcttttccctgttaagtagtaaccagtcaggcccttgtagcctcaccgcctatcactcccgaaacggctctgacagtggcctcgtgggatcgggcagctccatatcggacttggaatctctcccaaacaacaactcagaaacaaagatggcagagcacgaccctccacccgtgagaaaggcccccatggcctccggttatgacaaaccgcacatgttggtggacgtgcttgtggatgttggggggaaggagtctctcatggggtatagactcacaggagaggcccaggagctgtcctaaggtctcccgaggcctgctggtggtaaagaaactgaccttttaggcagtttttctgcattgatttcatgaaagaagctatacattagctaatactaaccacatagaatatcagacttagatacgtgaataaggatcctgtgggcactgctgggtccactctgcaaatgccaagactatcaaaggaacgtattgtcgcttctggctccttcccaggtgggctagcatctgtgagtttgcctcggctagccttgcttcctacagccgccactgctcctccaccctgatcatctcacaggacagggtggaccgggttttttttttttttcacacacctttgtatatgtaagttcatgtatataatatgtttacatgtttcactttgaactgaaagctactcaaagccagccgtaagtctatggtagaatgtgatggaacatgttggtggaagcttgtacaatagaacacattggtgggagcttgtacatacttttttatggagcattacttacgattttttaagtaaaatgttttgaaaccaaaactcacttggatattcatttattgaagcacacgggcaacctttcatagttatttggcatattttcatctattatttgatgatatatattaatgctttaggattatttttagcatatatatgtgtgtatatatatatttaaattttaggactaagagtaattctaaaaataatctcttttaaaatgggtcggggtggagagacatctcag

SEQ ID NO: 18686 - DNA, 1146 bp, Mus musculus
ggcgacacgtgaacagtcaacagtgttccttagtggcgctgttagagatgggcttacctggtgtctttagaagttgaggctgaatccttctgtaattgatactccaggattggctcttctcatcacttatcttcagggtgcatggctcaggctggtttgggatcctcctgcttcatccattgaagcgttggaatcccaggcatgccccactgcactatctcagagaggtcccagaaggcaggagattgtttgtagttagaagctaccattgtgctgtaaccctgcttgggaatgttgaggcaagcttgtactgagttagttgtacgttggcattcctccattttcccagaggacagctattctgaccacatttgttttttcctttttctttttagtttttttaaaaatttttttaatttaattttttttggggaggggggcggttcaagacagggtttctctgtgtatccctggctgtcctggaactcactctgtagaccaggctggcctcaaactcagaaatctgcctgcctctgcctcccaagtgctggcattaaaggcgtgcgccaccaccgcctgacctctgaccatgtttttgttttctcctaaaaataccactgggcaccctggagttagctggcgaggcagacacatgaagcaatccccccttttctgtttgtaaacgccgtgctcttcggattgttcttggtttatttgtcagatagttaggcgtgtgttgtccaaagagaggtctgtgtcagaggataagccacattgcgtttgagaagattttccaagaacgtaaaagaagatttggcttaagctctaacttaagactctcaggcttcctgtgcgtccagtcttcagttacctgacgcaaacctggggaaatgaactggagacttgggctagggagaagctcttgatgacttcatctttactttatgagacttttcttttcagcacttgtaacttcccagttacccacagaagagcctcttggccagcttttgaactacaatatatatctgatatatggtcacaggggaaattcctcctgaatccagcagatcacaaagctatttatgaatgtgaccttaacatccacttccatctaagttaaggataaccacagaactctgtatc

SEQ ID NO: 18687 - DNA, 1220 bp, Mus musculus
atgaagcagagctgctttggttgttctgtattcatctccagcagactccggcttttctcccttcgaacgcggagagacttaaataggatcagaaaaggccatagcttgaaacatggaagaaatacattttatgagggcttacagctgtctcttcctggctgactattaggaagctgtgtttacagctacctggtcagcttttcggctcttctgtgttattacaaatagtcaaaaaagagactataattgtacagtactctgctaactatttcttttggttgtaggaaaaatacaaggcataattagtgcatgcaaaattaattttaagaaattatatgaaagtataaagtgcatttcattactgtgttactaatagggtagcttgtctgagttttatttatattgtcatttatacagccaatctggtttttttattcgtccctgaaagtctttaataatttaaaatgagcaagaaattctcacagatcctgagggttccacattacttctgtggagctaaagattctccccacttttggttctagatatccctgggtttcctgtgtgccacctgaactctcctggcacgaccacggaagattctgaacttcctggctggctgagagaaaatggagctgatgaagacactataagtcgggtaaaggggaccgatctgtgggactgtggtgtttcagttctgtacctactgcagaggtgcccggcacattacctcaggcacagaaaacacgctgctgaacatgtcagagccagtcccgccctacacaaattcatacattaggaaagacaaatggattcccctgatttaaaaaaaaaaaaaaaaaaagtcttaccttagcaaattctgacacagttttcagggatctgtgtgtgtgtctgtctatgtgtgtgagtatgtgtgcctatgtctgtgtgtggagtacttatttgtgcacatgtgcctctgtgtgtatgtgtgtgtatggtgtgcttgtctatgtgtgctgtgtatgtgaatgtgtgtggtgtgtatggtgtatgtgcatgcgtgtgtgtgtgtctgtgtggtgtgtatatgagtatgtgtggttgcgtgtgtctgtgtgcatgtctgtctctgtgtgtggtatgcttgactgtgtgtgatatgctatatacatgtgtgttgtgcatggggtgtgatatgtgttgtatatgtacatgtgtttgtatgcacatgtatc

SEQ ID NO: 18688 - DNA, 1167 bp, Mus musculus
tgaaattgtccctccaagtctcaggccctagtgtgataagaacttgactctgtactttgtgtcgcatatcagagcatcgtgaaacatgaaggttttactgagctgtaaactgacaggtctatcagccctttagattctcaacattcatgaataactagcacatgactactcagtatgagtgagttgtgctttttttttaatcaaaagacagtttgcttagtgaaatctaaaatgtttcatcatgtattagagcagtgcgtgtgtataaataaattccataatacaaataattaggtttgttgatttatatcttacttcaaaagatccacagggattcataaaatcaggattcttaatgagaaattgcttttcttcagtcctattcagttttaaagggtgattccacaaaccatttctgcactgtaacctgttaggttatgcaagaaggtttttaatgtcttcaaaaacataataaaataaaatgaccagcttcttccttggtgctgcctacgaggtggctgccatctgttttgcggcatcatggctgccctccggcctctggtgaagcccaagatcgtcaaaaagaggaccaagaagttcatcagacaccagtcagaccgatatgtgaaaattaagcgaaactggcggaaacccagaggcatcgaccacagggtgcggagaaggggccagatcctgatgcccaacatcggttacgggagcaacaagaaaaccaagcacacgctgcccagcagcttccgcaagttcctggtccacaatgtcaaggagctagaggtgctgctgatgtgcaacagatcttactgtgctgagattgctcacaaggtgacctctaagaaccgaaaagccattgtagaaagagcagcacagctggccatcagagtcaccaatcccaacgccaggctacgcagcgaagaaaatgaatagacggcttatgtgcatgttttatgtttgagtaaaatcacaaaacctgaaaaaaaaaataaaataaaatgaccaaagagcaagtaatatgacaaatagccaaaaaggtgaaagttaatatttaatctttctgcttacttgattttatctaacattaacaatgaagggtttcatgattttctgtaacagcccatataaggttaaagattaacatttttatgtagcatc

SEQ ID NO: 18689 - DNA, 1237 bp, Mus musculus
ggctcttaagacagttatagaccttacttgcctgcttgcatgtttcctggttctagctttagttccatagtagaggtaattaggaaaaatctgtccataagccagtcttcctttaaaaatggcatcacagatatagggttttatcagaaccattggtctgtagtcatacaaggctgagactgtccacaatcggactgttcctatgtctttagtcaaaactgaaacaaacaagtagtattaccttccaggtctgtcagccgggcacctcacaggtttgcagggagaaggcgagttgaggatcttggggctgggcactttaggtaataacgtcttctccccacttttctttctgtcttctgcacctgcctctggctctcttcacctgctcctctggcactcttgtgtgtaaaaccaatcacctgcactctagttatccccatttgtcctcgttcagcatcttgcagccccatcatcatgcccttcaaagctgcacactctagaaacccagtggaccgaccaaaactctttgtaacaccgcctgagggctctgcacgaaggaggaccattcatggactagcggtaagtggtgtctggagaagccggtgtgtgggaatcggtgctgtgtctctgcagagtgggctctgccctaaggtgggctctgggtacaagatcaggtgacagctacacatcaccccacccattataaacccagctggctgtgtacctctacccctcactgcctctcacttggggattttgctctccctacacatttgcaactgttcttcactcaagcactaatgagtggcagacctattctgctgggacctttatacaaataagtggttgggaaacattttcaaggtcagaaattatgttgcctttgaagaaaaatagacctggcttgcagcctggtctcaaccataaagctggcccaacactgaaggtagcttactcaaacgggtatgcatgtctatgtatgcctgccacagcccatatcttaaaacaccatgaaggatttggaaacagtttttgttcagtaggtacctcttgtaaggcatatatatatatatatatatatatatatatatatatatacacctcaagtgtttaaagtgaaggatagataatatctgtaccctaaccatgctgtaaatggagcgaggtcatctgtctctttgaatccttcatctttgtttaaactgtgagcttatgcgctgtagttgggagatgtgaa

SEQ ID NO: 18690 - DNA, 1777 bp, Mus musculus
gttttctaaagagttcctgaccatcgtttttaaaagacgtattaaagccagctaaagacagcagactcagtagctttcctgatcgttttcgccaacagaaagagatggctccttaatctgataccctgagatggcattttccagtgtgtttcttcttagtaaatcaattttttttctttgttctttaaaaacacaaaagagcattttattataaaaagaaatggactggcaaggcgtgattatcacacagatcttttttcatttttaaacttcagtatataagattagcaaaaataaaataccttttactatgtaacacttgacagtgggtatctctttgccctccaggcagagtgagcggaaggtatttaaacaaattggattgtttaaatattactacctggctctcgtaaacacagctcgtcgcgggcatcctgcagaccctgctgccacagccttctgagactcctcttacagaactacactggcaagtttgaaaatgtgtaaacatttttttacagcaagaaaataatttgctgtcctttttgttttctgtttttgtttttgttttcctactttttggagaatgggtttctctgtgtagccctggctgttctagaactggctctgcagaccagactgacctcggactcagtctctgcttcctgagtgccgagatcgaaggcgtgcgccaaccccgcctggctcagccgtcctcttaagtgatatgtttataaaagctttttttcagctagataaattaaaacaaggcagggtgcagacatgctctagcagacgtctccgcatgccgccgtgggagcgtgaatgtccctgtgaggcgctctgaagttgtatgctgctgccacccacagtgagggtaggacttctctccctttgccttacgtgatcacaaatgatgtgggggaaataaatatttaatattcctttagatcaaagaatttggttctgctcgtttcagagcaatgaaaaataagtgatgtcacgttgacgttgggggacaaggactgacatagatgtccttggtgtagagggactgtcagcctctcctgtcttatcattcttcactcctgctgctcagccctgctgtataaacttgcactttcatttgctaatataaattcaattttattttcccacttacgagacgaccaatgagagatggagacaggagcgccaagggcaatggtgtatccctcccactatgatgtattggttttatactaagagcaattggttaatctacaagatttaatgtgagactatttattcatctattggggttcttttaaatccaagcatacaatctttatcaacagtttgtaaaacattgttaaaacatcagtttgtggggtttccctatttggttgtccttatacatctagatattgtattaaaaaaaatctgttcagcaaacttgttctatttatttaaatctaccaaacataaaatacaaataaaatgtttgacatagttttaccgtagggttcctgtggtttcacttccttcaggtaaatacacacaggcacacacacatcctgtctgcacagagagcctctttccgtcatgagactaatcttcccacttctaagctacacctctgccccatgattgatttctgaggcttcagattactccccacctgacttcagtgccatttccaaggatgtgggaatgcttgtatatggagtgggtttatttaaaattcaaaatcatcattgtactttggctaagttgtctttttatgtttatatgttgg

SEQ ID NO: 18691 - DNA, 1753 bp, Mus musculus
agtctggttctttaaagggtaatttccttcctcccttttttatttaacaaatgatatttttttttcaaataatatccgcagcacagagaataggagcctattaagagttaatactagtgtgtaatttttctctatgtagtcagctttgctgagtatcagtggctttttgctctgtgtaattccatgtaaccccttttccctattagcagtacatggtgtcatttaaatttctcttagtatgacatttagtgacagcctagacgttttatacaatcttgtgttggatatattggtaccctttccctcatttcctgtgcctactttcccagggcctctcattcattgcttatcttggacaaaagctttaaacataccagaaacagtaaactttttcaaacaaatattttaagtatataattttaccttgtatatgttttattcagccagatgtatttaaagtggtaaaatgaagtattttgttttttaaaaaaaattgatacttatttcatttttagttctaggtctcgttccagaacatattcgaggtctcgtagtagagatcgtatttattctagagattatcgtcgagattacaggaataatagaggaatgagacgaccttatgggtacagaggaaggggtagagggtattatcaaggaggaggagggagataccatcgaggtggctatagacctgtctggaatagaaggcactctaggagtcctagacgaggtcggtcacggtccaggagtccaaaaagaagatccgtgtcttctcaaagatcccgaagcagatctcgccggtcatatagatcctctaggtctccaagatcatcatcatctcgctcttcatccccatatagcaaatctcctgtctctaaaagacgagggtctcaggaaaaacaaaccaaaaaagctgagggggaaccccaagaagagagtcctttgaaaagcaaatcacaggaggaaccaaaggatacttttgaacatgatccatctgaatctattgatgagtttaataaatctgctacttctggtgatatttggcctggcctttcagcttatgataatagtccaaggtcacctcatagtccttcacctattgctacaccacccagtcagagttcatcatgctcagatgcccccatgcttagtacagtgcactctgccaaaaataccccttctcagcattcacattccattcagcacagtcctgagaggtctggatctggctctgttggaaatgggtcgagtcgatatagtccttctcagaatagtccgattcatcacatcccatcacgaagaagccctgccaagacaatcacaccacagaatgctccaagagaggaatctagggggcggtcctccttttatcctgaaggagatcaggaaacagcaaagacaggaaagtttttaaaaaggtaagaatccaaagtagtgcgtttatattatagtactaaattaaaaataacattgtgctttgtatttaactgtttttacttgttcctgcttgataattatagtttttaattatttaagtggtttgatgtttctattctttgttttattagccattttcgatcagttcacaactagcagttataaacaaggaaaaaaggccttgtttataaaggcctaagatagccaatattataaacagttttgtgttagagactttcctttttgctttagaatgtgacctttcagaaacaacatagtcatgtttacctgttatgtggtaatatagtccagc

SEQ ID NO: 18692 - DNA, 1135 bp, Mus musculus
gtagtcagttaatgtgataggacctttagccttttctactgggttttggaatgggaatactttacatacttttcagctatgaagattgttttacttaatagaatagtctataagttggggagtaactgtttacatatatttattaaaaaatgcagtttgggatgtactagcctcactgtaaaagaaaacagccgagataagttgcctcaagcctgtgctgttatgatttaccatggaaacgcctcgcctgtggattgatatagattcatagctagatgtaaatctcagtgcaggcttttacatctcttaggcttgacataatttgcatgacagctgtatgttagagaattggtatctttacaagaaagctgttttattgatgtttctttttaaacctttttatagcacgatgacagagatgatggtgtggattactgggccaaaagaggaagaggtcgtggtacttttcaacgtggcagagggcgctttaatttcaaaaaatcaggtagcagtccaaaatggactcatgacaaataccaaggagatgggattgttgaagatgacgaagagaccatggaaaataatgaagagaagaaggacagacgcaaagaagaaaaggtaagacattttctgagttttcagtttatttagtatgaactttgagggcaattaagttgataacttttagaaatattaatattcactacccacagatttactgacctttaatttccttttccttttttaggaatagtctcaagattgcaacagggagcagaacttgacacttacatttttttaaacctgatttttgttttcaaataagaatgtaagcattttacttaaactgtactgtttgcaagtagtttatagaaattttgttttaagtcttcaaataccttgaaaaaaaatagactgtatgttgaaaattgtattgaaataaagtagaaaatgttcggtatcatatttgtaactatcaacttttaaaaacatttgactgtttttgttacatgcattgtatttctgctttgtctataagaagtggtcaagtccaactctgtgacaactcttaacttgcctccctgttaataagtctttgattctgaagtgaacgttagcttttctcaaacccaca

SEQ ID NO: 18693 - DNA, 2002 bp, Mus musculus
agtaaaatcctgattccataaacctggttgtatttaaaacaaaaaacaaaactacaatgaaacttgggagtccttttcatgtagaggaaggttatcctgtagcataatgtatgcacacggtcatctagtacctgattggatagcttacatatttattggatgctttgaacagctgtatattagtccataacataactacaagattagatagaggcaacatactgttaagtcatatttaagtaattagttttctcttaatgttgccaatagaaggcttgagcaggaagcttgtagcactgatctaattgtgtgtacaaccatcaacttaaatttataaaatggcctttttcttggcgtctattctttaggtaaatatgtttctttttctttttctttttttttttttttgctatttgtttaatagcttttaaaggaataaagcaaaccagtgctaagaattttttttttaaagctagctacattgcagcagagttgttgtgtatgtgtgcatttaaagaagataatgcttattctgttaatgcacacttttaagttttgatgattttttacagtgttttagaccttgaatagctagtggcttttgctaaaaacttttggcaacaaaattaaactaaaaccaaagtcaacatgtgaagtgtttatcataagatcctcaggagtcagtattgcatgatgctccccttaattgtcacactgaaattatgtagtaaatcagaaaatacctgaaaagcaactttattgcttcaatctggatataagtagttatttataaatagttaagattaatttaaatgtaaaaacgtgcttaattccctaataattttcataccattcctattttatatgaatatccaccttcatttcaacagttccttggttacacactcaatctttacgtttgtactgcttacctttactttctccacaacagagacaagcagattggttgaaccttatttaatgaggagtaacaggctgtttttaagtgtttgcctgtggctacttccgttctatagctcaagaatatgccattacatcatagtcaaggggttgctatgagaactgtagtagagaataccactgtgagtcttctccttttcagagccaaacacaaagcagcctgcgtgcattctttgaggtgagcatttaatcacacacttgatgacattacaaagctaaaccatgcctcttggtaaagctgcttgattacaagtgccaggaaaacgactgttatccactgcgtactacatgttacatgctgcatactgtatgttacacactgcatactatgtgttatacactgcatacacatacttcctttacccagagaaaagaaataaaattgaaccaaaggattttcccagaaaaaaacaagaaagcagttttagaaggccatgactcaattcttaggtttgtatgcttaaacatcttaggaattttaatataaaaagaaaaggctttcccatttgcactctatttcaaagaattgttattgttccctttcgttaaaatcagtgttgggaattaaattataatttgaggggaaaatatccaatgggaatgaatgtagatggctaaaggactcttcctcagtgtggtgtatatttcaacagggacccttgtaaattgtcatatgccaataaaatgtcctaagtggtaatagctggtctctgtttgcctgacgttgaggctatcgctgcttgaactctacccagctgacttccatgcctgtttctagaatttggaataccaacttgtatacatttgatatgtggtttgataaatgtttttgattctttaaaactgtcttaattgctttcttgtcttctccttgggaagatgagaatgcatacagtttttagtgagccattctataaagcacagcaattccagatccttgaaaagaataggcaccaaactttaatcctagcacatggggatgccaggttgtggtcagttggcgctgcatctctcatttgta

SEQ ID NO: 18694 - DNA, 1147 bp, Mus musculus
cagatagaaacatgatattgtgacttggacctcagatacttcatttgatatccaactttctgaagtttttttctatgaaatattttttgtccttttttttcttaaatgaaagtgcaactacttaggattgtcatagtatgaagattgttctcaggatatagagcacagctgagacatgcttgtactttcagctattatttgtatcattcctgttttattattttacttaggtgactactgaaactttcctattagaaaaacttaaaattcttgacttttgcaagcactatgaaatatggttaaggtgatttttttgatgatgaaaatcttttaagggaccatgtatatattggaattggattaatacatacattatttttatacattatatattttttaggctttaaggtatcctctttaaaataaacatatagaatgtatttggaagtatgtttgcatgttatttaaatagttttaccagatctctgacagttgctgtagagtgaataatgagacatggatcctttcttcttgttcctggtggctgtgtgcccagcactccccaagctccccagcggccgagccgtgagagtgctgtgctcagtagaataaggacacttctacactgtgggtcctcagctagagttaggagtcaccagagaatattttctaaacgtagttaactgttgctgcttttcagactggctgactaggtttctgagggaggcccttgggaatgtatttctagatgatacttaatgtatcaagtgacacatatgtctgcttctcctggagaattgtgcagtaaacaattttgatgtcagatatatcagaccaagttaatttctaataatcagaaatatcaaggacaagttactaatcagggatagttgtcttttgcctagaatgataaacaatagtgttaatattccatgcataatgttatttcttcgtaaatattgagtagctgcccactaaacatttttttttcctggcagctacttcactacttgtgtgtgtgtgtgcgtgcatatgtgtgtgtgtgtctctgtgtatgtgtttatattcagattgatttttccagtagtttcagttgtacatgatactgccacattcagtattttactgagccacaatacaagtccca

SEQ ID NO: 18695 - DNA, 1099 bp, Mus musculus
ctgttagttctgtttggggccagattaaaagtgaagccttgtgtactcaggcccagacgtctcacattcttatagttgtgtctcagagtggcttagatgtttttgagaagaatcaccattaaatccaacaagagtctgtatgtaacacatgacaccacaatgctctctttgcatcctttacaaaagtacacagtgagagagtctttggttaagtccagcattgaagctaacaaggaagcaggcagttctgggggaagcatcagtcgaagggcgactacgagggacaggaggggccgttttctaagaatgctttattgcagatggaactgtagcatgaagaaggtgaactgggtaggcatgcaggtgattggcttaggctgtagaccctgttatcacagtgaaatcatttaacttgtatgtcctatgtatctataaaatggaaaagccaggtttgatgaagtgaataacttagttttaatgaaggatggaccacgtatgcagttcttcccattgtactggggactcagggcgaatcattaactatgcatctttagaatgcacacctcggatggccctggattggaggctggatgaccatggctcttgatactcttagaatgaatggcatgtttgaatttggcctcatagtggtctgtcgaaagcagtgtatacatagatccactgagctgggaaccatttatttcacctcatgtgtgagtggaaacttgacacacttcatttaccagattgctaaggagaagggccagctggaagctatgtcacaggaagggttaattccccactggtgcaaacctgtgactgccaagaagactttgagaggagagttataaaggggcaaggtatcagctggttaacagaagggcgggactggggcaccgaggcctgttctctactcctttgctgctgcactgtgagatgtactgcaaatacatctattgcacacagtgaatggatttccacttacttgggaaggatatgatattctctccctctccccctgtgtgtgtgtgtgtgtgtgtgtttgcttatttgaatgcttatatgtatctgtgactgagttgttggtgtatttctgacc

SEQ ID NO: 18696 - DNA, 1105 bp, Mus musculus
tcatactctagctcatagcttatcttcatgcttttaatttttctatattgtcctcatctcctgtatttatgggtatcatagacctcacagtatctaatgctctatgcaggtaaaacacaggaaatgttccagagaatttcagcagattttcatcttgttcatcagttgatgaatcaaaaatagtttagccatctgctaactgaccagacagttttagtattgtgaaagggtgtggtcacagaggtaggtagaggatctaggtagaatgtcggaataaggctcagagcagaaaccaccttgtttcttaatactgaaacttaacagtcagctcaaaatttgaaagcgatctggtgggttgaacatgggtgtccagagggcgggggtttcccagcatgggcctcactctatctcactgcgtgaagtctgtgtcaatcaatcacagtctctaatttataatatgccatatgtttctggaaattaattgtccttttatattttattccttaattaggaaaatcagttatatctcggtcatcccagagtgaatctgaaattgtgccaaaagttgctaaaatgactgtatccgggaagaagcagaccatgggatttgaagtgcctgggtaagacttgcaagcccctacccctttttaaaatctccatggcctcctatgggttgattagagcagcctgttcaattctacataataaagcactggaattcagctatctcatggactttgtgtagagtaaaggacagacagggctgagaagttggttttgattttagccttgtctttgaatgactcaatagctacaatactgctttgtggatggagagatgactcagtggttagtcacactcactggctgcttttgcagagtactaaggttcaaatcccagcacctacatggaggctcacaaccttatggaactctagttctaggagatctggcgccaccttctggtctttgcaggcattacacacacttggagctcataaatgtgcaaatacattaaaggaaaaaaattaaaaagagaataaaaatactgtcttgaagttttttgcaactatgtgtttgtatgtttgcatatttgtgtgtgtag

SEQ ID NO: 18697 - DNA, 1170 bp, Mus musculus
gtatctataaggaaagcacagagtaaatagttctgcaactgtgctaagctctctgttcaccttcgcacagtccatagcttaccatcaatgacttgtttctttttggtgcttgagacagcatgtgccaccatgtccgagcatgggctaccatgtcctagctgtctttcttagactattctagtagactcgaattttcagatttcatgtctcagcactatgtctagacacaggagccccagcctttgggagtgtttgaacatttgctatatgtatacaagttaatcataatatatagtgtgtcagatatattacaatgtattctagttctttttttttttttttaatttcaggcttttagtcacagtgtttccgattaacaggatcctctcagatcaaatgatttgaaatatcatttaacatacagataatttattagaggtttctggtagtctgacagcacacaatatataatactgaagttgggcattctacacagttgcgatcctaatactctagaggttgtggcaggggagcctaagttttagaccagctttggctacataatgaaactgccttaaaaacataagcagacagacatggacacacgaataacactggacaaatatttcttgaataatggaacatgaaaaactaaaatgtataggttgtttaacctgagttcaacttttttctgactttttgttttgtttttggtttttgtttgtttgtttgtttgtttgttttctgagacagggtttctctgtgtagccctggctgttctggaactcactttgtagaccaggctggtcttgaacttagaaatccgcctgcctctgcctctgcctctgcctcccaagtgctgggattaaaggcatgaaccaccacaccctgccctttttctgacttttaaatgagcaaattacttttcggattaagtcaagtatgaagggcagacctagcaggcacacccccgccacaccagtgctctagaggctgaggcaggcaggtcaccatgcgttctaggctgactatgtcctgagtgtcaggtcagccagtgactcactacattctgtctcagaaagagtccagacatatataacagaaaagcatataacagccatgctttctcagaatgatagaccctaaacaatgaccatgcggatggcccag

SEQ ID NO: 18698 - DNA, 1149 bp, Mus musculus
ggcaagctgaggcagcagatagacgtgaaagcggaattggaaaagcggcagggcgggaagcagctcctcaacttagtggtcattggtatgcccttgttctgcccgccgggttagcaggaccgcggcaggaggcgcccagcctcttggagcagtgtaggcttaaataaagcaaagaggcattgcatcataatgcattctggtcacccagggtgcaatggggccgcgttaccaaggagggcatcatcggacttagcttgtggcagttttatgtagtgaacattttgaaaatgggatgcatctccccccccaaaaaagggaaactttgccctctctaaaactgtgtgtgcagtcctcaccccctcccccatttaggtgttttaaccttgatagaaattggtgtttgttatactaaatactgacgcacgctgttgaattagtgttgcaatgcctcaatgtgagcatctgaaatgtacctagtattaaccctgaatcaattttccttaggtcatgttgatgctgggaaaagtactctgatgggccatatgctttatcttctgggtaatgtaaacaaaagaactatgcataagtatgagcaagaatctaaaaaggctggcaaggcttcatttgcatatgcgtgggtcttggatgaaactggagaagaaagggaaaggtagccgctatgtttcaacgcttttagtctttaaaataagtgggcactggaagttgaatgtgtaacacataaatgcatcagcgagacgttcagaattccttttgtttgtcatactttattctgtgagaagaaggttaagagaatatttatcccaaacccaacaaggaggagcaccggcagacagcagtgctggacggtgaggctccctgagtgggtcttgctgtgagccagtggagttggcagttgttgctccctcggcatatccggttgttaaagtcggatctgactcagtcttgcaccaggttttaaaggaactgcccagcaggtccagactacaggctcacaattccattctcatgagacacacactcacagtccagaaagaaacaattgaatctatcttgtcagttattctttcagtgtctctcggggcttagtgctagtttaggtggattctagcagaaggatgaagatactcg

SEQ ID NO: 18699 - DNA, 1099 bp, Mus musculus
ttggtatgtatgctgtggccactcggtgttatgtgctgtagacgcgatatgtgttatttagagttcttcatgcgaggcagagtgtatatgaaaacgcataggatttgtagtcagagaaactaggttctcaggtttgaaatcatgtggacatttaaagtaatactcaatgttttgaagacagattagtgagtttagaacttgccctacctgtcttattgactacttgaaattaaatgaagcaatgtgggaaatatggtttataaatgaatgatatgaatggtagtcatttattattagtatgtacaaaataaattctttttctagaaagaagagagagtaatgggcatggtggagataggaaaaaaagtccctttcaggtttgagggtgctaggaatggataccaggccctggccgagctctgctcgtgaccttctgctgagcagtgctcacagcctataacttaaaccacaccttgctttttgccgtgtttttctaccagattccttcaagccccctcagcgctcgattgacaaaccttttagattatgtgtgtctgatgtcttcaaaggtgagtgctgttctgccggggtggggtgggtggggctgtctactctgtatcttgttttctcggactgttatattgttacattatatctggttgattctctttgcctgaatgtaaggatggacagcaggcacttttacatcacacgcccagtcctaggctcctgaacacccttcagtttacaaccacttcccactatatattcacctgtcaggggcaaagagctcgaagcttcatctttctgaccttgaacacattggataattcgccattcttaacatccagagtaatgggccggcaagatggctcactgggtaaaggcatttgccaccaagccttaacagcctgagtttggtctctggtcccacatggcagaggagagaatcaatccctgaaggttttctcctggtgttcacacctttgcactctggtgattgactgcacacagagaagctaaataaatgtactcttaaaagtaatgaagtatgtatgtatatgtacatacatgcacacaccgtttaagatcctgattg

SEQ ID NO: 18700 - DNA, 1173 bp, Mus musculus
ctcctttctctccctccgcctgcttttcacgaactactgtctgtgagttcccctaactgaggctgttagcatccctccttagttctctgtctcccctgtccctcgcccagagcctgcaccccagcgtgctgctgtggattcttgggtgcacagtgtgtgtgttaagccacagttgaggccctggagtgcacttgcctttgtctttctctttactggcccatgctgcttacagtgaacagctctgtttccttcccttacctgaggttaaagagctcctggcctttactactcagggaatatctgcaacggaatgagccttcagtttctgtaatctgaatacttttatttgcaaggaaaactggggtatgtgggtgctctatttagcagaggtgttaaagctgacctgacgattgcttgctgttcatttgacttctggccttttataactatgtgggaaacacatgtattaactacctggtaacgttactgtgtgcttcacgtgctgttggtatgttttacagatcaaggatctggcttttgtgtgactggtaaaattgaagctggttatatccagactggtgaccgactgttagccatgccacccaatgaaacctgtactgctaaaggtactgacgcgtctgcagcatgcttctgctaagaggccttgagacagcagatttctgcttcagtagtctagttacaactccagagtaaatatcctcttactgaaattgtaactaactgtcaaaatgatactaactgttgaacgctaaagtgtaaaaacattaaactattgttttcctgttgtggcatatgtctatgcgtacacataacattctaagcctggcaacactctcttttgggcactgagtcatgaaatctggtgtaaaactgaaccagccacatacataccagacaagttcttgtaaaattacaatttgtagaagaaattaaagaatccaacccaataatagctagtcagtagcaggcagcttgtcaccatagaatctgtagttcacaatcagttaacagctttggtgatgtttatacctatacgtaatacctttgattgcgcgcgcgcgcgtgtgtgtgtgtgtgtgtgtgtgtgtgtgtgtgtgtgtgtaaggtagatagaggaagacctaagtaagagaccaacacgaaaggcttact

SEQ ID NO: 18701 - DNA, 1405 bp, Mus musculus
tttaaataagaggagaaaggtgtcatgtacttacagtcacatgaatgggagtcctgactttatgtagtagaagaagccatatttctttaacttactggctttcagtgactttaaataattcatccaaaaacttgaatgaatgtagttgcaaacattttctgaaacatatcttctgtatgtgacaaaatacaatggcatttgaaggggatacctagaactgaagcaggaaatctcagtagttcagatttcttctacattctcataagtaatatgaatattttatcttaagattaaaaagctaggtatcaggacaggggtgggagaaccacccatgcactgtcactgcagttgtaaagtgtctcatcttcttctttattttacagataaaagagtgacggtccggtcctcatctcaccatgcttccagaggagcgagtcagcccctggggcactcagtggtgcagctaaggaaacagcatgcagtcatgattgttagatgagagacactaaagtacagttagctgccaacaagtattaaggattactctgcaaaacttcccagttgccagctgccagaggccagcactgaactgccatttcttccctttcggggtggcagtaaatatgtttgttgtgctgagacttgtgggaggtatcacaagacacttaactcagtggactcgacttccagccaaaccaaatccaaacgctgttctgtttccattctcctgctgtgtgtgttctaaggaagccttgaaccttagtggggcttggagagtccgtctttgacctggtgctttttttagttaacactaagaaaagatttactgaaggtaacagtgaagctgttttgtgctgaaaataaaaccgtccatcaagcctgccttctggagtgtaatgcgaagtgacagaaatctgttcttaagtaacaaagatgctacttaagttgagaagccagctaataaaatgccttagtttgaatgtattgcaaaaatgtgttttatttcttagacatctctgagggagtctctcccccctcagcagctgagactcaggcgccgggtggggtctcttcaccacgagttactgactgatgcgctgcttttgctttctatgctaatggtgaaccaagcttagtcagcctcttctaaccagatcttggggttctattcctttggaattggttattgaccatgtctcggtcatgtctatatcgaaaggctgtgctcctttatgaataagactctgattttcttcaaagtatcagcaacaaacttgaagggttattgatttaatggtgatttgttgggccatttctcaagtcaaagaaattgaggttatctgatgtccttagccgagcctgggactgaaggactttattgtagacatttagaaattagaaaagg

SEQ ID NO: 18702 - DNA, 1100 bp, Mus musculus
ccccactaagcctcagtttctttgtctctcgcagctgttctaccatctccagagggagcgctgcttcctggaaccacgggctcgattctacgcagctgaaatagccagtgccctgggctatctgcactccctaaacatcgtttataggtgagccaaaggttcaaagctaccttgaatgctggagagggaggccaggctgagcctttggagtcctaaaataatgagatattatgtgcactttggtcacctctaacaattccctagcatgtgagttgtctcaactgcccataccaagagggtggtgcataatcctaacagcccaactaaggctcctttctgtgattggctgtggaacaggagtggattagcaatcttcttaatacccaagcaatctttacagagggtttgtcatgaagtcaagctaacctacctgtgtaactactttttcctacagagacttaaaacctgagaatattctcctagactcccaggggcacatcgtcctcactgactttgggctctgcaaagagaatattgagcataacgggacaacatctaccttctgtggcacgcctgaggtaggcagtctgacgcagtgcccggtgtatacacacaggggaccagtggacatcacaaagcacagaggttttaactaagaagcaatccaaatacacacacacacacacacacacacacacacgcacgcaagacgaggtggggaggggagccagttgaccctggctcttttcaaagcacatgtttgctgtgcggactgccaggttctgagagctaacccctctctctggtgtcatttcagtatctggctcctgaggtcctccataagcagccgtatgaccggacggtggactggtggtgtcttggggctgtcctgtatgagatgctctacggcctggtgagtaacacacagcatcgtgcccagaacacttctaagacatatgtggacttgctcgtgcaggcttagctaccgtggcttctctgtgtcagaagccttatcaaaagctttagtaaaggagacaactggctattttacattttataattttataaataagtcttttggatcttttttcaatagtctt

SEQ ID NO: 18703 - DNA, 1197 bp, Mus musculus
atgcttaaattaaaagagttttgcttctggtgaactgataatcactagaaaattctgcctctaggtatggctaatgtaactatacattatataaaaaaaatttttattgtttctacttctatacaagaagccaagagttttaatctttcagtgtatattgtttcctaagtggaaagtattttattaactaatgcttcttaaagaaagtttaccttaaatccttgctctcacccaaaagattcagagacaatatccttttgttacttacggttttagtttactacaaaaggttttacaaaaaataaagaaagcttttataattgttattaattggtaattaaaaattagttgtgcccaagacaattctttggcttagttgtgcccaagacaattctttggccaaaaaaaacattattgtaaagtcatttttctcatcctcccagctgatcgttggccgacgtgtacccaactggcagctgtgtggcagagtcttaagacaggcagtttcccctgttccagcacaaataatctagttgtgtgctgtagatggtgttttaaaatgctgaacaatcaaaccttaatttgtatattaatagtcagtgccatatctctgagctcacaattgcttaaattgttcatccctcagatactattaattctcaaatttacaattgcttatgcatatttctagttaataaataaataaattatgcacatgtgactcttaataacttttcaagctttctagttacaaccactccttaagaaaaatgattgaaagtgcaattagtcactgcccctttacagccaagtatttaaaatgttttgtcaacaagttattaattcaaaaggttaggtattgtgaaattttaaaactttaacttcttaaaagacaaaaaagagagaaattgtatccccttacatactatttagtacattcccatgcacagtatttaaatcatatctttattttcaaaatttaaaatttaaatgtcaaaataaatgctttgtagtatcttaaaaggatctacttattggcttatagattaatcctaaaacagctaccttattaggaaaagaaaaaacaggttctctccacagaatgctacagaagcatattacttcgtgtgacgagctggcaggtaagttgactcagtgtcctgattaaaatgaaaaaaaaactaaattcatgtttta

SEQ ID NO: 18704 - DNA, 1151 bp, Mus musculus
gtttgtatatatttgtgtgtatgctacatgtatatagtatcttttcatgctctgttaccaaatatcaattagaatgttctcctcgcagattggaagtaaaaaccatgtatataagctctaggtaactagggtagaactccacaggtaaatgataatgtttgtgttactaatttaatatgatagaaaatgttaaatgcgtttgaaaagctaagaggttgtagttttgaagagaggccttttcctgtctaggtggatctgcagtagccccgtaacccttgttattctggaaagctggctgtagatgaacgagccagcagaggttcttaactacccttaggtcggtgctcaaggctatgctggtcttgtcagaaattgactgacattgtgttttaacaagaagtggctcgacttgacccaaagcctctggcaagctggtctctgtcctcgccgtgtctgagtagtgcatgtgaagggtgactggaggattaagagaggccactcttaaacttcagttccatgagacagggcctcagccgtgcatgggctctgggtggaaaggcatggtcggacaggtgcttagtgtagccaggagtggctttacctaccaataaactaggtggagtcaaaacttagattctctgtacagacgaaactatttcccaccaagctctgacttactgttgtatttttgaaatgtttgcaaaggcttgtgacatgtgcaccatattacagaccttccaaggctaacttaagcactggctgggcagtgcataggagtctgtgttcagttctgttttcttaaagcctcctcatcccctgcccctcagctccttcagaacgtgggagcaaaggtgagctttgcacttgcttttcccataattcattgtgactttttaaagccttcaattttttaaaaattgtttttatatttgggttttggtttttttttttttttttttgcttgttttaagattatttttaaaaaaccagaggtagaagtagacggctttaaaaccgtgaggatttaccacttgttttaacagtgaactcctggtttgcagtgttcagaaacatgtatgtgaggcagaaacttgggtagggaaggtgcagatccattcgctgtaacatgttcagtgttcagtgacctgaaa

SEQ ID NO: 18705 - DNA, 1184 bp, Mus musculus
gttatggtttggttaatatatagaactgaatactatatggttgtatacaggttttagaaatttttatttcttaatattctaaaatagggccacaccttattagcccaaggctagccctaaacctggggcagtccttctgcctcagcctcctaagtgcagggattcacagcacagaattgaatccttttgttaaatgctagggttttgtattgtgcctacaaggactcagagccacaaagtccagtccttgagtgtgatatgcgtggcttctcactgtaactagagcacacatgaaacatgggggtgattcttgcatgtaaaagttactggtttttaaggattgaaagttatttaaagataatttttttgcacctactgtgacatttaagattatttgtggaaaatggcagaacataaaatttcagtgactattttgttttctctcccaggatgtgatcttcgtggtgggaaccaagtttctaaactaccccaatggatgcagacagtgatgttgcattggacattttaattacaaatgtagtctgtgtttttagaacaagatgccatttgaacttaaggaagattgctttggagggagcaaatgtaatttataagcgtgatgttggggtaagtgtctgagtttcagtgtgtgcactctctagcctgatctgaccatgctttgagtggtactgttgtattgtgcagatgaattgtgagcaccttgttatgctaggtgtaactgggcagcatggagccctgtagaaatggcccttctcctggagattacaggtacagataagagataggactgactttgcatcttggtggctgtataccctagttcaaaccctactttaattctgttgtatgtaaatttcctgttcctttttagttagctaagttatatttttaaaaataagttgctaaataaaataagttgtgattcgtgccgggtgtggtggcgcacgcctttaatcccagcactcgggaggcagaggcaggcagatttctgagttcgaggccagcctggtctacaaagtgagttccaggacagccaggactatacagagaaaccctgtctcgaaaaaaaacaaacaaaaaaaaaaagaatgtgattcgtgttttaacctacgtgtaagattttgttttattaaacctctttaatctatttaaaagcattagtg

SEQ ID NO: 18706 - DNA, 1995 bp, Mus musculus
tccaagaacaactagttgcgtgtttttgaagcaactgaggttcttgttttcttggcattttctcgaaagcactccgagttcccctgacatggctccattcctgcaccatgtcccgacagtgtgtattggcgtttgtctgtgtaccacatgcttgagctacaggaaggtgtgagctgccattcgggtacagggaattgagcctgggtcctctggaagagtgtagtcagtgctctcaaccactgagccatctctccagccactgatttcttctttctcaagttcaaccatactcccaggagaactaccagcaattaaaacattgccccttgaattatagcattacttcaagaaaaatattttttgaaaaaacaccaccgtgtgtgttgtaaaggttttttagaagaagaatctcagccccaaatatgaggtctccaaattgttccccaagttcactgggtggtgttcagctgctgtggcatcccctcactgacgtactcaccgtgtcgtcttcttgcttccgcagcgcaaatccaggaaaactctctgcattatcatttttatcctcgtggtcggaatcgtgatcatctgtctcatcgtatggggactgaaaggctgagccccgagggcgtggacgactgcatgatgctgtctgagcgatgcaggcagattcttgcgatcactttctcttatcgttatcttgaggctgttgtgtaaaatgatggttccatactttgccatttttactagggtggggggattctttttggattcagtctgatattttctaatacccaaggcttttctaaacacccttactggcacagcttccctgctttttagttcaacaactgttaggttttgctcacgttgtatatgcctttcatttgtaatttatttattgtaactttttgactgagttttgggaattatttgattggcgtgtatactctgcctgcacctctgtaactgtgtaacatgtgtaacatgattgcattatcttatttaaaaagaaagcccaagtttaaatttcatttgtccagtaaatgttctcaataggaaacccttaacataactgtttgtgggatgttttatccgctgtggtccacagcagtgcagatcgttattgctctttcattattggattgttgttttcgtctctgaataaaatcagtgaatcttttcctgatgtgtatgtatatatgcatttgctgtggattacctagtaaagacagtaaggataggttgtttttaacattatggactgtttaatccaatgcatactaaagaaagcttagttactgtattgttcagtgaaagttggaggaagtggctgaaaggtccatacctgcatctattctgttcagatgctaaagattccagtctcttactgcactgaaccactttcaccatatggtctggctttgtggccattataccttccctcgtgcgccatggaacacttcttaggcctgtatctttgggtcctgtcttcacaaagtaatgttcccatagttacagatttgggatttcattttatatttagtttttgacacttaagttttagagtttatttagatgccatttttttattattcttcattcaaataggaatcagacgtctgccaatgaacacacttgtcttttttgaatcaatgttttaatgcactaatatgaatgctgtaagaggggttatcttagtttatcatttgtgttttataatgttcttacacagcagtttgctaatgatggcactgtttaatgtggctctgaaacctttaaatgggaacaagtgaaatattaacaaaataattgtatctttgcaagcagaataaagatgattctggagatgtctgctaattctgagtcccaagaactctttccctggagcccaggcttcccagacatttgctgctgactatgcaccatggtgggacattccacatatttctgctgggaggttttgttttttgttttttttgtttttttttaaatatt

SEQ ID NO: 18707 - DNA, 1168 bp, Mus musculus
caatgacatctttgagtccctgtactacaggaagatgtacggagacatggcgtaaagccaggaagtaagggacacgaactcattagactataacttgaactgagttgcatctcattttcttctgtaaaaacaattacagtagcacattaatttaaatctgtgtttttaactaccgtgggaggaactatcccaccaaagtgagaacgttatgtcatggccatacaagtagtctgtcaacctcagacactggtttcgagacagtttacacttgacagttgttcattagcgcacagtgccagaatgcacactgaggtgagtctcctggaacagtggagatgccaggagaaagaaagacaggtactagctgaggttattttaaaagcagcagtgtgcctactttttggagtgtaaccggggagggaaattatagcatgcttgcagacagacctgctctagcgagagctgagcatgtgtcctccactagatgaggctgagtccagctgttctttaagaacagcagtttcagctctgaccattctgattccagtgacacttgtcaggagtcagagccttgtctgttagactggacagcttgtggcaagtaagtttgcctgtaacaagccagatttttattgatattgtaaatattgtggatatatatatatatatatatatatatatttgtacagttatctaagttaatttaaagtcatttgtttttgttttaagtgcttttgggattttaaactgatagcctcaaactccaaacaccataggtaggacacgaagcttatctgtgattcaaaacaaaggagatactgcagtgggaattgtgacctgagtgactctctgtcagaacaaatgctgtgcaggtgataaagctatgtattggaagtcagatttctagtaggaaatgtggtcaaatccctgttggtgaacaaatggcctttattaagaaatggctggctcagggtaaggtccgattcctaccaggaagtgcttgctgcttctttgattatgactggtttggggtggggggcagtttatttgttgagagtgtgaccaaaagttacatgtttgcacctttctagttgaaaataaagtatatatatattttttatatgaaaggcttggctgttcattcttgtaaacttttcttggttttccc

SEQ ID NO: 18708 - DNA, 1183 bp, Mus musculus
catgtgtctgtttggtgcccagacaagagtgtcaaattccctgaacgtggagttacacagagttgtgagctgccatttgggtgctgggaactgaacccaggggcagctagtggtgttacttctgagccattcctctagccccaacatttcccacccacccacttcttatttgcatgcataacatatccctacagaaaagttcaattccccccccccccccaaagactttgtttttccgcagtagtttctattattccctggctctcggttcaggttgtagtctgcaaatgttctttcccaaggtatatttgatgtgtcctcccaaccccctcctctccaccgccgcccccacacccccagcaaacatagctgaatacatccactcccgctgctgctgtcgacctgattcactaagaaaataggaagagggtaaatgaaaaacagtcgaggaagtcataaaccaaataaggcaatgggtgagccgcaactgtgggtgtaagttttccccttttctctctttcaacagggagacacatcatctcttcctcccacagttccagactgtctgcgggctgatgtcagggttgctccttctgagagccaaaaatgttccttctatttagcagacaagaatatcacccatggcttcctctatcctggttagtgaaactcttcgggagcggctaggaagccctcagtccgcggatgtggcgtgtgcgttaaacatatatttcccacccaaatgacctgcttcggtctcctaagaggctgcccagaggtggcacaacggcttccttaaaggctaataaatttttctgcgggaaccacagattagctgtaatcaggcccagctgtggagagagttcagcaggtttaagtttaattttacaactgaagggtatttggaaagagacacaagcatctaagaaaacattatctctggcacaccgccgaagctgaggtcctcacagagaaggcagctgcttcgtgcaaaggacaaaagctggcctgtccacttggttgtgtgtccaacagctttgaactgtaaattaaccagccaaaataaatgaatttcatgctgttttttttttttttttttaaagtgaggatgtctcctggggtcatataaaaatcagcgtgattttttctaaaactaaagtctccccaccccgctctgttcatc

SEQ ID NO: 18709 - DNA, 1181 bp, Mus musculus
cttcttttccttcctctcttccttctctcaaagattagcataaaatgattgaagagactttgaatttaaacttgcttagaatttctgtttaggacttagaaaaaaggaacttagagttgctaggccagcctgtaacgttcaggctttctttctttctttttttttaatatttatttatttatttattatatgtaagcacactgtagctatcttcagacactccagaagagggcatcagatttttgttacagatggttgtgagccaccatgtggttgctgggatttgaactcaggacctttggaagagcagtcggcgctcttaaccactcagccatctcgccagcccacattcaggctttcattactgcctgactcaaggacacttagttttataagacacataaacacagaaggaggtatttgttctgccagaaccaaatgcacaccaagttcctcgcctccgattgtccagtgttccttttttctgtatccagtgacatgaacttcgaatcttccttttaggctttcttcaagcaaaataacgtgccccaggaaagccgttttaatctgaagaagaatgtggaagaagagtacaggaagtggaagtcaatgactgatgaaaacgagatcatcacccagttctctgtgcagggcttccctccactcttcctctgtctcctctggaagatgctcctggagacggatcatattagtcagatcggctacaagtaagccagaagccccgggtttcagtctgcttggcagtcagcgttgtccatgccagagctcagttctcactctttgccttgtagggtcctggagaggattggggccagggccctggtggcccatgtgagaacatttgcagatttcctggtgtatgagttctctacgtcagcaggaggtcagcaactcaataagtgcattgaaattctcaacgacatggtgtggaagtacaacattgtcacgctggacagactcattctctgcctggtaagaatacgtttctaagcctttttaccatgcagtgatgggattgtgtgagtgggaggccgcgtgctgacttcctctgtttggcctcagagaatttcaccgacttatgctgtgcttaagcttccttaaagaagaaggactttctggattccctttttcagtgcattttcagtgattagtattatatt

SEQ ID NO: 18710 - DNA, 1189 bp, Mus musculus
tactacaacatggatgattctgtgctaagtgaattgtgtgggacatttaagatacttaatttcctagaaactgaaattaggacaggttactatgaatcccacagttaaattaaagttggccttggctctctctgtcggtggcttcactaatacaaatgccacagagctacatcatacagtgaggaccaattcatcccatctttggcatgattgtttagactggattctcgtgaggatctccagtctgtagtttgcttctctggatttcatttctgttcctagaaatagtagcttgctcagttgatagacagtgaaaacgtccaatcccttcatctgaatctccatccaaaatccggagccagccatctctgcccagcgtccctcaacagaaaagttactaccaaatacaatgagtttaacaacaacacatattgatcatgaatgtaccatcgtttataggatgggaatatcaataatttctcttcacctagactgtgagactataaaccccatccaatttgaattgtatttttactgcatttactgacagccctttctcttattgtctcctacaaaatgtaaaaaaaaaaaaaaaaaagaaaaaaaaaagaaaaaaaaagaaaaaggttacatatctgtcaaatactgtaccataaatttatatatcaaacattctgtgctgtatctattgcttctctttccctccctccctccctccttccctccttccctccctccttcctttattcctgccatctgatgctgctatggactgagttatgtgtgccccctctccttgtgtgtcaagtattcctataatgacagcatttggatataagatctcaaaaaagggttaattaagtcattttagtggatctgtttcaatggtgtttttataaaaatggaaaatcaaacacaaagtggggaccatgggcacctactgagagaagatggttatgtgcaacccacagagaggccacagaagaaatcaacctgcctggatctttatcctgggtctctagtccccagaactgagaaacaacaaattcctgttgttaaactctgtccctcagggaccccttgctatgcaagccctggcaaagaaagattggctgacaatttcatctctccaggaacaagcagtcaccccattacagagccaacacacatatttctagaggagccaaaa

SEQ ID NO: 18711 - DNA, 1197 bp, Mus musculus
ttgatgtatttgtcatccatgtctgagttgaacatactcaggagaaggcttaaagcctcagaagctcactatttaatgtaaagaatgcacctttaaaaacaagactgtccaaaaccaaagcaagccaaccaaaccaaccaaataaacaggaagccaggcatggaacccatgtccacccagcactcgggagacagaggcaggtggacctctgaggtcgaggccatcctagtctacaaagacagtccaggatagacagttttattacacagagaaaccctgtcttgaaataacaagaccaacaaccaactaaccaaccaaacaacaacagcaacaacaacaaaaaccaagccacatcaaaacaaacaaacaaaaaacccccaaggctccgttaaaggagtagtaataacctctctatggagattcctgtgtattgagttcacttagccaggttgtttcggttttcacattggagtttaacaaataacaatttaataatacttgtttatgtttctggtctgttgcaggaaaactagattccggtacgtgtgaacatatatcaggagaagaggaagtggcacgagaactggaacccagccctgtaggttccctgacagacatgccgtttgctgctgtagatattcaagatgactgtggaagtaagttctgtattcaaacacaagtgtttagaagcagtggacactacatttagttatacattccctctttaagttaattcattttatagatgtatcatgcttttgagtgctgacagttatctggtactttgttatccaaactgtcaaggataatgttaaggcatggctcacaaaattttggaccagactattctgtggttgtttctgaaggtcacggatttggcagatcatttcatggtttacaataacccactttagttctttagaaccgcctctgatttcagaacctatcacttcatgtaataaatggttagtggcatttgggtgtatgtaggcacttggctttgcgttgatcagatctatctctccgctagtgaaccagagaggcattatcagttcagttctgtcagtcccttagagctttgtctacaaagtttatgaatcaatacttgattgaaatgccaaactagaaagtttctgtcattgtgaaaacagaaccatccataatgactgggactctctcctctaccaaagtgacaga

SEQ ID NO: 18712 - DNA, 1157 bp, Mus musculus
caatgataaaagccatgtggtttgaaattgcgtattttattactagtcaattttaaaggtaatccctgtcttttattacattaatttaattttttaaaatgaatccactaataatacaaagctgtgaataagtgcaggattatatgctgtctctgccttgtttgtgcttacactatagctaatgaactgaggcattccttagtctgtcagttttgttattttgttactaaagtcatttcaagtggttaccagtcacttgactaaagaacttttgagctcctcacaaatcatttccatgcttgcacaaagcattattttatatgtaacattggaagtagatcacacacacaaacacacacacactccccccccctctctctcacacacacacacatacacacagagtctctctctctctctctctctctctctctctctctctctctctctctctctctcccacacacacacttcctctccctctccctctccccctcacacacacacacacacacacacacagcctggatcatccttttgatacactgtgcctttttagctctggctttgaaaactgtagtgacatgcagaatgaacgtgtaaaggaactattaactgctgaagcatctgctgatactgtaggaattcttgcaagcactgacagcctctgtggccaccacagacacatgccacaggacagtgtatcaaacagcaggggatacgaatcatttgcatccttttgttaaacaatttgtgattgtcgtgttgaaaagtatctggctaaataccatttattaaaaagcaacacagcttgtgttctacatgatatccttcaagtgctaagtggtcagaatcttttcagtcatgcttacagagtatctgaacaaacagctactgaagagaaagttcaggatttctgttcagtttgtcttcagtttatatatgtaattatgaaaaaaatctagacaaatattgtattaagttctaaatgaaatctttcttatctttagcaaatgactagttctatgagcatttttctagcatttttagatacatgtgtcagcagctaggtttgagtaatgttagctaaaacctcatagtcattaatatgtgtaaattttatgtgataaaaggagtccagtttctctccttaaaag

SEQ ID NO: 18713 - DNA, 1161 bp, Mus musculus
tttcttcttcgcccttttcacactcgcctgaggtgcattttacttcatttccccaccctgctactgaaagctcatgagacgggttttcattctgggggcatttaggtatcttttcctccacttattagtaaagtcactgggagaaacatcaagaaacaatgaatacgattatagagcacctctcatagactggggggaaaggccagcatgttgagaactgttgaaagcactgaggcccagagctgtagttattcacagaagaaagcctcacctaagcagagccagctaagagctttgcagagctcaagtttcaaaacccaaactccaggtatcttctggtagtttattatttaaaacagcactcacatgcccgaccacagttgctgcggtaagtgtgttggaatgatcctctggaatcctgagcaagccaaacctgtctagccattggaggctcagtaacagttctgccactggcctatagtgagctggagatgcgtcccttagagatgctctgagtaccaggcaccttcatctctgcaggagtctgtagttaaatgaacttgcttataagagcaggcatgaggttttcagtttactctccgcaactcttgagtcttcagtaaaattggaaaggtgattctttgatctattgatcacacttttacctggcatgacatgcattttgagcaactcagacatacagttgccatgactttgagagtaaccagtgacagaggctgtagcctatgtttgtaggaactacagacgattgtatcgcttagctttggatgtccttggttgctgggacccatgatgtgactgatgcctattaggaaaacctctgagtacagttagtgtcttgatggcacaacagttagcgttccagtatggtcagaggaccagtgcacatctgcattcagtgtgggtgatattttgagtaaacagtaccgctgcctggaactaaattattttttgttaggtcactaataggagtgccacaaggatataaacttatctcactgttttatttctgtaagtgtaaggtagcatgaagcattgagcctcctaaaagaaccctgcaccccagttaatactggactagagaaatttatgttactatatctctacttcaaattgaggtattagtaactttctggaatg

SEQ ID NO: 18714 - DNA, 1736 bp, Mus musculus
cttgattgaaaactttgattatttaactctgtttttaagccactggctttggaatatttaagatttatgtctttttttttttctttcctagaaagtcttttttaaacaacatttaacttcatgaatctgaagaactttgaccattccaagtcttaacgccgtaccactactccagcaaaactgtgctccgactggtaacagtgaccagaagcctgaagaattaaaatgccaacagcaaaccataccttaacagctctggtctctactattcccatacacttctaatatattgtttgttatataaccacttctagacaccctgctcccctgttctttctttccctacctttttttaattctttgttttttattagggtttgtgtttgtttcctttccctacctgcttttttgactcatttgctcaaatgacagtgaacaaagccagccgggctggtaaggcgctgttcacctgaacaggtgctgttatgtggaaaggaaactcgtgactaatttagatagcaattttcattcttcaagattgtctccattcaactcttacagtcaatatttacagctttcagactgcagtagggatactgcatgagaacatattaataccaattaaaagcattttttacatcttgaaatttttctaatattagggaatttcactacggatgatttttatatagatctttgaccttccagtcctttgactttgtacttcagtagagtcagacagagactctctggactggagaattaagaagctcactgaccaggtactgtgttgagagaccctcggcccacagtgcagtacttctcagacatgcgctttgccacagcattccagaacaggaggagaaccacaccgtgtgcccttcccttttactaagagaaaaccaggcagcttccagccttagagatttctttcttaaccttcccagttccagttcttcccactgtctgaacacttgctttgtatgaaacttgtctgtctccatgtacacggaccctttgctactgagcaggtaatctctgacatagtttgatgacttgcagctttgaagacactgggaagaagaggttggggacagtcggtcgggggtttggttggttgtaagaagccataccatgtaaaactaacatcagagaagctgataggagtttaactgtattgaacattcttctcatttgcttttgactctatgtatagttatgacggcagattagatttatgtcagcttcaagttgtattaaatattttgctttatgtaatactgttataaaataaaagtttgtttattctataaatgtgtcacttctcttttcataaacattgaaataaactggggtgctatttttccatcagaaaatctagcatttttacaaaatatttaaaatagtaacattttaagagtggctaagctgtgttttgtttttcaatttgttactcctgctagcctcagtaaactggtggaaattgtgaaaagtttgcaaatccaacatttcatataccagatgccttgtgatgggttagatgctctgggcagttacagggtctgaggtgtgagtccaccagggagggctgccttcctctccttggtgtgcttgcaggcaatgtttcagcagtaccgctgtgccttgccaccacgctttgtgtcctgccttttgtccgcagtgtgttcacagagctcggagcagactgctgagggactgcgtctgcctgggattga

SEQ ID NO: 18715 - DNA, 1099 bp, Mus musculus
gccaacattaaactaaatggagagaaactcgaatcaatcccactaaaaccaggaactagacaaggctgcccactttttccctacctattcaatataattcttgaagtcctagccagagcaatttgacaacaaaaggagatcaaggggatacaaattggaaaggaagaagtcaaaatatcgctatttgaagatgacatgatagtatatataagtgaccctaaaaattctaccagagaactcctaaacctgataaacagcttcagtgcagtagctggatatgaagttaactcaaacgaatcaatggcctttctctacacaaaggataaatgggctgagaaagaaattagggggcagcgctcgcagcaggtagacagacgccgcgccgtcgtcatgggcaagggtgaccccaacaagccgcggggcaaaatgtcctcgtacgccttcttcgtgcagacctgccgcgaggagcacaagaagaagcatcccgactcgtcggtgaacttcgccgagttctccaagaaatgctccgagagatggaagaccatgtctgcaaaggaaaagtccaagtttgaagatttggccaagagcgacaaagctcgttatgacagggagatgaagaactatgttcctcccaaaggggataagaaaggaaagaaaaaagaccccaatgctccgaagagaccaccgtctgccttcttcctgttttgctctgaaaatcgcccaaagatcaaaattgaacacccaggcctgtctattggagatactgcgaagaaactgggtgagatgtggtctgagcaatctgccaaagataaacaaccgtatgagcagaaagcagctaaactaaaggagaagtatgaaaaggatattgctgcataccgtgccaagggcaaaagtgaagcaggaaagaagggtcctggtaggccaacaggctcaaagaagaagaatgaaccagaagatgaggaggaggaagaagaggaggaagaggaggaagatgaagaggaagaagaggaggatgaagaataagtggctgtcctaaagtgtggagtatatttgctcaggcaattattttgctaagaatgtgaaattcaagtgcagctca

SEQ ID NO: 18716 - DNA, 1176 bp, Mus musculus
agaagggcatgcagtgaatggaacttaagtcttgaactttggcactggggacctgtgttctcaggtaggagagaaacgtgccctcagtcattggtgcttagggtttaattgtgtacccacctccaaccccaccccaccccacccccaccccgtaccatctgttgctgtcttgtgtggcatgtggaatgaaggattgattcaacctcactggagggttcatgaagaaaggcagaagacatgggattagagttacacctgaggggatgttgagtcactgtcaggcatgctctgtggaaactggcaccttgtagcttacttaactcttgcggcctagttgccccttctgtaggggtcagataatacctgcttcatcgcatgccacaggattcaaataaaagtttcagggggcagaaatcagttcgcaagtacttgaagcatggaaggggcaagtgcggacatcatcttctaaggttgtattcctgcacttagagtatgttgagtgtggtttctgggctagaagaaggtctcaaagcactgtgaaggaagggagtgtagctatctgacacgagatgactggtcacattaatcacgtcttctctctcagcacagagaaaaagaagaaatatccttgcttggctctcatgcatacacatggaagttgatgtagtttttgggaaaaggaggctggaggatcaaaaaagtgaaagtcactctctacacagcaaattcaaggctagtctgagctaaacaaatacccacctccaacaaagcacatctcccttttaaccctaggggctggggtactcacttagcctgttggaatttgtataacatgatcttgctcactttatagttaaatcataaatattgaggggtttttgtgtttgtgaatttgttttctgagcttttcagaaccacccacgattgatccacagggatcatagcagtctgctattagtagttcacccgtgatttgcataaagtcctaaatgatggagatagggagaagaagtgaaaagtgattggtgccggtcacttgtcacatgtctgccttcgaacactggatgggactatgatgacttgttcggtggcaaaggaaatgagtttggagccttccaacttttgagtggggcgctgtgtgctactgacagagtataaggaaaatgggtcagagtg

SEQ ID NO: 18717 - DNA, 1183 bp, Mus musculus
gcaaacaaacaacaaatattttatgttatgaagctgaaggtggttgggcctctaataatcattgtaagttaaaagtactatgaactaacaacccagactttatcctccaactcaggaagtctgcttctagaaaatgatcctactagatactcgtgtgtgtgtgtgtgtgtgtgtgtgtgtgtgtgtgtgtgtgggttcttcgtaggtagagagttacaacagttcaatgccatggcataaaatgccacagggaaaggcaaagaggaaactccattctaatgtagaaataattcaagatagaattaatatgactaattttaagcaaagtacaaaaatgctgcgctaccatttgtataaaaccaaaggagatatggagtatgtcccctgtatgtacataagttatgtttagaaggatcggtcagcaactggaaattccagctgtgtccaaaaggaggggagacagtgttcaacaacagccacattgagctttctccatgttaaaattaaaactaatgttaaaacaatacattcaaaagttatgatatctaagcagggtctggccaggttaatacttggatgggggagcacctgggaataccaggtgctgtaggctttaaaaaaaaggttatgatataaatataatatataaatgttaaatcctacttcacgcttatttaaaagtatattataagaggcatgtcttcccacaaaaatatttgctactaatgtcaacaagagaaaaaaatggtgtagaagtcgctatgggaaaattagccctgtgaagctcttgggttactgagagagaggagttaactctaagtgcatgcttatcagtataacatatggcaaagaccatatacacccccagacccagtgtttacagccccaccatcctgatcaacccctgaagttgtggtgagacttcctaatcattgcttcctcagagacatgattcttcataagctgaggggcaggcgcgcattgccaggcctggcctacgtccaggtagggctcttagtcagagagcttattcttaactgctatgaacactgcaaataaaatgatttttaaaataaaacttttttttaagagaaatcatacaagcaaaattaactactagtggagtctagtgttgacgacagaataaagggaacgtggacatgtttatgaaagccatagttcc

SEQ ID NO: 18718 - DNA, 1170 bp, Mus musculus
aagattttattgaaaggacgcagatgtagctgtctcttgtgagactatgccggggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaaaaaaaaaaaaaaaaaagaagctgtaatattgaaattgccttggagactcaaagatgttaaagatgccagagccatgggatacatggtgaggaaagctcctaacagaaagtggaatcagcccaggagaaagcagtttgatgcagtcaacaaagatgaaaaaggagtggagatctgaagaccgctttgacagccatggagatgcagagattggagtttgcccagctgatttcttgtctttctttgaggattacagttaagtgattgggtgaatcacagaagagactttggacttttaacattgttgagactgctatagactatgaggatactgaaagctgtactaaatgccttttgcatttgtatggcagcatccaggcagtcatggtgcaggaggagctgagagttctatgtcttcatccaaaggctgctagtggaagactgacttccaggcaactagggtgaggatcttataccaacacagtggcacacctactccaaccaggtcacacctattccaacaagaccacacctccaaatggtgccattccctggtccaagaatatacaaaccatcacactccctttcttttcttctccctcctcttccttctgttctcttctacctttccttttgcttcctcctttcttttctcagtatattttattatttttctggaaagataaaaccatgtgcagtaataactacttagcaagtacatcctatctacaccagtt

SEQ ID NO: 18719 - DNA, 1179 bp, Mus musculus
agcagagtcttgcccaacacccgcaagggtccacacgggactccccacgggaccctaagacctctggtgagtggatcacagtgcctgccccaatccaatcgcgcggaactcgagactgcggtacatagggaagcaggctacccgggcctgatctggggcacaagtcccttccgctcgactcgagactcgagccccgggctaccttgacagcagagtcttgcccaacacccgcaagggcccacacgggactccccacgggaccctaagacctctggtgagtggaacacagcgcctaccccaatccaatcgcgtggaacttgagactgcggtacatagggaagcaggctacccgggcttgatctggggcacaaaacccttccactccactcgagccccggctaccttgccagctgagtcgcctgacacccgcaagggcccacacaggattccacacgtgatcctaagacctctagtgagtggaacacaacttctgccaggagtctggttcgaacaccagatatctgggtacctgccttgcaagaagagagcttgcctgcagagaatactctgcccactgaaactaaggagagtgctaccctcccggtctgctcatagaggctaacagagtcacctgaagaacaagctcttaacagtgacaactaaaacagctagcttcagagattaccagatggcgaaaggcaaacgtaagaatcctactaacagaaatcaagaccactcaccatcatcagaacgcagcactcccaccccacctagtcctgggcaccccaacacaaccgaaaatctagacccagatttaaaaacatttctcatgatgatgatagaggacatcaagaaggactttcataagtcacttaaagatttacaggagagcactgctaaagagttacaggctcttaaagaaaagcaggaaaacacagccaaacaggtgatggaaatgaacaaaaccatactagaactaaaaggggaagtagacacaataaagaaaacccaaagcgaggcaacgctggagatagaaaccctaggaaagagatctggaaccatagatgcgagcatcagcaacagaatacaagaaatggaagagagaatctcaggtgcagaagattccatagagaacatcgacacaacagtcaaagaaaatacaaaatgcaaaaggatcct

SEQ ID NO: 18720 - DNA, 1164 bp, Mus musculus
tttcttttgttccgtttaatgaactctcaggcttgaaaacagcttttttttcattagaaaacaaatacagagctaaatagtcttacttgttgacgttatttaaaagaatatttataggtacacactgcctaagggaccagaaatggtatgtgtaaactatttttgcttgatttaatgttggtacaggaaatagtattccctctgactttggcaccagtaacctctagctttactattctctctttcttccatgatctgtgtaataaggattgcatttgcaggccagtcagatttcatgaatgggagttagtaggtagactatattaaatttcacaggggttctttttactgtcttttctgctcatatttaagaaccgagattcttgtcagttttctcaagagaaaaattatgatgtaatagacagtgtacactattcatgtcaaaacacaattttcttgcattttatagcttggtttagcattcttctagaaaatgaatttccccagaagacctaattgcctttttattaatgagtctgtgtggtgttcttttttttttttttttttcctctccatttactattctaaatgtgtctacttttgctagctgtttcaacagtgatgtctctgattaaatcacaactgctatatttgtttttgctgttcactagtgatttggaaaaatactggcataatgacatggttatagcactgagtgatgaaaggcaagaagtgtgaagtaatgttaacccctgatcatctgaaatactgtgatctttgaagctagagtttggggacagtggatatcggtgcttttgatactgtaaatcaaaatctatttagcctacagtgtcttaaatgtgagaaacagagctcttgagattgatacattccatatctatttaatactttgcagttcaaggggagattaaattagagacaaatcgcagacatggaaaaccttaaagttttcacacacagtccagaactttggagtttgaatgttcttatcaatagttttttctaattttattctaaatttactaagtctacttttatttttgccagccattgttaggctcatttattttcttacccattggaaaagaaagactttcccaaagcaattacaacatgagggtctgccatttgctgatgttctat

SEQ ID NO: 18721 - DNA, 1199 bp, Mus musculus
ctctctccttctctctctctctctctctctctctctctctctctctctctctctctgtctctctctctctccgtctttcttccctccttccctctcttcctgtctttctcccttccttccttccttccttccttccttccttccttccttccttccttccttccttccttcctttcttattttccttaaagatttattagtttttattttctgtgtatggctgtatgtatgtatgtgtgtgtgtatatatgcatgtatgtatccatgtataccatgtgtatgctttgtgcccacggtagtcagaagaagacttcaaatagcctacatctggggttacagaaagctgtgaagcaacacttgggtatggggaattgaacccaggtccaggcctgtgctttgacctgcctcagcgtgtcttctctgcttcttcctgtgttatcatgagtgagttttatttatttacttttctattataaggtaacattcttattagtacattccttttatctccatcccacccattttgttattttgaggaagtatctcatatatatagtccaggctgaccccaagctctctacatagccaaaatctgatactgacctctgatcctcctgcctccaccgtcaaatgctgagagtagagattgtactgctacagtttaatacaactcttttcatctgtgaagtgagttctaatggtatgtagtcatccattagtttcattgtgaggttagaagtcacagacctctagggtgaccaatatttcagtagtatgcatgtccacatgtacatgcaaggtatcatgccataaaatcccttctcttgttctactggccttaaacctttagggtagtgggtattttattgctctcttaacaccctcagtgttggacttgtgacaaattggttggttttagattctatctctaatctaaattcctgattttgaccactgctacccgtcttgatttatttgaaaaattagcttttagccagattagattctaatagtagtcttgagactatttcagatgagactgatctaagctgtgggcccatgggccacatccagccttacgcctgctttaggaaacctgttcttcaagtgcggtcttgtaatctgttaagatttttcatgtttggctgctttcttgctacagttacaagaattgtgtagttggaacagaaggtaaagga

SEQ ID NO: 18722 - DNA, 1176 bp, Mus musculus
tattattgcttgtcccttcttaatctcacacgttgcagcataataagcctggggcatctctacaaacaactctctctctccttctctctctctctcatctctctccttctctctctctcacctctctctctctctctctctcatctctctctccttctctctctcatctctctctcatctctctctctctctctctctctctctctctctctctctctctctccctccctccctccctctctctctcttcttttataaaagatttcatagttcttcctaagtgtatctgctaattaatctttacattacccctgtgaggtagacagctgaataggatattctgcacacaaagcactagaccatgctgcttctctgttatgatagaggattattgttatgttaaaatgtttatacaccaagtacataaatttgtagagatggatgtaagccgattccttgggcaaaatatatgaacgtggttatagcataaaactgcaattgtaaagcaagttttatcagcttctggtatttaaaggattgtcccagatctgcatactaaacctctgtatgatagcctctttccattctccagcctttgggtagtgacaggacacagtaagctggcgaagcaggactgcagcaagcagctatctgagatcctagatagcattacttttagactactggaagcttctttggtctttaggaatacatatacataaatcactagagtaatagcactagtagtttttgatgataacctgatgatagtgaatggaaattggttaggtgttgtacgctttgtatagagtttggtgtgggtcttctagaacatagctttttaaccctctattgcagccccatactgggcatatgactaaatgtgagagtctggaaacgttggggtctgtataggtggagatggggacttttcatgtgtaggaacagtggcctggaggatgggctgagtcttgctagtgaggtacatcctcacataagttgcttatgcatggatcatgacagtagtggcataaggaaaccactgatagtggacatgggaaaatgaggttatttttctcttgccttaaaatggcttggaatttgaatcttcaactctcttaaccctttgcctgttaacacatgtgagtggggaaacaaggaaattgctttctctat

SEQ ID NO: 18723 - DNA, 1199 bp, Mus musculus
atcatcatcatcatcaatttaacaggcacctctggtaatatgtttttcacttttaaaaagtgtgtcatgaagcaaaatgtgtttctgtggggaacaggaatgattataagataatcacggacccggagggtatagagatgggaaaggtgcaagccaatgtatctcttcctttgacataatgattatttcataataactgagtgcctcattccagtcttctctgccagcaccatccaatttctccattccattctaccagactgagacaggaataatagaatttttgtgctaaaatataatgcaggtgattctatgatggttcagtatatattttagctgaaccgtgcatttccttataagaagtaagaatggcccattaacagatggagttgaaataatagagaaaataagttcttccaccctttgctgggctatccctgagttgatttgccaggattcttgtttaagagaactgcagtttgtgacatgacagtggtgtgtgtgtgtgtgtgtgtgtgtgtgtgtgtgagagagagagagagagagagagagagagtcttggggacaatttctccctatgagatcctggcttgtgttgaactcatgatcttatcgccttggactcctgagtgctcaatgcccaacttttcaagagtagttttcactgttccttttagaaggtgtagtttactttattaacctttccaagcaagatgctttctacattattaatacaaagaaaagcaactgttaggtacagagttatgtggttttcaaagagcgtaagtttgaggaccaagtctagatataatgaaatctcagctgcgtcttgctctgtgtatacttacttatttcgtccagtctcacatttgtttagaaatgctagaggctccgtcttgcagatacatgcatactgaactttcatgaatctttcttcccttggacgtcctattctgactttggttggagtatttggggtgggtaaaggaggggtagattaaggtagctgctaatggctttatggaagagacccaggccttgctgttctgttctgggataatgtgattgactccagctttctgacctatgtcagggaggactgtttcttgtcagccagctggaggcctctggtgagtgcagtgcatatgagcccctcactgaagccatgaccctgtcagtaggaaattacagatttattg

SEQ ID NO: 18724 - DNA, 1145 bp, Mus musculus
aataaattgattctaacagtcctttgaaaaaggttttagaatagctaacatagtactagagaaagaaactaagctggctggcttctaccctctaatttgaaaaatatctaaaaagctcaagaagtcaaatagtgaggtgtgagataaagtagtgatgcattaaagaatgcaaaataggatcatacaaagtgagtcaagtgattagcattgtcttacaatgttgtagttatagcccgtcgtccagcaatttcattattttccagcaaattaggattaaagcaacatttataccagctgtatatgtaatcaccccaaaccctaagcaatcatggtatctttcaattacagaatgaataaattccgacccactagtccccactttatacacagggcacctgagccccaatctctaacaaatacttgcattacacatagaacaaaaacctgttctgtgcaatgtttcttcattaatttatagattaatcataattagcttaacaacaatgacaattgaacagttgtagctatatactataataaaattgctgacattgctactcttagatttggaagacattattaatgtattacttgaccatggccgcatggatacctacatggtatagttgattgcattgtagacactgtggaaattctggacagagagatgacttatgtcccaggaagagctgtatagcttgcaaatttttcatgttattcaaaatgtagtgaaatttaaagctgtgcatagtttatttcatttagtacgttcatgtcttagatgaccgggggtaactgaaacctgaaaacacaaaactgcatctaaggcacttatggtttgtgtgtgttgagggtgatggtactttgtatgtatatagtgtggcagtcagtgactgaaggaataaaaatcagatcgacagaagaattttctgcatctgaattgtctgagatagagtaacaccaagaaagatgttgtattactccagcctcaccagttggcgccataacatcaacttcaaacacccttccatggtgacatataaaattaacagttccagttggaagaggtcagtggttgatttgggtctgaggactagatagtataagagacacagtggagaggtgttttttttaagacaataaaa

SEQ ID NO: 18725 - DNA, 1321 bp, Mus musculus
catgctggccttgaactcagagacacaccttgtctggttgctgggattaaagtgtggtccaccacagcctggttctttacctttttgtaagctgggaaacattcttaactattttaatcctataaaaatccttggcactatattaaatgataggaaatttagggcaaagataaaacatctttttactgtttcttttttttcttaaaagggatcattagacttgagaataaaatatatatggccagatgttcctgttatatgcaaaataagtaatttacgacttttaaataatctaaattgggtgtcaagaactcacacagatgctattactcaccattagccttttgctaactcctttcatcccttctgttctgacatgatgcaggagcagtatcgtttttgctatgatgtggcgttagagtacctggagtcctcatagttcgctgagactatttgcagagcatccaagcagaaatccattcgtctgttgagccagcagctgttgtacctgttactgcaccgagagattttaatgtacggggtgggaggcttttacattggagaggcaaatgtatttttcttataaagttgtgtatcttaataaaaaggacttgatcagtttctgtgactgtatgagagcatccacatttcatgccacctaattttatctttaatcagaggcagatttggatgagaagtggtctgtgtctgtccagtgaccacacagccttttctctcctgctttctgtagagcagctaccacacattgcatgcactttgtaagtggcatttccctctctttttaaaataaaaactgtgggaccttaagaatggggaaggaaacaagctgtgcaaagtcatggtaaatttcattttatatgttccaagtgtaccagattctatataaatgtgtgtgtgtgtatatatatatatatatatatatatatatatatatatatatatacatacatacatatatacatatgtgtgtatatatacatacatacatacatatatatggcttattttcttttaatgtgcaatgatggctggatcatttaaagttccttttagaaaataacataagccaaagactgaagtgtacatatgtctatatggaagaagcacattatatttattggttacttacattacttttttgatggataaaatactaccgccacacaatcatttttgttgttgttgttgttttaggagagttagctaaaaatcaatggtaaacaattttttgtagattattttttgtatgtttagtgtaagtaaaggataaactttttattcataaaccaggaagcaatgt

SEQ ID NO: 18726 - DNA, 1389 bp, Mus musculus
ccagcaggaaggatcccaaattcagggagtggcaccacttcctggtggtcaacatgaagggtaacgacattagcagtggcactgtcctctcagattatgtgggctccgggcctcccagtggcacaggtctccaccgctacgtctggctggtgtacgagcaggaacagccgctgagctgcgacgagcccattctcagcaacaagtctggagacaatcgcggcaagttcaaggtggagaccttccgaaagaagtataacctgggagccccggcggcgggcacgtgctaccaagccaagtgggatgactatgtgcccaagctgtacgagcagctgtcagggaagtaggggtgctgcacaggggcccccacagccttgttaagttgtgtaaagcatgctgttccccccgcccccttgctaccctctcattgggagttcttagctgtgctaggatagaggtttagggtgtcttccctcttgctgccagccgttacgattctggatagtcccatcccaggttctgtttgattgagtttaggttccgtctggggaggggtctaatgttctgatggagtcattctgttgttgatataaaaagagcaactctgaaaaaggaaacattccgccaggatcaggtctagaggagagctggagctggtggtgtctgtgagtggttgaacaaggaaactgtccagaaccgggcacagtggggtctttaagggccctgtcccccaactgagacaactcaagactcccatcttagctgagccctgaccgtccagatcaggtggctgcgtaggtatcaagtgtctaaagaacagtgctgctgtggagagagaccctcttaagccccttgcttctcagtggggtaggcaaaagtcatctgagctgccgagtgtgttgatcctccttgtcaagtacaaataaaaaggcattgcattcaaaaaaaaaaaaaaaaaaaaaaagaatcttatatgaaggagcaaaactcatggtagaacattgagagaccactgataccacaggcactatgggatttataggcagactctgaactcttgactgttcatgatttcaggtcagcaaggtacccactgcttaaaatgtcccactcacgtaatggactgcccctcctcgccctgagtccccctcatattggaaccagctctgcttctgcaaacctctaccagctgaattgttgccttccttaggagctacagcgactgatttgttccctttgcctctctatgtgtatgtatctgaaagataacagatgatctggacatacagaggaacacagaaggcaggtcagttacaatagcatggtaacttagacttaaataagtaaacattttattatataacaaccctaaatatctcctaagacaaagtc

SEQ ID NO: 18727 - DNA, 1165 bp, Mus musculus
ttatttcgacttaagaaagaccaaaacagccagaaacagcagtattaacaagtgtttgggaggcggtagcaggagtgtcaggaattcacgtctacccttggcgctacatagcaagtttaagaccctctcttaaaagttagtatgttacaaagcataagcctgggctaagaattactacaggaatgtagaaattggtatatgttaaatgataagaaagacaacagagcactgaattacaatatggagaaggccccccgagccaactacgcagattagcagtcccctttgaatgacttccgcagctcatttctaatcatctcacctccatgcatgttcccctgcagcttcacctgtactacactcattttaaaggctatttagtatgctttcctttcttagcaatagcctctaaatttgcaggtccaccccacagtgtttccaaaacgtctcgttcattctgtaacgcctcctctatatacagttctcgggcagagcagacagatttttttaaacccctaatgacttgtggaggcccactgacaaatttctccagccactcttgtgcctgttctagagccgtagtttcatctgagggctgtaagacctcatcagtcaagcctatatttaaagcttccttggaatccagtttgagagtcccacttaacactttgagagcttgtctgctgccaatgatttcaaccagacggctggtaccaccccagcttggaactatacccatctccttgtggacaaatctgatcacactttcctcagtcatcaacctgtaaaaacaaaaataagaactgtaactatccacatgtacgagaaccatggtctcacaggaaatcgctgatctttttaggcagacataaagttgttggaaaatgtccccagctagaatttaacttaccatgtactgttcaataaactcttgcttttaaacgtaacatttttgtttcaacttttccaatctttgataagaactcagcctcacattttaagaactttatgttaaccaattctcaaagtatctgtgatataaatactctcatttctatggttgaaaaaacatgcaatggaagccaaatagctcatcctaagtcatacagctttagtaacgccaggacttgacctccagatagttggcttcagtgtctggatgctt

SEQ ID NO: 18728 - DNA, 1099 bp, Mus musculus
aactcagtggagacagcatagctgaacggagtcacagaggtgaaggagaagaagatcatgaatcgccatcttctggcagagtaccagatacctccgttgaagaaacagaatcagatgccagtagtgatagtgaggatgcccctgtggtagttgcacagcactctttgacccaacagagacctttggttccaaatggaaaccagacagtagccgaccagtcagaccgatcaggaactgaccgatcagttgcagggggtgggaccatgagtgtcaatgtcagatccagaaggcctgatgggcagtgcacagtgacagaggtttaagcaaatgtcttccgcaccacactcaagggtaaaatggatacctgtaaatttctgcccacgtaacattatactcatccttagtagtgcgttgtgggagttgggggggaagggatatgggaaagacagacctgaaattaaaatgtctaacatgtctctgctgaaatttatttaatgtgaggaactggggtgttgatagttgagagctgttcagtataacacagttttcttgacatctgtttatagtgtatttttttaagtttttagttcttttggctagtgtgtccctgtgcattaatggtcctcatctgactcttgcactacttattttttctgcatggattggtataaaatcttcaataaaatttggcacctgtgagatatttgatatcattatgagcaggaagcttgatgtgaatttgggattttaaaatagatgattaacaactatagttggtcttcttgagatagaaatgtaaagctgcagctaataagtttcagaatctgtaacgcacttcatggtgttcccttccataagatttgctgtcttgtccttgtacttggaggtttctcttagtctgcatttttctttttgattaaaaaaactttataatttaataaatactagagtttatcagaaataatttgtttgagtctggaaaagggatggggacactttggtatttgtggctaaagagcttttttaaaggtgaggtttgaattgattgcattctattcaaactgttccttactcaagaagtaagtctgatttcttcaga

SEQ ID NO: 18729 - DNA, 1420 bp, Mus musculus
tgtttattcaaatatataaattgcatatatatctgcatatgtatatatccatatgcagacatatatacatgtatatacacaatatttaatgaatacatattcatatccatatatccatatgtatacatataaaacatcaaatagaagagaccctatttgaatgtatgtgggtgactaatactatgtagaatgagagacaaaacagaataatggagagtgagtttgtttcagatatataatatatttgatgatattgttcctatgaaacccattgcctagtaaacaggtatcatactaaatatttttttctataaatgaagtgtacttctagggggaaaagattctaccaggaaatgcctccagctgataaacaatttcagcaaagtagatggacacaaaattggctcaaaaaaaaaaatcgcttttcggctttcggctcggaggaggcaacggtgcaactttcttcggtcgtcccgaatccgggttcatccgacaccagccgcctccaccatgccgcccaagttcgaccccaacgaggtcaaagtcgtgtacctgaggtgcaccggaggcgaggtcggcgccacatccgccttggccccgaagatcggtcctctgggtctgtctccgaagaaagttggcgatgacattgccaaggctaccggtgactggaagggtctcagaattacagtgaaactgaccatccagaacagacaggcccagatcgaggtggtgccttctgcctcagccctgatcatcaaagccctcaaggagccaccgagagacaggaagaagcagaagaacattaaacacagtgggaacattacttttgatgagattgtcaacattgcccggcagatgagacaccggtctttggctagagaactttctggaactatcaaggagatcctgggtactgcacagtctgtgggctgcaatgtggatggccgccaccctcatgacatcatagatgacatcaacagtggtgcagtggagtgcccagctagttaagaagcaacaagaaaatattccaataaaagactatctgataaccagtggaaaaaaaaaatcaatagacttcctatatacaaaatgacaaaagactaagaaagaaatttgggaaagaacagttttcacaatagccttaaagaatataaaatatcttggggcaaaagacttgtgtgataacaatttcaagtaattcaagaaagaaactaaagaatatattagaaggtagaaagatctcttgtcttcatgcatcagtaagattaacatagtaaaagtggacattctacaaaaaggaatctactaattcaatgcagtccccatcaaaatccaacacaattctacaaagatcttgacaggacaaatctcagcttcatatggaaacacacactgaaaaaaaaaaaaaaacctcaacaat

SEQ ID NO: 18730 - DNA, 1220 bp, Mus musculus
agtttcatgagttttattgcaaattgtgtcttgggtaatctaagtttctggggtaatatccacttatcagtgagtgtatatcatgtgtgttcttttgtgattggattacctcactcaataatatcctccagatccatccatttgcctaagaatttcataaatttattgtttttaatagctgagtagtactccattgtgtaaatggaccacattttctgtatccattactctgttgaggggtgtctgggttgtgtccagcttctggttattataaataaggctgctatatagtggagcatgtgttcttattacaagttggaacatcatctgggtatatacccaggattggtattgctggatcctccgggtagtactatgtccaattttctgaggtgccgccaaactgatttccagagtggttgtatcagcttgcagtcccaccagcaatggaggagcatcttagccatctgactggtgtgaggtggaatctcagggttgttttgatttgtatttccttgatgattaaggatgttgaacattttttcaggtgcttctcaaccattctgtattcttcagttgagaattctttgatttgctctgtaccccactttttaatagggttatttggttctctggaatcctatttcttgaattctttatatatattggatattagtcccctattggattgagggttggtaaagatcttttcccaatctgttggtggccctgttggtggcccttttgtcttcttaatattttcctttgccttacagaagttttgcaattttatgaggtcccatttgtcgattatcaatcttaaagcacaagccattgctgttctgttcaggaagtttcccctgtgcccgtatcttcaaggcttttccccactatcccctctataagtttcagtgtctctgttttttttttgttttttgctttttttttttttttttttttgtggagttccttgatccacttagacttgagctttgtacaaggagataggaatggatgaattcgcattcttctacatgataacctccagttgagccagcaccatttggttgctgtctttttttccactgggtggttttagctcccttgtcaaagatcaagtgaccataggtgtgtgggtccatttctgggtcatcaattctattccattgatctacctgtctgtcgctgtaccagtaccatgcagtttttatcacaattgc

SEQ ID NO: 18731 - DNA, 1208 bp, Mus musculus
cctatgagctcacatggaaaacacagatgtttccttggtctataggacaccttagtcagtagcagctttaaacctatgaaaacctagaacaactggaaaaatatgaaatgaccaaaagccacgttgaattataaagaaaagaatatgtgtagttagtacccctttggctggcttggtttgtctgagtcttcagatacagtcttttctctgggatgcaccacaagtcctctagtgacattatagctgtgcatgtttgtataacaaatttctgtgacattcagattagcacagatttacctaagaacacttttttttttttttttttggtgtgaatattttatcagtgacactggaaaccaacaatcaggctctgagtgagcaaggtatctcctgggtggcatcctggccaaaggaaacactctctagatttcctttttctttctcagctaggcaaaacaggtccaaatgtgagtgttcagtcctttagtttgaaccacaggcagttagttaacgcacttcttagtgactgattagtggttaaaatggccttttgtattttctctggattggcagctggcccgacgacttccagccagggtacaaggctatccatggagactggcctacagcacattagagcatggaacgagcttgaagactctctacaggaaatcagcatctctagatagtcctgttcttttggtcatcaaagacatggataaccaggtgaggcctgttcctctcacagagaacatgtatcttgtttttggagagatatgatttcaatctagttcaggctatataatctaaggtattttgaattcctgatctttctacatccactttctgagtgctagaattattagtgtgtatcatcataaatggttatatagacgctagggatgaagtccagggtcacatgcatgcagacaaactctgccaactgaactgtatctccacctgaaaaggtgttttggtggcagatttttagaatacccacagtagagagactgctatatcgactcccattctcagactaaatggatttggacattcttgttttatgtctttttcttcttgtttttgtttgtgggtgtattttgaaatcctaatataaagaaaatggaacaattgtatgctgagaaattttctccctgtgctgaccataagatagaaaatagtaacctaaagcagtttaaaagtagaag

SEQ ID NO: 18732 - DNA, 1176 bp, Mus musculus
aagtacccttttacactgagccatagctccagccctctggatttctaaaaagtagaatcctagacccttacctcaggatactttggtttagtaagtctataggaaggatgttagaatttatatttttcaaagctctaagatgaatctgaaaaacagctaggttttaaaactactctcctataagacaagatccattcaagcaagacactgaagttctttactctttcagatcttacccacgtctctcatctcttcttctagggctctttgttcttcagccatcaggaacctagagcatccatctctgtaccccttgctgcaaccctatacctggcatatctccccacccagctcacagatagatccacccactcccttgtgaataagccttctctgggcacaccaggtgtccaacccttctttgagccttgaacacattcagctcctttattgcatgtcatggcatttgtttggctataatttcatcttctgtcactcatccatagaaaactatgggctgtgtccctgttcctggcaactcacctggcatgccccagaatacaggaagtgcttaataaatgttggcactctccagtatccaggaaacacttaattaatgtgttctatcatgaaataccaggcactgaaaatggtgcttctcccaggaacagaattcaagtgatttagccctgggttgttaggtatgtgcatgcctggctggtgtgttgtgtccattcatctgccagagtataacttagaacctaccccaggaccctgaaccttcagcagcccctgggactgagagtcccctgcggtgtggaagagtagcagaaaaacaggtgaaaattgatctcttgtagatctgtatttctttccaagcctgtgtcacctgatctgacgatcaaaaagaaccccgtggaggactttatcagtcactaagatgcatcccataatgtgaaacgataaactgtaccttgccacttgttttgtcaaactgcacataagatggcattgttcactgcctcctataagttagaaatgctcccactctttcaagttacttatgccaacaaattctaaaagtcacatagaaactgctgttgccggagtgagcctggctaccacccctgtcaaaggctccttttcgtaagattcaaactgatgctgggaaccaac

SEQ ID NO: 18733 - DNA, 1214 bp, Mus musculus
aacgtacttgcacacgcatagagcccccagacaactctgaattgtggaaattaaagaatctgcaatcttccaggggaacaaccagtgagtctccctcagtgacccagctcagcatgcgtgctgccttggaacctacagccaaagaaaactgtcttttaaaaggagatgaggactttgttgacttggaagaactttcttctcaacctgagagtggaatcaacaaaggagatgccacgaaagaatgtctttcctatgaccaaaagaaggatgggccgcatacagtcatgtctgcaaagaaggggcacgtgcagtcagcccaggaagttatgggaccagagagtgatactgaactgaagggagccctagatctagaaactgctgagaagcaagatgaagccccagaagtagacaaacactctggatccccagaaaacttgggggaaagcacgctgaatatacacgaagatctagataaaattaaactcattgaattttacctaaataaaaacaaggaagggtcacagctgttagaaaatgtgcagaagtcagagttaagtgaccgcaaaagtattgaaccaggaggaatagacatcacacttagtagctctcttccccaagcaggtgattccccacctgaggacaacaaagagccaggtacactctgggtaaaagggggagaaactctgcccctgaaactagatcctagtgcagaggaaactgtaattaacaataaagaggttctggattctttgggatcatctctagacaagatgtgtcacagtgcacagatggataacaaatctgagattcagttatggctgttaaagagaattcaggtaccaattgaaggtaagacgttgtttggtcgggttttggttggatgttttgtttggtgtgtgtgtatatgtgtgtgtgtgtgtgtgtatgtgtgtgtatgtgtgtgtgtatgtgtagtatgtatgtttctgcgtgtgcatgttctcatatgtatggctacatatatacacatggaagccgtgtgtctttggttatggcccactttaattactgaggcagactgagcattaatgactgaggtaaaaatttacaaaacaatttgtagaccttgaactaaatatagatttctgtttcagaagtatttaactctttcaaacaaatttttttattaccttgcatgcctaaatctaaagaagttgaaactgtatatgtgtgta

SEQ ID NO: 18734 - DNA, 1162 bp, Mus musculus
ggtgtttctgatgaacactttcaaattggctacattaagtgagttttgcacaagtattacaattttgatatattggagcttgtgtatgtataggtactttatggttttgtgtgtcaacttgacacaagccagagttatcggagaggaaggagcgtcagttgaggaaatgcctccgtgagatccagctgtaaggcatttttctcaattagtgattaatgagggagggcccagcccattgtgggtggtactgtcctggggctggcggtcctaggctctgtaagaaagcaggctcagcaagccagtaagcagcacctctccatggcctttgcatcaactcttgcctttaggttccagtcctgtttgagtccctgtcttaacttccttcaataatgagcagcagtatggaagtgcaagccaaataaaccctttcttcctcaacttgctttttgatgatggtgtttcattgcaatagaaacactaaggttggtaccagggtactggcatattgctgtgacagacctgaccttatttgggggaggattgtggaaagacttttgaactttggcctagaaaaaccattgagtgttgagacctcactgggctgttctataggagcttggaagctaagaatgttgaaaacagtgcaaatgatggagacctgctttgtgaaatttcagaggggatattaaatggcattagagccatttgctattttggtttaagattctgtggttcagattagctggagttgaagcatcagctgtgataaacaagataacagaactactaaaatgaaacttttacattactgggacaattgatgctatttagattgagctaagaaattagctgtgataagaagagaccagcatctcagagatgaaatcttctgggaaatgtttcgtgagagcagagagaaactgttttccagaggcagccaaggttgtatctcctggcagctggacttgttaaagagttaccctggtggtatgggttttggagatgtgaaggggtcatgcagagaagttgaggcttggcaccaggaagagagcctatgagaggctgttggggaaagtgaagcccagtttcagcaggagacaccagtgttttgtagataccagtacaatgggatgaccaacaagaacagtaggcaacagtggag

SEQ ID NO: 18735 - DNA, 1228 bp, Mus musculus
aataagacacggtcatgtgatacatatacatatgtacatatgtatatacctataataatatatgtacatgtattagtttgcaggtgtgatatgcccttcagtgcctacatttacacactaatggctttgaggggtcctttctgccacttttgttggtatttactattcatgtgacaggaaaaaaaagatttgtatctttgtacaaagatacaaatagagacaggttagatttgaatcaagtgtctaagaccatcaagaaaacaagcaatggcaagatctggacaaaagcttacagtagtaggggcatagaaatagtttcatggaccgcaacactaggagaaaatcaggactttctccagcactgcaggcagaaggggatcaggtttcgagggtcccttctgtggtccgctgtgaggtccgcaggaaaagggccccagttttcggtgctcattcttatagcaattgagtacatgcatacagttcaaggcaaatctgccctctagtgtttgcaagtgcagccaacactttaaatgaatcaaataaaattacagaagagagtcaggaagcctccctggtggtctagtggttaggattcggcgctctcaccgccgcggcccgggttcgattcccggtcagggaagcaatgtttttctaaatttcaagaatttttactgtaatttgttttttattgcttctttattgtccatgacaaaagttgtattagttttacgaatgttttcaataactatgtttcaaatagacatatactatgtctttttagttattattgacgattaaacaagttttatgggttcttaatgataaagtacttgaaatatatttgtttatacatttgtcattccgtttctaagattgcaattttcagcctttgataataattgggatatgtatacaagcagggatttttagaaagcttttatttactcttgaatgtgactgataaaagaagaatatcattttaggaagacttatgcttgtgttttgagtcaatttctatttcttatatattgaaatcctatttatttaaagtggatctgttcctatcttgttatttttaataaattaaaaatatgtttctgagaaatgtgaataatgaattatctgcttgtgttttttcttagtttaaatttgtttgtttgttagatagcatcttactaagtagccctagaactcactatgtagaccaggctggccttaaactcacaga

SEQ ID NO: 18736 - DNA, 1389 bp, Mus musculus
gagaatgcctacgccaaggtctgcctctatctcaccagttgtgtgaattatttaccagaacctgagaactctgccctcctgcgctgtgccttgcgcatgttccgaaagtttagccgtttccctgaatctctgagattggcactgatgctcaatgacatggaactggtagaagacattttcacttcctgcaaagatgtggtggtccagaagcagatggcatccatgctggctcggcgtggagtgttcctggagctgagtgaagatgtagaggaatatgaagacctcacagaaatcatgtccaatgtccagctcaacagcaacttcttggccttagctcgggagctggacatcatggagcccaaggtacccgatgacatctacaaaacccacctagagaataacaggtttggtagcagtggctctcaagtggattctgcacgaatgaacctagcctcctcttttgtgaatggctttgtgaatgccgcctttggtcaagataaactactgactgatgatggcaacaaatggctttacaaaaacaaggaccatgggatgttaagtgctgctgcgtctcttggcatgattctgttgtgggatgtggatggtggcctcacccagattgacaagtatctgtactcctctgaggactacatcaagtcaggagctctccttgcctgtggtatcgtgaattctggagtccagaatgagtgtgatcctgccctggcactgctttcagactatgttctccataacagcaataccatgagacttggctccatctttgggctaggtttggcctatgctggctctaatcgggaagatgttctaacactgctgctacctgtaatgggagactccaagtccagtatggaggtagcaggtgtgacggctctagcttgtggaatgatagcagtgtggtcttgcaatggagatgtcacttccaccattcttcagaccatcatggagaattataagactgagctcaaggatacctgtgctcgttggcttcctcttggcctgggcctcaatcacttggggaaaggcgaagctattgaggccatcctggctgacttggaggtggtgtcagagccattccgcagttttgccaacaccctggtggatgtatgtgcctatgcaggctctgggaatgtgctgacggttcagcagctcctccacatctgtagtgagcactttgactccaaggaaaaggaagaagacaaaaacaagaaggtaaagaaggacaagggcaagaaggacgtccctgctgccatgggagcacatcagggagcagctgttctggggattgcacttactgctctgggggaagagattggtgcagagatggcattgcgaacttttggtcacttgctgagatatggggaacctacc

SEQ ID NO: 18737 - DNA, 1222 bp, Mus musculus
aacctaccttctgtattaagccatcttgataagagcttccttactaaatgacttaagaccaacttcacaggctcatgagtcgagtcgtttgcagtaagcgattccaccccttcttcgctgtaaggatgaaagagtcagaggtggaggaggaagggattaagggagccttcttcctgtgtttttctgcatctgcctcaaaaatgtctctttccagccctggcctcagagtttgtagcttccactgaccctaatttagtatcttatgaaagctttttatttctgtgaaagcaatttttttttaactttttaaagttctagcctctacagggctaacttaaaattttactaaacagtaattgtaataatgaatatatttgtgatctagagaatttctctcccaatagattacctgtgatggggaagataatttccacacattgagttaagtcccagctatttcttctattctaacgaaagccatgccgtttatctatacatactaagaagactgaagcctgtctactgtcatatgaccctgaacatgccccattttgtctgattttagaacagaggccggcctggctagtatttggatgggagactgcctgggaataccaggtgctataggcttaaaagccaggtggtggtggtgcacacctttaatctgaacacttgggaggcagagacaggagagtctctgacttgaaggccagcctggtctacagagtgagtttgaggacagctggggctacacagagaaagcctgtctgtcctaaagaagcaaaagaaagagagaaaagaaaatagaaaaccaatatgaccatctgttcctgagtcaaacacagggggaacaggcatatagtcctattcttacactaaacaatgggggggggggtaggagggggataagccaaaaccaattctgtggtaaagaaacccttgcttagagaagaccgttaactttctaaaaacactcagtatggacaacctactgcaagactttcttgaaaacctctcgtcattagtcccacaaagtctaagctattaagtactaaactctatacatactcagctagttgtctactaactctatacaaactaaactagatgtctacaaagtatacatacacagctagttgtcttcaaactccatacagattcagctagttgtctacaaactctatacagactcagctctatacagactcagctagttgactgt

SEQ ID NO: 18738 - DNA, 1144 bp, Mus musculus
ctacatgttccagtatgactccacccatggcaaattcaacggcacagtcaaggccgagaatgggaagcttgtcatcaacgggaagcccatcaccatcttccaggagcgagaccccactaacatcaaatggggtgaggccggtgctgagtatgtcgtagagtctactggtgtcttcaccaccatggagaaggccggggcccacttgaagggtggagccaaaagggtcatcatctccgccccttctgccgatgcccccatgtttgtgatgggtgtgaaccacgagaaatatgacaactcactcaagattgtcagcaatgcatcctgcaccaccaactgcttagcccccccgctggccaaggtcatccatgacaactttggcattgtggaagggctcatgaccatggtccatgccatcactgccacccagaagactgtggatggcccctctggaaagctgtggcgtgatggtcgtggggctgcccagaacatcatccctgcatccactggtgctgccaaggctgcgggcaaggtcatcccagagctgaacgggaagctcactggcatggccttccgtgttcctacccccaatgtgtccgtcgtggatctgacgtgccacctggagaaacctgccaagtatgatgacatcaagaaggtggtgaagcaggcatctgagggcccactgaagggcatcttgggctacactgaggaccaggttgtctcttgcgacttcaacagcaactcccactcttccacctttgccggggctggcattgctctcaatgacaactttgtcaagctcatttcctggtatgacaatgaatacggctacagcaacagggtggtggacctcatggcctacatggcctccaaggagtaagaaaccctggaccacccaccccagcaaggacactgagcaagagagaggccttatcccaactcggcccccaacactgagcatctccctcacagtttccatcccagacccccataataacaggagaggcctagggagccctccctactctcttgaataccatcaataaagttcgctgcacccccccaaaaaaaagaaaaactgtgtttgtagaaggcaaacaactctagtgtttcagtctgagaatgtactaaaaaaccatttactttc

SEQ ID NO: 18739 - DNA, 1175 bp, Mus musculus
aagggcaacactctgctgcctacttacactgcacttcttttcgctgctccgttgccctatccttcgtggatcacaatggaagaagaaatcactgcacttgtcattgacaatgactacggcatctttctccttggataagagttatgagctgcctgatggaggcacccagcacaatgaagattaagatcattgctccccctgagcacaagtactcagtctggattggcggctccatcctggcctcactgtccacttgccagcaaatgaggatcagcaagcaggacaacgatgagtcgggaaccctccatcatccactgcaaatgcttctagatggactaagcaggtgccaggcatctgctgtatgagttgattctgaagtatcgatttgccctggcaaatgtacacaactcatgttagcctcatgaacctggactaagcctttaaaaagaaatttgtccttgaagcttgtatctgatatcagcactggatcgtagaacttgttgctgatttttgaccttgtattcaagttaactgctcccttggtatatgtttaataccctgtgcatttcttgatttagtccttagttcatgtggcttggtcacttggtggctggggagagcacactgtggaagagaaatccccagcttggtggatctctgtgagctccacatagtgatctgtgcaaggtattaaccgacagcagatgtccaggtttcccgaggctggcaagggctcctgaaccagttaccactccttcttgctagtctaacagggagggaaagtccaagccttaggaccagtttccgttctggtttttccctcctgaccgccatgggttgttacttgccctgagtagagaacgtttgcatcgacacctgtatatgtatccatcctttcaatttatgtaaggtttttttttttgtactcaattcttttagaaatgacaaattttggttttctactgttcagtgagaaccttaggccccagcaacaagtcatagtgtaaagaaaaataaaagcgctgcaggaacttacaaaataaataaatagctagctagataaagtgagggcctaatgagatgcttccaatttaggaataattaaaattaagaacattaatgaattttcacatcagttctttttccaaaatcattgaattttaaacaatttcaat

SEQ ID NO: 18740 - DNA, 1339 bp, Mus musculus
tgacagaatttttgctatatcccagcaacagcggcagcagcgaggcaagtcgaagaaaagccgaaaggcgggtaagcattacaagtttgtggatgcggttcctgatattttcgcacagattgaagttaatgagaagaagattcgacagaaagctcaggttttagctcagagagaacagcccatagacgaagatgaagaaatgaaagaccttttggattttgctgatgtcacatatgagaagcataaaaacgagggttccgtgaaaggtggctttggacaggtgcggatggtgacaagtcacaacagagcaccttcactgtcagcctcctacaccagactcttcttgatcctcaacattgccatcttctttgtcatgctggcaatgcaactgacttatttccagagggctcagagcctccatggccaaaggtgtctttatgcggtcctcctaatagatagctgtgtcttactgtggttgtattcctcctgttcccagtctcagtgctaacgccaaggccatgagcctctcaggatcacgagaggtcaggaaatgtatgcatgtatttcctaattggttataatgtctcgtccagatttacttgagcaaatttaagagaagttgttttcacacacaaaaagtgggggtatggaaagccctgagctagacacacaaaggatgtacctagggtgtaagaatggctttggctgcccccttgtgtttctggaaatgtttggctttgctggctgaccagtatctattagaagagtcaaaaatacctggctttttctttcttttttttttttttttacatcagctttctgttactataaagaaaaaaaatgaattggactttattatcattaatttaattctgttagaagcttccagattctgtattatggaacatatggaggcacataattccaagcaatacaggctgttaaaatataaataatgggaactgtgattataagacctggaaacttcatgaaattacgtgataaaatgatagcagaagatcataaaggaactgaaattttttaaaatggaaaacatgtaagaatgaacatctgtttgatgctgtttgtcagtgcaggaatggtatttgtggcttttcgataaataatacaataacaggtaatttcatattctcttcctcttttatgtaaaatgtttatagacccaaagggtaaagtttttgaaataaactattttatatcttgaaactcaataccaaagaacatggaactaaagttttggtgtgattctgatgtttttaattagaaaagtttcttcaagtttattttgctaaataaaccaatcataattatgatctct

SEQ ID NO: 18741 - DNA, 1187 bp, Mus musculus
aagtccagctgggtgttcagatccagagcctaatacgggcttctctagagtaggaacctgttgactagaattgtgatgaaatgtttaaatctaagagccccagcaatctggatggcaactctgaagttgcctagtaaagaatatccaagtagaagttagtggcagaaattgttttcattttcagcccagtaacacgggttacacagggtgtttccatgaagtttccagtgctcggcctggtgtatgctgatctgagagtgttttgtgacatgccccagatattctgccctgccctgggtagcatctgtagattgtgtattgcaactatattaccatgtggcaccatagctctagtgagttctttttactttcatcaggaaaccatttaatttgtaaaaatttattcccttcaggtatgatgccagcttgaaaccagttccacctccagattttggtaccccaacattgcattattttgaggactggggtgttgtgacttatggaagtgcactacctgcagaaatcaacaggtcattcctttccttcaagtcaggaaaacttggagggcgtgcaatatatgacattgttcatagaaacaaatataaagactggatcaaagggtggagaaattttaatgcaggacatgagcaccctgaccaaaactctttcactttcgcccccaatggtgtgccgttcattactgaggccctgtatgggccaaagtacacctactttaacaacgttctaatgttttctccagctgtgtctaagagttgcttttctccctgggagggtcaggtcacagaagactgttcatcaaaatggtcaaagtataagcatgacctggcagccagctgtcaggggagagtgattgcagcagatgaaaaggatggggttgtttttatccgaggagaaggcgtaggagcatataaccccatgctcaacctgaagcacattcaacggaatctcatcctcctccacccacagcttctccttcttgtagaccagatccacctgggagaggagagcccgctggagacagcagcaagtttcttccacaatgtggatgtcccttttgaggagacagtagtagatggggtccatggggctctcatccggcagcgagacggtctctataaaatgtactggatggatgataccggttatagtgaaaaagcaaactttgc

SEQ ID NO: 18742 - DNA, 2274 bp, Mus musculus
agaatatcccaggcttctggatgactgccttccggaaccaccctcagttgtccgccatgattaggggtcgggatgcagagatgttaaggtacgtaaccagtctggaggtgaaggaactgagacaccctaagactggctgcaaattcaagttcttttttcgaagaaacccctacttcagaaacaagctgattgtcaaggaatatgaagtgagatcatctggtcgagtggtgtctctttccactccaatcatttggcggagagggcatgagccccagtccttcattcgcagaaaccaagatctcatttgcagcttcttcacctggttctcggaccacagccttccagaatctgacagaatcgctgagattatcaaagaggatctgtggccaaacccactgcaatactacctgtgtcgtgaaggaatccgtagaccccgacgtcgcccaataagggagccagtggagattcccaggccttttggcttccagtcaggttaatctttgcatttgaaaatgcggccggaactggtcccttctcacctgtgcttgagcaaatgcaacgggtatgcagtgttttgatttctttcctcctgacttttctgcatcttctatctggatagtctccacctcgagattaagactggacatgcttctgctttcccatggccttcatgctgttctgaattagtatctgctggttcacggccctggcttataccctttctaagctcaacaatgaaactgtatgttacactgcctttacactgtttggaccctattgttttcagtcttacctgtttactgccacctagatgtcttgctttaactgggggcccttctatttatctgttcatcatgtggcaacgtggacacagagtttttggacagttgctgagcctaaacattgaaggagtgggccactgtctgtgtgattttttttttttttttttttggcaccactttctaggttatatcacactccattgtgtttgccagtgctcctcaccctcactctcccacctttctcctgctattttaaagaaaagtagttcagaaacatctgtaaggccaggagtcatttatacttagcatttcctgagaagatactctgtaaaagaggaaacaactctgccttgtctcctctcttacccactccccagcctggttagcaagctctaaaaagcttccagggagacagctagatggaaacagctgagcccttcctaatatatggaagaactaaagaagttttgatgggtactctaagcagaaaaagtgagctgaaaaggcttagaatcaaaataagtcagataaaaattgggctgagaatgaagacaggacacagcttacacatcttggtcagtcagtggtgatgggaagagaactaatttctcaggaaaaaatattttctctgagtgttgaatgttgcctagatagtgcttctttaaagaagcagtgcaagtttgagttattttcctctctttatatgtgatctgatataagtgaaagtataatattttgcccatcttttaccaatatttagtaaaatgctacttgtttcaacttactgaaaaaatttaaacacttttgtttgcatttatttgaaaccatttggaatattgtaagacaactcactctgtagaccaggctggtcttgaactcagaaatccgcctgcctttgcctcccaagtgctgggatcaaaggcgtgcgccaccactgcctggctaacagtagtctttataatactgagactgaatattcgtaacagttttcgatattactccaaattcttagaaacggcttggataattggtcttaatcaaatgtgtcaaattattgttttcatggaaaagtaaatatgtgacttgattgtcttgatatagttataaaagtactttgtcagcactgtatatttgttgccatttttatgcatgatggtaaataaaagcatggcatcctgttagatggcttttttttttttttaatccccaacctggccgtaaacttgccttaatgggtttgtataattgacaagattgttgaattattcaattccttaaacgtacacaattgacatcccagaggtaccaagagtagttgtttctcctgcttgaagagtagttgttactgtcattgttttgttgctgtagaaggttgacagttacaactgcttactgagattgcagatcttcccacacaacttgtgcagtatcaccataccttcacttcttcaggttcacaatttctgtctccacatatgatatttttcatgtg

SEQ ID NO: 18743 - DNA, 1151 bp, Mus musculus
gttgattttctgtggttgttggttgttcgctagtctcacggtgatggaagctgcacattttttcgaagggacggagaaactgctggaggtctggttttccagacagcagtccgacgcaagccagggatctggggatcttcgtaccatcccaagatctgaatgggatgtccttttgaaggatgtgcagtgctcaatcataagtgtgacaaagactgacaagcaggaagcttatgtactcagtgagagtagcatgtttgtctccaagagacgtttcattttgaagacatgtggtaccaccctcttactgaaagcactggttcccctgttgaagcttgctagggattacagtgggtttgactcaattcaaagcttcttttattctcgtaagaatttcatgaagccttctcaccaagggtacccacaccggaatttccaggaagaaatcgagtttcttaatgcaattttcccaaatggagcagcatattgtatgggacgcatgaattctgactgctggtacttgtatactttggatttcccagagagccgagtaatcagtcagccagatcaaacactggaaattctgatgagtgagcttgacccagcagttatggaccagttctacatgaaagatggtgttactgcaaaggatgtcactcgtgagagtggaattcgtgacctgataccaggttctgtcattgatgccacactgttcaatccttgtggctactcgatgaatggaatgaaatcggatggaacatattggactattcacatcactccagaaccagaattttcttatgttagctttgaaacaaacctaagtcagacctcctatgaccacctgatcaggaaagttgtggaagtcttcaagccaggaaaatttgtgaccaccttgtttgttaatcagagttctaaatgtcgcacagtgctttcttcgccccagaagattgacggctttaaacgtcttgattgccagagtgctatgttcaacgattacaattttgtttttaccagttttgctaagaaacagcaacaacagcagagttgattaggaaaaatgaagaagaaaaaacgcaaaaagagaagacacacaggaggtggtggctgctttctagatgctgatcctgagggccatgctgaccatgaccacc

SEQ ID NO: 18744 - DNA, 1177 bp, Mus musculus
acaaatggcataaggcaggccaagaggctgggtctagatatttctagtttagataataattaatgtggttcctatccttaatagtaaaatttaagataagatttaaagcaatgcctctttattaaagtattaaagcttgctttaatagctattcataggtattaattggcaaccaaactttgaaatatgatggtaatgcttctaatattgattttaaagatgataaattgttttaaacttgggttttgctttccaaaagttatagatatattctaatattgcaacgaaaacttaaaaattatggttaaaattgccagtgttccattgactgcagcttgcagtttgatttcaaatttaagatctttaattcacctgtatattgtaattaagataattacaagagtaatcatcttttgaaagcgctaatacagctcacttcatacaaaactgtgacaaagttatctagttatgtttgtctttgtgcatagattagaccctcaaacaatcagtttggctatagttgcagcctggcaggaaactgcagtatgggcaattttttcacaacactaaagttgtgaagagcgttttaactgtaagtcatcttaagaaagagtatcaaaagttagaggcgtagcctgttatattgttcctctagaattggtccttattgcaggagggccaagatgctcagattaaaaggtattttacgtttgagtcaatgcatggctctgggcagccccagagcagcttgtggcctttctttggttttgcaaacagtgcctgagaaagtttttctctgtgttcaagagaatttctttttaacagtgttgcagatctattcagatgtttagaataatgcttaaattcaaagagttttgcttctagtgaactggtaattactagaaaattttgcctctaggtatggctaatacagctttaccttatgtaagaaaaatttttattgtttctgcttctatacaagaagccaagagttctaatctttcagtgtatatttttcctaagtgaaaagtattttattaactaatgcttctcaaaggaagtttaccttaaatccttgctctcacccaaaggattcagagacaatatacttttattacttagggtattagtttactacaaaaggttttacaaaaaataaagaaagcttttataattg

SEQ ID NO: 18745 - DNA, 1173 bp, Mus musculus
aagcttggttttgtttttgttttttagtcaaagtgttagcatcttttattcaaatgaaaagataatcctttatatattaactcttactagtttactttctgcttattttccatctcataactggatatttttactttactggaccctaaactgaattctttttattttttaccattgctttattaaatgcaaaatagtctacctgttgtgctcttttcttgagtagagtgcagggtggagttcagggtaaagttgaaccactctggtggcacctcaatattacatcgtattaaaaaaagagataacagcattagcctttcaataatgttcctctaattgaaataatagatcaaaattaatggatacttttctttctaaatatcctccctgataataaaaccaagtaacacttgaaagaataaacttgaccctgagtttcttgaggttttggaagattaaagtcaaacctggtaaccaaaggactgagtggtgggtcgttcccgctttaaccaacttgtttgagaacccctagttggccagatatggtgcctggtatgtagtaggacttaactgaaatgggttttaaaaaaataactcctgaactgagtagttaaaaatactgtgtagaaaagtattctatattgctaggtttgttcttttaacagctgagatttattaagatgcattattttgattttaatcactgcctaaaacactttgggtggtattgatggagcggtggattttcctccaagtggctaaatgcaatttgacatacttttcatccaaagttttgtacatcctgttgttttctaatggaaaaaaaaatgttaatatggcttttttgtactactaaaaatagctttgagattaaggaaaataaataactcttgtacagttgagaatcgtgttattaagtctgtattggcagtgtgtgcagtggcctttgctgtggttatgaacactctggattataagaatcatttggtccaattcctattgcttgtaaataaagttttaccagttgatataatcaagcctactaaagtagggtgtttttacagattttatgttttaattcaagttttaggggaaataactgtttcaaggtgtttctataactcaatttaggatttagaggacacatgcttgatactgtacttagaatgtgag

SEQ ID NO: 18746 - DNA, 1877 bp, Mus musculus
ggcggcgggggagaaggcggaggagcccgcgcccggcgccaccgcgggcgatgcgtcctccgccgcagggcctgagcaggaggcgcccgctgccaccgacgaggccgcggcgtccgcagcccccgccgcgtcgccggagccgcagcccgagtgcagtccggaggcgccccccgcgccaacggccgagtaagctccagagccctcacgcaattcaagaacttttccccccagtttgtttgttggagtggtgccaggtactggttttggagaacttgtctacaaccagggattgattttaaagatttttttttaaatttcacattttttttaagcagcaaattttttgttttttgttttttttaagcccccttccccacagatcccatctcagatagttgtttccaccattccgacaggccgaggacgtgttagacagcttcctctgccttctttctttacttttactttttttttttttttttggcatcagtattaatgttttttgcatactttgcatctttattaaaaaagtgtaaactttctttgtcagatctatagacatacccatatatgaaggagatgggtgggtcaaaaggaataacaaatgaagtgataggggccactatgggaaattgaagcagtgcataacattgccaagataatatgccactaaaatggtggtgggtgtaaaggcttagggttcttgtcctttctttctttctttctttctttctttctttctttctttctttttttttttaaagaaaaattattacgatgtattttgtgaggcaggtttacaacactacacgttttgaataagaaggaaagagaaaaaaataaaaacaccaatacccagatttaaaaaaaaaaaaaaagatcatagtcttaggagttcatgtaaaccataggaacttcctgcttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccttcagaagcacatgaagtttgcaagtctccaccctgcccatttttgtaaaactgcagtcatcttggaccttttaaacacaaaattttaaactcaaccaagctgtgatacgtggaatggttactgtttatactgtggtatgttttttgattacagcagacaatgctttcctttccagttgtctttgagaataaaggagaaacagatcttcagatgcaatggttttgtgtagcatctcgtctctcgtgttttgtaaatactggaggagctttgaccaatttgacatagagctggaatgtaacgttgcttacaagcattgctattcaactcctgcttaaggtgttctaattttctgtgagcacactaaaagcaaaaaaataaatgtgaataaaatgtacaaatttgttgtgtttttttatgttctgaggctgacttctaggtcttagattaattttttaggaaggccttgcatgccatcaaaagtacatttggctgtggtttttgataagaagttttcaagctcagaaattcataatcagtgtcaaattaagtatgtaggaagatcttatactgtgtcagttgttaccatttacctgcttttagttatagcatgcgagaataagtcctttaagacaaaagtggcttgaccctaagactttcaaatgtcttatgagactatttcataaactgtttccttgtcattgcaggtccagaaagttacattttataatcaggaagaatgtggagttcagactgcacataagtcatgaaaagatggccaaacctgtttaaatgt

SEQ ID NO: 18747 - DNA, 1300 bp, Mus musculus
gttaaataaagattatagagttcattgtactgaatgttaacagatcagtctaaaagtaaaaatagagtcactcacgttaaagttccatagcaccatgctgacactaagtcattttgctgaacttccgaaggcttttcaaggtgtattgtccagaaggattctactgggaaggaagaattcgttctcctgccccaacttacaagaccagctgtggctgatgttgttgaattctaggaaccagaaagagagggatggaggtaaggctttttttttctccttgattctttttcccaaagtctatcttgtgagtccttctagcaaactcccaataaaaggcttgtccttgacattgaacctctcctttgtgatgtaagctgactatactaacacaagaaggcattccttggggcgtgattccgtcctgtgcggctgttctgtggaacaggaggcagttgttttccgtccggcttcccccacaccgaagtgcgcgcctccacctcatggaagactcgatggatatgtacatgagtcctcttaggcctcagaactaccttttcggctgtgaactaaaggctgacaaagactatcactttaaagtggataatgatgaaaatgagcaccagttgtcgttaagaacggtcagtttaggagcaggggcaaaagatgagttacacatcgtagaggcagaagcaatgaactatgaaggcagtccaattaaagtcacactggcaactttgaaaatgtctgtacaaccaacagtttcccttgggggctttgaaattacacctcctgtggtcttacggttgaagtgtagttcagggcctgtgcacattagtggacagcatctagtagctgtagaggaagatgcagagtctgaagatgaagatgaggaggacgtaaaactcttaggcatgtctggaaagcgatctgctcctggaggtggtaacaaggttccacagaaaaaaagtaaaacttgatgaagatgatgaggacgatgatgaggatgatgaagaagaagaagaagatgattttgaagaagaggaaactgaagaaaaggtaccagtgaagaaatctgtacgagataccccagccaaaaatgcacaaaaatcaaacctaaatggaaaagacttaaaaccgtcaacaccaagatcaaagggtcaagagtccttcaaaaaacaggaaaagactactaaaacaccaaaaggacctagttctgtagaagacattaaggcaaaaaaatgcaagcaagtacagaaaaagcacatggaacattcctgggcactactggtaaattaagccc

SEQ ID NO: 18748 - DNA, 1754 bp, Mus musculus
gaaaggttgtcatctgtgccggctggaactcactgctcacgtgggaagaatgttagtgcctccagctcagcagtggctgaggacaagaagagggaatgtcacttgcccacctgtcagtatgcttacctcatgtatgattgtaggggaaaatgcccgtaggcagcttattttaaatatttatgaattttagtgaattcttgtgttgtcttaaccatattttagccagatccacatgctaattattaaatatttctcacatataaaatatgattctgaatatatggacagtaaatggcatccgatttatatggtatccataggttatcattgtaatttttcatcccattatttcatacacattgtatcatgaataatcatgaattcatttaatattctcaggttttctcattactgccaaagtgtgaattcctgcataagaaaaatctcagatcccagcaacaacaacttgggaagtttgtactaattactatatttgttgacattctttctttacagttctttattgttggaaggtgttgaacccctgagtacatgtgaactagaagtggatgccgtagctgctgacatcttaaataggctggacattgagggtatgcgcatgattattcctgatatgcattgttactcacaaaatgtaatgagaaagcagagcagaggtgttaccagagaagtgagatacggaaggagaaggcaaggtttacctgcgggttatataccatggacagaagtttagactcatttctcatcagtgtttgaattttacttagtttgtgtgtgtgtgtgtgtgtgtgtgtgtgtgtgtgtgtgtgttggtggtggggggtagggatgggttccatccaaaaaattaaaatggacgcaccatgataaacttggaatagagataatttgctcattatagcacacaccacatttttctaaaataatatcataaggcatgatagtacatgcctttaatcccagcactgagacgacagaggcaggcagatctctgttgggtcccaggccagcctgggttacatgatgagttccaggccagtcagggatgcactgcaaactagcccccactttacttattaaagtttaagagtttatagagaagagtgtttcactttgacccttgtagtattgttgtgattgtagctcagattggtggaaaccctgggctgcaggccatatgggaagatgaaaaacagcggagaagaaacaggaacgaaagctctcaaatcagccagcccgagtcacaaggtaaaggcccaacaatgctctgatgcttctaatgggaaaatagtgctctcagcactaaatgttgtgtcttaattacccctaatttttctatgtaaatctcctgtggtcattgctgtacaaccagtaaatctttataattatctacaaaatatcactttattatagtcatccctctgtctctgtgttcttgttttatgtgccgtatcttcttgacacagttagttgtttcctttccatcctcaaatatattcttgtcttctttttccgaataaggtactgaaaccatgaatccctgctcagaaacacctttttatttgttctactttgaaaatgttggccatgaaacattgtcttcactgttctctgaaactgtcatataaacgcaccttgatcatcatgtgaaactgagggaaatagtccttcgtaattaaatgttataatctgaaagaatttgaaggctcacacactgtagatgcagcaaaatt

SEQ ID NO: 18749 - DNA, 1122 bp, Mus musculus
acgagcaagctatcagtaagaccctccatctttcacaaagatgctgctacattagaacctccgtcttctgctaagattacctttcagtgtaaacacacaagtgccctttcttcccatgttttaaacaaagatggtttaactgaagacctttcacaaccaaacagtacagaaaaaggtcgagataattcagtcacttttacaaaggaaagtacttactccatgaagtactctggctctttaagtagtactgttcattcagataattcccacaaagagatttgtaagaaagacaagtctttgccggtatcttcctgtgaaagtagtgtttttgattatgaagaagatattccatctgttacaagacaagtaccaagtagaaagtactcgaacatgagaaagattgaaaaggatgcctcttgcatacatgtgaaccgtcacattagtgagactatattggggaaaaactctttcaactttgctgacttaaatcattcaaaacgtaaattatcctctgaaggaaacgaaaagggaaacagcacatctctcagtggtgtatttccctcttcgctaacggaaaactgtgacttgctgccgtcttcgggggagaacagaagtatggcccattctcttgagagcatcactgatgagagtggactaaacaaacttaaaatcagatacgaagaattccaagagcataagatggaaaagccaagtctcagccagcaagcagcacattatatgtttttccccagtgttgttctttctaattgtctcactaggccacagaaactttctcctgtcacatacaaattacaatctggcaataaaccttccaggttaaaattgaataaaaagaaattaataggtcttcaggaaacttctaccaaaagtactgaaactggagccacaaaagacagctgtacacataacgatctgtacactggtgcttccgaaaaggagaatggattgagtagtgactcagctaaagctactcatgggacctttgaaaataaaccacctacagaacattttatagactgtcactttggagatgggtcgttagaagctgagcagtcttttggactatatggaaataaatatactctgagagccaaacgcaag

SEQ ID NO: 18750 - DNA, 1340 bp, Mus musculus
ttggccatccagctaatcaaattaatgaacgtatggtttagtttgagttgctatctcaaaatataaggtggggaacaactaagaaaggatgtcaccctctggcctccacatacgctaactcggccatataaaaacatactccaaacacacacagagactaataatagtgataaggattctgatgagttagtgtcatgggatgctaaaataaaaataaaagtaaaaccttttttcttttgaattggtgctgccttctaaaagaaattaattttgtagttaaatagaaaagcatattactagctgcagatagagtattttgtctgcaattggggtgaatggggaaaaagaaattgttatatttgagacaccaaagaggaccctaagtctgttagataggaacttattttgggtaattatttattgaaacagaaacatttattctaaaaatgtatttatagggaaattggtggccggctcctaatggtggaaactcgacttccaaacgacctgattgaatttgaaggagacttttccttggaaggacttcgcctgtggaaaacagcattctcagcaatgactcagaatcccagaccagggtccccacttcgtaatggccaagcagttgtcaataaagagtcaagtaatagccataagatggtagaagataaaaaaattgtaattatgccttgcaagtatgctccaagtcggcaactggttcaagcatggcttcaagccaaagaagaatatgaacgttcaaagaaactccctaaaaccgagttaactccagtgacaaaatctgctgaaaatgtcagcccttcacttaatccaggtgacacatgtgcagtctctccacaagtggataaatgcccacatacactttcttcttctgcacataccaaggaagaagtcagtaagtctcaaattgctttgcaaacatcaactacaggatgcagtcagacactgctagcagctgcctctgcagctgtccctgaggaagatgaagatgataatgataactgttatgttagttacagctcccctgattctccaggtattccaccttggcagcaggcagcatccccagacttcagatcattaaacggggatgacagacattcatcaccaggaaaggagctttgctccctagctgttgagaacttcttaaagccaataaaagatggtatccaaaaaagctcctgctctgaatcgtgggagcctcaagtgatctctccaatccatgctagggcaagaactgggaagtgggatccactttgccttcatagcacaccagttatgcagaggaaattcctggaaaagcttcctgaagcaactggccttag

SEQ ID NO: 18751 - DNA, 1233 bp, Mus musculus
actagattgatggtgaagcagtcaatgaagtcttacaagcaggacagagccctgtcacggatgctcaatgcccgtcaactaggactaaagctgatagcaaatgtcacgtttggctatacggctgctaatttttctgggagaatgccgtgcattgaggtaacacatttaataagagagtagttactgaagtattttgctttgttactaaactttaaaatgtcatttccatgacatactagtttttcttaaattggatctataaacatgcatcttttcttatttcaataataatttttaaattatatgcatatttccacatttactaacataaggtttcagtgccagtttataatagtatttacagtaattttgatactaaataattccttttaattttgttgttgttttgttttgatttttcaagacagaatttctctgggtagccctggctaccgtcgatctgtagaccaggctggcctagaactcagaaacctgccttcctctccctcccgagtgctgggattaaaggtgtgcagcaccatgactgactccttttaatttggtagttaggtccaaatattacattaaagaaaaaacaccccatggactggagagatagttagttcactcagtaaagtgcctactgtataaacatgagggacccacacgaaatgtcagaaacagcaacttgttacgtgtatccaagtgttgagtgggtggtggcaggaggatccctggcgctcactggctcttactgactagtctgtttaactgcataaactctgggttccatggaagaccttgtctcaaaaaggtgggaaataagtgactaagacatctaatgtcaacccctgaccactgcacacacatgtcttgtgcacagctcacaagaggcaaagtgaatctcacacctgctcaagagctgacattagagttcatcaggtcagctgcttaatgaagcaagcctgctgacttcagttcagtccctaggacccacaaaaatgtggaaggagaaaagtgggttccatggagttatcttctgccttcctgtgtatgctacagtcacacacgcacacacatttgtgtgtgtgtgtgtacgtgtgtgcgcacgcgcgcagtcacgtaccaacataaggctagagagatggttcactgggagaaggggagagaagcgggatgggaacatggctcagtcagggcttgggggcactgtgcacactagagagcttgagc

SEQ ID NO: 18752 - DNA, 1177 bp, Mus musculus
taatcctccgtgcatagccagtataatcctccgtgcatagccagtatagcccagaggtcgcctgcagcacagtaggagaaagacatcgagttagaactgcagtgttttctttacgtccccaccctaacctcatgaaaatcaaaatgttcccctgtgctttgtaagatttctccttctgagcttttcttaggaaactaaatgcaatcaagctgatgtgtctgattacatttgtttcttccatagcagaatcactcacagtccttaaatttgaaatgacaaagcatttagatgtcattctgcagtcagattgtttagataatttctctcttctttcactgttttatatataataacactaaggactcatccctaaaccaggtaacagtgctatagagcataagtctcaaactgttacagcactgtctacttgatatcagctgagcaaagtgtacataattctcaaagaatcaacaatctaatttgaaggattgctcttggtttcaggcttaattctgaatagtttgttggcaagatgccttctctgacagtctatgtacttaatttggatttgaacaggaaaatgcttgcttatgatcggcgctctgagcctcgagttggagaacgagtgccatatgtcatcatttatgggacccctggactaccccttatccagttgataaggcgcccagcagaagtcttacaggatcccactctgaggctgaatgccacttactatatcaccaaacaaattcttccacccctggccagaatcttctctcttattggtattgatgtcttcagctggtatcaagaattaccaagggtaagtttactaaataacatatgtcctgtaaatagttcacttcagaattcagtgtaactggattttatgtgtgcagtgagaacttagcctccattattgaaacttgcacggacgtcgtgctcgccaggcttcctggaggagagattataaatatctgtgtgtactgtctcagcttctagcaagttccaaaccacagaaacattcaatgaatccccaagagtttcagtgctgattggccatttattgataactcaataaatcagctactgaaaaaaaagtgaattacaaaattacttcaaaatgggaaggtttttttttttaagattttatgagtgtttttgtttatgtgggtgt

SEQ ID NO: 18753 - DNA, 1695 bp, Mus musculus
tttcagtgtaacgaggtagcattgtaaatgaaagtgaaccaagaaataaaatgaatcttgagaccgttttgtactttccatgaaatatggctaggcttctgagataggaaacagacagaattctctgtactgagttaagtttgccagttaactgaggtagcagaaaagaaggaatctaaaaacctgttatttacataggtgtgtgtgtgtgtgtgtgtgtgtgtgtgtgtgtgtatgtatatacacacagaagcattcctattctgttttctttcatcttcagatatgcaggaactgtacaggttcctttgaccgacatatcccgtgtgtttccctcaactgcccggtacttttcaaactctcacgagtaaacagagaattatccaaggccccgtacctgcgacagttactggaccagttttaagttagcagtgtcacagaattccaggtgctctctgctcagtgtttaccactcagttcctctgcatggtgctttctcaacctccatcaagtcaaagatgttcactgtctgtctgccatccaagactatgaagatttctgctaacgggattaaaaaggatacatgctgctctctggatagcttacttcttacaatgtacaaattccgcatcatttcacctttgaacattgttttataataatacaggtgttggatttgctccagtttatgtaccatcttgtaaatccatttgaacagatcatgtttacttccctgtggaaggaacactgaaaacctcttaaagtcattcgtgtgtattccttaaactgtctgtatcaggatgtgttgcttagagatatccactcactttataattttgactgcaaaatattttgtaaatacacttttttacttttcaaataactgagtaaaataatgtgcaatgaattttatacaatgattttcacgttgttggtatatctcctctaggttttgcttgactcaaaggtagatttgttactttgatcaaactgtgcaaatagtaccatgtgtagcatttttgaaacattcttttctaaagaccgctgtcttgctatagctactaacggggcattgtgaggaactgtgcaaagacatttttgttacaaacctgtgggcctgttgcaatactttaaaaataaaataaaaaaatttattccattttgcttgttttgtatagacatttctattgcttctaaatatgcttaaaatattttctttccttatgtactgtacagttaatcttatttgccatcccttgaacacaaatgtgtatttaggatatttgtataactgtataaaatgaaaaaggaattatgtggtcagtgcattgttttttaaactggaaatccttttgttttgagagttaataatggaaaccaaattaaaaattgaataaaatatgaaatacagtgctatgacttttatcttaacataagcagaattctcttcatcggttctataagcaacacgggttccatctaaccctagactttcctaaattctaatgaggtaaatttggggcctagagatgtagctcaattggtagagtacttgcctagcatagaggaggccctgggttccatcctcagcaccacataaacacagcacagtaagcatgcgcttaggaggtggaggcaggacggcctggagttcaaggtcatttacatggtagatctgaggccagctgggctaca

SEQ ID NO: 18754 - DNA, 1154 bp, Mus musculus
gggacggctcagcaagtaaaggtgtctgttgccaggcctgatgacctagagttcaattcccagaacccacgtgtggaaggaggggactgactctcgagagctgtcctctgacttccttacctgtgccctggcaccatccctccttcaaatagacaacacatgccaaagtggtaagagaacagacatggagccagtgggcgactgctattctgaaaggaattcgggttgtggagggttgcgtcacagattttttttcccagacagaagctttcaaactgcttggtctgtcagtgagaactcctttctccatagtgggctgtcaagggaggaatcctgactttcaaagcagcttggtgttcagtgaagctgccagggtacaaggagatccatcctcttagtgcagccctttgaagcatggttgggatgagggctcctgtccttaccacgcttggctcagctcagctcagctcagctcagctcagctcagctcagctcagctcagctctcagctccagcttcctgcttccccagggaactggtggcttctgtttcaggcaggtccaggtagatggagtttactctcccttggcagttttcaccctgggagagatacgaagcataatcactgggtactgctgctggtatttactctccgtttcctccattgctaagaaccatcccatttggatgtgcatgtcaccccacctgtcagtataatgtctttacacttgtcttggatgctgcattattaattttcattgtagaaagatcatcttgctctcagagccaagtgtgatctggatcttatcacgtcctgttcgtgtttttattctcagtgtatgtgtgttacccattctgcccacttgtcatcatcctgtcaaactgacggctggctaccttgtccaattggaactttgcttatgaggtcttgcttctttctctcctgccctctctgtcaagaacagttctcccatttgtaactgtgcgtggtaatcctcccagcaaggctccttccacacctggaagaagcctagcgtcgtgtaaaagaatcctttccctaccaacctctcattgctttccggatcaattatttatttccttgtgtagtttgcatccactgaagtatgtgttaccatagccctagacttgctccc

SEQ ID NO: 18755 - DNA, 1170 bp, Mus musculus
cagggaagtgagaggctcccgggacccagtggggatgactttagccaaactccccaacaaaggggagacagaacctgtagagactacctccaatggataggcatgacccccagttgagggatggggtcacccatccatcttaaagtttttaacacagaattattcccatccaaaggaaagacaaggacaaaaaaacggaacagagactgaaaggccatccagagaccgccctacctagggattcatcccatctgcagataccaaactcagacactattgctgatgccaagaagtgcttgctgacaggagcctggtgtggctgttccctgagaagttctaccagcacctgaccaatacagatgcagatactcacaggcaaccttcagaatgagcccaggaaccaaaatggaagagctaggtgaaggactgaaggagctgaaggggattgcaaccccatatgaagaacaatatcaactaactggaccacccagagctcccagggactagatgaccaaccaaggagtgtacagggagggatccatggctccagatacagaggcagcagaggatggccttgtctgacatcaatgggaggggaagcccttggtcctgtggaggtttgatgccccagtgtaggggaatgctaggacagtggggcaggagtgagtgagtgggtggtggagcaccctcatagaggcaaaggggagggggggaagggggaatggaatagggggagtttgtggaagggaaaccaggaagagggatatcatctgaaatgtaaataaaatgagtagtaataaaaaatgagtctagaaatacataatttctcaactatgcaaaaaatgatgcaatatgaataatatgagggccttcgcaaatctaaagaatgagccagtttatcagaaaactacaaaggcggacagatacaaaggcaggttgatttctgagttcaagaacctgggacacagccagtccaggcccagatgtggtagacatgatgatttcaggactgagtccacccagccagttgaccatctgtgcctaacagaggcaggcaggtctgtgaattctttttcaatgttaaaaggaaatgtgtgtgcatgttgtctcctaagagtcaagaggctgaggcacggatcctgattcctaggataatcaaaaagaaacctg

SEQ ID NO: 18756 - DNA, 1175 bp, Mus musculus
agctgtcttcagacactccagaagagggagtcaggtcttgttacggatggttgtgagccaccatgtggttgctgggatttgaactccagaccttcggaagagcagtcgggtgctcttacccactgagccatctcaccagcccaagacgacctttttctacagattattccagacatactgcttgttttgccttttgttctttattttgtgttcttgtggttcattatcagctcaagctgtagctcaggctagctctgaactcacaatcctcatgcctccatagtgctgggattatagccatacaccactatgcctagcttcagatatacaatgtatatagtaaatactggggactgaagagatggctcagtagttagggaacatggctgtttttttcccagagaaccagagttcagttcccagtccccatgttgggtgactcacagttgcctgtgacactgtctccagaggatctggcatcagagggcacattctcacatacagacaggcatacacattaatgaaaaattcttttaaaatgtgtaatattaaaattaaatagcttagactgggcatggtaggacatacctttaatctcagcatttgaaaggtagggctggtggatttgaggccaagcctggtctacatagtggtttccaggccagccagcattatggtgagaccctgtctcaaaaccctaatagcgaaaataaataaacaccttgggctgctgctcagtgggaaagctgcttggtgccaagcctgacaacaggagttcaatccctggggcctgcacagtggaaggactcttacaacctctacacatgtgctgtggcactcctatacacatacaaacacataaataaatgtaattacaaaacaaaacatcaaactaggggctggagagatgtggctcagcgattaagagcactgacttctcttccagaggtcccgagttcaattcccagcaacagcatggtggtttacaaccatctgtaatgggatccaatgccctcttctggcctggggatgtatatgcagcagagcactcattaaaaaaaatagaattagggggctggagagatggtttagaggttaagaggactgactgctcttctaaaggtcctgagttcaaatcccagtaaccacatggtggctcacaaccatccgtaatg

SEQ ID NO: 18757 - DNA, 1773 bp, Mus musculus
tgcaagcagccatgtacaactaaatactgagagatactaagcatcccagctcgatagagagtaataatagctgtgaaaataaaatgtaattctttatttttatttcattattttttgtgtgtatgtgtataggtgtttcacctacattatggtttgtgcaacacacattcaaacaaaaatagctgggtgtgatggcacaagcaattgtgatgtcccagcatttgggcagatggatggatgaatctctgcgtttgaggacagactggtttacatagtgaattgcagaccaaccagccaaggctttgtagtgaggtgctgttaagaaataaaaaaaggtggaggagatcatgagatttgcatatgatgccagcatctatgatgaaatttctctgattccccccaaagggatgtggcccagttagcagaagccctgacgctggaagccctgactccatctctagctccacacaaacgttgcggtggtgcttacctgttttctcagaactccagaggtggaagggggaggggaggagaagaagccatcacaaccatgtggttgtgagccaccatgtggttgctgagcattgaactcaggagctctggaagagcagtcagtgctcttaaccgctgaaccaagcctgaaagggcttatttttaggtcccaatttcaggttatagtccatcttagcaaagaacaaagagtaatgctgaacaattggaaggaccatcccggagctacatcgcatacgcgtatgtaaacgttttcaccttttaaaagtttcctctgctgttaaaggcacgtctgtggaaacgtttgggaaatactgaaatattaggggtcttgtttttggggtttgttttgtatttttgttttgtaaatgatgcttggtaacttggcggggaaggtgaaggactgtcttgtcaagtactccggagactgaggcaggaggatccaaaattcaaggtcagccaggtgatttagttagactcagtctcaacataaaagtaaaatgaggagataaatctccctggagggtattagcatttgtgaagacctgggttcagtccccagcaccaacaaataagcaaggaggtgaagcttggagtatcatgtgacctttgtagccacagaagtacaccaggggtcagcagccttgtgttgtggagtgggatctggaggactgggcttctaattggatgcagaggagcagatgagggggaaaaaaaaatccagattattggtatgtgagggtgtggtagtgtatgcctctaatcccggctcagggtactgaggcagagatatcacaaaaaggttaggctaggaaacttatccgaagcctgtctgtaaaataaaatacatgtattaacttcttgtttgtttgtttgtttgtttttgttttttttttttccagacagggtttctctgtgtagccctggctgtcctggaacttactctgtaggccaggctggcctcgaactcagagatctacctgcctctgcctcccgagtgctggaattaaaggcgtgtgccaccactgcccggtaacatttttaatttcatgtattatcagtgtgtatgtgcacatgcacatgtaatacatatgtttgggtaccaacctgaaacaattcacatgtgggtgtcagaagacagctttgtgtagcagtttctctcttgccaaaaggtcagttggcctgacagtgcacgactttaataccagatctccagagacagaagcagacagatctctgagttccaggatagccaggtctaca

SEQ ID NO: 18758 - DNA, 1459 bp, Mus musculus
gttactcaaaaccaatttctacttcatacaggtgttttatgcaatggcaattaaagtttttcttccacaagttgagtctttgtaagaaaatgactccagttgcttgttttatgttctgctgttttaataattgctcctgcatttagagtcctatagtttttccaccacctttgatgaagcaatacactgttacactgtgggcttatattataattttacaccccaggtgagagtttggagatggtcccttgcttaattttttttcctaagacataagaatgtggtctctttattggcatgaacttctgtggaagataaatgacaaaactgaatgtatcaaatgaaaagaactcacagtctccagggcgatgagcaaggagaacccattaaagaaaactccatggaaatgataggctgtgcagtgcaccttaattagcgttaatggagtgcctactatgccctcactaatttactaagtgataggaatgtccactatgtcaaagcagaaatgtagtcctagcattctgacctcagtaagtgctgccgttgccaccaggttttatttactaaaggagattttgattcgaaggagaatctggtttctacttgtcctaccgtcagctggtctctggtcttcctttcaccgtggccttcagatgatcagatgaatgactgaccagagggaggaggcctctccaggttactcagccagatagtgaatgtatgaatggatggaacggcgcaatattctgaatctatttaatggcactagaaataatgggcgttgaagagtcggcatgttggtgggacttaaacagaaaagagcaaactggactaaactccctatttattgcccttctgttttcttggtagtttctggactgatgcagtgatgttttgttccttccgtatttataacgaaacacttttttagcgtttctaaacagagtctacttggtttgagatcaagtggttggaacactgtctggactctttctacacggtgttgattgaaggcttctttggggaagctttcggtcagctttatctgtctgattctgtaatgagcacagcacctattttgaattgctatttggagggccagtgcttatttaagctggattttgtaacccagtagattttggcttgaggtctgatttccccgtcttaaattaagaatcctaatgttgagaattgcataggtttgtgtggaacaaagcctagaacaactgtaggtaaactagtgatctagtctaattacaggtggggaagttttggtgccataatttctctttgttggtgttggacttttaatcagctgaaatgtatttctgtaccacaatgtaagcttcaataaaagtttgcttaattgtctagtaacattgagaaagttttctgtttggtgtctacttaactaaaacccagagaatttaaaacatttgaaggtagaagtgacaac

SEQ ID NO: 18759 - DNA, 1459 bp, Mus musculus; identical to SEQ ID NO: 18758

SEQ ID NO: 18760 - DNA, 1178 bp, Mus musculus
taagtgggcatgcatcaggttaaaaaggtagctgaatagaagcctggttggcaccgtggtgagctgcacttgttcatgatctttcctgtagttgtttcttgagctccttccctggcttcacttagactgtgacctagaaatgttagccaaataaaccatttttcctcaagctgcttttggtcagagtgttaatgacaataagaaaaagcaaactgaaaaaaaaatttttttttaaagatttatttatttattttatgaaagtacactgtaactgtcttgagacactccagaagagggcaccaaatcttgttatggatggttgtgagccaccatgtggttgctgggatttgaactcaggaccttcagaagagtagtcagtgctcttaaccgctgagccatctctccagcccctgcaaactgaaattctttagagtattgctaaagaggctgtgttgcactggatctgtgatagagtttagtgaagttctgtgtactcagttgtatttattgtggctctattttgattgttctttttaaagccactttttaaagagtactggtgtacatagcctcctagttgacggaataaatgtgttcctggattttgctaatcacttacccaaataatgaaaagggaacattctagtacttgatggagaacaaaacatcacagttcacacaagcaagctaactagttttctcgtgagctgtttccacgctctgttcatgtacttattgataattaatgcactgaagggcctcaaatgtcacttgtgaaaaatcacaagtagttggtaaaaatgtagtagacaggaaagcttaagtttaatcccacctttgtcagttttgattcttagtctacattgactgtactaaacccaggctcttttcaagatgaaaattaatcccttcactcaggtagctttagtccagttagggttgctactttgcatccattcgaaaactaaaagaacatggcgggcatatgtggtgcctgaggtctcaggtgagatcattcccatggcaagggacacatggttggaacactgaggcttctttaacaataagcctactgccaggccacaactggaaactagaactacaaatttggaaaaaaaaaattagggttaagtgggtggcagagaagcttaagatagggtcacacttagtccaggctg

SEQ ID NO: 18761 - DNA, 1122 bp, Mus musculus
aacaaaacaaaacaaaacaaaacaaaacaaaacaaaacaaagcaaggaaggaaggaaggaaggaaggaaggaaggaagaaagaaagaaagaaagaaagaaatttatgtgtaaactttttatcatgtaatcatgtattctgaaagttgtataagtgctgaggatgaagagaggaaaaagaactgagctgagattttgcaggctgcatttccattaggttagtggcggcaatctgagccatccgagccaccaccatgacggtgggcaagagcgcaagatgctgcagcacattgactacaggatgaggtgcatcctgcaagatggccggatcttcatcaggaccttcaaagcctttgacaagcacatgaatttgatcctgtgtgattgtgatgagttcaggattatcaagccaaagaactccaacaagcagaaagggaagaaaagcaagtccttggtctggtattgcttggggggtaggggtgggggtggggggagaacctggtatccatgacagtagaaggacctcttcccaaagatactggcattgcctgagtggcacttgctggagctgctgtcgggccaggcatcagcagggctgctggcagaggaatcccggctggtgttcccatgccccaagctcctgcaggacttgctgggccagtcgaggtgttggagggccatatcccaacaaatgatgaccccacaaggaagaggcactgttgcagctgctgtagctgcagccacagccagtattgcaggagccccaactcagtacccacctggccatggggcccctccttcaggtatggtgggcccacctcttggcatgtggcctcccataggtcccccaatggagctccctcctggccgaggaactctaatggccatgccccctcctgggatgtggcctcctcctccaggcacttgagttctgcttttatcttccgcacagcattactgtgcatagctcagagatgtggaccctgttccccagggtcaggttaccacagacctgtttgtttgttaggcagttcatggagtctcactggatctggtttccctttcagggctccctccctgggaaatgtgccctccaaggccctagactcatcttggtcctcctc

SEQ ID NO: 18762 - DNA, 1802 bp, Mus musculus
tctgagtcccttacattcacgtttcccgtggtaacggggctgtgtcgttcacttcaccagcctaaggtgtatgaataaccaggacttgttttcattgtattgcagctatgtgatttcaggagatggaaatgggaaattaaacatctgggactggaagaccacaaaactctacagtcgctttaaagcccatgataaagtgtgcataggcgcagtgtggcacccccatgagacctccaaggtcatcacgtgtggttgggacggcctcattaagttgtgggattaatgggattagtcctttcactgtctgggatcatttttgatccagtgtcttatttaactatttaattattaaaatgtgttggatgacagtttgatttataggtaatcttttcttatatggccttatgatgttggcctattgtttttaagagcttggtaaatttgcctcagagaagttcaatagcaacttcattttgttctttatagatgttatttatatggggaatgacaactggttatatttgacaagtagttactgttggcaggcagttgcgtttgtccctgtgatgtcactgaaaggatcaaaggatcgttttggagtgaagaaaaaaaaatgcctattggatatgggatcttatgggaaatgatgtagctaacgactcagaaaggtgccaggcacttaaccgacccacccagcagggtggcaggaatacaggcggagccacccacagtcacctacagtcacctacagtcacctacagtcacctacagtcacctacagtcacctacagtcacctacagtcacccacagtcacccacagtcacctacagtcacctacagtcacctacagtcacccacagtcacccacagtcgcctacagtcacctacagtcacccacagtcacccatagtcacccacagtcacccacagtcacctacagtcacccacagtcaccgctgctgaatcaagctcttgtcttcttccggttccattatttttatggcctttgtatttttacgtgtaaactagtgaccctcattggttgcagctttcttctaactattaagcaatgtaaaattagaaagcagtccgaagttcctttcttgactctcttcctagtcacgagagacaggactgtgtagacctaagcagaaagtgaggttgtctctgaagctggaactcaagggaacaagccaaggctttgaatgttgcttgcaatcactgtctgtaaggccctggctgcacccagaaatcagggtctcaggctctgctttgccactggatgaataataatgagttccctctggccagagtgtgaagacagagtccaaaataccacttgtaatttctttaaagtcacagttttgtccttaaaatcactctggttttacttgtgaatataaacagtaaaacttttgaatgttagaaaaaaattaaatttcttttcagatctttgaaaaaccattgacattataagaaaatgcctggagccccccagtctgaaaggccacggggctttctcttttttaaatcacatgctgaacattgcactgcctagccattgccatttctgtgtcttccaggaagggtggcatataggaggaaggaattatacaaaaccattctgtcgtccaaaccactattttaacaaatgtgaattactggaatgtagtaagagaaaaacttcaacaacagtattgcatgttaacaaatcataatttcgtaatctcaatttcttttattgtgtttttgactgtttctaaacagagtaattgtacataaaagttttctcttttttgaa

SEQ ID NO: 18763 - DNA, 1099 bp, Mus musculus
cagtccccagctgcaggcagaacacctgtgtttgtgagccccactcccccacctcctcccccacctcttccgtctgccttgtccacttcttcactaagagcttcaatgacctcaactcctcccccaccagtccctcctccgcctcctcccccagccactgctttgcaggccccagcagtgcccccacctccggctcctcttcagattgcccctggtgttcttcacccagctcctcctccaattgctcctcctctagtgcagccctctcccccagtagctcgagctgccccagtatgcgagactgtgccagttcacccactcccgcaaggtgaagtgcaggggctgcctccacccccaccaccgcctcctctacctccgcctggcatccggccatcatctcctgtcgcagttgcagctcttgctcatcctccctctgggctccatccagcaccatctactgccccgggtccccatgctccattaatgcctccatctcctccatcacaagttctacctgcctctgagccaaagcgccatccatccaccctgcctgtaatcagtgacgcaaggagtgtgctgctggaagccatccgaaaaggtaggagcgctgtcggtgtgcttcgggaaacctccccagttcttagctaggacagtgcctcattccacacttagaagcttttaggtggccgtgtgtttatacaaatggtcttaggaaacaggaaaatgtggaacttacattttaaatgactttcagggaaaacaacaacacgtttaaccaggagggcttcttaaaatgaatgagaagttgacagccctgggttgggggtgtggctcagtggttagggtgcttgcctagcccgtgcagagccctggggtggatcccgagtgctatgtaagactgagcactcagtaatcccagcactggagaaatagaggcagcgagggaatcaagttctaggtgattcttggctacacttagtcccatgccagcctagtctatctgagactgtctaaaaaagaaatttaaagcattggtcttctatgatacagaaaacttaataagcattctctctagtacctatattaacctccttaaaat

SEQ ID NO: 18764 - DNA, 1220 bp, Mus musculus
tcacgatggctttgctttattaattaaatttgacttttgtatctgcttcccctgcatgtatgtgtgcgtctcccttcttccttcctgccaggagcagaagagcagggaagccagaagagggcactgggatctcctgggactgaagttatagggggttgtgagctgccatgtgggtgctgggaatggactctgggtcctctggaacccaggcagtgctctaaccatgagtctcctcccccaatgtgttttattgtgatagtgattgtacacttcatctgagacattttaaatgtgtctacctagagttacataatttctccatctctaaactggacacaattggtcacttgccttagtttaaagcaagccctagagagtttctcagctgcaccataagaatctctcagttgttgctcctgaagcacgtgacctcagaaaagcttatgaaaaataaatgccaaggctatccatagtcatcaaggaaaatgttttaagcgggagacaaacagaaaggaaatcagcttcctgatgctgcctgtcacctcaggagaacagactgcatctctcagggggaaattgggtgtgcatggtatcaaccaccctgcaggcaggagtgtggctgtcctctttggctctgagtcaatgcttgggttagtgccataccatcctccctggagaggggtgatacggcatcggctcatcagctggcttcctctatttgattgacagcagttttcctaggagtagctggagtgcacttggaagtgaggctgggaatgaggggatagaggattgttaggtcctgaggaagctgagtcaacgctgtggcctcttagcagcttccctgcctcagggccggtctctggcctcatccctctccgtgttactctgtcattgcaagcacccaaccgaccccatgcttcctatattctgtgttgataatggaaatgcagacgtgacttcacttgtgtcaccacggttgtgcaagcacaccctggttggtgtgagcctctggactcatcccaggtccttctgtctttggcttatgcccgtcctttgtaatccataggtttgttcagctggggcaaagtcaacataaacaggaccgaggtaaccagcagctgtgttcccgttgctcagatggagttataaaactgtaagtacactataacttggaagttttttatttcatttatttgttttgtgtgtgtgtgtgtgtg

SEQ ID NO: 18765 - DNA, 1175 bp, Mus musculus
gccttcttcttacagcctctggtagatacagcaaagttgctcaggccacagacaatcaaaaccactagtgtagtctgctgctgcaagaatatttaaaatattagcaaagctcaggctttgcactttttttgttcattggctcatattagaataaataccttaattcatgatttttctctataaatgaagctctgtgcattttaaaattatggttattgttaataaatgattattaccaacctgattgacagaaattttgagttaattgtgtttaatgaagtgtgtgtaacacttgcacttagcttggctggtaactgaccagaggtcagtacagttggttttctgaaatgttgcattacctacagtactgaaacaattaatgcccgacatggaaacaaccaacgctcattctcgctgcaggaatgagctgcatgtttacaggtgtgaagctgctcgcttgcttcgggttacataattgaagcaggtggttttgggggcctatgtgtgggaacaaaaggaagccggtgttacagcccatatcctcagatagggaactgaggtacagggagaatatgtggtggctgagactattgagcccgagtgtgttacacacagtagtttctgacctagaaaacactgtttgagcgcggtagacaatagcgctccagcagttactctactgcacttctttatcctccgcagtagcagacggagcctgctggattgaaatcaccactcgacactgctcagaaacagagcttgttactttaaggtgcggttagtgtttgggttgggattttttttttttttttcttttttagtgtcacccagctgtataggttattttgatgactgttaaatccggataattcccaacataaatgaacagttaaaccagaggcagtatcaggcaagagtgtggggctcagcctagctcacatggtgctgagtttgaatcttgagaacaggcatggatatggttacttacccctgagaccctgcttttccgtcagtggaaaggagatggcactagatcccacacggcttttacttactgagttaattattctctcatttattacatccgaccacagtctcccctccctcccatcctcccagtctctcccatctcccctctcctccagatcctctcctcctcatttcccttccagaaa

SEQ ID NO: 18766 - DNA, 1173 bp, Mus musculus
tgccacattcaaacacaggagtctatgggagccattcctgttcaacccaccacagacggatttcctcagaaaggatcgatcagctaatgttccttccagtacagctgagaacactcagcttggaagtttttaccactttgctggaagtggtttagtccaaattttgtggataaatagcaaagctagatttttatgtgttcactggttctgctgctgtgtgtcagggttgctgtgtttgctcctactgcgtgttgatctgggccattcttagattccagtagtatttctctcattaagtggtaaaagatggatgtctaatttctttctttttttctccctaacagttcaaaatactatttattaaactgataaataagtgttatttatattactggtaaaagaggctactcatcacaaacttaattctagaataacagataatctagttccaaattttgggggaggggattaatttaaaattattatatccagtcctgtgtcatttaaatataattagtaataaaacttgtcagttcttaatggcatttgaatagcttctaggtgttctgcttttaaagtgtaattgagtatagaagcaggcactcacttgtcttcatactggcctcttcagacgaccataaccaaaggctaccttgcaggaaaagctactttattttacagtttaaagtgtccaggcagactgggcagagctgtgcaggcctttgatcccagcacttgggaggctggcaggtctctgaattcaaggacaaaatagtctacatagtgagttccaggatagccagggtaacatagtgagacccctgcctcaaaaagccagaaaaaaaaaaaaagtcgggttgaagagctggctcagagcactggctgctcttccgaggtcctgagtcaattctcagcagctccatggcagtgtgcaactgtgtaacgtgtggtttcatgagaccggatgcactctcctggtgtgtggatgtgtgcagacaaaacacgcataaccataaaataaataaaccataaggacaaagtacatacaacaacaacaacaacaacaacaagtgcccagccagtgctcagtcttgaagggtggccttgtagcccaagctcaggtgactgtgccaccatagagacactgcctgttgtgacagcagcagcagcagc

SEQ ID NO: 18767 - DNA, 1192 bp, Mus musculus
atagtaatttcagtagactgagagtctgatcggatctgcctgaaggtctcagaagttacagttgaaatgtcacctgtggtgcagtcacctggaggcttagatgccaaggaccagcctcagcctggagacgggttctgagagaaggggtgtctggaagcagtgaaaagaaggacaagagaaagtcagattgtggatccaagttgtgttctgcttgatccagttttccaggctgctgtgttccgctttctccctggagatctctttgtctatattctaagagacctctctgtccatgctcttcttgcttgtgtgtgtgtgtctccatccgtctttcactctgtctctctctgtatgtgtgtctatatatttatctgttctccaagcagttctttttatcctaaattctctggatagctcatctcctgtagaacacaaagtccagtcttattttacatagcaatccagtcatttactctaattcttaagagacagcaagcatacatttttttcccctaatgtagcaaaagaattcagagatctgtctgcctttgttaagcacaaaagatctagttgggtgggaccttgccctgaaattacaatttctaccactcgtgggcctaaccttgctctgtctgaccttgaacttgctctgcctgcctttgtatctctctgacaagctggctcatagtgtacctgcctttggtctttagattcatgaaacccctcatacttcatattgtatccttatattttgcatagttgaatatatatatcactcatgtatttagagctcttttctgcagccttaagggctgtcctgaaggtcccagaattttccattttgctgagacattagccacaccttcacctcctggacttatgctgtcagatcatcatggagtcacttgctctgggcaagcccccgagggtcttctttcttgttcttggttcattttgaagtagcagagggggaagaacatcggtgagggtaatatgtcttatgagatatttagggttgttgtacaataagaaaatgtttacctcttgtcttagttagggttttactgctgtgaacagacaccatgaccaaggcatctcttataaggatgacatttaatttggggtgcttacaggttcagaggttcagtccattatcatcaaggcagggacatggcagcatccaggcaggcat

SEQ ID NO: 18768 - DNA, 1232 bp, Mus musculus
ttcttggcagccttcgatgcagcctggatggtgaagcggtgggcagagggcgctgggccgctagaggtgttggctgaacggtgaggccggggctcagagactagtcagtactggtagggaagacatgattcgggacacgggtcaggaagagggggcaggagatgctgaaggtagggatggaggcacgggactacaggaaagccctgcagttgctcaggggtgggtgctgacagctcccttcgtgtctgtgcactgccttccaccaccaccaatagcgagagcttgtaccagcttctgtcacaaacatcccccgagaatatgcatcgaaatgtagcccagtatgggttggaccctgccacccgataccccaacctgaacctccgggctgtaacccccaatcaggtcagactctctaccctaccctcccgcccatcttcccagatcacctccctttcccatgccaggtcttccctccttagctgctgtcccagcagggggtcagccctaccacagcaggctcctccctgggggctgaaggggtaggtggtccgctgccttgagactgagaggaagctacctcaggtacaggacctctatgatatgatggacaaggagcatgctcagaggaagagtgacgagccggattccaggaagacaaccacaggtgaacaggcttgcacgggctagcgaagcatcttctgcatgcagcagggctctagggtagtggtttgtacccctgtgctgtgttctactggcagtgctgagtagccacagccgtgctctgcagtgccagcgcttctgccaaccccttcctgcggccatgggtgtaaacccagactacctgttctgtgagcctctgagcttcgctgcccttctgtttcccctcccctggcttttatggagcaagggtttagaatggggaaggaggccagcagcaggcgtgtgggccttgggcacagcatggctctgctcccctagggtccgcaggcacggaggagcttctgcactggtgccaggagcagacagctggctttcctggagtccatgtcactgacttttcttcctcgtgggctgatgggctagctctgtgtgccctggtacaccacctacagcctggcctgctgtgagtcctgcctctctcccgggcccagccctccctgtcactgcttggtaagaagatgctgggcaggagttggcagcccagcgagtcccagctccacctgtccctagag

SEQ ID NO: 18769 - DNA, 1192 bp, Mus musculus
ggcaaactcttggatcccgtggttccgtcattactgagtccccgaactctcaaaaacaaaaattcacacttaaaaataaatcaagcttcacggaagaaaaggcggctcctacagagccctaggcgagcgcggtcagcagaactcaagctcagcggtctcagagcctccgggcttcttacccgcagcgcgctaccgaggggtcacgtgacacctcgcggcccgcctcccaggcggcgcaggtggacgcccctcgctacgtcacgtgggcagttccatccttgccagggcggggggagatcatccgtggtgcagatgtgaggaaagctccattgtgccgcgcgtgatcctcccaggacaagaaggacggcttgcgacgcacggactgctgccctagaggtctccgcggccgcttctctccctccggccggcttcctagtggtctcgcccgttccgccccgccccgccgggctgctcacgtgaccggcgcgcgctcccgcggggcgggcttctcggggggcggcgccgcagggacgcagtgctagacggagcctgctttgccgcagcttttctcccggacgcctgggctgaagacacaatgtcgggctcctcccgccgactgctctgggccgccacctgcctcgccgtgctctgcgtctcggccgcgcagcccaacatcaccaccctggctcccaacgtgaccgaggtgccgaccacgaccaccaaagtggtcccgacgacgcaaatgcccaccgtgctaccaggtgggcgcccgccgcacgcgccgagccggtggggactcgcgcaacatggccgcccggccggaggacggcggcccgacggggtggggggcgaaggcgacaggcgagctaggccgcgagcgttgccctcagaggcgccatccccccaagcgcctggtaactccgcgccgcagctcgggacggcgacgtggcttgcttccgcggtggcagttaggagtaattggacgaggcgacgcgccccgcggtcggcggggtgcgcaaactttgggctcgtgggacagactcttgtcctcccctcgaaacttctccggaagtttctaatgaaggagttcgggataggtgggggacatttagagatgagttgggtgtccctttgccccctcccaccagcgagcctcctgtaacttcacgttgacttagctgagcggtgttgg

SEQ ID NO: 18770 - DNA, 3035 bp, Mus musculus
atcatgtcctggacagaatgatggatggcattctgccttaagtggagataaattctagttatgaagacatgactcaggaagacctgtatagaatataactcggagcacagttgatgcctggggggtctgggaattataaataccatgatacttactgaggattctttgtttatcatcatagcagggacaacaaataccacactgactccaacctcccagcctgagcggaagtcgacctttgatgcagccagcttcattggagggatcgtccttgtcttgggtgtgcaggctgtaattttctttctctataagttctgcaaatctaaagaacgaaattaccatactctgtaaacagacctgttaaattaatgtggactggcagttaacttgtgcaactcactgaaaccaaaatattgaagaagtcccacatggaagacgctgttccaggatctttacctttccaaaggatgcatacaggatattttggagcatcatcctcgaagaaaagtcagttaaaccatttagttcatcaggaatatttaaaatattctgcatgaatccgtgtggctgtcgtctttgtttaccatggctgctgctgtgggactgttttttcctctgacatgccaaatgtaacttctgtaagtggtggagagtgctgtcctgtgtaggcagcttctgactgcagttgaaatgtagtcccctagaatcctaaaggctgttattctcatcctagttccaggtgtaacttggtggccagaattgagaagagtgccaaatgaccacccgtcaggcagattgagggccatcacttcaaacatagattaaatttgtttagcactaaactatccctagagtaaatttttatgcttgacaagttgtattttatatattagaaataagatgccacacagggcaatccagatttagattaaagaaaggatacacagacattaatctgcaacaggtcttgttcatactcataaagtgtaccgtattaagaaatcagaacagtgccttaagacagactgagacgtcgtgaaaaatgtgttcacactgtgggaggcaaagcttggtctgagaatgtaactgttgatgtgagcagcagaaatctgcttatagataacatactgttaatatttaattaaaagcattgttttttctagagctgagaaatagaagctaaagaataattagagctgaaaggcttccttatatcaaaccatctaacatttttcttagggctgttaaactagacataaaattgatttatctttctctctgtacacaaagtatccaaatattataccttaaggattcctaccaggttttcttgaaaagtggcttttacatgaggcaagaaggaagtagttgtagatagaatcattttctagttctttaaatgagacaatcactttgttttctaatagatgtgacctgtgtaacttaaaaaatctgagggtttgagagaggttgctctagatttccaatgacgataccctggctgaataggcttttctcttccttgggcctttacttcttttcttcctccttggtttcagttcccatgtgctatcattataatcatgcagacttttacttcagttgcttctgaaagcactaagttttcagttttggagttacttctcccttgcctctgacacactgcacacgtctagaggctgtaattggaaataggcttttggtttcctgtgccattcaagtttggggctttcatttggttacagagttcagcgcttggttcccagggtttatatacgaaacagcggattgctgtgggctggttcataaagtgaaactaatgaatctatctctttgtcacttgctggtacagctagtttgtttcacttgcacatttgtacatatatctaatgttttcaagtgccttacttgtttaaactctgacttcaaaggtttttggggaaagataggtttacctcacagttatgtttccattgtaatttctaggttcctcacaaaaatctatttcagtgctgtagctgttagttttaagtgagtgctaaagttcttttaaaagtacacagaatttccattccttataaaggtggcaaaattggtttgtcatttacctccatgtgactccttgccccatataaatgtcagcatatgtagcaagttttctaagaatgtaacttaatttgaagctcctgaaattttgagcactgctctaacattgtaggaagttagtgacattttgcaagtctctacaaaagctcttgccacagaattcactgctgccctgactcttcaccatctttctttagcaaggtattttgagccattaatgattttgggttttttaatccagaaggtatataaaagccttttcagagttttcatctgatttgtcctgaggatctagttctatcaaataccttattttacctttgccatacttgctgcacaagcagacactgctggacttagaagtttctatttgagttccttaaactacaaaactaatatgtatgtgtaccaaactgatttaaaataaatgtttattagtctcttgatcaaaagtgtcatattttgattatgaaattaacattgtgtttgccttacctgtccatttgaggctgggttgtccattgtttcttttgttcctgtagactggtatatagatgggaactaatggctgtgaattagtggagaacagaaccatgggaatgattgatggttgggctgatggaaggggcatgcgtctagctcacattaaccaagagagagtgagtgagagagtgtgtcacaggactacttttgtggagcctgttgttctttcaactttgtgggtcccaaggattgaacacaggttgttggacaagtacccttttccactgagccatcttgccagctacatcctaccctttagttctgagtacatagggagtaaaactttgcttctgattagcgtgtcatgtgctgctgtggagtctggttctgttggaccgtgtgcaggaacatctatatttgattacttgagttacactaaagttgtt

SEQ ID NO: 18771 - DNA, 1475 bp, Mus musculus
tctatgacttctgacatgcacacattcttgtcttcagagttatccgtgtgtgtgtgtgtgtgtgtgtgtgtgtgtgtgtgtgtgtgtgtgtgtggtgtatatgctgtgtgtgtgcttcctctctaactggaagaattggcttgcggaaggcaaggctacctgaccagcagtatcagcgagtgactcaccgaattgaacctttgaattaattgtaatctttaagccaacaatctagtcctctattttagggtatccttacattaatttttacctaaaatgttagatttcttttctcttcaggtccgtaaactgcaggaaaaaattgagaactcaaggataaatgaatcttcaggtatccatggcaaccctaaaggatctaagaacttaaaaaccagcccccggaaatgtgtgagtgaaaccagctcttttcagagagacagaggctttcaaccagtgcaggtccacagcctgcagtcgaagctgaggcgcgatgacatcaagtgggagcagtgaccaaggcaaactgtctgtcatctaaatgaacctcaccagtgagaccgcacgccgtctccgtggtttttatttcatatgctcttaaggaacccttgaattatgtttctgactgctataaagtgtgaagtcgtacattttcagaataatggctaatgacctaccagggttcctggcatctaaatgactgcttttcattgttgttaaccaaaggccttgacctcatgaagctctttagaagcatctgttttgcagctcccataaggtaaatccaagaagctgtactgaatggatggatgctcactgaaatcaagggagtctgacctgtgggtactattccacagtttgatttttgcaggctgtctgtcacctgtagatccacacggaatgagcagaattccagacgtttgtttggtgtccctggaactgccaccttcccttgtctcagcggtgctcatgcttgctctgtttggaaagggagggcacagtaattgtgcagttttgtgaaaatgaccttaactcagctctgctatgacagccactaaatgagatgcataactgattaacctttgaagacagttctaattcgtcttccttcctctgctacgccctgtctccttttaaactccaacaattgattttatcttatatgttatatgtgatttacatccatatatgacaatgtaatagatgtctaggacccaaaaaggtaataggattctataagaccacaggaaaacatgaattaggtaaatgtggtatcatcttttatactttaaaattagtgatgtcacaatggatttctctgttgtatacacatgttacataataaatttatactttttgcctttctaaaagcctgtggaaatattctgggacaactagaaaattgatgccatcaatggaaatagaaactagagctgggcatggtggtgcacgcctttaatcccagcgtttgggaggca

SEQ ID NO: 18772 - DNA, 1191 bp, Mus musculus
agaccaggctggcctcgaactcggaaatccacctgcctctgcctcccgagtgctgggattaaaggcgtgcgccaccaccgcccggctgttttgaggcttttaaaaacttttttgtgtatgtattacaaaacagatttaaaatattttactgatttttaaaattatgagtcctactatatttgtaccagtaagcacaaaatagtttcaaactcataattgacattttactaattttcacatacagttagtagttcagaattttgatatctgtggcacattcactaaaagcaggatgtaaagagtaatggtgttggcaaatagccctgtcagaagcagacacaatctctaagtactgtgctacacttaagtaatggcaactgtcgacaactgactccatttattctgtctctaaacctgctcttcccttcctgtcctgttccatatcaacatgttaactccctgacggtcaaaggtactggagctgaggctggagctccgttggtagtgtttgcctggcctgcatggcatggtggtgcatgcctgtattcccagctttggaaggtgtagcaaggggaactagaagattggtcatcctcagctaatggtgacttgaagctagctgggactgcacaagactgcttcaaaaacaaaaacaaaaacaaaaaaaaacccccaatcttttggcgaggggatttgtatctgtactaaacatacacactcttgtcatttcccaaacaatatggtgtgactaccattggcattgtataaggggtagacacaatctagagagtgtatgagtgtatggatggaagggcgcgcacagcgtagagagcagtttatcaacctccactggaatctaaatggctcctacacagttggagccagtctgtgtcagtccagctagccagcttaatgcagaaaacttagtttcctagacaaaaaacttgaacccaaactagaatttcgtttggcctttgtactaagaaatgaattattactaaatgtacttttattattctcttagtaataattactcagataaagaggtgccaagctgagtgtagtggtgtatccctggaactcagaatctgagaatctataaattaaaggctagtctgatttacacactgagctccaggccagccagggctgcatagtagacagcatctaaaataaaaggaagataaaata

SEQ ID NO: 18773 - DNA, 1891 bp, Mus musculus
gctgcagttctaatgcagacctcaggacggagagcctcagtgtgctaactgaggggctttagtgttaatggtcctttacgctagtggtgtaattatatatggagcagttatatggtagagtcaactgtatgaatctgtgtagtttggaaaggaaaaatagggtgttttgtacttgagttttgtattttaactacccatcattccagctttttatatactatatttcatttatgaagaaactggttttctctgaggagtcacttcagtctgtaattttaaaaaagcaacagtcggaatatttatagttgattcttcactgtgcatacctatatatgcccttatccctttaaatgcctaagtagggcatgctactaagaatcaagctggtgaaaggcagatgtgcctatctctgttggaagccgactaaccctccgccctccgtggactcgaagctggaggtggactcagaaccctctgggttgcagtcacacgcagacccccttactctcccagtagtgtgtgtggcagttgcttggtagtagaaacctggtggggcctgagccctgccgttggcctctgcctcttgtggttcctgagaaggcagtagaacctggacaattgccacccctctgttttactgaatcccccgtcagtgttcatcactgttgtgattttatcccgacatggaaagcgctaagaaatgaactttccagttagccacgcgctgctgcaggtgtttgataaccctgtttaaactggtgctgtgtacatgggatgtactgatacagaacttctcttctagggaaagctaatcatttgtcaatgatttaaaaattattgtcactactgttgattactgtggactaagtgagcctcgtgaaagagctgattggaatttgtacctttgtggctgctcatgcattttccatggtgctacagacagcctgcccgggctggtggctaggaaacgtgcgtgttcagcgatgcctagcgctctcactcctgagcactctgacttggtgcccacccctggcgcgtgctggtttggcagtatgaaatgcccacgagggttttgtatctcacaaaggttatgtagcctgttctgtgaataatgagggaagcagtttcttggtggaaattttaacatgcctttagctgtggcagtgatgggctttctttttccttctgtctgggtcaggttgtgcacaagtcatgttatttggaaggtgcactgcactgctgtttacatgggcattttatgcgggtgctttgaagtgccttgcatcagggattagaatcaattgaattctttttcatgggactatgtaaagcatgtagtattgccttggtatgtaactattgtagttttaccatggagaaatacctttaaattataactctggagagcagccatgaggaccctctgtacttcctggtgcttttccttaacatggtgggtgagtagcgagtgcggggcaccctgtacatggcagggtggggcgttctcattaaataatactgagatttaaaaaaaaaaaaaaaaagacataaaacttttatgattgcaataagccttaaagcactagagttggacaggatctgccttctatgctattatgtctatttccctgccaataaccctgaggtagcacttgccacgttccgcctgagccgctcttacttcacctgaccagccctcatggccaggtctcacgatcccttaccccatggagtcttctcctctcttttctcctcccttctcttgtggtcctacctccaaccccaagcctgagaaccaaaatcctgcctacttctcttctgcccagctataggctgtaggcatctttattcaaccaacagttttaaattaaggagcaagtttgcatagcat

SEQ ID NO: 18774 - DNA, 2119 bp, Mus musculus
gggaacagggtgagacaagagtcgcctcggcagagtgggagagcagaggcagagtgctttgatttactctacacacagaacacgtggagagctgaggcctgccgggccctggagaggctcaggcgagacttggacggcaatgcctactggggtatttgcactcccaccctcagactccccacacagagaggccaagctctcttaagaagcccaattgtgtgtcagacttgacagaggtatagcctgggccctctgtaccttctgttgggaccctgctttcagggtagcttggccattggccaccaagtagcattctcagtgtcttaggtccctaacaaggaaccggtctgttgagacatctgagcaggtgaccttgtggaccttccagacttagaaccagcccatggagtcctgatgagaaagaagtgtgcagtgagccctcctggggagccctgcacgcctgtgacaatgtcacagaacgccaaaggcccatgtggaagactggcgttctcttcaggctctagaacctgataccttgtaccaaagatagagaagagcatggggcaagccttcgccatcctagctctaggactgactgggctcagcatacccggttaactgtgactgcattagaggtgtgttctccattgtatcctctgcaacataatgacggctgaagcacatagaactgttttcctacgtctcctgctaatggaggagcgtgcactaggtgtagcacaaagcagacattggggcttgatgattagcgtcagcctaaggagaggtacaccccatctcaggtgtgacttcagccaacttctgaacccatgtacaggttcatagggacagacaactctgccttttcttgaagcgctccatccactgaacgagcaagcagcctttgaatctcttgggaaagagctttaagagtaaggcggggagaaaacaagccttccctccctccgtcatcccccggactaagggaaaacaaaacaaaacgctacctattcgctaaacacaaaggaaaggtaataagagactggctgagtcgtcatcttcttcctgtatttgggaacatcatgattaggtggacgagtgttgagttttttaattaaaagcagaccttttgtagaaaagcaatcactgatacagaggtacaaagaagccagttctgggggggaagaagtagtgggaacacagggcatgaggttagagatgtctgtggatcacgtctgtcaaacaggactagagaaagatgcccaagcaactgacaggaataagtggtgtttgaactaaatctcaagtgtatagcatacagattagatggatgaagtattttctcttgttgaattttattcatttgtattctttcatgaatgaatgattgcaaggcctcggtcacactccaggaatacttgtgcgactgtttttttttttttttttttaaagcgtgtgtctggtcacttctctaaaatgatctccttgtctggcaatcagccttctctgtagacttgtcccggcacattatgtacgtgggaaatgtggacaggtgtgaaggagaccagaagaattggtgaatactgaaaagtgtgttgtgcatttaggcttcacgtggttaacgttttttgggtttttttttttttttaagaaaaaagttgcatgaatgaaaacaacctctgtacacattacctgtaaaaatggcctgttttgatttcttgcttctaccccacacaaactagaatttcgtgtggcgcgtggccatgtttaaacacctgcagcagttggtcgtctggtttgaggcagacgcaatcctgctgcattctgggtactgaggaccttgtctaaccatacgctgccgtgagttagctctgccgcctttcttctcaaggatcaaaaccagtttgatttgggaatctgccccttcccggtggaatggaggtgcgtacttcccgtggcgtttgtagatattgcctgtgtattccatttaaaaccataatctagtttgtaaaagagatgatgacgcatgtaaataaagctttggtgacactctatctcatgcccaggagtctgtcatcattgtcctgttccccccaggaaagagatggttgggtttgtgagg

SEQ ID NO: 18775 - DNA, 1104 bp, Mus musculus
gagagcgacaaaccacgtctgcaccagctggtccaacggcactgtttgtgaaacgtgcatatcttttgattcttttcaaccttgctgtgtgtacgctgatcttcctagaagtgtatgagtgacaggcaatagtatacaaggtgagatatctctatatatataggcttagtttgtaattcttcaagtgattcatggaaatacaagataaggcaatttaaacttttttttaaaaaaaaactttttctgcttctgtggaactcatttttgttgttgttgttgttgtttccaaaaagttatggtgctgtataggtgctttctgttgagcctgcagagtgtgagtgtaggtggtactctctttggtagacagcgtagttgggaacacctttggtacatacaaaactggtgtggcgatgctctgactagcacagcatatgcatatgtctccaaagtgatatctgaaggctttcttctttgcataaaaagcactaggcatttaagtgtataaaatattttatcatgtacagcaaagatggaactctatgcatggcgtcaggaatgtgggctaatgttctagcacaggcctccccgcttgagttctcgccattgcctgcactgtagctgtgaacaccaacccaggcgtgccacccaatcccctgcctcagcactggcccccttgtgcacctttgcttcctgagcactctgggggtggtgaagatggccatcacagcccctagcacagtgagagttccactgggtattgtcacaggtctctcctgcctcgcttggattcttgtgtctgagcgatggccctgttgattccactctgccttttatggaatctgtacgttaccacgcggctgtggtcctgctaggcctgtggcacgttgcctttcccaagctgctacatgtttataaccttcatttttaaagtccagttttgaaaacgtgtataggagtcgtgtgacctgctggccagagagcccatacttgcttatccaatccttgatggtgatgctagccacgccctgatgcttcagccatcagctgtccccgcaactgtgtcattttggtggaggactaactggctttctggcttcccagagt

SEQ ID NO: 18776 - DNA, 2285 bp, Mus musculus
taggacagtctctgccgccccaacatgaacctttccacttaacttagtgctttgtaccaagtcaaaaagatatttgtagtttacaaaaataaataatgttagcctataaaactaagcagggctggcaagatggttcagtggatttaaaaaaaaaaaaaaaccattgccaccaaacctgatggcctgagttcagtccccggggcccacgtggtggaaataaaagccaggcctggttgcgcacccctttaatcccagcacttgggaggcagaggcagacggatttctgagttcgaggccagcctagtcaacaaagtgagttccaggacaggcagggctatacagagaaaccctgtcttgaaaaaccaaaccaaaccaaaacaaaaaaactcaactcccacaaattaggttcccccatgtgcgtatgtggtgccttcccttcctcctaaaagttacaaaaaatgttttgtttgtttctcgggtggtttgttctttagaactacctggagaggtctttagaaacggaagtctctgaatgtctgtttgaactggaccttcctgctcacagttcgcctttctctttctccacagaactccatccggcacaacctgtccctgcacagccgcttcatgcgcgttcagaatgaaggcacgggcaagagctcttggtggatcatcaaccccgatgggggaaagagcgggaaggccccccggcggcgtgcggtctccatggacaacagcaacaagtacaccaagagccgaggccgggcagccaagaagaaggcggccctgcaggctgccccagagtcggcagacgacagtccttcccagctctccaagtggcctggcagccccacgtcccgcagcagcgacgagctggatgcgtggaccgacttccgctcgcgcaccaattccaacgccagcaccgtgagcggccgcctgtcgcccatcctggcaagcacggagctggatgacgtccaggatgatgatggacccctgtcccccatgctgtacagcagctctgccagcctgtcgccctccgtgagcaagccgtgtactgtggagcttccgcggctgacggacatggccggcaccatgaatctgaatgatgggctggccgagaacctcatggacgacctgctggataacatcgcgctcccgccatcgcagccatcgcctcctggcgggcttatgcagcggggctccagcttcccatataccgccaagagctccggcctgggctccccaaccggctccttcaacagtaccgtgtttggaccttcgtctctgaactccttgcgtcagtcacccatgcagactatccaggagaacagaccagccaccttctcttccgtgtcacactacggcaaccagacactccaagacctgcttgcttcagactcactcagccacagcgacgtcatgatgacccagtcggaccccttgatgtctcaggctagcaccgccgtgtccgcccagaatgcccgccggaacgtgatgcttcgcaacgatccaatgatgtcctttgctgcccagcctacccaggggagtttggtcaatcagaacttgctccaccaccagcaccaaacccagggcgctcttggtggcagccgtgccttgtcaaattctgtcagcaacatgggcttgagtgactccagcagccttggctcagccaaacaccagcagcagtctcccgccagccagtctatgcaaaccctctcggactctctctcaggctcctcactgtattcagctagtgcaaaccttcccgtcatgggccacgataagttccccagtgacttggacctggacatgttcaatgggagcttggaatgtgacatggagtccatcatccgtagtgaactcatggatgctgacgggttggattttaactttgactccctcatctccacacagaacgttgttggtttgaatgtggggaacttcactggtgctaagcaggcctcatctcaaagctgggtaccaggctgaaggatcactgaggaaaggggaaatgggcaaagcaggttagtgcgccacaatgcaatgggaaagcatcgccggtgggcggggcggggggggggcgggggaatggggggggtgactcctatcctgacagcgcatgcagcagtcaggactcccagccggttcatcagagttttacctgtaaacaagacagggctcacagctgtcagtaataaaaagaacacccaaatattcaaaaagctcactctttatgtcctctgttgtcactatgaggcaggttctcctaccctctgtgtgtgggt

SEQ ID NO: 18777 - DNA, 1174 bp, Mus musculus
ctgccacatcagactctaccgaagcagttcttatgtgccagggacccataaatggcctaaaactactggcagcccacctgggcgaaccgtgaactctgctgaactgtcaagcctgctggctgagtctctcttttcttacaccttctttcacctgcagtgacaaacagggtctgaatgaacagattccaacgtccctttagcctgtggagtgcccgtttatggaattttccattcatgctgcatgcttacctttctttaatatgtgtgtgtgtgtgtgtgtagtgtgtgtgtgtgtagtgtgtgtgtgtgtgtgtgtgtgtatgtggtgtgtgtgtatgtgttgtgtgtgtgtggggtctggtggccttcctcccttccatgttagcttgtctgtgatggtccttgctcagctcatgcttaggcagccatcttgatgagacgtcatgggggttgcttatgacatttctaggagacagtttcacatctaactcccagttcttctgacacacagtcttccctccccctctttaatgacccctgagcctgagtgacagagtagtgttgtagatgcatcagttaggcctaggcttcacaactgcattttaattggttgtggttttctgtaaaggacttcatctgtcccaaagagacatttattacttgatgagcgattagaactctactcagattctagagaagggtgtgcaggatcgtgtttcccttggataggttctcttacaactcttctggtccctctttgggcgacagatagtacactgccgcccgtgttctttattaggcgcttcccgtttaccctgcaatccgtgaaatagattaacacccagcgtgtatcagtactaagacagcgccctcctgtagtatgcagtctttagaggggctggtttatgcaatgcatgctcggcctccttagctcaccgtagcccagggaacagtctgatattacacagtctagattaagtttaaatgagtgacccagtggaaactctttcagaagatgaaatgccagtgtgtagctggttagtctattcattggagatttttttatgtagattttggagatgtctggtggtcatctgtctgtgtaattggtacctagcagtgtcctggactcattggttgattcatttgaatgttcagcaaagtcattaggctg

SEQ ID NO: 18778 - DNA, 1202 bp, Mus musculus
attggttacatcctgtactgcttagtcaccacactggtgtaatggccattagcacttgggaagctgggctgctgtgcccctgctctgcctgaaaaaccgggagttccagtgagggagagtagttccactgggcgcccgtcaccctggtgactctgggtgctttttgcccatgagttgccttgctggctccctgctgttttgagtcacaaaggcatcagatgtcatcaggtcaagccaaggacttccttgctcattcataaggccatggcacaaggcacaggtcaaaatataattctcaaggcagcatccagaagaaatttattatgcctacagtacaggctgtacttcagccactgcagtgaaaaaaaaaaaatctaggtggcaacctttgaccccattgatcattttcctttatcccagcacattcctcttagaagtaaatgctagaaaaacatgctagggacagtaaaacccaaacctcgggccaaagtctgggttcatgtgggcctgacctcattgccccgctgcccccaaacggggtctcactgtgtagctctggctgtccatgaactcactatgtaaactaggctggcctcaaactcacagagctttgcctgcctctgcctcccaagcactgagattcaagacctgctccaccacctcccacaccgccacgccccacacagccactgcctggcttcttagaagcacttgctccttggccaatcccaatctttagttttggtttgaggtccagcctcaggtcttagtcctttgtactgtgtcagctttgatgtctcttatgtaatgttgcccagtagccattggcatggaattaaaagtgtcacttatcagcttgtgaccttggacaagtcagtctctttggcacctcccctcacccctttaaatagcatggagatagagctatctccctatattagaaggttagtggttgaattaaaagatgatcatggttataaagttggtggcatgaagcctggtgaattataacctcccataaatgtcagctgctgctgctatcggtggtgacaaggtgtgctgggtgggtaattagcctcttctctgcccattttcttgtcaacaactggaggcaggagtgtcttgaccctttgtttatcaattagatctccgtgaataattgacaggatctttttagatgtgatgcagagtcctcacaaggc

SEQ ID NO: 18779 - DNA, 1293 bp, Mus musculus
acctgctgagcatcttaccacgttcatgacccagagggaaagaccattgtttgatagcatagcttatgggttgtccagagtaatgcttgcatctaataaatagtgcacatttcctagccttaaagtgtgtgtgttttgacccctcccaccaccatctttaataaacaatggactaaaaattttttttttttttttttttttatttccagggtcgctggtcatcctctggcccagaatgaacgttgtcttcacatgtttttacaggatgaaattatagataaaagctatactccatctaaaataagacatgcctgagtttggtgagaagaagcaaaacccgagaccattaatgattcatccgcaccaatgaagaagttgtaactaactagcatgctgcgcagacactggcatagcatgccctgggtacactaacactcacctgctccctttcgttccgcttgtcttggcagttgacaagacattcgtttgctttagtgaaactccctcgctccagcctctctaagtagctcttcccgctgtgtccgtgtgcacactgtagccccacagccccgtagaacctgcagtgtcctgactaaagctgccgacttgctctcatttgcagtttctgtgtcatgtttgcttcttgaatctgattgactagaatatttctcccccctgccccttgatgtgtgatgtcaccacctggtcctaatttatgtgcaggagcacgacaccacttgtctccagcgccacacatccgaggtgtactttgtgtgcagaatgtgtcttccttctggcctgtaatccccttcccatgaaagattaatgagggaaatctttatattctgtataaaaacaaaatcaaatttatatactaaaatcatttgtctaaaatttaagttgttttcaaataaaagttgaaatgcattcctgtgtgctctggttgcacggcctccagagcctggcgtccgtgctctgtcctgaaagcctcccttcccgagagggttgtgtactcacgcagcacttcattcccggaacgccatcctctttaaaggcagtgggatcaagtccaccttacgccaccctttgaacgggggctttaaacactggaagggtttccttggcttcctgccttgttggggggctgcatgctgacaaatgctgtgtagtctcaagtcactctgtcgaggcctttagttagccagtagcacactccaacctcagcagctcttccccaggtagagaagtgacttgctggaacttagccaccgtgtaggagtggcaggtgccggt

SEQ ID NO: 18780 - DNA, 1204 bp, Mus musculus
aggaatttaaactcagccctgtgtctctccccagccaaacgtctcaagtcgagcaccagttttgccaacattcaagaaaatgccacctgaagcctgcaaaacggggactcgacctcacgttgtgccagtaagtgttagaccacagcacagtcgagaagaagatgagccaaggtcggacaagttgcattctcacgaaatgttgggactgcagacctataatttattctgaataagggttctcaaattcccttttcctgagcacccctttttttttttttgaagatttctgtatttttagttttcaaacatagcaatgttacatattttaaggtatatctgttacaataacaagtgagggcttttttctcaggcatatgaatgactactggacacttctgatttatcctcgttagcagaagtacacaaagcagaaaaggctgaggtctgctatttacacattagtcactgggagcccactctgaaaaagaaacatacttgccaaatggtagcaggctcagtgattaacttaagtgaattcccattgtagtattgttgtatgtatatacatacatgcacacacacacacatatatatatacacgtatacatagatgtatatatgtaatgtatacttaatatatcatacattaaaataatgttctctagttccctgaagtcccttttgaaaccactagttgattataaacctccttaacagttttcagagagtgattccacattatgcatttatccttgttaaaggtttacagtaactgaggttctaatatgacttttataaatactattttacatcttatttttgtctttatttagtaagtaatttataatcactggactgcttaattacctttgaggacaagatggattcatcttatgccagggatttgcatcatgaatttcattaagttatttggcaacctgtaacttgttagtagttcaagtcgaatgtcacccaagtgtgtcatactgtgtttaaatttgtgattttttttaatgaaaattttatcttggaatatttggagatttggggagaaacaaggacaaacacaagagcttaaatttcagaaaatagacagggacctgagggatgctcacggtgagacagctgcgtggtttacactggagatgactcggttgacaggctcgcacaggaagcctcccagttacgggaaagatgaaagtca

SEQ ID NO: 18781 - DNA, 1106 bp, Mus musculus
tagcttagattccatatttggagcccacgtggtagaaagagagaactgactcctgcaggttatccacaaaagctgcatattcaccatggttcctacacacacacacaccattttttttttttttttttttagggatggatgttcagcagttcttgcagaggaccacagttcagttcccagagagggtccaacacattcttctggcctcactgtgtacctgtatgagtgaacaaataaatgaatgaagacatgatgctagagagtttaggatagggagcagggtatgctagccagggtggttctgaaacaggtactggtgatactgagagaggctggtggacagcatcagcttggctgtattcacctcagcaatttgtcctctgagtttgaggtatgatgccacatatgtgccccttcaaaaaatgaaatacacctttaaaaactaaaaagcatgaaggaatgaacagaacaaaagctgatcttttttctcttatagccatgatcttattgtatttaaactatgaatccttccactgaatattcctgctgtgcccccaaaatttttggtatgtgctgttttctttttttcttttttcttttcttttttttttttttggtttttcgagacagggtttctctgtgtagccctggctgtcctcgaactcactctgtagaccaggctggcctcgaactcagaaatctgcctgcctctgcctcccaagtgctgggattaaaggcgtgcgccaccacgccgcccggctgttttattttcattcatctttaaagctttccaagttctctgatgtgttagattcttgattatagttctattaaattttacttttgttgtcattttacttgtcactttttaaaaatgtcatcacatgtagtcacatgaaagataatttgtggcctaacatacaggccagtcccagaaaatactatgtatggggtaactgaatgtttctgctgttggtttgtgcatgactggagagaacttgttttgttttgttgttttttaaatattgggtctctatttgttgttagcagcaagctactccagaaacacctgaagagtgacttgctccatggacttggagtagtgt

SEQ ID NO: 18782 - DNA, 1118 bp, Mus musculus
ggaattaacatagtactgttaccgagtctttgttcaccctctttggctgtcttcgttaacttagagcttctttatattttctcagcagtaaatgacaggtgtggacatttgtattgctgtgcacttgataacatttattggttattttaaatgaaagaaataaaatttgtttcagtggcttttactgctttgcaggcatgtaatagctttttcttaaaacattgaccttgtatcaagcatcttaatgacttgacattgattttaaccatttatagatgttctaattactccacatatgcagttgcagctgttgtgagggaagacaatttttcttttaacctttatgccctccatttctgccttttgcctttctaatcccgagctagtttagttttgtggacagtgaattagcttcagagactcaaaacgataaatactgactgggatgctcagaacttttgtttttgattttgccttgtaggaagctgcaataaaggaggaagaagacgacatttctgacaagggcagtgattctgaagaggaagaaaccaatagagattctcagagtgagaaagaagatggtagtgacagggagtctgatagagagcaagatgagaaacaaagcaaagatgatgaagcagtaagacctggtgtccttatccatgtcccccttaccctcttatgctgagagcagagccagtgcacaccccaggtccagatgtgttagttacatcacttgaatcctgtttctgatgactgctggagctgggggttcatttgtttaattgtttgcttgccttaactcatccattttagaatctcattactttacaaatgtgtttgttttgaggtattctcaaggaaaattgtttcagacaaggattagaaatcccagttttcttaagtttgttgaaattacaaagcagaagcaggtcctgtgtctgagtgacactagtctggtctcttaaggaaaagtgcagtgatggaaagtgtctctggagatagcagtaagggaaggcaggagcagcccttagaggaccttccatgccttccagagcatatttagaagtaaccctggtactagataatcaggaaaggggaaagctttgattagttgc

SEQ ID NO: 18783 - DNA, 3143 bp, Mus musculus
aatgtagagttgcagctacaaagttcactctctgtgattgccacagtcagagaaaaccttcactagatagtgttttcattattcttctccaaatttctgacatacgtatttaattgtttatagttggaagttcatgaggccaagcctgtgccagaaaaccacccacagtgggacacagcgatagaaggtgacgaagaccaggaagacagtgaaggatttgaagacagctttgaggaagaggaggaggaagaggaaggtggagactaacccgagtgagtggactacagcgtttgcacatccttgcaaacattgctgctctgtgagaggtcataaagcagcagcagtgagggctgatatggagggaagggttgccgactttactagaaacggatgcaaaaaagaggccgctggtgccagggtacaatctgaaaagggtttttaaagcctttcaggtatggggtggtgcgtttatctcatctgcaaatgataataaatcctttgatgttccaactgtccagaagtgtgggctgtgcattacctgatagattatgctctcagtaaaagtcaaggcacatgaaaacaatctataaatgaggagctcttctttgttcagctttagttttagtaaacattaaaatatgataagcatcacacatgttttaagtaatgtctgctcaagtttttaatctgttagtaagctctattattcatttatcaatattttacaaatggtaagattgtaacagttccatatgtaagttgaaaccataattttcatctatcttggccataacttagcattctcacacattccacataatacagagggctacattttagaattttccattcttaattgcccagagttagcagacgttataaaagtggcttttattggcttacagcctcttaaagcctctggtggtgtcagtgcaggatcgaattaatccgataagcttcagggccaaaagttactccgggaccacacgttctctgacgctcggttgatgtcattcagccttttggaaaaggttcactagaaaagctgcactacattcgtagtttaacctacctgactctgtccgaagccttctgaagacagtaactacagcatacaaaggaggcacttttgtattcatttggactcctgttaataaaatagaagtttgactcattttatgtttgtaatcgtgtgtgtctttttactcctagagaaagggcataaatagggtaatgttttatttttcaactctaaagtttaatattgtacctcactgtggaagtgactgctatctctgtctactcttggaaagcccaggaggaagaactcttctctctcatttagtacaacctaaaagatagtgctcaacacagagtagaaatgtgtgtgtgatgagtcactgaggtcagaggaatatttttattactagacatagaggacacacacgtctacagtactataagactgactgcaataatcctatcaaactctccataggccaaagtactgttgcaatactaacttatcacctgtttatttaaaaggttgctactcttcctgcagaattatcgctggtattttgttactacagtagttggaaataaaatttaaaaattaccaaaaatgaattttttgttattgttctaaatttaagatgtaacatgtaatagttgttctcactggaaccctgcttccttcctctgcaggcccgggggtgtggctttgccttcagatcgagactggctgggaagctccagggttggctggcgctgttagacgcaggcgggagggagggagggagggagtcagctgtgtcaggtgagcagagatgaacagccagagctgtgctggtcacatttcctagttttcctgagggagccaggctcaaggaccgcttctctagtggctctttgccctctgaaaggtatacagactgttcaaacaactggcttctctggcttgagagtctctggtgaggattttacaccctgataacagcaccatgcttacaaaacagcatgtcttccatgattggaaattccaacaacttgattctgtttgcctatgttgtgatgtgtagcaacatctcaacctaaaggaccagttttcctcttaacaagtgctttggggaaagactccagctagggtgctcgtctctctactcagtcacttaactccacatccctatttttctctggattaataatttgtctgagtttgcatttagttgaagggagatacagagtgaaattgattatgaaattaagtagtttacattgtgtaaaagttttaatctctagatctgcagaatgtctgtcaaaatagagctttccacaaggggtcttcctgctagtggaaagtgtggcaggtgcgaaggctgacatcgggccacctgactgaggtctcagacccaaaagcagatgttcgcagtctctaaactgttgggatttttgagaagactcgagacattgaattaagattctgtgtgtggagcaatctcgttctttgctctgcctttcccagcatgccctaggggtggagaagaacaggctgttgagtggtactgtcctgctgtgctgggacgttcgggcctgtccgacaccagttcctgccatgtggaatgaggcagtgtactgaggctttctttgtgtgacttgatttgtgttttgtttttgagactcactatatagccttggctggccttgacccacagtgtagcctaggatgtggaccttgtaatcctcctctggcctccgtctccggagtaataggattacaagcaagagccaccacgcctggtgttaacgtatctgctacatgtattcaggtatccgctccagctgcctcctaccatacactggagtgttgtttagtaataatgtgtatttcaaatgcactacatgtttttgagggattgtttatcatgtatttactgaatttccatgtccgggctctgtcattaggcactgtagctatatggacactctctgtgttaaggacttaacttggacttttagtcagcacatggtgggaatttctcctttctccactggcacagtggccaatacctcccctttcctttcctttcctttcctttcctttcctttcctttcctttcctttcctttcctttcctgttgttg

SEQ ID NO: 18784 - DNA, 1174 bp, Mus musculus
tttcttgaaaaaaaggcggggggcgggaactgtctcgacaaagtttgaaataggacatactgatttctagtttcatggctgcgttcttagctgtgtgtctgtggctaatttttctagtcttcaacaaatacgcagacgtgtttttattgggtttaattcaatttacaaataggtttttactcttcactgtgaagtaatgggaaaaaattgattttctaccctttgcagctgtgtccagagaggggggtggagccagggtttcctaggcagaagggtgacctctttactgcctattctttatggaatccctccccctttgtttattctcgatgaatagagaactcatgggcacagccttttccttaaaggcacatctggggaaggtgagggtcaaggataacctagggtctcccttgacaatagtatgaattttagaaaggcaccttccctcaggctgcagtctgagcaagatctcagctggcaagtgtagccagacgtcctggactgtaacaagataaatgcggtctctcagatggatctacctattgtaccaatcaggtagaatttaggtaaagagcacaggacatactccatgctgtgctataagggcccactttgatgttccctgtttgtgggagtgtgacatgaccctgcaagatctttgttacatatacacgggtggttggacttaagtaagacagagaaggagaaaattgtcccagagcttcccactgaatggaacttgatcaggctgtggatgagccggatgtctgttattgctagcatgaggcagaaatgaccttgaattagaccttggagagactctttaagatgataaagcaatgagcggactctgcctagaagaagatttttaactctgggtgctcgctgctgctctgaagttagatccttgtctcagaaagcatcaggcagttcccacatacagaactgcttgtgtgaaagctttgagattagaccggtcacttcacacaaacgtttgcccttccctggaggttcacggtgcctcttccagggacacgggctccttagtgagtggtggtattaagcttgccaaatgtcctgcctaaacttacccatgtctcactggtgccccaagttaaaacaaggccaaacaagtcaggggaggcctctaataatttttgaaggagagcta

SEQ ID NO: 18785 - DNA, 1182 bp, Mus musculus
tgtttaaagttaggaatcccagtcccactgcctcagtagctagaaaaaaaaatcccacaaataataatgaaaacaatgtatgagtatgtctaaactattctccccacacagaattccactggtagatggactagtccctcctttgccgatgcctggaagcttggtgggtagctgtatgaactcagagagatgtttgtactagaatctctatagtttatgcttatttatggtacatcggggagttcagagcaaccatgtgtaaatttttgaaagtattcaaagaaaatatcctcattccttggttttccagggaaacaacatattttaaacaaaataatcaatgggaaaaaatgaaaaccaggaataaccctttcaccccattctttatgctctcctggggcagtagacccacacagtgccctctgctctgtggttctccagtctcttacatgtttctagagctgtggaaatgggtagagagaacacgtgactctttgttcctggtccaaattccacaatgttcgttccttgctcagcagcggaggatacactttgcatttgaagaaagctggaggagtttcacgtaatttgggcttcttggagcttagtctggttgtagagccacaagccccaaaacactgtttcaaagcatagggttagcttcacggggaagccaaaagggaggtgttaatgtactcattggtgagtttgtttctacactgaaaaatccaagacaacagcctctcttggagggcgtgggaaagtcgacctaaacccatggattcccacttctaaagaaaagaaaaactataacagaatggaaaggagttggtacaagtgggaattctccatccctaggctggacctgagctgtgcttgctgaagtatttaatgattagaaatacccactgggtgacagtacctgaattaaaggtactagccctcagtttgcacttggaatagttctgggtggaagggctacaaagagccactgagagccaccaggctgacacatctacacctagaactagtgagtatatataggacagagttggtgtgatcaccagctctctgaaagaacagtgcctagataaaacacagaaatgcttatccagtgaactaactcccagctgcctgtatccttagaaccaggggtttgtagagggagggaccttaatgtgc

SEQ ID NO: 18786 - DNA, 1198 bp, Mus musculus
caatcctagtggagtaggcgtccggtagcatactaccaagaaggaagctgtgacttggaaatatttgctcagtcagagcttgtcggtggcggacccggtgttgacttcaggcctgtccattcaatcgcagagggtgagctctcccatctatccaagcaggcaacaagccaaaacattggtttgttataataaacattgtttattaaccgattacagaaagaagagaaatgggtgttcctccagcatttaacttagacactgctccttccctgggctggggacacacagaagaatgtgcaaagtaggttgactacgtcctatggtgggggggggggacgaggcctgggggaggggaggaggacgagtatcttcacagggtatgcaggctcttctgggtgtttccccataatatttctttggagctatctccaaagaaacagctagctatcttcatcctcctagtggagaaataggattggggaatttgtccaagattatctaacttgtgggcagagtttcgattcaaatccaagttgtggaagtccaaagcttaatttccttttgagcaccgtaggagaatcgtctcactagtccctctgtcaccacatttacaaaaggtctcttatcaccttgaggcaaagtttataaagcacagcaatgagcctccacttaccaactcgcccggtgtacacgatccgagcccaccaacctcttgctttcatggtgggaacgtgagcacttggcttacagccagagtggaagccctgaaccagagctaatggctagtgtgagaatcgtttcttggccaccatggtttgaggtctcctttcctgctggtggctttgccagtggggccagaacaccagagatgaggccactcttctttcctcctttagcctacgatgccttcagtctgaaggcagtggtcttggccttctggaaagcatgccaactgaaaacaccccagataatttaatctgcttgacaatgctttgagtgacccccccaaaagtgagaacctttagaaagcactgggacttgtcactcacacacacacacacacacacacacacacacacacactcaaggaagaatgggagggtaaaagatctcattgccattactgtgctaagagaccaggacaggaacagtgacagtccctataagtgtctaaagtatctattaaaagcataaggtg

SEQ ID NO: 18787 - DNA, 1311 bp, Mus musculus
ctgtggaggcttgaagggctaaagcaacaaagtccttgcactctgggaggaacagacagcttctggggcagagagctcactgaaatcacctttagttcaccattttcctcaatggaggaaaagagacactgggttcaatgtgctcgggattgagtggtcagaagtacggcaagatgaaaccccctcacgtaaatgacccagtgaccttctgacctatataatcagcaccagcagaaagcacagggagcatacaggcctctggagtcagcaagagtttgagggaaatcagcccacagaattccaacaacccacatttacctgctactgttctctgagtagtctaagttgaaatgtttaaaaattaggctgggctcggtcttagcgccatcttccttgagactcctgcgccatgagagcgaagtggcggaagaagagaatgcgcaggctgaagcgcaagagaagaaagatgaggcagaggtccaagtaagcctgccggtgcacccacgacgcctgcaggagcagaagtgagggatgctgagggccgggacaagctatcggactgtgtgctgccatcggtaatgagtctcagtagacctggaacgtcacctcgctgcgatcgcctggagaaatgaccgcctttcttacaaccaaaacagtcccgctggccctctgccctggacccccggcactctggactagctctgttctcttgtggccaagtgtagctcgtgtacaataaaccctcttgcagtcagcttaagaatcaaaaaaaagaaaaaaaaaagaaaaagaaaagaaaagaaaaaaagaaaaaattaggctggactgggcatggtggcgcacgcctttaatcccagcactcgggaggcagaggcaggcagatttctgagttcgaggctagcttggactacaaagtgagctccaggacagccagggctacacacacagccagggctatctcgaacctcccctcccccccccccaaaaaaaaaattaggctgggcggtggtggcgtctcccagcacttgggaggcagaggcaggtggatctctgaggttgaggccagcctggttttcagagcaagttctaggacagagaaactcagtctacacagagaaaccctgtttcaaaagaggacaaagaaaattttatttatttatttatttattttcgagacagggtttctctgtatagccctggctgtcctggaactcactttgtagaccaagctggcctcgaactcagaaatccgcctgcctctgcctcccaactgctgggattaaaggtgtgtgccaccacacccagcacaat

SEQ ID NO: 18788 - DNA, 1287 bp, Mus musculus
ttcacagggctagggtgccctccctaacccttacgattcaaaattcaaatttagactagatgtggtagcccaccctctaggcagaggccactggagtttgaggccagtctagttagtctgcagagtgaattccagcccagtcagggctgaacaatgagaccctgtctgaaaaacaagaaaatgcaaacgtagcaacttgtttctctctcctcatgttttacatcttctatttttatcttttttttattattaaaatgaatttttgaagaatcattaggctctttgggagccattttatttagaaaaaaatcataaaatatttgagatgagatgctgtaagattacttcagttgctgggatttttttaaagatgattttagatttatgcttttttcaaaaaagaagaaatgccatattcaggcattatgggtaactgtggcttcaggtggcatagtgactagttttactaatcctgtgtctgatatctgattttggaagagtccatagacccccttagattcagcagacgggatggattataagtagtgtgtagcccctttcttattctatgtgagcttccgttctgcggtggcccagcctgtctgccgccgccgtgtggtgctcgctgtgtagatgagaacactggaagatgatctgaatgtaggtagaacggaggcgtgggtccttacagccttcgtgggagctgtgccctccacacagatgttgctgtagagggacacattgcaacacagtgtgtagggacagttttgtgtgatttacgggtgagcttttgggttcaccgagaactgtttacttcccatgtatttgtacaaagtccgtgtccccagacctcagtgttagctcctcccatggtcttgaacctccaaagccccagcctagggctcttttgcaggtgttggaagaacccaaaccatcttaaatggagtgcccacaccccttcccagtcccaccagaccttttccctcaaaccttgcaggaagttctgccagcctaccctggcccacccctagcatggaggtgcgtatctcttccccttctgcactggggccagatgcctaagaaggaaaggagaccgtgtttcccaaactcagtgcatcgcatccccgacctagaagactgagttgcccggggcagtcataaaacccttgtgggacattacagacgtgataactttaatggcttaatattttgctacattaatatgcagaggtgatagaaataatctatgaattttctcataaagataagaactttagttctagtaga

SEQ ID NO: 18789 - DNA, 1048 bp, Mus musculus
tgtacccaatgggcattcaattttcaatgctataaagcttctgtcctctgtcattctcagattatttatgctataactgtaaacctaaattattgacattgagaagtgcgcagagactttgtggcacacacgaatctccttataagaagtgaggggaggggccccgcggagaacaaggcaaccttcttgtgcccaggaagaaggtaatgggcagccagaagagtccccttcccccctcacttggcctctctctaatgccttagttacacacacacacacacacacacacacacacacacacgctaccccaaagatggctgtggcactctctcactgcttccactggttggagagaattccatgggatttgttctggtcttgaggatgtaaccgagaggattccaagccatgtgaaaattgtcctgctttccagaaagtggagtgtggccctgcaacatcagaagcacaatcggccattgagtttttacaagtcccatctcgtcacatctgagaaatggcgggctctaggaactgagcgggactttttgtaacccagagtgtgttaaattctgggaacctgtattttggtttccttaatactttaactatgtagggcttctctcctcccaacccccacctccacccccagtcccatcatcccttcagtgaaaaagagctggtcactctgggagctgtttcctgcccactggaccgtatggtgtcctcactcacccatccgtacagggagttccagtgggcatttttttttcatgaagcaatataaatataaaatacttattttttcagaatttaatggttttcatgaaatctgttggcaactactttccctgtcctcatctaaattctttgtttgtgttttggatgatttttgccttgtatccagaggactaaagattagccccgatattctgatgttcactaaaatagtatgtcacagtaggtggtagtggtcttggttttctctgttagtaagctgttaaagaatgtctgaagatactcttgaatgtacagtgttcgaatcctgctt

SEQ ID NO: 18790 - DNA, 1059 bp, Mus musculus
gctgcccttccccttcagtgttgaaccccaaaccttcctttccttttaagttaggaagtgaggggttcatatcagcagcaatcatcaactgaccaatgggatctacttagtggcgactggatttggcctgatcacaccacagtgtggccatttgggtccttgtagagattgtctcggtttctactatccccccagcaactgcttcctacctgatccagagggacctggagacccctagttggaggtcactgggtcattctgaagtggggggtgagggcccaagggctgtcactgctgtgggcagtctttgtctcttgtagatccagccttaatgtctgacatcccaggaagcgcagaccctgcacaaagtggatatcagagcgatactgtgaggagtaagtaaggagcataggtttaccaaagagaatgagctagcacatcatgtctgcctgttacactgatctgagtgcacccttagaaaactgaatgtaccacagacccaggacagttttggaacttgtatgctctctagcaactttgtgtgaatttttatacaagcactgttttattaattatataaaatataaaaatagaaaaactggtctctttaacgcttcatttctttaggccacttagagtgtgtctgaatttgtctgtccacctgtttggggacttcagtgcctggatgtggggtacagcttgcaaggttttggtcataggcgagtggcagaactcaccaactccatccttcagtgctacttgtatacagagcacaaattgaggcactcttccatctccttcctggcctggtgccagccctgcctgtcccagcaggacatcacttcctcgaccccagtatttccaccctgtgtcacatgggttgtagtttctcaaagctaacctggtaacaaaaagatacatgttttccctctgctggttacaaatcagcaaccttttaacaagtagcatggtcaagctggagaggcccgtggttaggtgcactggctgctcttctagaggacccaggttcaatcctcagctcgacaccatctgtaattc

SEQ ID NO: 18791 - DNA, 1176 bp, Mus musculus
acacaagtaaaatcaaagtgaacaaatctttaaaaatgcggccaatgatggatacagaaagacatccagatatccctgaaaggaaagagctgtatgctgtagagtgggggcttttaacattcattcctttatgtagtgcttgcacacgtgtgagtgtagaggccagaggacagtttgcaggggtcacctctctccttctaccacatggttctggggattgaactttggctgtcaggccaggttggtgacagtatccttaactgctgtgccatctcacatgaactgcagcatttcgagctcctgctgtgccagcacagaaaatacactgcttccatttccttttattttacattgctaggaccaaataggccgtgtacatgctaagcaaacagtccacaactgggctacattcccagtgtagacatatgctattttctttctttattctaagcctacaaagttaaaaatctcttttgggtgggtctctattaaatgggaatgcattggactatcgtttcttgccagacatggcacctgtgcctgcaatcatagtactttgaagctgaggtaaaaggatcactcatcatctgagacaagtgtggactgtgagtgagttccagagcagcctgcgcttcaggaggagaccctgtctcaaaaaccaaaactaggggctgggaatagatagatggttcagtggtcaagaacacttgttgagggacaggtgtggtagcacacgcctttaatctcagcacttgggaggcagaggcaggcagatctctgagctcaaggccaacctggtctactagattagttctgggatagctagaactacaccaagaaatcctgtctcagaaaaccaaaacaacaaaaagagcactcattgctcttacatagtctcggtctattcccagctcccacaggatggctcacagtcatcttggttccagttccaggctgtaacaccttcctggctgccacaggtaccaggcgtgcagtggtgcacagacacacatgcagccaaaacagatggataaataaagtaatatatagtatatattttttcttttttatctttttaattttatttttatctttttctctgtttttcctttattaaggggctggagtgttgactcagtggttaagaacactttgatcttgccgagggccagggct

SEQ ID NO: 18792 - DNA, 1798 bp, Mus musculus
actattatctgcttgagtgttattacagagtgcaaatggagatagctgtggatggttctgaaatttatctgtgatttctttttccttatttattttagatttactgcaaccaaacatctgttgcaccgtttcccggtaaccagaatatttctgcttccccaaatccaagtaacgctaccaccagagggggtggcagctccctgcagtccacagctggtctcctggctctctctctctctcttctacatctctactgttagagactcaggccaggaaacgtctctacttccccatcttctacacctaccccaaatggcaaccacaagtccaatgtgatcaggaagaaacaggtccacctcgaattggctgttaccatatctcaacagaaaacacggagaattcgaaattcgacgggattaaaggacgcgtgaaaggtttgagagaagagagatgccgctattgaatctgctggagttttacatcccaagatgaagacagcattcagaattgatgtgatttccttgaatgtggcttaggaaatgtggacacttaaaactctcacttgaaattgggcacaggtttgatgtagagataaggacggggtgcggaatggagacccattttgtcattgattcatctgaccgataaggccatagtgcagttaggtgatattcgaaagcttctttgatgctctttatgtatatgttggaaggaactaccaggcgttgctttaaattcccaatgtgttgtttcgttactactaatttaataccgtaagctctaggtaaagttccatgttgttgaactctgactgttctctttggaattgaacgttttgcatcctcctcctgtggctttaggtctgacattgtatttgacctttactagtaattaacatgtgccaggcaatggtggattggaacccatccccaagtccagccaccactgaataaatctgatttcaaaagtcaaacagtagacatttcccattgtcgtttctcactcaccacaagcaccaaattcactagagtacactggttccagagagcagaatcatgttggccttggctaatttcaaaatgctgtcttttactttggtatatgttgagggcttttcataatttaaagtgtgttctgttagcaaggcaaaaattatgagtcttaattctacaggcaaatatgcaaaggagccaaaactgtaaacccagcatttgggatgtgaagactggaagctaactctcattgaattcacaaagtcttttatacaatttctgtacatactttttttttttttaagagaaaaacaaacggtggatcagaatagccacgtttggaatactttggttatccattcatatttttagatagttattggtcctgtgcctgaaagggggcttggttctaccgtaagtttttccaatttccttgatatacacataccttctaaaacctagacatttcctgaaaaaaatcttttgttcgcatggtcacacactgatgcttacccgtacagtagtcttgataaccagagtcattttctccatctttagaaaccttcctgggaagaaggagagctcacagacccgaagctactgtgtgtgtgaatgaacactccccttgcctcacacctgaatgctgtacatctatttgattgtaaattgtgtttgtgtatttatgctttgattcatagtaacttctcatgttatggaattgatttgcattgaacacaaactgtaaataaaagaaagaaatggcggagagagcagtctgttgaatttatttacttactttttaaaaa

SEQ ID NO: 18793 - DNA, 1181 bp, Mus musculus
ctggttttagttttgagtgatagtcactcatttaagttgtagttaggagtaagaacacaagaagtagttagcttccttgggcacctcacacatggcctacactcacaatagacacatgcacatagatttagaaaatcttttaaagttttctgttgtgaaatataactcaaaaaaagtccaagtgataagtgatataaacatatatagtccaactattaccacaaagcaaacatgacaggcatgagccgtattctaatcagtagatattctggagaagggctctagggattggactcagcctgaaacatgcggagtgccaccccccagcgcagtcagtcctcagccccagtctcccatttgattgtgattatcagtgagaactcaagtgtctacacataggaattcatgaaacatctcttgtggtgtcacttctcgatggaagaatgcagagcctcttagagaaatgggaggttagagagggcgcacagtgtgagtgagccttagtttcagtaaacactggggacactatcctaaccatcagatcagtgtcagatttgggagccatcttaaagactgccaaagatgtgacagtttcagtttctgaaaagatcattatggtagcttgagtcactagaaagatgtttaaattcatgagtttatgttgattttttttggggggggaagtagttaattttggaacattatgaggaacaaattataaattgataaagggaaataactaaatatgccgccatcccatcagtgccactttgatatgacatgtatgaccgagtaaaccgtatcatatttgaagggaggcattttttttgttttttgtttttgtttttcaagacagggtttctctgtgtagccctggctgtcctggaactcactttgtagaccaggctggcctcgaactcagaaatccgcctgcctctgcctcccgagtgctgggattaaaggcgtgcgccaccacgcccggctgggaggcattttttattaactacagccgttacatgaaaaggggtggcatttgaacatcactccttggcacccctggtggacagactgaagtcctgagctctggcagcttgctgaagtctctagctttgtcaggtaccatgtggggatttctgtagagactgaagcccatccttgtccagtcttcagaatgcagcaga

SEQ ID NO: 18794 - DNA, 1099 bp, Mus musculus
tctacatgtacgttcatgggatgtagccttttgtgctaatcatttgccaatgctcagtacaaaactgtcagctcctgcacttgcctgcagtcagtgggaagtacatggtgctttgttttaatttattttgattttgtgtcatgtgtatggatatttgcctatgtgtatgtgcaccatatggcatgtcttgtacctggggcgcccagaggtggttgtcaggtcccttggaactggaattaacaggtgattgtgagctgccatgtaggcactgggaattgaacctgggtcctcaggaagagcagccagtgttcctaaatgcggagctgtctccagcctctgcacagtgtttttgttttcataagctgtggtttgacccagctctgtaaatttttgtggcctttttgtagctcaaaccccgccatcttatgttaatgtctgtgagattctaaaacgggtcagaacctctcccaaggaccttcgtgtgcagcatcacttgtgataatactgggaggtagcagaaccttacgtaggacctagtgggaggaagtggggaggcactgctggaggagataccaggacccagggctttcctgcttctatgtcttgatcgcctgtaggcaggcctgaggagcattctcttgattgatggttggtggatgggtccagcccactgtgggaggtgccatccctgggtaggtagtcatggggtgtataagaaaccaaactcagtaagctaaggggaagcaagccagtcagcagcactcctctgtggcctctgcattagttcctgcctccgggttcctgcattccttgagtccctgccctctatgatgtaatctgtgagatgtaataaaccctttcctcctcaggctggtttttggtcactgtttttatcacagcagtggagtcctaactaagacagaaatcagaaccaggaatggggttttctgtgagacctgaccatgttgtttgcaaggattatggaagtatttggacccttgggctggagaagccattaagcgcttaaagcttaatgggctattctgtgggcgcttgggatctaggtgtccttacagggagcctgtgatggaggcctggc

SEQ ID NO: 18795 - DNA, 1153 bp, Mus musculus
attctaataaacaccctttctaaatatatagaaagaatcattctataagttctgtaactagagaaccctaatacactataattccttctagaactcaaggtttttcaatgaaaaactacctgtgtgtacattaccaagtacactgaccaaatgagatcacagcctaacactactatacaaataggactgaggatatagctcagtgcgcacttgcttagcagacgttagaccttgattcaaaacactggcatttcctaacaggcttttccttaatgaagcaagggaaccgcacagggagagaaatgatccttacctttcacatccaacactaaatttggtttcatcttgctgtagatcctgccgtcggacttcatgcaccagaactgactgtcgacattttgatcgagggccagtcctagtttggagccagacgtgacgaggctgcccacgatcgtcaggcagcagtcttctgctatctgcataggaaacaacaggctgtctcagaactcccactaggaagtccctggctggttctagctcatcttttagccattttagctattagcttcagtaactgaagccaagcaacgggactttatttcagatgatgtgaacgatttcaagattaccccttgtaagactgttaccatagggagaagcctcagggggactaagtggttaacacagctgctctttcaaagcacccacatggtggctaacaactgtctgcaactccagtcctgggggatccatcttatgccctcttctggcctctgtggatatgagtgcatatacatgcaggtaaaatatccatacacttaaaaattaaaaacaaaaacaaaacaacaacaaaaagccaacacaaaagaacctaagaggagccttggtatagtaaattgcccacagcttgggtctccctgtcagcagtgcgcatgctcagaggccacatctgaagctcgccgtcagcctgagtttccagctcagcctgctcttctttgtagctgcactagaacaaccactgactatatcccccaggcctacccccttaaacctggagttacattcatttactccttgtctctccttcatgagaaacacctaaaattgtctaaattggcacgttatcatccacatataaaaagtagaatgcaaa

SEQ ID NO: 18796 - DNA, 1197 bp, Mus musculus
atgtcagtacctaccacacagcacacctgtagtggaatcataagcaatgtgctgtgttttaataggaagctaggtttttttaagttttatttactttatgtatatgggtattttccttcatttaaggatgccacatgattgttgtacctgagcaagtgagaagaaggagccagatcctctggaactggacttgtacacaattgtgattggtcatgtgggtggtgggaactgaacccaggttctctgcaagagcagccagtgcttttaacccaacattggatttttacatatttagatgattccaagcaattagtcaaatatgtatattaatggacttacaaatatatatacagtaataaaatctcttcacatgacaatgttatttatgacctaatgttaaatatgacctaatgacctactatatgatcacaacatgttatgtctgacatgtttaatagaacattggggcatggagtatagtagggtggtagaatattttcttagcatttagaggagaggccctgggttcagttcccagcctccaaatatctaaatgaaaaaaaaaaaaaaatgtatgtttgtgtgtgtgtacaatcactgtggaatactggtatgcattcttttttgtttgtataaacacacacactggtcactcgaacaccacagagacgccacacacaccacaaacatatacatcacagacccacactgcaccatacacacctcagatacacgtatactacagaacacagaccacacacaccctcctacacacacagacacaccacgatcacacttaccagacacaaccacaccacacaaacccacatatatacacacacatctctctgtctctctgtctgtctctctctctctgtctctctgtcacacacacatgtgtcagtcaatggatcagtaaggtggatcctcagttcatttctagcatccatgtcagatggggcataatcacctgtaactccatctcccaggggtcctacaccctcttctggcctctaggatcctgcactcagatggcacacacaaccatatacacgtaaatacaaatataaagactggctgtgtggaggacgttagtatagattttgaatgtctaatcctcttgctttggcctctgtgctcagtactagaattctttttctaaatttatatttcattttattttgtgtgcctaagtat

SEQ ID NO: 18797 - DNA, 1377 bp, Mus musculus
ctcaatgaaaaaaaaaaaaatggaaatgtgccacagtttgtatttctgattaacaaataagtggggtatttcctaaggtgaccatggtggaaccttaggcaggagaatggaaacattggttgaattttcaatagaattagacttaagaaagtaaaagagaaattctgttattaataacttgcagtaatttttttgtaaaagatcaaattacagtaaacccatctttccttaatgagactttcctgtttacagtcagtctattggtatgcaaacaatcttgtaactttgataatgaacagtgagagatttttaaataaagcctctaactatgttttgtcatttaataacatacagtttgtcacttttcaaagacctcctgaatctcatagagtaagccactttttcttctgtgttcccatttctcactggcatagcaagggtgcggggcataaggcgacttgtctcaggagctgtcacaggatttattactgtgacttgaaaaatctgtcttctatatactaaaggtataaataatcctatctgtctttgctgttacgttggtcactgtaaacctgtcaaatcatagtatgccaagtatctgtctatgataatttttgaatattttgaatctcccgttcctttccagtgtttttgtttggtttggttttggttttttgttttacgtttttgttttttggctcctggattatgtcattgtggcccctggcagccagtctttaaagcctgcaggtgacctgtctctagactgcagtagcttttccttatcattaccaaaaacatccagaggttactggaactcctaccacagtaaggaaagtttgctgcactctctcgatggctgcttggagactcctgctgttgatttgtgagctagcttgctgtccacattgaatgtcaacccatctgagtatgctaaaagatgatatcataaaataatggttctagattcaataataaagatgaatgttttcttataaaaattatgtggtggctcaagtgaggtcctgatagcgctccttcctcctttctccttcccctgtcctctcccctggccccctgccctctcccctatcctctcccctggccccctgctctctcccctggccccctggcctcctgccctctcccctaccctctcccctggccccctgccctctccccctgccctccttagcttttgatcttcactgatttacagcacattttttcacaaaaatgagataaagttggccaaatagcaaatatcctagaatggaagttgtaagcataataataaaagaaataacagtgagggtcaatcacagaaaaaatagaagcgagcaggaaagcattgcctgacaaaacaaagcgcccttt

SEQ ID NO: 18798 - DNA, 1102 bp, Mus musculus
gtgaagaagataaaaaagccgtgttcagaagatctgtcgtaaagcacagatgttgtgtgtgtgtgtgtgtgggttggggggtttgagtctggctgtcattttgctgttggcttgtttttgtttttttaatatcaaaattgcacaaagctggtgccctaccaagaaggatttgatatagaaaggctcaggccacacttaaaatacaagcaagcaaagagaacagaaaaaaataaaagtaaaaacgggtattcttatcatcttaggttaagcgggtaatgaacattcctgtccccaacgcatcaactgtattgtatctgtaaaactcagcttttctcagtatttgtgtttttgcattgtataattaacttaattaaagatgaaagggcattgcaaaagtgttcaacaattacctcattgagtgtatccagtaggagtgcaggaattaatgtcgtatctcatgagttgctacccagctgagcgtgtgtgcttccaaatggtaggctgggtggttcggtcctgtattctcctaagcccaaaggttacctgttggtgttcaaggtgtaataaagaatgctgtatatttatgaacctatttataccagtataccatgtgtatatatgatatatttataaccacttaaattgtgagccaagccatgtaaaagaacctatttttcctaagagcaaaaagaatctctctgaagttttgcttaaaactccatgacctcgctatgactttggtgcttgggcaccaccctgcctactaccagagagcagagcacctcagtgcagaggtgagggtgtgtagcatcttgggatggatagaaacaccacaccatccagtcgcatttgatggccttgctacatgtgtgtcagttgggtcacagaataaaaatcatttttctatttctgctctcctcttcctcttcctcttcttcttcctctttctctccctcctctagaaccctgactcatgctcactgctcagtctgatgcttaccttagagttttgtatatatagatcaacttacaaagagggaaaacttcagatcctctgggggaaacccaagagccttactgacctgttgctgtgactagctag

SEQ ID NO: 18799 - DNA, 1120 bp, Mus musculus
agcatcaatgcacatgaaataaaattaagtaaattaattaattgtgtaacaaaaagaaaagattaaacctttaacacacagaggtccttgcagcagattccccactatgctcttaaactccccacagtgtagtaaaaaaaaaattttttttgactgagtgtgccagtcctgtgctgaggcacagtacccacatggaatggactcatctcatgcatgtacaacttgatgagctgttggtgaatttcacctactgttccagacttctaggtgatgaatatcatacacaaaccttatagggattacggtagtacatgtatttaatattttgttcttcaaaactcatcagggaagaagtctccaaaggctgcaaggatactttcccccactcaagtgtcccccaaatgtgcatacactttcttcccacctcataacagatgttcttatatcttgctagaatcagagtgacagtcgatggcgaatttctgcattatatttccccctttcagttcctggattctcctgagtgggattcgctaagacccacagaggaaggcatttttcaggtaaggaccaattatgctgcatggttcaggccccaaccttctaaacagatgaatatttgttgtaaagcgagcaagcatacaaatagaacaacatacaacacacacagcttgaatttatatttaactttagatacagttcccttcatgcatgattcctagccgtgagtcctgatgactgacgttagtcacgggtacaaccacagaaagaatgggaatccaggagacaggaaggggttgtgatgagaactttctacgttttccatgttgaacctcatatatgggaattagttaatatgtaaagacttgactttaaacactgccaatgtgattgtttagaaaatgccaagagaaaaagatcgtacttattacaaaaccaatggtctttgaaagtagaaggggccagtggatgtcagctattctaaactttgtcatctctacgctgtcatgtgctggtagtactaaaagacaaacatttctgtccattatatttattatgctatactgtttcctataagccaacacatacatgtgcatgcacattcaaatgtatgtaaata

SEQ ID NO: 18800 - DNA, 1102 bp, Mus musculus
ttctgcagaccaggctggcctgggattcatagagatctgcctgcctttgcctcctgagtgctgagactaaaggcacgtgacaacaccgcccattccaacagctgaatacctcaggttccctacgaacaagttgttgttatgttgggaaagaacagtacccttaaaagtgtcctcggggaataaattgttgtttaatctctctgttccaaaatcaggtacttgggattcaccagatggctttgggcagggcgtgagggaggtgatgtctgcaattctctaggacccaaagataaagaaagcacagaggttgtcccagggttgtctaaacttctgcacctgtccttctgggagggtgtgtgtgcttgagacttatagtaactttgtttgtaagatccgacttgccctattccccggcctcagcacctggagtcttctttgggggtcagaacaattcacagccacttctctgatcttctttttaaaacttaagttttaaaaaagtgggatgcctgtgtgcctgattacttatgatgaattccttccttccttccttccttccttccttccttccttccttccttccttccttccttccttccttccttccttccttctaagatcatttccaaagggttaagaagccctattcaatgcatcttcagttgattaatattttaaacgaatacctcgcagccctcgcttctgttttagaagaacactatgtgagtatagccataaggacgaacttgacattttgcttacacttctgccacacacctgaaagatggtgaattactgtaactcagctctgccagttgcccaggttctaaaatctgtacttttgtatatttaatgacaccaatgtctaatttctgggtaatccaggaaataccaaaatacgggaaatttcagaatgcaccgaagtcttgcagcttataagaaatcttgtttgccatatcttgtgtgtgctaccacctgcctgtctaagacgggcacagaaatgaaagatgtaattgtccagtagctagttcacttgttcactgggcagtttagttgtcagactagagaattctgaccactgtgacgggggaggggcaggaga

SEQ ID NO: 18801 - DNA, 1941 bp, Mus musculus
aggcaaagcatactgcagcattccaagcctcaggcacacaactaactagcaccagcttgccatgggggaacttaaagtgcagtgttgccttgagccagaggggaacggggtctgtggagcaccactttgcaggggttcctcatagtgcggtgtggtttgagccatcttttgacctcccccttacagcaacacaaatgtaactcctaaaaaacgattcactaccagcctttagcctgcgaactattcgttctctacacagcaggacacagtggacacatttttatacttgcatttctaatctttggatgtatttttacaaatgaaagacttaggaagatttttatctgcttatcacctggaaattttagtgtgcaatctaaagaaaaagataaagacatcacattattagcatcagtccacctcccaaatataggatgttttattgccaattatttttgtattctggctgagctttattttgcaccagggcaggcctaacttgccgctggttgtatgtagtttgtgaatagaagcccataagtgttaatagaccttgtaacattcgctgtaagatgaattatacaggatgtggggaatctcagtaagtcttaaagttaatttaaagtaatttatctgttttctctaagaaatgtttatcataaaatatatatgtaacttcccattttggtataaaatctagggaagtgtgtgcaagtggagttgtgctgactttgaatttctagatgtcttaatgagatttatttgttttagaaaaagaacaacttgttgaaagcacccagttctgtcttacatactgtcaacagcctcttcaagttgtgcctgtgtgatctgtgacctcctgttcctttaaagtgagacagtgacctatgactcattgttgaccttatacttggaacagaactacggcatttacggtggagtcctgtacgacgagaaagtgtcaggatatgcaacgcacctgtggcttaccccttgacggcccagcttggaaatgatggcaccgactacctcttcaatcacttgtggctatcaaccacaggcacttagcaccaggctggctttaattagtgtgtgttgtttttgtggtggtaacaactctatccatatgaagaccaaagtgaaccctggtttctatatgtctttaatgcagtgttgtatctagtatttggaaattatctcattcagtgtttagattacctcactccattttgattcatgttgtttacaagtgaacatttttttaaagatacacttgaaattgcgttagaaagaacaaaggaggagttgctattagactggcacagtgcattccacagacttggtggactgctctctgcagacatgggcctaggactgtctttgtaccgaatgtcttactctgttggctattgatgtttaaaatttcatgatagaaaataaaagacacaatgttggtgtttaagatgggtttggagatattttgtgtgctgtgatttctgtggttaagaaattaagtaaatggataaaaggccctttcagaggctttttggtttggtttgttttggtttggttttgggtttttggagatagggtttctctgtgtagccctggctgtcctggaactcactctgtagaccaggctggccttgaactcagaagtctgcctgcttctgcctcccaagtgctgggattaaaggcgagcgcctggcttcagaggtatttttgtcaatatcaggatgagttaaaggtttcagcatggtctggtagtggtggaaaacatggaaggtttttttggggggaagggggtggcttgtcttcatctggattgtccattattatcatcaggaattgtataaacatctaaattgagacctaccctttgtgtgtccagaaagagtgtcgtgaagcttataaaaagctcttggagaaatcattttagaa

SEQ ID NO: 18802 - DNA, 1695 bp, Mus musculus
tgcccgccagttctcagggaagacaggaggcagaatcccagccatgcagctctgcggcaccaagagaagtgggaggggggcatggctgcacagtactgtttcctcaggaggtgaagtcagaaatggcagagcactcagacaggtcaccccaagaagtttcttccacgaaagcgtttgcagcaataggagagcaaaacaaaaaggggcctttgattcagaaacggaaaaagacttagtacttgtcagtgttcccttcacccgggcgggaagtctacctcatgcaagcacaggggaatagtggtccacagagagcagccggccgggatgttaactactgctgaggaactgggaagttcttaattagacaaatcactcttaagcaaactacatttaagcagggtgtcatgttttatagaattgagatactacatatagtatgtgcataagtgagaggggagacttgaatctgtatgtatgtgtgaggatttcacataagagtacaggcacacacacacatatatatatacacttttatatatctgtggttgtctttgtgtgtgtgtgtgtgtgtatgtgtgtgtgtgtgtgtgtgtatgtagataaaagcacatactcttcctcagataattgggcatctctaagcattgaaaatccatgtgaagcatttgagatggtttcatagttaacccttggaattttttctaaatactacttcttttatattatgtaaaaaatgaccacgtgactgttacctttcatgtgaaccaaagcatacttcagatctcagagctgccagtcaaatggtactaaaggcttttgggatacttggtgcctcccaagtctgtattcataactctatcttgatgctgatagagtgttttgctgttgctgttatctgtcttctcctgtttgaaggtagtaacttaactctagatgcctccgactgccataagcttttaatccttggatacgtagctccagaaaagacaatgaatgtgaacttcctgtgctgatatttcagtgtcttttattctgtttgattgtaaattacatggctattaagaaaaatgaaggggagggtaatgtatatagtaacatggtccttttcagtggtattttgatgctaggtcttttacaagggttctgaggtttttaagggatggtggcaacagaagcctcctttgactaagtagcttttgaaccatcacttagatcaggaaggtctcttacttactactgaagccttagagaaaattttaattatttgggtatatttttggtagctgtttttatttcccctggagagtcctcagacctgtttataaaacaaacaaaagcagcatagaaataaaatagtggggcttagaatgaaaattaagttgcccaatagatacagcccatgattgatactaaaaagaatagtgtttgatggccagcagagtgaatgagtggagcagagttaccaaagtgcccactgttctgtggctagaaatactttatatgataatattgatgccatggcaggttccttgagtatagaagcggaagtatggtgtgtgatagattcaggatgagcactcagatcaagttataggatcttctcagatggattctcagtttgctaagattggctaggaactgattgtagtattgggctgttttccatcatgttttgttttcttttgttttttgaat

SEQ ID NO: 18803 - DNA, 1174 bp, Mus musculus
atatttttaccagaccgtactgtggttgctttaaaacaaatgaatttctgttagtttatgtatagtagaatcttctttttttaattgtattactttttttttttaatttattgtaggtttgaatataggtgcatatgtgaaggtcaggacaagtgagttctctccttttaccatgtaggtcctgagacttgaactcaggtgttagtgtgtcagcaagtgctttacccaccaagtcatctctctggttttataatagaatttttgtggtagaattgatgggacaaagaatgtagacatttaaatttttgtatctctgaattgctttttacaagtggtataggatttcaagtgccagcactgtaagttttatcaaacctcaataaaataaaaactatatttttgtaatagataacagaatttcttgttttgataatcttaagttatacagatgatttataaagcagtaataatcttgatctctctctctctctttccctactctttacagagcaaactattcatggaaggatttagaagcttgaaagaaggagagccagtggaatttacatttaaaaaatcccccaaaggccttgagtcaatacgggtaacaggcccaggtgggagcccctgcttaggaagtgaaagaagacctaaagggaagaccctgcaaaagagaaagccaaagggagataggtaattgtacctggcttatttgtgagtctattcaatttggaaaatatttaaattttttttattcttttgcttttatgggttttatagagagagcctagtgcaaactgtcatcagtgtgtagctggatagactgtgtcaggaagaaagtcttgtcttgaggtttggactgtcttcagcgtactgagttaggttagagtggtgtgggatagtgcttgaccaccattccccagactgttggaggccagaggaggagctcagattctcagaggaaatgcctctctctggacagtttctttcattctccacctgcttttcccaaagagagctttaaaatgacaattcacacattaaaatccaaacattaaaaaactgaagttattttaaactgactcttgcatgtcactcattaacacctgcatatattcccactatctgaatctgccaaaattacaaacagtgctgtcagggcaattgaatctgt

SEQ ID NO: 18804 - DNA, 2190 bp, Mus musculus
taaatttaagtttggacttaagaattgcgtattttcctctacaaattaaatattaatgtccctaaggtggtttggtgctgtgaaatagcagaatccctatggggtgtatatatgtggggaataataacatcagttgctttatttaaatggctcccctatgagattagagaagcttgtgtgtagagcaggcgtgtgcacatacactgcctttttaaaccagcgattcacaagggcccttcgtttaaataatacaaaatcagcattctgattaatcataaagaagcgtcccagattgtctttaagataacatgtttgagtttttcgtgctcattcataaattattttgatgtcagcacagatgaaatggcgattggttatctcttcctcttgccagccccttaaggatccgaggtgaattagtagcaagaaagcatgtaattgacagagtcacgtgtgctcaggggccagaaaccggagagagaagagaaaaaaatcaaaagaaggaaagcacattagaccatgcgaactaaatttgtgatcgcacaaaatcaagatgttagactgatgctgaagatcactccggtccaaagggaaagttttcatctctggagtttgaagctgagggccggtggggcaacatggccgaaggttaattttcttttctattgttttactgtgattcctctcttcttttctcccctgcttctccccaccacgtagtttttcaccccttctctcctttcccccattaccctaatactgggcattatctccccacccccttagagtgccgtggggctttggcaaaacctattgttacagatctccaaaatgttttgtaccgcccacactgattcacaacttggaaagctttcagagggctattgtttgaattgtgtgtgtgtgtgcatgtgtgtgtgtgtgattacgtgtagtttcagttagtgagttcaagaaaacttttatacacctgccccctcccccattctaccctaactttaattgaaagttagggggaggggaacgcacattgcaaataccccgggattcccgtctgcctcatgtgcattaaccagtagccagccatccttaggatttctctttttttctttctccttgctaggaaaagcaatctcgctgaaaaattactctttgtaaattggaatagtattagatcagcagcctgtgagtgaagtgtcagaagctgtaaccgtagaatgttgccgagaaaggagccagatgaaaaagtctgcggctgtacggaaacgtggaagctgctgtgagcagtgcagcaatgtggcttcccctccctggctttgcttttaaccctttttgtttcaattttttttttaagaaggaaaatgtttgccaaccttttgtttttaatcttcatgtcttcttttcccaagcaaaactttttgtttagatgagcactgtatagaaatgcaggctaactgacttttgtcctcttccgtgtcaggcggggcaagcaaaggtgaagagccagaaaaactgcccgggctggcagaggacgaaccccaggttctgcatggcactggccactgtaaatggttcaacgtgcgcatgggattcggattcatctccatgataagtcgagagggaaatcccttggatattccagtggatgtatttgtacaccaagtaagccagactttttaatcccttttttaccggattccatgcttgggagttggtgtgtagttatgttaatatatatagaaaaatgtgcttttaagtgtattgtaatacggaaatattcgataaaaatcaggtgattgtccagttttcagatgtgtccctgctggggtatatttttataaatagaaaatgaaggctggtacttcactgactggtacaacataactcgagttgatattatttaataaaccttcccttcattcgacaaggaaattgcattctggaagcgccccttactattggcttacattgcctggacttatgaatgaacatgaagtgcaggaagaaaccctgggatcctgaggtttcccacagccagttggcttgttgtaagaaagtatagataggcaccctacttttggatacttctaatgacagtaccacctgtactagtttatcactgtctgttctgtggtcatttgcgggcttaggaaaaaataatttggttaatagtaaaataaaatagaatgt

SEQ ID NO: 18805 - DNA, 1122 bp, Mus musculus
tttgtttgtttatttatttatttttaaatttgtactttaaaaattatccttcattgaaagatacacaagactgctgtgcggggctctggctgcgcctggtctggcaggcaccatgtgtgcatcccgcgatgattggcgctgtgcgcgctccatgcacgaattctcagccaaggacatcgacgggcacatggtctgcctggataagtacaggggtttcgtgtgcatcgtcaccaatgtggcctcgcaatgaggcaaaactgacgtaaactacactcagctagtcgatctgcatgcccgatatgctgagtgtggtttacgaatcctggccttcccctgcaaccagtttgggaggcaggagccaggaagtaatcaagaaatcaaggagtttgcagccggctacaacgtcaagtttgacatgtacagcaagatctgtgtaaatggggacgatgcccacccactgtggaaatggatgaaagtccagcccaagggcaggggcatgctgggaaatgccatcaaatggaactttaccaagtttctcattgataagaatggctgcgtggtgaagcgctatggtcccatggaggagccccaggtgatagagaaggacctgccgtgctatctctagctagccctacaagtgtgtgcccctacaccgagcccccctgccctgtgacccctggagccttccaccccggcactcatgaaggtctgcctgaaaaccagcctgctggtggggcagtcctgaggacctggcgtgcatccctgccggaggaaggtccagaggcctgtggccctgggctcgagcttcaccctggctgccttgtgggaataaaatgtagaaatgtgaaaaaaaaaaaaaaaaaaaaaaagaaagatacacaaaatgacattgtgaaacttggaattatttaaaaaatctttaaaaaaattttttttaccctttattttctttctgcagacatccaagagagttgttttttatctgtaattttacacatttctgtatagggatggtgctcttgaaccaaagctggttttatgcagtgtgagattaaggaagaggctctacttgcgtttgtgcttgtcgccaagtggtttataggcgactttgtaactgacccc

SEQ ID NO: 18806 - DNA, 1196 bp, Mus musculus
ttttttccagcttctggctattataaataaggctgctatgaacatagtggagcatgagtccttcttaccggtaggaaaaccttctggacatatgcccaggagaggtattgagtgatgctccggtagtactatgtccaattttctgagaaaccagcagactgatttccagagtggttgtataagcttgcaatcccaccaacaatggaggagtgttactctttctccacattctcaacagcatctgctgtcacctgaatttttgatgttagccattctgactggtgtgaggtggaatctcagggttgttttgatttgcatttccctgatgattaaggatgttgaacatttttttttcaggtgcttctcagccattcggtattcctcaggtgagaattccttgtttagctctgagccccactttttaatggggttattttattttttggagcccaccttcttgagttctttatttatattggatattagtcccctatctgatttaggatagataaagattctttcacaatctgttggtggcctttttgtcttattgacagtgtcttttgccttgcagaagcttttcaattttatgaggtcccatttgttaattctagatcttacagcacaagccattgctgttctattcaggaatttttttccctgtacccatattttcgtgggtttttcctactttctcctctataagtttcagtgtctctcattttattcgcagttccttaatccacttagatttgatcttagtaaaaggagataggaatggatcaatttgcattcttctacatgataaccacgagttgttccagcaccatttgttgaaaatgctgtcttttttccactgaatcactttagctcccttcttgaagatcaagtgaccataggtgtgggggttcatctctgggtcttcaattctattccattggtctacttttctattgctataccagtaccatgcagttttcatcacaattgctctacagtacagctttaggtcaggcatggtgattccaccagaggttcttttatcattgagaagaggttttgctatcctaggtttttgttactccggatgaatttgcaaattgccctttctaattcaatgaagaattgagttggaatttcgatggggattgcattgaatcagtagattgcttttggcaagatagccatttttacta

SEQ ID NO: 18807 - DNA, 1150 bp, Mus musculus
tttgaagaagttcacaggcaaatttgtcccgatatcatatagttaatatttatcctggactatgtatgtgtcttgtcagtacatattcagtgattttggatcatgtcttttttgttcttaaataatagtgactgtttttatacatgtaagccttcctctgcatgtttcttatgcagtacagtattttttctttctccttgagaaattaaaagaaagattgcttttggttacagcagtcatcagaaatcattcaattgggaccattcattgaaccaactgactccattatccaagtaaatttcttaggtataagccaaagaagtatataaagttaaatttgccaagagctataaggtattttctatgccttacctattagaatactttggatagtacccttacactataatacaacagtgcttaggaacctaagattcttcaattttttcataaattttattattccttaatattttatatgcttaatactaaattatactaaaattttcatactacaattttgttttatattacaataactatgtatacacatgaaaaatttggttaattgacttggccggttttcctttgaggactgtgtatgaagaaatattttgcaaagaaagtaaaagttgttcacctaaagcgatataaaaggacaagattcctagaaataatttaaagatatagctaataatatgctcagtgatcaatgtattaagaatttaagaactgctgataatgtaagaacagattgatcacaaaagaactatattcttctctactctaaatacaactggtcatgaacaattttctgtggtcattaatttgaaaatgtgcatttatagagaagatgacctccaggagatgatgagattttggggcttataggtttgggtagttcattgataagtctgaagtactagcagaaagtaagcaaagtttacaaggaaacaaagcattgaaataatgaaactgacttgtaaattcttttgaggaatttacaggggagggagaaatgtgaaccaaaggtaaatatggaattgaacttcaagatcattggtcagcaaaggcttcctgagaatctatttgagttacccttcctgggaattttagcagtgagggatatggtgcctgaaatggctattta

SEQ ID NO: 18808 - DNA, 1147 bp, Mus musculus
tttaaattagctggatttatttgccagtattatataataaaaccagcaatattttgtcattatctctgattgaaaatcttaccagagcagttgcttttactctttattattggaattttatttttgatacttgcagatgattttaccagaaggaatccagagagagaataccaagctgtatgaggaagtcaggatcccctatggtgaaccaatgccagttgggtttgaggaaaaaccagtttatatcaaagatttagatgaggtaaggtgagccttttgtgtaatagaatcttggaacatgccatttgtcattggtcagtgcagttaagaatatagataactggttgcttaagaagtatactattggagtatacatggtgaaaaatatgtacgcgagttccttatacatgaaacaattcatatatgcctttgcattacatatgttagcttgtgtttattttgcttatgttttgcatgtatgtgttcatatgtttgtatttatacacatgttcaagagcttgcatgtgactgtagaggtcagaaatggatgttatatgtatttttctagcactgtctaccttatattttgagatgggatctttcattgaagctggggtagctctaaccaagcaaactgaaagacattgaaaaaagaatttgaagaaatcaaaagacagaaatcccatgctcatggatcagtaggatttacatagtaaaagtagtcattctatcaaaagcagtgtacagatgcaatgcaatccccatcacagttccagaacagttctccccagaactgtcgtgaataaatagtgtttaggttcatatgaaataaaaaaaaacccacaaaaaaaatagaatggtaaaacagtcttaaataataagaactacagaagatatcactaaagctgatttaaaattctactagaaatctatagtaataaaaatagcataatactggcacaaaatcagaaacattgatcaatgaaattgaacttaaaatccagacataaatctacacactgtggacacctgacaggaatattttgtccccttctcattttgcttactgaccagcctgcccttttgccacatatttaaaatataaaaaatttaaaactaccatgtaaaatagatttttttcttaaga

SEQ ID NO: 18809 - DNA, 1198 bp, Mus musculus
aataatgagattgtttgaatcaatagttgttagtagtgggtaaatggtctcagagtaaggatttaatagaacccaggctggtgagatggcttggctagtaaatttgcttgccaccaagcatgacaacccaagttccatccttgggatccacatggtggaaggagagaactagttgttctctggcttccgcatgtacaacaaggcaagcatggcctgctctccttgatgtacacacacaaaaataaatgaaaaagaacttgctcaagtgtgagaagtctggcactgagggtgaaaggctaaatactgttagagactaggacgattcttaaaaattagactatgaagtaattcctacagtggaagacttccattgatgttatcttccagatattaatttcttgttttgtatatgtttaaaactatgtggttgcttgtcttgtgtggtaggggacacttatttgatgggtgtgtgtatgtgtgtgtgtgtgtgtgtgtgtgtgtgtgtgtgtgtgtgtaaaactcagaatagaaatgaagttgaacccctgaggcctggttcacttgaatccagatccaagcaagacttgtgatttcttttaagagggagtgaagattgaagaggctgagttgtccaggggtgaaggactggctggagaagtcactcacattcataagtccaagtctgagtattttaccacagtacctggtacagactctggcagataactgctccagataactatttccggggtcagtgcctggctggggcagttactctacctcagctgaggtttggaaggaagcgggaaagaatgaaattcacaaaggtattttcaatagcattatttagtatatggtgctgtctgtacagccttaggaaagaaacacttgtgtgccagccccccaccactccagcaggagacgagagaggaagaacttaaatgaggaagatttactttggctcgtggttttaaatgtttcagtctcaggttaacccactgggtagtttgatgggcttgtaacaaggcagaatttaggattgtgtggtgaagcagacatgcttacagtgcagtcaggaggcagaaacaaacgagcgaggaaccaggggcaccataacaccctgtgaaagcaaggcccaggagcctgcgtccttcagacctcacctcttaaagttcctgccatttccagtagatcatta

SEQ ID NO: 18810 - DNA, 1179 bp, Mus musculus
tataaattttctttttaactgttgctcatttatggtctctgggtggtttcgttcttcatagtatcaccatgttaactggtaactgaaagtgcacttcgtatgtatattgttagtgatgctgagataccttgtagtgtaacattgcctgtaaacaaggttagtattttaactgtacaaatgaataaacacgttacatattactgtttgctcctgataggctagacctcttaaaagaaagattgttttttcctcaagtattcctcccacaccaaacacataccccagtgcatgacttgagaccttcaaagtaggtggtagccattgtattcatttaaggaaaaaatgttcatggtaacagatctgaaatatttttgctttgacctgaaaccatgctgctcctatatcctttcagcattgcctgggaaggaccagggccattttattttcctttttattcatagattatatgccttatatactatgattgaatcgctaggaaatgtaagctatataaccctttgaattttttcaagaacttcacagcagatgtgaaagcaaaacttggatgagcattttcatgtgctgcctaggagggattgtgtgagatgggtacagaatatatttagaaagagtagtttatggttctacaggtccgtctttccatctctgctttctggtttggaagcataggagagtgctgtggcgtgaaacctgctctgagagcatcctggtactctcccaggcccactggagagttcacttcagagtgtgtggtcccaaagcactaagtgaaaagtagtctttatagttcatgttcataggaaagatgcccatataacactgactcttcttgaacaaagccaaaaaatggggggaaagctgttgcaaagccattacaatgaaaacgtgtagagcatgagaggtgtgtgcgtggacatactcacacttattgtgtgaaattgtcttctgcagttttctgttctgaacatgatgaaagtgacgtattcgggttagggattattgttaaattaaatttgagagagatgaagagcttgcaagtctgttgattagaattaaacaattacaaataacataacctgtccatggtgctggaatagaccccacagcaaggggcttatgttgttttcatattttaaaacaaaaaatatattaatttac

SEQ ID NO: 18811 - DNA, 1131 bp, Mus musculus
ggaggctgtgtgttgcctagagaaaggcgggaacctcagggcttcatgtgaacaattctaagtgcataaacccctgttttctgtggtataccttaattagctattgcatggaaggcagttttgattttcctggaatctaagcaccaaagcatgtgtttcccaaaggggttttactaggctcttacaggccaagtggatgctatttcatttggctccttttcatgtataacaggacagtgctaactggaattctctaagtaccctttaaatacagcagagtaaatgataccatatattccctaaggataactgcggaatttcagatgacagaactttactcagtgaattgcaaaaatctaggttgacatttttgcttaattgaaaattttgtttcaggttttttttaaaaagtatcttgtacattcctgatatctaaattaattactatcttaaatcattatgatgagttcactctccaggtaactcaactgcagtacaaaacggttttctttaggcaatcctgtatcaatcaatgctgctctaggaatagtttgggaaaagttactgtgcatttgactttggacttttaaaggaaacgcagacaagtggaaaatggcctgttttcaattatgttgatctgtgtgcatggtattggagcattacactgttaatgtttagtcccaaatgttaattgtctggaatccacgaaaaacagctttatacatttttgagctgttcccaagctttgtcttgtgatagtcaggaacattactatgtcatgaaatacattgtgttcaaacagcagttggctttaagtacctgacttgccagtcatttaaaaagccgggggccaaggtaggcaagatgaggtaaagacattttggtacagtgagcatattggtttttatatcagtatatgtttgactaaagcaatactcgtgtgcaaactctgtaaatgtattagttctattgtatcagaactaagtacagagtgcctgctcccttctttcctgacctacagacaattgcaccctgcctgccgggcaaactgaaaatactgtacttaaagaggtgtgatttttgctaagtcactgttttaaaggatttacacctaagggaatcttatgtggg

SEQ ID NO: 18812 - DNA, 1112 bp, Mus musculus
gggaccgtggtcgatttccagcatctacacttgctgatgcggtggtggattctctctgtgtaacttccagttcatttagattgcttttaactccttgggaatcgtttctgtcatggccgtgagggggagataggcaacaaatctcaagctgcagatcctcccctcagtctgaggaacagcccaatcattccataggagaaaggctagaggcgttggcgcgtcgccctcctcatccccagggggcgccagcggcccggagccagcctcattctcaagcgcacgctctctttagcagtgcggtggcggctccagccacgactcccggtcgcgtcggagttccccggcagccaatcagaactctccatgtactaacgggggcggggctgcggagggcggaggaagatggcggcgggggctaggtgaggtgttggcagtggcgaggggctcgggcgcggggggtggggggacgcggagcgatggcccgcgccggccgctggggcggataagaccctgtcgcgccgcgggtgtgggccggagggaggtgacggtgcccgagcgccacaggagtatgacggggctgtacgagctggtgtggcgggtgctgcacgcgctgctctgcctgcacctcacgctcacctcctggctccgcgttcgcttcggcacctggaactggatctggcggcgctgctgtcgcgccgcctccgccgcggtcctagcgccgctcggcttcacgctccgcaagccccgggccgtcggcaggaaccggcgtcatcaccggcacccgcacgggggaccgggaccgggaccgggaccggccgccacccatcctcggctgcgctggcgcgcggacgtccggtccctgcagaagctgccggtgcacatgggcctgttggtcacggaggaagtgcaggagcccagcttctcagacatcgccagcctcgtggtgtggtgtatggccgtggggatctcctacattagcgtctacgaccaccaaggtgaggccgggtgggaggtggggtgaccgaggcacttccgagtctgaggactacgtttctagctagtttgttcccggtcgtcctgcgaggccgccgccctctccaggccctgcgagt

SEQ ID NO: 18813 - DNA, 2711 bp, Mus musculus
catattcctcataatttatcaacaaacacaaaaaagtgtcttacttgagagcgaatgagtgtgtgtgtgtgtgtgtgtgtgtgtgtgtgtgtgtgtgtgtggaaataaatttataaatgggggcacattggagaatggagtatatagactggagttcaagcaagtaacagcagtgtgtgtcttaggaactgagattccagatagagaggcttcggttcctgctacttccctgtttgtctggggagtagaggaatgagtagaactgatttagttgtctgtggtgggtggggataatttttgtgcagtcttttttagtgaccaaactttaattttgaagaagaatatattgacttactaaggggaagtattctcattttgagtgacattcagaggttcacgtttgcttctctgccgagcaaagggaacgtcctcagatttccgtccatttcatttcttcattagagtaaacagtgggacttgggaggattagtctggtgtctattctgggctagagagatcatttgacgaaaaaaaacttacactatttgatgtacagaatagaaaacatttaaatattgaattaggcactcaaaaccaacaaagagaatgagcaatcatcttaaagatggaacctcttaaaggacaactttgatttccttcttcgtgtgaagatgctggatagtacccaaatcacttaaaacctgtttccattcgctttttacttaaaaataaacatttgcgagaagttaccaaggcagctcttgtcctcagaaggaacctgctcctcttgagtggcacctgggattttctcctcccagtaaatctcagtgatgatgtcatggtgattgagtaggatgaggcctgtattaccgaagtctgggagcataattgaacttggtcttctgtgttctagagaacagcactgctctgacaagtgaattcttgataaatggctaatgcttttctctcacactgctaatctttggatggaaaccattctttatattgatggacagttttcagaaaactatcaacaggtgtacaagagtcatgttcatttagaatagagcagtgtaaatgctaggcctcagaaatctgaaaaaagatagcaaagaaagtgggtttggaacgtatggtttggaattgcttgtcagactctgaagaagatgtgtttcagcttgggattacaaaccccatttataatttttaaatatacttgaaataaaatgattaaaatgaattttggtccagtcacattactttgcacttcttcttcttttttttctttttgtacaaaattttaaagacttaatttattgccaaaattctgtgtaaagtgacagtgtatctaacagttgttagagaactccccatttctgttcccctgtgctgtgtatggtctgtgttcctctggtttgattccctctggcggtgggggaggggcggagttgtgtgtaatttaagacaatttaaggtcttttctaaacacgatagttataaatgtcctttttagatcttctggggtatgcacagctttaatgaattaaatttactggaatcaattgaaataagaggactcaaggtttgttctaatgaagtttgtcaaattactctttggaattgagccaaaatcctagagttgagtttttattcttccttccttccatacaacaaaacaagtccatagcctatgacccaagactgtttgtggccttaggaacaattgcttaagcaggtcaagcattttgaatttcaatgtaggccttcaggatcttctcacatgaggtcaactgctaatgcaatctctacacttcaaaaagcactgatcgttctccagttcttgccaagatcatcccaagttggatatcatcaaaactatctttgtgctcccaaaacttggtgttcatgtgtatccctttaagttgtttctccttgacacgctccacaatggcaaagataccaagtcatacctactcaacagatggcatgggacatatgaagaaatggagacattaacttcgttctaaagcctgattgtagattgctccttaaaactgaacagttagtgtttgaagttgaaatgctgaatataatgtgaatagcaaaatctggtatgttgtgactaaggcttaagagtgcctgtttctgacaataaaatgttccaatattaatgaacagtgccaaatacactgtgcatatctataattttccatttgaatgtatgttaattactcccttctatgtgatggtcccatgcttagagtcagtgaagttcttgtgatgtttgttatgcttgtagattttggcaacttgtaaataatgtgtataccaagtttttatgattaaggaatcaaatttattgaattttattattgaaagttgaaataagatgtatgaacaaaaaaaaatcaataaaagaatatactcttttcatggactgtagtagtatgtgaatgttacatttagtttgaacagttctgaagtataaggagaaatgtatgaccagatagcaatcctgcttttagatagtatgctcttgattggaacaaattttcatttttttaaaaatctgctaaacatttgcaatcttacatttgtattttaataccagagtgaggtttagctttgtctttctgggattctcaggttccacagtaattacaagctgactttttactgaacataggaatgttaaaaacaaatgtgtaggt

SEQ ID NO: 18814 - DNA, 1163 bp, Mus musculus
tgtcagatgttgtagattccgacataattgtacataactatgttcctgatgacccagattcagttgtaatccaggatgtcattgaggatgttgttatagaagatgtccagtgtacagacatcatggacgaagcagatgtatcggaaacagtcatcatccctgaacaagtgctgaattcagatgtaaccgaagaagtttctttaacacattgcacagttccagatgatgttttagcttctgatattacttcagcctcaatatctatgccgaaacgagtcttgacaagtgaatctatacatgtgtctgacattggtcacgttgaacatgtggttcatgatagtgtagtagaagcagaaatcatcacagatcctctggccactgatgttgtctcagaagaagtgttggtagcagactgtgcctctgaagcagtcatagatgccaacaggatccctgtgaaccagcaggatgaagagaaaaacaactgtgaggactaccttatgatctcttgtggaactgtagatattgtcgaaagtgagcctgagaatgagcttggagttgaactacttgatccaaacaatagtatttgcgttcccagggaaaagatggtttatatggctgttaacaactctcagcaagaagaagaactgaatgtcactgagattgctgatgaaatttatatggaagtgattgttggagaggaggatgctacagcctcagagcatgagcaacaagtagaggacaacaaaatgaaaaccttcatgccgattgcatgggaagctgcttatggtaataattctgatggaattgaaaaccggaatggcactgcaagtgccctcttgcacatagatgagtctgctggcctcggcaggctggctaaacaaaaaccaaagaaaaggagacctgattccaggcagtaccaaacagcaataattattggcccagatggacatcctctgactgtctacccttgcatgatttgtggcaagaagtttaaatcgagaggtttcttgaaaagacacatgaaaaaccatcctgaacaccttgccaagaaaaagtaccgctgtactgactgtgattacactaccaacaagaagataagtttacacaatcacctggagagccacaagctaaccagcaaggcagagaaagccatagaatgcgat

SEQ ID NO: 18815 - DNA, 1128 bp, Mus musculus
ttcttcctgtctagctagcttaaaccaaaattagcttcctggggtctggactatgtattctaaagccagaacgggcagcaatttctataattagtcattcattccctcaaagactgcaccgttctattatcaatccctgtccattcctgttcaggtctcattctatatcatcccatctctaccttctggacctaacacattttcttcaggagtatgcagctgggattgctcactactcttgcttcctgtctgagtcaaactgtaaaatgagataattcacgtagcagcaccctgtgcaaggcaagcacgtgacctgcgaccatgtccactctctggccttcccctccacagaaactcagaaactgggcttgctttcctgtcaaatggagccctcagtgttgagagcatggttttatttctagtcctttccctgtcatcattttcacagagaccaacaagtgttctattaatccagccctctcctccaaatatatgccaaaataagtaggacttgaaattgtgtccaagtcatgagagcagttttctgccatgtaagtggaaaagaaattacaaacagaagttggatttttcttgccttttttactactgctcactctctggtcacgacaggctttctctgatgataacaacacttccatttggctctgtttgggttttttccttgacagctcagaagtcatgtttcctctaggtatccagggtgtgggtggttaaaaagaattttccagaagcttccagatgaagcacctctcttagaaatgtgtgaaccaagccaccagctccctcaaagtacagattttaatgagtcatttcaattttaggaagcacattaatctaaaaggtgcatgagccagaaagcagaattttctcaagtgggagttagaaatagtccttgttacaggcagaggggagctctcctctcactccttgtatatgaatcatttgccagatcctcacatgaaaagatgctgacttaggtcactcactgtccctggacgttgccacccacagtagtttcaagaataacagcttgaactcctattggctggttcctctgtaaacgctgcacagtgtgtttaattcactttgggtcaagccattgaatag

SEQ ID NO: 18816 - DNA, 1193 bp, Mus musculus
ttgtgtatcaagcctttaacctcctaggaagtgttaaatagtattttacttctagtctgttcatgctgagtcattctaacacagccacatagaacacaggtagattaatagctgtcatggggaagacatggttacctgtgcaggtaaaatgagctgagtcacgggcataataatgccctgtctttgtatttgactaggcaaaacttaaaagaattttatttttaagagcacagacccttttaatatttggaataagattcttgtctaatgttaacattattatatcttagtaatgattgtggggtcgtaattttgataaactgaatttaactttcagtagcttgttagaaaaatccaagagctagaacatattgctaaaatggatattggacagttctaacttggaagctcatgtccagtaccgttcttgtttctgactccgtgggcatctctgcaaggatatttgtaaaagggactgtttcattaaagggtgttctttaaatatcagttagagttcattgagcagcgggagctaactaagcagctgggctgttttgcatagtactgctgaactcaagcatgcctctggttctgcttgccgaagctctcatctagagtcctgccactgcatctgtagttacagtgataggatgttctctgagtgagcatgcatagcagatgacattggaaccaccttctgcccccctttgtttccatctctgacagtggtcaataagccaagagaaattctctattgggtataaagtctaaacctttcaactttgccctcccccaaaacattgatggtaattgctgtatgaatgtatcatacatttaatcatgaaagggaaggatttgagatttcttatttaaaggaaatattgaacataatagaatgtactttgaaatcaataagtcatcggcaacactgttgcagctgcatacagagagaaccttttgtgcctttgtgcctgcagtgtttatttctcttacatgaactataagaatgttgattattgcaccttgttctttggtaaatatacttaagaatttttctaaaaagagccatttcttgttagatgatagagctaccttagtaaacatgaggggatgtatcatatttgtatgtgtttgaagccttttctatatagagagcaggaaattccttttaaatgtattcatttgtgtgtatg

SEQ ID NO: 18817 - DNA, 1225 bp, Mus musculus
ccagctcacctctatagaagacactagttattacagtgcctcatttctgaggctatttttctttacctaagtagtggggtgatagtgacatttccagaaaacgaggctgcattgtgttaaggaatagtgctggcttgatagctacaagttgaaagagaaaaagaagccccccttttttattcagcatgacaaatttatagaaactgaaaagattctaaatttgaaacctaaacaggatcagtgcagcacggtggcatagacctgtagtcccaacacttgggagactggtacaggattgaaaccacctttggctaccttgcaggaccatctcaaaaaccaaactgaaaaagaaaagccgaatctaaacaaagctcctctttctcttttctcacttgacttggccttctttatcatcttagattggaacaaatagtgtgcttattaagaaaatggctacaggccagggagatttcaggttgaggtcctagaaaatgataacttctgacctttctcacttcccagggaggaatgaaatattggccagcttgtgtcctcaagtttttgggatgtatctagtgaagcttgctgtggccatggtactggctggtggaattcaaagaactgatgctgcaggaaccagggttagaggtcagtacctactgatacattctgagaaatacgaacatgtagagggcaagggaggccctcacctgcttgttggagggtgagttaaaatggcaaaggtttgaaaatgaccaaataaaacctattacttaggatagtaacttcaagaaattaattttaaaagctgcctctagagctattttctaaatgtagtttctaattgggtttttcatacttagtctatatccatatttatcagaggctactttctctaattctagaaagatgaaagaaatcactagtttttcagtggttatatactacaagcctaattagctctcttggagggaaagggagagagagtgtgtgtgtgtcttaatgtctccaagctggtttccatctgtgactgtcaactgctatgcagtcatctgcctgctgattctcctgctggtagacagcaaatatgccatctgccaggagttactgctgtaggtcacacttgaagcacagactgcttcaagcgtgcaacactatctggatggcacaaagctcctgtgcagcaagcaggacacacacagagctgttaaccagtgaacccaca

SEQ ID NO: 18818 - DNA, 1162 bp, Mus musculus
ttcagaggccgagcgagagcagcgcgaagaagcctgcgcgcccccgcgcaaggcggccccctcgagcggccgcgcgcacgccccgccccctccaacgccgcgcgggtcgggctggggcgaccacggccgcagcgcggtcccggcgaccaagacagtgcgtgttgagcccgtaagtgaccaccgcagcgtgaggtcccgggggatcgtttccctcccgtggttagcgtcaggtctcgtccgcatcctttaatttctaaactccccgcagggctgggaggccacagccaaccacctgtggattagaagcgaatttccaaatgctttccaaagcatccctccgctaggctctcgctcgccaggcggcctggaggcgcgcaatgagcgcgcacccgcgaatggcgcgcaacgcgggattgagacgcgcggggcgtggccacagctcccgaggggcggggctacgcgagcctaggtgagggacaaggctctatccccaaactgctctttttggcgccaccttgcagtggatagtatgaaataaagcaaagccattttatttgtttggatgccagaggcaagaggagagagaatttgatagttgtacaaccatcgtcccccctcccctagacagtaaatggcttaagtttgtaacgggatgcctgagtttataggttgataaacttgtctaattgcacggatgttggaaaaaaaaaaaaagaagaagaaagctgtgtttaaaaaatatcggtctgtttaacactgtaatttaccggtttaactaggcaaacatttaacctgcccctgttaggaacttaaaattctttgcccgccctctttctgcgctgttggagttgggtatgttgttaattgttgtttcggatttctgctctacattcactttgtatttgtaaaatcgtaaagatattcctttggtcactcttgagggtagtgctgtgatttttttttcccagctaagatccacatcatgaaatactatgatccctttcccaaataatctctttttttactcttggctgattgattatgctattacctaaccaaaaccaagtcgcttagtattttagtgttggcttactttgactgattctctgaaaaatactctcttaatctcataccagcctcctgtacttgtcagtgttcttgg

SEQ ID NO: 18819 - DNA, 1175 bp, Mus musculus
atcccatctattttttcgcattagttgatactaaggctgtgtggttcaaaaagtggatggtaaggaaaaatgttttctctctatcatttgagggactggcctgtgtttctgtgcttggtgtgtgctgagttctaattgcttttctgcatgtgttaatgcctttaacctgtacacggacaggtgtgatggtagatagacatcaatctcccatttagaagctattttgcccaggattttttgtcaagtcagggtcaggatagttttttgtttttgtttttgtttttttttttttatttttgcagggggtggggtgtttcgagacagggtttctctgtgtagccctggccgtcctggaactcactctgtagaccaggctggccttgaactcagaaatccgcctgcctctgcctcccgagtgctgggattaaaggcgtgagccaccacgcccggcaccaggatagtcttttaagtggtggtctatttgaatcttcttaaaaggaatgatctattaagggttctaaaagtcacgaatcaaaaagcttcaaaaattttaaatagatgttttaagacatgaacattcagggctcatctcccttgggtgtagaggataatgcctagaatcagtttctgtttactgcttcctgaacctggactgggggatatgtttaatgcctgaagtggcagtttccactgaagcttatgacagcccaacactgaaagccgtgtttaagcagtctttctactgtcgcccctgtcagctgatgtggagtaacagtccctctcggagcaatagcagcagcaaaatacagacttctgtgctgatgtccttgtctttctcactccgtctgccaggctgtaggttcttgtctcagtggagcagagagagggtcagggacctaccatgtgagcgctgacccccctcttgtagtcctcagcagggcagctggatggccgaactgcctttgccttttgatgtggatatggtatatgccccattaattagagcacaactctgtctctagtgctaagcccttacgttacctatgtaggaatgtctgatgaatcttttaaattcattatttttacttaaatcaatgtaattgactagcctgaatcttttgtagcccagaaaggataatttttcttaattttcacaaggatgaaactagctttat

SEQ ID NO: 18820 - DNA, 1730 bp, Mus musculus
ggcggcaaaagtagggaaaggggaggtatgtaacggtatttaatgtagaagattcaaagagcttaaattctagtaagagtctcattggatgaaacatagatagggctttctctctctgccccccaactgaaccttaagaatggttctgtatacatgagtgagtgggtgatatatattttttttaatttttgttttactgagattctgccatagagctttgagcaggaatccaagtcctcaacatggcatttcctttatgaaaagacaggttgtcctacatccccgctaaaaaacattccagtgtttaaaaacttggcagtttgcaggcgagcttccctggcctgaccctctaggtgtggatggaccttatgctactatacacgattttcattcttggtaggtatcaattcgaagttcagacaaggttcaaagaaaaagattgcccatgtatttgcatctcagtgggttctttttcaaatctgtcccacctttgtgtcttccatatattatcctcagctggtcctcaccctcaccaaatgatttctatcgacatttttaaaacagtgagaaagtcttttttttttttttttttgagttagcatcagggaggcaagccatgctcaatatttaacaatcgcttctgtctatgtgtgggtgtgcaagtgtgtaagcgtgtgttttgtcattattggtacaagcagaggcagtataaactcacagatttgaatcgaattcacacagtgttcaaatttgaaccttcctcatggatctttgtggtgtgggccaacgtggtgtttacattatagaattcctgccgtgcaaaagtgtaaagcacacactttttccctaaaatattttttccacgtatcctattatggatactggttttgttaattatgatttttttttcttttttagaatgtagcagtaatagccattactgaaatgaatgatttcctttttctgaaatataatcattgatgcttgaatgatagaattttagtactgtaaacaggctttagtcattaatgtgagagacttagaagagggttgcttagagtggactatcaagtgagcctaaaggaactttgtagtaactggtaatctggtaatttttgtcctacttaactacacattaactcagaacttgtattctgagtttaacagtcttttagattgacgagcaacttggatgtttgcactaagattttctttgagatactagagggggtgaaggagttttcagcagtgcacatgtaactaatttatttgaactgtaagctaaagacacctaccagtttcttcaagtgacttaaaaaaactcatcacagatgattgaaatgtcgagttatcatgtttcctcttgcgcgccagctacacaaggagtttttggacaatgagaaactaatttgtttgacattccatgttaaactactgtcatgttcagcttcattgcatgtaatgtagacctagcccatccaatcaatgtgctcgggaaagtgttctttattcaataaaattttaatttagtataataaagataacctgcatgtcttgtgtgatttaaaaaacaaaaaaaacaagaaaacttaccaaatttattcaagattaccaaaagtagatcccataattacaatgtcttgggctaatgaaatccacttttattttattttcatcttttgcttgccggtatctctgtgcaatggtatgttgctgcttgcagtggccag

SEQ ID NO: 18821 - DNA, 1647 bp, Mus musculus
catcaacacaaaagaacaacaacaacacaaaagaacaacaacaacaatacccccaaatcctaattacaacaacagaggactctcggctatgtaataagcaactataagtgaatttcaaatgcctcaaaaatgctaaaggaatgtgaggaaaatgtttccccaaaggagattgaaagatggttgagaaagccttacatggtgcatgtatcaggttgaagtctggacttagtttgcaggagatgggagaaataacttgtgagcaagtttgcttctttgttttggaatatcagtttgaaaactgcttataaaattaggaacaatgatctcgtaaattggggtttgtgatggaatgcagggagtgctgccttcctctgttatgtttctggcaatgcttgtctattcccatagcatcacaattctgcagcactcatcatgggattttgttataaagaaacgtttcgggcgtgattccgtcgtgcgcgtctgttctgtggaacaggaggcagttgttttctgtccggcttctcccacaccgaagtgcgcgcctccacctcatggaagactcgatggatatgtacatgagtcctcttaggcctcagaactaccttttcggctgtgaactaaaggctgacaaagactatcactttaaagtggataatgatgaaaatgagcaccagttgtcattaagaacggtcagtttaggagcaggggcaaaagatgagttacatcgtagaggcagaagcaatgaactatgaaggcagtccaattaaagtaacactggcaactttgaaaatgtctgtacaaccaacagtttcccttgggggctttgaaattacaccacctgtggtcttacggttgaagtgtggttcagggcctgtgcacattagtggacagcatctagtagctgtagaggaagatgcagagtctgaagatgaagatgaggaggacgtaaaactcttaggcatgtctggaaagcgatctgctcctggaagtggtaacaaggttccacagaaaaaagtaaaacttgatgaagatgatgaggacgatgatgaggatgatgaagaagaagaagaagatgattttgatgaagaggaaactgaagaaaaggtcccagtgaagaaatctgtacgagataccccagccaaaaatgcacaaaaatcaaacctaaatggaaaagacttaaaaccgtcaacacctagatcaaagggtcaagagtccttcaaaaaacaggaaaagactcctaaaacaccaaaaggacctagttgtgtagaagacattaaggcaaaaatgcaagcaagtatagaaaaagcgcattgaacattcctgggcactactggtaaattaagcccaaagatggggaaagaggaaaaggagaaacaaatatagtaccatcaacaatccagacatctcaatcccctttcctgattggccatccatccccccttgcaggctggaagcaatcttgtttttcctaaagcacttttcttttactcttgtgatgcagaactttacttctctaccacttgtgcatatgcctcatttctttgaccatgttttaacctatgtatccttagctgctctcaataaatttttaaatgaatcaaaaaaaaaaaaaaaaaagaaacctttcctggtgatgggtaccac

SEQ ID NO: 18822 - DNA, 1098 bp, Mus musculus
tatggagggtatggcaggaccatcatgattccaggagctactgcacattatcacaaactccatacaaaggaagcttaaatgaaggggcctagtagcttgatagcttagtaacacaagccattaacctacaatcactttgacttttcctcatattgtaggtatgagccttctcgtgagatgaaaagtcagtggacagcagtctgggtgaaaatctcttccagttggattggccttgtgctgtacgtgtggacactagtggcaccacttgttcttacaaatcgggattttgactgaatgggatgtctggcatgagtcccactttggccattgtctatttgacagtaacagtattcccaatttttgtaaagttgtatgtgctgttgtgtaagtgtaacactgtttttctcttgcatgaaatagatttactctgccaattttatccatgttcttgctaagtctattgatgatatgaattggaaagggagaattttgaatatggtgagaaattgggaaaaatggacattgataggcatatcatctgctttgtgtacatatggtattaaaactgaaaacaaatattcttgacatttgggtttcaaaattgtgttagcacttattttagaaacattaattaagtgtatggctgcctttgaaatacttgatgtgttgttgttgccttacagaggactacaagtataaagcaaatagctgttttaaaattatgtaaataagtcacaggctagttatttgaaaactctaagtcactttaattttgtcagaatcttctcttactaggtaggcccaggatgttccatagttagtggaaaacagtacaggaggtggagggaagctaagcaatagacaggagccgtcacaggaagtcactggcaatacgggtttaaagcaggtacttagatcacggttttctctgtaagaaaatatggccgtcacccccgcccaccaaaaaaaaatgatttgctctttgtgaacacacaattatgaatttcatggcgatgttaacaattctgcatttagacaaggttttgcaaaagatattgtgttagaaaaatttgaaactaaaagcttcccaaacaaaat

SEQ ID NO: 18823 - DNA, 2227 bp, Mus musculus
caacaaagagtgctcagatgagatattttctccctctaagaatgatccagcactcaggagacagaagcaagtggatctctgtgagttcaagaccagcctgggctatagagctagttccaggacagccaggacttcacagggaaaccatgtcttgaacacacccccctccaaaaagaattatttaatctttataatgactagagaaccttaagagaacaaagctgaaactgagtcagacatagaagttacacacacctttaattcagcacttgggagtcagagcaggcagacaactgatttttaaggccagcctggtctacataacaaattccagaattccaggtcagctgcagctacataatgagacctagtcccaaaaagtaaatgaatgaatgactataggggaggtgacagaggcaggcaggaagcagcaatggcagcttgtaaaaatggttgggcaaaactgcaacttggagctgcctggcagcaagcgtgtgtgcttctgcttccgcctctgtgtttgtgcccttcctctatgtgaaactgtcctggtcacttggtttctgtactgaattatatttatgatgacatccaaatacttttgcatctctataggtttccactttgtcaagcgccatcatgtcgagcaccagtggctaattccacttctgtagatcatataatacttgtattgcacttaggatatttcttacacctctgtcaggtttttaagtgttcctggatcttaggagagtaggccagcttctctataccacaaaataacagtttacttaaaaacgttcaaattatcctcaaagatgggcaggaaagggactggaaagatagcccagtagttaacataaggactggtcttgcagtttcagtagctctgattccaggatcgcatgcctctggcctaagtgagtacctgcactcggaaacataccccgttctactcccaacatacacaaatttaaaaattaacagggttattggattttggttgggttttgagggggagttgtttttgtttttgtttgttttttaaggtttgtttgtttgtttgtttcatgtaggtgagtacactgtcgctgacttcaggcacaccagaagagggcattagatccccattacagatggttgtgagccaccatgtggttgctgggaactgaactcaggacctctggaagagcagtcagtgctcttaaccgctgagccatcttctccagccctgtctttgttttttgtttttttaacttcctactacttttcaaattatctctctccattttttctggtactgttttgtaatgtctagtacttcttagtgttcctgatctgagcttgttttgataaagttctatttgctctggacatcctgatagcctgcctctgcaagtggggtgagggaaggggtcagtgcaggctgcagatttcccccctgctcccagactccgagtgctcccaaagcacatgtccccagagtggaaggaggaagtgcacttgccccagctcgtggctctggttgttggtttagtgcttctgtccctcgccagtgtccagcttctctgtgatgtatgagcttgggcaggaatgtctctctatttctgtcttcacactgtgtgcttctgcgctgcttctccctggcagtgtttagaaacctgtcacctgcttctctgtttactctctccctgagttagttagtagctctcacgcttgtcttcgctccagttttgttttcatggggcagggattgctcggggagaagatgggaatatttgtgttcattttgcatccccacactctctggtaactaacctctaaacgccagcttctcaagagtgaaataagaagactggaaagaaaccaagagcgtgagaagtctgtggctaacctggagtacttgaagaatgtcttgctgcggttcattttcctgaagccgggtagtgaaagagagaggcttctgcctgtgatagacaccatgctgcagctcagccctgaggaaaagggaaagcttgccacagttgctcaaggtatgtgatgggacgcagtcactggtgtgcgatcctgggcactaaccatggctcgtgcataagaattgatgtgtgcctgtaacctttttctgttaaattttattcacttggattacttttgtaacacacataactggggttgaaaagctggctctttaacacttgagtctgttgcagtacatcaatgagttcaa

SEQ ID NO: 18824 - DNA, 1134 bp, Mus musculus
aatagtcttaaaagtcctctggtctcagtagtggtattagacatatgttcgggtcacaaagaaagagaccaccactccaactgaagtgtcatacactttacaaggcaaactttactcttgatcaagagagtgtgttgggaacaccaagatagtaagcaaaggtttcattgggtgggaaggatttaaatagtttcctaaaattcttacaaagtaggagagataaaaatattttagttctttgtcttaaacacaagttttatagtatttgataaaaaaaaaattcacatttgctatttattacagtggtaccagaactgtttctttaaggagaaggcagaaacttttgggagcagtatttggacaccataaccattaagtaggctaaggccagaggcactgaatgtcatgcctagggcttttggaatggttaaaaataaaaagacaggaaagaaaagggaaggggaataaaaggaagccatataattacctgagcaaattatctgagcgtagaccctaacagtaatcataaagtactcttttacagtgtcaggaaaacttgcttcttccaaaataccatggaattatagatcgactgaatgagctctgtttgaaactttaagtctttacgtttgtgtgtgtgtgtgtgtgtgtgtgtgtgtgtgtgtgtgtgtgtgtgttttggcatatatgtgccacagcatggaatggggtcagagacagtttgggaccttttatgggttttaaggatcagactcaggttgtcatgcttgtagggcaagtcttttacctggtgagccacctcccccatccccctctccttgtatttatggatgatgccccttcaagaaagccctttattatttttatactggtgatacaacccagggccttgtgtatgctaagcacacacttaccatttggccattattttatccttatttttttttcctttttcttgtttagaaaatcaagtcctttaagataatggttaggatatattactaagttttttattttgttttaaattgaagagtaatgaacttgttatgggaagcctgctagagaagaccactcagacacagtctatagccaattgaaaaatctttattccaactggctgaggctacacttagg

SEQ ID NO: 18825 - DNA, 1134 bp, Mus musculus
agtcttgagagttgctgagtagtcattttcaattccctaccccacacccctgtccctgatacacctaccttttatctttatgtatttggttataatagatacctctagaaagtggaaacatgtagtatttatcccgtagtaacctggtttgggtttttgtttttaatttggtggagaaaggtcttcaaggtccacccatgaatcacatgtgagaatttcctttcttacaggcagtcatattccatcatttttctgtagcacatcttacttattcattcttacgttgttggaaccttttagattttttttccttcctgagacagatcttaagtgtaaactgctcttgaactcactgtaacccaggctggcttcacactcagaatcccctcacccacacttcagctttctgagtgctgagagtacaggtgtgtgacttttagctattgaattgttctcaccttagtgattctttgagtaaattctaatttcagcttttgtgaatgatgctccctggggaaaatggcgggcaactatctctaagaactctggagtattatccagaggtagaatccctgagaacagtggtcgattttctgtttcgttttgtttgataatgagtgggattaatatctcattatagttttgtttttctaggaaaaatacagaatatcattatctgcacctgtttcttttttggtttttggagacagagtttctctgtgtcgccctggctgtcctggaactcactctgtagaccagactggcctcgaactcagaaatctgcctgcctctgcctcctgagtgctgggattaaaggtgtgcgccgccactgcctggcttctgcacctgtttcttgtcctgttaagaagctaagctcattttgtttagatcttttgcccattttttttgttgttgttattgtctatctggttgttggtgtagaatgtgtgtattctaggtagcaatcccttctaatatatatgactttcagatacgtcttccaagcctattggttgtcagtgctgggaattgagcagggcccaggaagagctctcaactgctcaaccctctctagcccttaaaaaattgttttaaatgtattgataacggatacagatgaacgagttgccttgt

SEQ ID NO: 18826 - DNA, 1099 bp, Mus musculus
gcagatttctctctccttgtttggttttcccagtgtgtgcctttctcccccatcccagtcgatattaacaggaaaggcctgttggtaatgaatgctgtaatggaacaatgattaacaaagagtttcctcactcatttcctctaatactgtatcctgattattcaggaaggctgggactgagaagtgaagactgaagagaggaaactccaaagccagcctctctgcttatctactgacccacttgtctcagagcaattcatgacagatgtataaatcaccaagtgactgtccagcatctgcatttctgaaatgagaccatcagctaagttcccgattattggctctaaagcaacagttattaagcctcctccctcacccctctgataagaatatttacagaactccaaaacctacacagaaagaagcagggctgttgccatggggctcatcttctcccacaccacactatctcctgggacataatgtttcttgcttattgtatttgtggtgataatcaatgagaagcatcgcctataggctccttcatctgaacatttggttccccgctggtggctgtttggaaaggttgtggaaccttgagggaggaagtatgtcactggaagtgggcttgaggatttattgactcaccccacttcctgctttctttctttgcttcctgtctgtgaataaaaatgtgatcagccagcttcctgctcctgccactagggcacgccttccctgctatgatgaactctgtccttctggaactgaagccaaaataaaccctttcttccttgagttgcttttagtcagagtttcatcacagcaacagaaagtaactaatacagtattccttgttttaaattggcttgggggtttaatgtaattatctaaactatagtgtttatggaaatttgattcttcaaaagttatagtttctggtttgttcttcattttatatcccaaacttttctgggttaatttatgggattccccagactctggttttttgagacagggtttctctgtgtagccctggctgtcctggaactcactctgtagatcaggctggcctcgaactcagaaatcctcctgcctc

SEQ ID NO: 18827 - DNA, 3060 bp, Mus musculus
gtcagctttcacgggactcacataagctttgcttccctgatcgcataagaaaatcatttcccattcatatactgggaactgtatgggaagataagtgcccaaacagttcctatgttgtcatgtgcttatccagttagcattgtaaaaggaacatgcatattactaagaagcaaaaacatttcaggatgactgatttctttttttattaaatcactaagcttagttttctattttgttctccttataaatttttccttcataaaattacttaacatacttgtaactactaatgcatcttttacatttttaagcaaaacaaaacaaaaatttgccagttatctggaaaatattgcatacattgtgatgttggggaaatgaagcattttaaaactatattacacataaaatgcatagtattcaaatgggacatgaaatgcactataatgcagcttcgaatgtatggctttcaaaagtgagcgtgagccaggtgtggtggcactaggcttcaatcccagctctctgcaggcagatctctgtgagtcctaggccacccagggctgcatattaaaaccttgtttcagaaagaatgactgtatctcgtattatctttgtgctaatatctatacttcatacataatctaacttgccttgccttagaaaactgcatcctatatcaggaattctagatatttcttataatatcaaaatgagtattttgattgagattcataaatttagaatcattcaccactgatacatactttaaaaattcttttctcaggaagccagtgaaagttaattcctgtcctcttattagaactatgctgatatactaaaacattttaatgaaggcttttttatttcaaatgtcataactgggttttgtttactataaagcagtaaagcagtataaatgatacctttagactgaaagagggtggtaagagtatcaactctaaggaaaaattggggagttctactttataaaactgtttatcctgaaatgtctgggccattctgtttgtatgaactcaatatgcaagagtatgaacattttttaaatttttctgctgctaacatgttaccttctttttcagttgccaagatatattttgcaaatactgctgaatataatgactcacattgtagtctcagcatttgggaggctgaggcagaaagattaccaggagttggagacaaatcctaggttacagtgtgagatactatcccccaaaacatccccacaaacaaaaacactagtgtattgttttgccgtaaagaatatctctggggcctaggaaaacgttcagtcagtaatggactcacaccagccttaggacctgagtttaaacttggagggagcagatccctggattttacgaggtagccaaactcagcctaactagtgagccccagatccaagggggaaatcctgtattccaaaaagcaaggtggatgcctcctgaggaagggccgcctagactgatccctagcctccacatccacacacacacatgcacacattcagaaatatggatgtgtacacacaaaaaggatatctcaggatgctgttactctgccattaaaagtttataatcatgaatttttaaaatacttgattatgcacattatggaatacatttctgtttccagataactaacttgtaaccaatcattttatttcctaatatccttttcatattaagagaattatatgtgactaaaaatatacatgatttgtgtttgttaagcattttaaatttgtctttgcttttgacaataagaaccaaaatttcttccgtgtgcctttgtcagctaagaatgactagcagtggctaccttagaagtatttatgaactattgtacatgcgtttaggcagatagaacttgtagtctagcgtcttgatgtaacttacatacctcactggaagtatggagcagaaaagcactcattcccgtgctttccccatccctttcgaggtgtgtggccttgcctgactgcctttgcttacgtgacatcgcttaagccagagtccccactgctgtctttgctcacttctcttcagacaggaatattccagtaagtttgatctcataattatgtggtaattcatctagagatggtgcttttcactgtggggtaaatcattagagcccttagtgtggaagatggaggtctaaatggggccaagacagagacttcatctacttcctattagttgtggggtttcactggctgctggcatttgtcagtgaacatctgtttgaatttctgagaacaatctgaaataattcattgtgcttatgaaatttctaagtgccctttttgtccttatcctaatataacatggaaaatggatacacaaaaaagattttttgtgtcatgttcaaagccttattataacactttgcctgaaataggtcattttgcctcatccatttgccaaattagccaatttcaagttagggaaactttgatgtaggctgacaatatccttgtattttattttagattgtaagcttaatggcaagaaattatatcaataattgtgctttttatgtagcaaccattgctgtgtacttttggtgcttaataaatattcataattattcatagtgtgttacatatcatttagtttgacctatctttgagaattcaaatattcatttagtataatatgttagaaacatcatatatgtaagtaaaagaaaatggcctgggtatggtatacaagccaagttttagcaccttttgtattaacttttcctggggcaacacagataaatgtctactcatcccagacagagaaccattctacccacatagtttgctgatgtggtgatttcactgaactaatttccagcagtttgggtgaaggctacttacaagaatttggataactttaggacagctgcatcatagaaaagctgcatccttgcagcactgggacaacctccaaagctgcgtaaatggagccccacccttcagttacctttcctcctacatattctagtgcctctcacaacacgcccctctggagcagaatcacttacatctgg

SEQ ID NO: 18828 - DNA, 2100 bp, Mus musculus
cttgtaataatcctgttacaccaagtttatctactgcacctccctcttttaagtttggtacctcagagatgagtaagcctttcaggattggatttgagggtatgttcgccaagaaagaaggacagtgggactgtagcttgtgttttgtccgaaatgaagccagtgctactcactgtattgcttgtcagtatccaaataagcagaatcagcctacatcttgtgtatcagctcctgcctcttcagagacaagcaggtctccaaagagtggatttgaaggcttattccccaaaaaggaaggagagtgggagtgtgctgtttgttctgtacaaaatgagagctcttccctaaaatgtgtggcttgtgaagcctccaagccaactcataagcctcatgaagctccttcagctttcacagtgggctcaaagtcacagtcaaatgaatctgcaggaagtcaagtgggaacagaattcaaaagtaactttccagaaaagaattttaaagttggcatttcagagcagaaatttaaatttgggcatgtggatcaagaaaaaacaccttcctttgcctttcagggtggctctaatacagaatttaagtcaatcaaggatggatttagtttttgcattcctgtatctgctgatgggtttaaatttggcattcaggaaaagggaaatcaagagaaaaagagtgaaaaacatcttgaaaatgaccctagtttccaagctcatgatactagtggtcagaagaatggtagtggtgtggtctttggtcagacaagcagcacctttacctttgcagatcttgcaaagtcaacatcaagagaagggtttcaatttggcaagaaagaccctaattttaagggattttcaggtgcaggagaaaaattattctcgtcacaaagcggcaaagtggctgagaaagcaaatacgtcttctgatctcgagaaagatgatgatgcatataagactgaggacagtgatgacatccattttgagccagtagtgcagatgccagaaaaggtggaactagtaacaggagaagaagatgaaaaagttttgtattcacaaagggtgaaattatttagatttgatgctgagataagtcagtggaaagaaaggggtttggggaatttaaaaattctcaaaaatgaagtcaatggtaaactgagaatgctgatgcgaagagaacaagtgctaaaagtttgtgccaatcattggataaccactacaatgaacctgaagcctctctcggggtcagatagagcatggatgtggctagctagtgatttctccgatggtgacgcgaaactggaacaactggctgcaaagtttaaaacgccagagctagctgaagaattcaagcagaaatttgaggagtgtcaacgtcttctcttagacattccacttcagacaccccataaacttgtagatactggcagggctgctaaattaatacagagagctgaggaaatgaagagcggcctgaaagatttcaaaacctttttgacaaatgatcaagtaaaggtcaccgatgaagagaatgcaagttcaggtgcagatgctcccagtgcatcagacaccacagccaagcaaaatcctgataacaccgggcctgccttagaatgggataactatgacttacgggaggacgccttggatgacagtgtcagcagcagctcagttcatgcttctccattggcaagcagccctgtgcggaaaaacctcttccgctttggtgagtccactacaggatttaacttcagttttaaatctgctctgagtccatctaagtctccagccaaattgaaccagagtggagcttcagttggcactgatgaggagtctgatgttactcaagaagaagagagagatggacagtactttgaacctgttgttcctttacctgatctagttgaagtatccagtggtgaggaaaatgaacaagttgtttttagtcacagagcaaaactttacagatacgataaagatgttggccagtggaaagaaagaggcattggagatataaagatcttacagaattatgataataaacaagttcgcatcgtgatgagaagggaccaggtattaaaactttgtgcca

SEQ ID NO: 18829 - DNA, 1277 bp, Mus musculus
actgaagaaagcagaacatttggactttaagcatgtagtatttgggtttgttaaggatggcatggatactgtgagaaagattgaatcatttggttctcctaaagggtctgttagtagaagaatttgtatcacagaatgtggacagctataaaataatttttcacagtgagttttatctatataagcagttgaattgatgcgtaattgttacagacagtatagtaattatgttcaccttttgaaaacagatgtttccgatgtataaatgtaaaattgtagcttatagctgttgtcactttttagtgtgtaataattgatcttgcatggtgtgaaataaaagtttaaacactggtgtatttcaggtgtacttatttttatgtactcctgacatatctatattagaatggctaatacaaattttgttaaaagcaatagaatttcccagactattgaagtaatatgatatatgcaacttattttaattcctgttaagatatctggacttcctgcatggtacttatcattgaataaggggaccataatgcagataattttattttagatttgaaatatatatatatatatatatatatatatagtaatcttagctattcctgtgctcatttatgtatagactgacatatggatagagccacagaagataggagttaaccaaagtgctcttctgtcatttttatgctcctgtgtagttaaaaattaacttttaagtaggatactgtcttttcttgatatgttgtgctcttttgaagacgttaatttttacattttaaataagttgatcatttccttagctagccttctctccttcctccccatcctcctttcttctcttccttttttccttctttccattcacatttctgttacctgtctctactacctcagaaacttcagcttggtcctgatgatagaattggatttttctctagttcttgtgataaagtatcaatatttttaaaagatctataccatgttctttggttaaagatttgctttatattagattgttgcagtacctttttctggtgaattttgtagcagaaataaagtgataattgataacagccatgacatttaaaacatttgattacttgtgcatctaagttgtctgttccttccgtaactagatgtgatttctgcccagtgctctgagtgtcaaagtgaagaaattcaatgaagcatgggtaaatggtgggagtaactatgaatctcttaaggtagccaaatgaaggagattcccactgtccctacctgct

SEQ ID NO: 18830 - DNA, 1157 bp, Mus musculus
caaacaaacaaacaaacaaaaaacatacccaaaaaaacccaaaaaaacaaagacagctgctaaccattgtggaccaaatgtcatgctaccactaaacaaaagacccactcagtctgtgttaaattgtatgtctttttaaagatatttggagatccatctaagctttaaagagggccgggcagctggagaacctgagatacagacctggttctcttgtgttagctgctctgtaagcctctggatagcaatagctaatttattatttcattttttaaaggctttaaagtgcctgagggatgccctgaaactaattttctatttctgggattccctgggttctttataagagatgatgacacgactagggatttttttttaaagtatgaaaattgtccctgcaatacttttctcttagtggcattgaattatcacagagacagaaaattggtaaatttttaaaatttctaactctcccaggaaactccttgcctagtatttatttgatatgctttaaccatgggtgggggggtggacctcaagctgccagtattgatctacagactgtagcagtacactgggctgtactgtcagggatggcaagatgctctggggtgtattggacacctccagtttcttcatttctggattgagttttcttttcttaatgttggtactcttcacatcaccttgagatttagacttgtgaaggaacaagtctgatgaggataatagtcttgaaaggagacactgtacagaattggaagaaggaaagaaaagacttgttcattgtgatactttctgtaggtggccagtttgcttctcatagggaaatcctggaccacctgtcatgttggctcttaaggaactgctgttgtaagcagctcatcaagagttgaagttcatgtagccttgttgggaatatggaaaaggaagaaagccacagtactgccagttcagtctgggaagatctggatggttctgcacatgcaaaaaggacttgaagtttctgtatagacgcttgtaccgatccatcttcagctggctgaatgttgtatgatagcccttctccaaagcagaggtggaaggttctggtttcaccacacattttataaacacatctcctgttttgaattggcctatgtattgtaggtatcttt

SEQ ID NO: 18831 - DNA, 1158 bp, Mus musculus
cttgtatgctcgtacttgggattgggcctccagcgtcctgtagggcagacagcattcttactgctgagttgtagcccacgcctttttttttttttttttgacatggaatcatgtattctagggcagctagagtccatacatttattatgctaaagggtctaacccagagctttattcgtgctttgccagctgagcaacatctcacccccagcccaagcacaaagatctttaagagcgcaggactcatcctcaagacaatgtggcttgataattgtttttctttttcaaactcccatagctaaatatcctgtatgtgctgtctatttgctctttgtataaaagctttgtgaaagtaatgcttttgataatttttgcttccaatttttttattgttccatttaaaggatttttttctttccagctccaattttatgtaacacaagagttccagagcacagatggccatcacagtcaaagctgtttgtatgcattgagctcttgctccttttgccttatcagtaactcagttattatctagcaaagggctaaagctattcacatttgtagaaaaatattttcacgtataaggctgatctgtcagccaaggtgcatatttctcacacatatactgtcattaggaatctgtaagttcctatcttgctgtggatcttggtcactttcctgctgccggatgttattttactgactgttactctaagtagcaaaggttcatcgctattgagacactacagaactccttcatattatgcatagctgattgccattttattctagcatgaacctttttttttttttttttttgctgtatactaaacagaaaacactggaggcatgtatgttggactgtattacagagttaaagctaactttaaactatgtaaccttttatgactcaatgtgccttattgtgtattgctgtgatatagcaaaatatgcttagaaattaaaacatacatttgaagcttggttatgatattatttttcttataatatcatatgtatttttttaaaatttgcctttcagggactaaaaaaattgaaaaaaaataaagttgaaaattttattagaccatctgaatttgtatttcaggaggtatttgcattcagtgccttaatagtcctagagcattttaatgt

SEQ ID NO: 18832 - DNA, 1213 bp, Mus musculus
aatatatttatttatagtcctttggtaatcataaacatagaatggccataccattgtattcactaattttgaataatatttaatacagattcataaatgtaatgatatagaaaaagatttgatcattgtagatctggacagaatttactacttgagagggaaacaagcttacttaagtactatgtaaaacggtccatggttatagttggtaaattaacagtaggagtaaaataacttgagcatatggcaatgaaaaatatgtttttgctatttcctctttgtctcttggctcctgtagttgaggcagacttctccgtctgttagctagtattgcctgtgattcagagtgtataatgcaagtgtttcttccttgcttatgtatataataatagtagccattgatcagaagtgacatcttgctgtttgctatttcactgtgttttcctgtacctttcatttgacaagcattgattgtgttccaggaattaaagctagtattgtgcttttcttatttattttctctggctagtggaaaatgaaaatcactgtgactttgtaaagctacgggaaatgcttatttgcacaaacatggaggatctacgggagcagacacatatgaggcactatgagctgtacaggcgctgcaaactgcaggagatgggctttgtagatatgggcccagagaacaagcccctcaggtaagggaggctcttggaggaaggcaggaacgggggaagttagaaaggattactcgttctttcttaagctccagagtgaggaggatgtattgttagaaatctaactatgaaagtgattcatttgacgtctccaatcaactgatatccctttgcttctgaagattatgcctgactgtaaaggagctaagaaaaaaacagttcttttatacagctacttgggaaactgttccaagaagcgtgtaagttcaaggtctgcctgaactgtgcaacctgttagggccaacttgggcaatatagtaacagcttgtctcaaaaagttaaagaaaggtggggtggggaggagtggcacccgtgtgcaatgttgagagtgccggcatgatgaggtcctgagcagaggagaaaggagcagttagattgcgcagttgtatgtgagtaactgaaggaagcacttcagtttttgtttgtttttgtttttgtttttgtttttgtttttgtggggcaggggtgcctagaag

SEQ ID NO: 18833 - DNA, 1150 bp, Mus musculus
ttcaatgctgctagctattgaatttccttatatatagttgaaaaatactattccttaaaattaaagacttttacaactgtgatccgtaattacattccattcacttgtgctaagagtaaatggctttataattattttaaaatttaacttacaaacatattaaatcttataacaagagtagaaacttctgtgggagactggtttgaccaaatccttctctctagtctttctggcctacaacatagagggcagagtaagcagccaagtcctcagagtcgaggggactgcgtggttatacagagctcacagcattctgttgttaactggcctccccaagtcatagagatttctaacaaatttgtcacatctcaaaatagcacttctttaaatgtgaattgaagatgctcatgaaatatataagttgtggctcagtaggtcagagcacttgttctgcaagcatgaggatctgtgactgaatccccagcatccatctaatagggtatgcatagctgagggtatgagtaacctaacatgaggaactgagacaggcagagcctcagagcccagtggccagccagcctacctgaaagtagtgacttctggatcggggaggctatctcaaggcagtaagaaaggcatcaaggaagtcacctgacattctacttctatcttcagaataagcacacgtggggctcccaaacattctcatgcctacactacacacaaacacacatacacacataagttgctacccacttatgtgcctttatctttgttttaggatttaagtagatcgggtacattgataagcactttttctgtacacttaagtgaaaagccaatgtaaaaagcaatcatgtgttccatgtcttagacgtgttagctatatctagtgccaaataagcttacagttctcatctaggacttttaaattccatgctaagataaggcaactatcattaacttgcttttcaaactaaatgtttaaaactatgataaaacattaaattttttctggagtcattcctgggcaggccaaacagctcagcagatgaaagtggttatcttacaagcttaaagacctgagtttggccctagaacccacagtggatggagaaaacttaactcttaaaaattgtcctccagcttc

SEQ ID NO: 18834 - DNA, 1239 bp, Mus musculus
caaatgtctagttagttgcagctttccagtggtgagctgtgtctgtctgttttggaaacccaggctctcctatatcgaggattattggcttgaaattcagtgtcttattcattatggaagtttgaccttctgcttgttattgaggcatccctcttccccagaaagttctcttttattttcttcagtgctggggattaaacccagggcctttgatatgccagatgaccactctgtgcccccaaatcgtaaggatcagtgatgacattttaaagatcctaaatgtgtgttgttggtttgatgcagaacctgtactgggcactgctgctttgtgtgtagttccaagggtcatctatgtgtgtgtacacacattgtcattgttgttgcagaaatcgtctgtgcatgtgtacacacatcattattgttgcaggatcatttgtgtgtgtgtaagctcgtatgtgtgtagatgtgtgtgcatgtgtgcgcacacaaacatcgttactgtttctaacagatgtacgaatggacactgagttgctgttctaacacgtttattactttctttgtacgcagactccccggagacagaaaagactgttctgccgctaccatgatgggaaccggaatcctaagttcatcctggccccagccaagcaggaggacgagtgggacaagccccggattatccgtttccatgacatcatctctgacgcggagattgagattgtcaaagacttagcaaaaccaagggtaactttttcttctcagtttaccagatatgtgtgtgttaatcttttaatttgcaaggcgacaggaaggataactggggcggctgtaactttagatggttttaactgttactgcctcaacacaacagtgttaacttagagtttacactagttgtctcagtttgttatccacacaagtaacatatcctatagctgggcttgacacagtgagtagtgaacactgtagatatgtgttcatacacagagtcagtggtttgctgtctcactggaagacctttcgcgtaggtcatagctctcagtaccactcagagctcaattttttcatgcctagtattttttttatctgaatgaatactccaagtattgtaattttcctttagacataataatagtagaaaagtataattaggaacagatatcttgctagttttaaaatagtattatatagtttactaattttagtttattattattgtgttaaatttttctttta

SEQ ID NO: 18835 - DNA, 1179 bp, Mus musculus
atgaacgtggacaagaatttcgaaggccgtgcaccctgtcagaattggaatgacaaccaggcttcccttggctcctgttgtcctctaacgcaccaggcacgatggctgattataactccgacgtttacagctgactaacactccatgattaattgggccatgagcctcagccccatgtctcacctgtggacaatcacttattttgtggatttctttaattaatactcaatcaccacatgatgtaaaacttatggttcagttttcacaggatacaaggcattgaaaatgaggaacctaattttgttgtttaaaagagctttttggttaatttttttaaaaaaagcatccagaagtagatttcaccacaagtcaggagctggtggagcaggcgaggctgtgtggcaggcgtgcaggtggcaggcgagcagagcctgtgggcttacagacggcaggcatgcagacgccagtgtgctgctcttccgatgtgtggactgctgagcactggtaactaactagggcccagtcaggtctgctattccacgtgcagagttcctattatttaaagaaactctttttatcaaatccccctcctcaccacgggtgaattcagccagtttgagaaaattactttgttcaaaaagtcctgcagaactggcctcccaaccgagtgctcagccttcgcccttttcctcagtgactgcaggttgtccagagactgttccaagtgccaatcagctgcagcaggcactggtgttggcattctgattcaattctgtgccttaggagactgggagttagaaaacggacaggtccttggactgagggagttgatttttaaaaagaaatgttttataagaagccaagatgtttgtttttctccattctgaaatgtgttataacaatgacctatttatgatcttaaatcttttttttttaaaaagtctctgtgtggtattttcatgtttaaatccaaatgtaagaattgagcactgctcccaggcccgttctaatttacttctttactgcacagagcttagatttactactcacggttagaccttcgtcacccagaacaggctcccttgggataagcttcggggaatttgttccaggatggtgaggctttggtgtgtgttgttacagtgaagaccctgcagttcctcagaactgcagttcaga

SEQ ID NO: 18836 - DNA, 1859 bp, Mus musculus
aaaaggaatgatccgagatgaccgtgaatcccggcagagagtgcgcctgtttgtaactcacgccgttttaattaaagcatggcaggtggaggctggggtagagggtttttacctttaattctaaaaacaaaacacaaaaaggatcttagggaataaagggatcttaaatgctgaggatccagcatcatggaatccaagtgcaaagggcttagcgagtcttgtcttaagcatctccatttcggatgagagtgaagactccgtcgcagctgggcggaggatgttgggtgtttgcttcttgcatctttgcagggtctgcggaacactaacacaccagcaccccactcagctccaggtttttgtttttgttttttaatttaaagtttcttatttttgacataggaataaataagtgtataagaaaatcaaatcttctgattcatgaatggcagagtctgggccagtgcggctagccttcattttaagctggacctggccttcattttaagctggacccggtctctgcaaaggtaccagaatctctcggccctgcaccccttttctgaccacctacctacctgcagatcctggttggttggtcacactgcttttaaccacataatcattggaattaagttatgattgtttgatgattgacacttggattatctcttaatgagatctcatgtctatctccccggggctctgaatcaatgtctagaagtcactggcaatactgcatgagggtttttgttgtatttttttcctttttttttttcttttggtttttttttttttttttttttactaattagtcttgagaggaggaaaaattccttcctttatatactgatcccattgataacccccacttcctgcacaccacggatcagaaggcccgtgctcatccatattaccaaaagaggaggatgtaaggtttacagatcggctaaaaatcaggctccgagtctatttcagaccaagagactctgggttaatctaacacacacgtcatcatgtgctctcacaactccaccaccccagctgctggaaatcaagggcggatctcaaaggctgcagctatctttttaccaggaatatcttcctatggcttcctttagcctgtcttctccaccccgtttatttttatcttaaacagagagacaggagaattactcttacactctgatagagtgttttctaccatcttcccagatggtccctgcgctcgaagtcaaagcactctgcctagtggcctgtttttaactgttctggggacaggatggcaaggaggacgggggcttgccacacgaccgattgattgggtgtttggttttggtttgcttccttcccatgattcaccccgcctcatgggacaaggagtttctttttcctcctcctttggggatcattgtatatgaaagaaaacctttgaatgacaaacccagactctaggtgccttgcagaggttgaaggccagccacgccactgcttccaccaccagccgccactggcctgccagagaaaggatgcatgtctcggtccccagcccgcctcctccttccttcctgtccttcaacctctcccctgtttcttttccttgtgcagattatttttaagccatctatcctgtttgtgtgcagggttcttaagaaggcatggcacagtgcaatgagcaaatcctctgagtgtgggaggcggggggtgggcgagcaagatgttggacacgtgtacaatcctgtatcatttatgaaatatgtataaaaagcaatgtaccttccggaacaataaatacttattcaatttttgaatcatggcatctcgttctttacaacaaagccagaaagatcctgcctttcctg

SEQ ID NO: 18837 - DNA, 1200 bp, Mus musculus
agtatttgaattgtggggaggtgccattacaggcaacaaatagatgactagaaattcccagtgatatgacaaatctaaagaactgatttcccccttgttgcttaagaaaaacaaaacaaagcttttatacaaacattcctggatacttagtatccaggaaacataaatgtttcatgtgtctatataaatattacctccatttcagacaggctaaatcctactctacatagatataatatctaaattatgtctgttggagcaatgtctattctaagcattctctgtcaggtcaattattttcaagcctctgttagtgctaaggtatgtaataagacttagggtttcagtgttgaagtacaagcatgtggtacgtattagcaatttggtggtggtgggttgcatacactacaatggttcctatatctgtatctggagggctgagggagctgacccagctcctagctgtttgggtcctgctttctgctggggcacagtgagctccattcatttacacagctaggggcctattaaatcttctagtttgcaggcctgtggtaaatgtgtgttccttgcaactgaattatggctgctatgagactgtcagcttggaatttatggcaatagaagttttaaatatcccaaacatttcagtatggagagaaggaggcctttctttaaagggaccggggccagacatctattctgaggttggaatgaatcaacagtcatgttctgaagaaagctgtatctagagaagatggacggaggccactctgagtgcatctggtggtttctgtgtgctagggaatataaagcagctgtctggtctgttaggaagctcaggttcttagttcttttggaccgagaccccttaggtttgtttccagctctccccggtgagattgtttttctttcacaatttaagacgatctgaaagaggactaggggtgtgtaactcatcagtcacgaacttgccgaacatgcatgaggtcctggttccatctccagactgaagaaacaacagaatgacacatgggcacgatgtcatccttaaaataagaggtgccagagaagaatacgggatgtgaacattccaaatgaactcctgacagctgacagcaacattatcgtaacatcaattatacatacatttcttccagatttacttcatttttgtacatataagtgtctgcctgcatg

SEQ ID NO: 18838 - DNA, 1200 bp, Mus musculus
tgcaaatctgttctacatttttttttacagatttgtcatttcaagagtgttataaatatagaatcacacaatgcgtaaccttgtgagattaccttctttctcttagcatggtaaccttgtgactcatctaagttgccatctagaccagtaaatgactccattggacaagcattgtgataaaatgcatgcagtctctttaacatttgcaagtgtacagttcagtgacaagaaattcaccctcaccactctctgtttacaaaatgttcccatagcctcagtaacaacttcactcatcaaagactccctctccctccacatctttgtaacctttactctactttccatctcaaggaatttgcctagtctacacattttatgtaagaagaatcttataatatttatctttctggggctggtgagatggctcagtgggtaagagcacccgactgctcttccgaaggtccagagttcaaatcccagcaaccacatggtggctcacaaccatctgtaacaagatctgactccctcttctggtgtgtctgaagacagctacagtgtacttacatataataataaataaaaaatcttaaaaaaaaaaatatttatctttctggttctggcctattctacagagcataatgtgcccaaggcccatggatactgtgtcatttatcatttttttatccccatttataactaagtagttttatttattttttttactgtgcagtatttttactaataacatgggtggaatattaatgacttgcttggcaaatccataaatgacagggagttgtcagttttgcattttccaaatagagattgacactagttattggatagactgtattcatcaagctgtggaaatcactgatgtcaaattccatgtgtgatcctcacacggtactgtaactgtaaaggaatgtgacgtggttcagttgcaatgtgacaaacatctgacaatgacatgtgagtgtcctcctcacatctcctatgacagtgagaccacagaccaacttggcctctattaagagaagtataacatactgaacatggactgtgatccagctgccgcactgtatccatggctgggtaccagtatattttaaggattaaatatttagaatttgtgtatttagaagaaaaaaagaggataattttataggaaggtagtagccactcactattagattcaga

SEQ ID NO: 18839 - DNA, 1161 bp, Mus musculus
cacctccccatctttctgggagtaacctctgggctcagccggcttccctctccaccctgccctgaccccatcagtgttctgctaggctctgagtctgcagtcggatggaaggtcctaaaacaggactgaggcttcaaagtagagaccttagttaactcccttagcaagtgccctgtgggtcagtgcaggagccctcccaaccccggccagcccgggagggaggcagctctgctctgctctgacatctgtctctcgctgtggatttatagtagcaagaacactccctgccattttcctcctgctgtttttaagctgcaagtttggaaatgagctggcaggcgaaaggaagtgtgatgaatgataatgcagatgaccctggcaccctgagctggcaggaagcctggccagaggagggtctgtgttagccaccaggggctccaggaaggcactgtgcccccagcagaatccagattccaagtggctgctttaagcagctctccagaacttcccagctctgtggtttcctcccaggctccctgcgatgcctcctctgggactctgcttcactagagcaatggctgagcccctgtccctgtgtctcatcccctctctatggacctgtggagcccagacccagctcagagcctagctgccctctgtctaagacactcgtaaaatatcactttaattatagcactttgcaggaaatacccgcaagagctctgtgtcctttctttcttttaggccgttcctctgggcccttgttttttgtcatcagccagagactgatgctctctcgtcacaagcaacttgaggcaggtacaaaagacacatgtttgcacattagggtagcattgtgccatctcctttgaagtgttgcttccgaggaactgtcacacacagtccctgacacagacctatgagcatccggtatgttggatgtgcattgagaaccatagcaacagtgttgtctgatggactcggctccaccgctcagtggtgctgagcccggtccccatctgttcgttcatctgtgaaatgatagattgagctggatgggcccgaagttccctcctatgagcccctgcttcagctctccagaacctccagggtctgcctcagcgtgggactccaccctgactcagaacacagccaggggtg

SEQ ID NO: 18840 - DNA, 2832 bp, Mus musculus
agcaggcaggaggggtctgtgggccctgaccactccctctctggtgggacctgaggccctcactccagtgctccaaacctgggagccaggaaaccacgggcatccggccccgcccaggcatctcccctgtggtcttgaagaagggaacaaaaagtcacaagttcagggtcaaaagaagctactgagcacaggagaggtggggaaaagtgaaagttgctattaacaggcaccccaccccctccaccccttcccttgtatgtgggtaatgggcttggtgcccagtgcccagagcagggagcctggctcaagcctaaaggagtgtgggcagagccagaagttctttgcactggtaccctgtcctccccctcctctgcctgtgtctcctgtcacagagccattcacagactgtttcaagaccactcgatagctagtgtcagctctggggcagtggttgtactgcagagggatcgaccagggccagctgctgggctgtggggctaagctggaggtgcctgccacaaccgctcacctaactctttccctctcctccccagactatgaaatccctggagaatttttggtgacacacactgagccagccacagtgatggactgtatatttaaggaaagacatacacagaaaaaatttaaatggaactggaagccaaacaccgcacagccatcctctctcagacagtgaatgcagaaagctcttaggacagacagacagacagcctacctcgggctgcttcctcctctcccagggcaggcaagaagctccgcatcactggctcctaggataccgaaaccatggcaacgaaagtagaatgtaaaacttgcagcaaatgtctgtggggaaggactgggggaggggacaccccactgtgtctcctccctcctccctgagctgccaccagtcactcaaggagaaatcaggctgaggcatgggccaaggaacagagaggagagaattccagagaacgtaacttagaaatgcgtatgtatgtatatatatatctatttatatgtaaatagacatatataaagatatatatatatatataaagtcttttaaaactattcagggattcaattaagatgttcagctgacttgctccataatttagaaaacggggcctgtttgggaaggcagcctggttttcacaagctagacagtagccgtagccgacagcatacggaaagtcaaatcagatattagtgtcgcccttagccccagcctgactgatggcagcagtaatcatggtggtataaatccatagaaaacttgcaaaggtctccaggcttatggttaaggtaggggaagagcctggggcagggaatggtgcccctggagatagctgctcagtattgggctacagcagagatcccagacaaagccctctgggatggggccagctcctcaagctgcctcctctctggccagcctcaggtgggctcgccgccctcatgcccgggagccctgcagccactcccctgcccatacctcttccccacccaagtccccaggtgggtttgccttacaggtgccacagggcacagctccaccattgccaacaggttttctaagttgcgcaccaaggactccagaaggctgctcctcccagagctgagccaggccctgagtgcagcccagcttgtggagagccagtgctgtgagcgcctgtcttcactccacagtgggcccaccgggctccactcattggatgaagaatccactacgaccagaatggcttccccttcagatgaggctctttatcaaaacagccattgctgccaggggaaggaggaggttcaactcctcctgcgtttattacgggcctttgggaattgccgtttcccccagttttcctctggccacgggtgtgccgatcacctacagacttccaaagccttacttccccaagctgccagcccagaggtggtaactgacaccaccaccaccactccccacccccacccccccacccccaccaagggtgtctctctcatacaaccccctaacgaatgggatgcttgctgggaaaggaagcttggttaggaattgtcaaattggtcttttttttctttttttttttttttaaacaaggtcccaccctgcaatgaagtggccaccctggcctagagagataataataactgggtgtgggccagagtaccccacccgtagtggcctggtgctctgcccctgccaccccacctgtccagtcttggtagctgtccctggaggggctgagccatgtgcaataagaacacagatcctaaaggatcccctgagaagctgtatttcttgaattagaattctgatactgtacatgtataaatatatgtttattatgtgattggcagtggtgggtctgcattgaacagggggtggggcaggaagctcccaccagctgctattgacaccgcccagcctgtgcctccggagctcctaagtgacaggcctggccctcctaacaaagggtatggaggagctcagatggctgtggggccgcaggatgcggtgcccctgacaccagccctagatggggacctgcccaccaccctgtcaccgggctgggctgcagcccattcctgatctgggacttggggaaaattcccaaatggctcttgtcatctgtgtccacagtctgccagccacagcctcctctcccagggagacggagaaagctaacactgaggcagcctggggctcagggtgagccagcggcagatctgcccggcctcccggagacagggccggcagccgtgagtggcaggcccaggcccctcccgctggcgcgccagccaaaggcaggcgggctgcctggt

SEQ ID NO: 18841 - DNA, 1132 bp, Mus musculus
ccgggagcgttctggggctccgtgggggcggggccaggccgctgtcaccaggcaggagagaacgttgcgaacgtgcgcccggtgcctattggctgaggtgggccacactcccgggtctcgattgggctgcgacctggagggggcgtggcctcgccgggagagcccttataggctgctgctcgctggtgctagggatcgcagcaggcaggggggaggtgcgagagggttcgaagggacaggtccgggcagcgatcgggggttggcaccagttcgctcacccttcgagaggcagagcgctcttgtccgcaatcttcgctgaccgcgctagctggtgagtgtccctcccgggtgtgcacatcttgtcggggagtgacctcggctcttggggcctcagagccctcaatcctgtgcaacgccgacactgacgccaaatccttgtccctcttgtctttcagcggcttctgtgcgccttcattcggaccttagcagccagcgtcctggcgtctgaccccgccatgcctagcctctgggatcgtttctcgtcctcctcttcctcttcgtcctcgtctcgaactccggccgctgatcggccgccgcgctccgcctgggggtctgcagccagagaagagggccttgaccgctgcgcgagcctggagagctcggactgcgagtccctggacagcagcaacagtggcttcgggccggaggaaggtgagcactcagccggggccgaattgggttcggggatggggggtgggaggggtcccgggaggtgggtacgaagcgagctgaatcggctcaaagccaccttggcttcccaccccagcacgaaaaaacagattactctagggttagaagacaagactgcggggcggaaactgaggcacggagtggaaagggacactgtttgcttaggcaaactgcacctcccccgcccgtacagctcctgtggaaggcgctctaatacaataccctttccctgtgttctctctatccagactcctcatacctggatggggtgtccctgcccgactttgagctgctcagtgaccccgaggatgagcacctgtgtgccaacctgatgcagctgctgcaggagagcctgtcccaggcgcgattgggctcgcggcgc

SEQ ID NO: 18842 - DNA, 1305 bp, Mus musculus
ccattccctccccggccccttacatcccaccagcagtttcccctcctttgacttcccacaatccctcttctccatctccccattgcccacccccatccacccctctatttcttttttgaaaattatagagctctcatcagtcaaccatggaatatcaagtttcagtaagactaggcacctcccctcatatcaaggctggataaagtgacgcacacagtaggaggaaagggtttctaaagcaggcaaaaaagtcagagacacccccctgttcccactcttaggagtcccacagaagaccaagctacaccactgtaacatgtgcagagggcctaggtgagtctggtgcaggctccttggttgttggttcagtctctgtgagcccaggttagttgattgtgtgagttttcttgcggtgtccttgacccctctggcttctacaatcctccttccccaggactctctgagttccacctaatgttaggccgtgagtctctgcatctgtttccatcagttgctgggtgaagcttctctgatgacagttgggctgggcaccaatctgagtatagcagagtatcattaggagccattttctatccaagtctttgaactatccagcctgtcctggtcctctaggcttccactctctacatgggtctcaagctggaccagtaactggttggccacacccatttttggggcaggtgagagaaggtttcaagatagggtttctctgtctgtagccctggctgtcctggaactcactttgaactccagactggctttgaaatcacagaggtttgcctacctctgcctcccaagtgctgtgattaaaggcgtatgccaccatcccggctccttcttttttctgttatgagaacttcacctgtgttgaccaggctaggctattctggaactcctcagctcacacaatcctgcttcagcttcctgtgtcgatgagatgacagcgtgtgacatcatccctagctcagataactttgtgttttgagtgttaactagtgttctaggttagtttcacatggtctttctttttctgtttttcgttattgtaatgactttgtcctgattcgtttcttacttaattcctagaagtgaaaaggaggtaatgtatttgagtctttttcatgtatttatccacattatcttcaagaagataattaagttctccaaagtagaattgtttggcttctttctaccctttgtcaacactataggagttcttctgtgtattgcttttgtcatagggaagggggagtgaggcagaggtttgatttccaggctctttgt

SEQ ID NO: 18843 - DNA, 1102 bp, Mus musculus
aaaggtcggaaaggtatcagatctcctgggattggcgtgacagagagttgtaagccaccatgtaggtgttgggaaacagcttggtcctctgcaagaacaagtgttcttaactgccgagccacctctccagccctgatttgtacatttgtagtgcttaacattggactgtcacctgcaaggttaaaaattgacgtaaagcacacattctcagtttagagttgtactaattgataggcaaatattgttcttaaacagtatagccggttgtttgatccagagtagcatattgctacaactccattggcttaaaacaacacacttaaaagaacatctggtttaccatctgtgggtcaggagtgggagggaagtcagcccaggctgggatcttctcaggatcacaggcttgtctgtagataagcgagctgggtgacatgggaattttattgtttgcttacttgtttataaaaagtacaaacgcatatacccacgcagtgacacacctgtgaaggtcagaggcagcctgcagggctcagttctttcctgcctctgtgtacttccagggatcaactccaggctcacacttggctgcccagtgtctttatctgctgagctgtctctccagtctatgtcagaagatttgtgtggtttcattggactgaaatcacagtattggcagagctgggatcctttttagttctcaggaaaagtatctcttttcttgcctttaaagcctagcttttagaggtctctcacattactcacctagtggcttcttttctttacttctaattctaatgtggcattttttgcaccttcagttgtccctgctgctgtgattgcagcaggaacaagctgttggcctttaagaactctgacttgagtgaatgcatctatataattaaaccagtccctattaccaagcccaagacatggaagagagtagggcctagtcctccgggagggcctaccacagtagtgcagactgtactgcagcactccttagtgaagagacactgacagaccttccctcctgttctcccccaccccgccatttctagttacttatgaatagcgtgggctcactgtgctgcctcagcctctt

SEQ ID NO: 18844 - DNA, 1180 bp, Mus musculus
tccctcaagagcttgatctttaaatgtaatagtaactgggtttctagggagacagaacacagatctgttaccttcagacattatagaagtcacagaaaatatgaaactcaaagaagagcttgcatccccagagtagctggcacacagttcctttgagccaggagagggagaggagggaaggagaggccagaactgtgtgcagtcaggtgtgaatgaagtcctgcaggcaaccagtcaccatgctgcctgccctcggaacatgtggaagtctgcctggacacagtgaggactcttagagtcttctccctggtgatacagtgttatcctgtccttacatggatccatagcacttggacctgactgggggcagtgagactcaggaggcggggacagggcagatctctgtgagttcaaggccagccagggctacacagcgagagggctaccctgtcaaaaaataaaaaccaaagtaaaataaaagacaagaaggccaacccagaaacagaaagctgggatggactgtgctctcagatggagcctcagcacctaggaatctcagcattttactatagagacttgaacatggcagtgggctgttgtatgcaggtagacaaggaagactggtttatggtctacagctggactaaggggacaggttcagctactctcggtaggaaagtgtctgcagggaagcagtctttaggctgtcagtatccgggaatgggagggttgggaagagagccatcgtggacgctgtttgcacactgcttgcatttggtcccccaggaaggcttccctctgagctgaggctatgcatggagttcttggcatggccttgcctctgccaacacagtcactcagggcttcctcagctccctgtagtcaaggtcgactaagcgtagacagtcacaaggtgggagtctctccagggatctcaggacccacttcaggggagaagggccatggaggaaaagaagcttccacttctcagggtgtcaggatgcagcggacaatggcctgccgtgcctaccgtgcctgctgtgcctgcggtgcctgctcaggacttgttagcttctgcagttggtgctagtgctgccgtcactgttaatgctgtgtacggttcagcttcatcttttagcatgaaatctcctgtcatgagtgagttcaaaacaatttaaat

SEQ ID NO: 18845 - DNA, 1915 bp, Mus musculus
taaccctcaggtgtcttcatcccgagctgtgatgaagatggctactaccggaagatgcagtgtgaccagagcagaggtgactgctggtgtgtggaccagctgggcctggagctgaccggcacacgcatgcatgggacccctgactgtggtaaggagcatgcggctagttctcagggtggcgtacgtggggcaggactccaggctcagaaagtagacacagtgtgtgggttccttaccggcctttcgtgtgctttcccaacagatgacatcgtgggtttctccggggactttggaagcggcgttggctgggaggatgaggaagaaaaggagacagaagaggcaggggaggaggccgaggaggaggagggtgaggcgggtgaggcagatgatggaggctacatctggtagatagccctcgacggcctcggcaggccagggtgccgacggccagaaagacaggccagaagagacctggacaacagcaggcaacttagcaaatggatccggaagtcagtgcggaggaccctggctccagtgggggaggactggggagtgtggcttgtgtgtatgtgtgatatgagatgtgtgtgtatgatgtgagatgtgagtgtgtgatgtgagatgtgtgtatgtgagatgtgtgtgtgtgtgtgtgtgtgtgtgatgtgagtcacccaaaggtccctatgttattgattttcaaatgcacactttcacacacaaggatacactaacagaccaaaatcaatgagatgtccctgatcctgcccctcagcccaacacctggaatccctgccctgcctaatcagccctaccccatcctgcctttcttccttcctcttctgaggccagggagagggagggagggcaggcagctgaaagctgagcgtcctccccaaattgggctgatttgatatgaaagccccaccacggtcttgtggtgatgaggcaggacctgtacacacagcaaggcttactatccgtctcctgacatccgaagagctcgtcgcaggtgtgtctaatggcccttgggctgcacgtggttaagcatagctgtctctgtggcccaacacaaagaggtaaacttacttaaaacacaggggttttgttgctgtttgttttttgttagtttgtttgttgataattggattgaggagttaatcctctgtcacaatgtcaaaagcatggacatccctgatagattatctctcaacctagtcccgagtaaccagagatagctcagcagaagaggcagaaatcatgagacagaggacaatgggtcccttgatttcaggcctcagattaacccagtcagcacctgtggcctcatggggctctgggctgctttcttggcgaatggggactgtcatcatatagctgagatttggagtagcctgctatgagggcttgcagttgcactctctgttccctggcgagggtcccccttgtcccaaggagcagaggaccagcaagcagcccgtgtctgctcaccttctccctgaccctctaggaaatggttccctcttgccccgaccaatagaagggcgtgtccccgagacccttgtgaggaaccacggggagctgtgacttcctgtgcccagaaggtcctggaggagaggccccaaagccttagtcctctcagccatgactttcctctgtctcaagggtccccaagatggccctagaagaaccatgccccagactctatttaaagccctatagcatatatgaatagagaacggtgtatctatcagaggggaccacactgagcagctaggccctgatgccatgcctcagcacgccctcagacctccaggccgggtggaaggggcttttacccagatgtcctgtggggttttgtgtgtctattgctccccacttccccctctcaaaggaaatttccttgatatatttg

SEQ ID NO: 18846 - DNA, 2170 bp, Mus musculus
cccagtctggctctcccccagcctctcaggggcactggctggtcacatccactgagtattgatcggttggactttagggaagagcctcctccttcccattcctttctgccaccctggaatggccaccttaatcgtcatctcctcggggggaatacggaaatgtcaccaagctccataaagtgcttctcattccacgacacagttctgactctccgggtgactgtcacctgctcccatcctcttcttcctccctcccttcctcagacctctgcaaccatcctctggtccctggctcagtcacatcagccctctgcattctagaagcagccatcccgcccccctctctcctccccctcctccccttcctcctccctccagctggagttacttgaaacttcctgctctcgctaggatggagtctgattctttctctgccccagctggatttccagaacatccccgggtagctgtgaaggattttaggctctctggggtggggagggggtggtgtagaggaagacgcatccccttctttcaccctgccccgccctgccccgctggggagctatgctctgtgtgtccctggatcttctggttttgtatctgatgtagtaaacatgttttagtaagaaagcagaaggcgtggaactgtggcaggccccaggggtccagaagtttgtccctctctaaaacgctccccaccccatactgcttttcaccccactgagaccgagtcccacaaaggtaggcagaacagctgttcctggtggggctgaaggttcccaagtagcttctagttaagcaagcttcgtgtttcctcaggagcaaggtcacacaggtcagattattgtcggtcctgcgggcctcatccttgaataagctgcctgcccagttcctccatccgtgttcctgcctgctcccgttcccttgttgcgggcaggagaggtagggctgtgttggaaagagttcaaccaaattacggcagcaccacatcttgccgagccctggagctgccctactaagagcctccttagccctgggtgctgggaaggatggtgtacgttggggaagtttgaggttggagagagtaaatgtgccttgagagaccactcagaggtcccaggaggaacgggggcggggcttagcctgggagttctggcaggaggcaaagttggtgagagtcctgggacatcttacccccagtgttccacaggagtcgtgaccacgtgtgatgggtgggcacaggtctgccttgctccagccccctcccttggtttctgttggtacccatttggcttttatctgctttctgcttcaccactaagtgcgtaggtggggtcttttgatatcggctccccaaagcccaagcccacagccctaggagagaaccaggggcccatctttgacacctgggccatcacgagccctcccgcctgcagttgtcctagggaaagacctgggggtgcaaaaggagattcaagacatccgtaccaagtcaggcagagctacccgcttctcagcccgtgtcccacttaaaaccgtccgatgtgtaatcactgagcttagagttaaacattgtggtcaagtgcttgggttccgtctgtagatttaagtgctgacgttgtatctctcagtaattttagatgtcttttaaaaaatctgaacaagtgttagacccgtgtgtgcgttggtgggcactcaagcatcccgtgggtgaccccattctttccccttcctctgcgccacgccccctcctgccccgcccatccccacctgcctccacccgggaccctcaccttgctgtggtctttatctgcctattactcagcctaaggaaacaagttcactctacacacgcataaaggaaagcaaatgttatttttaagaaaatggaaaataaaaactttataaacaccacctgctgagaaacctttgcttattctgccttagtgttgtcttaagagtagatcttggcagatgagaccctgtggtccagactatctcagttagctctgtgctcttaccattgcaagagagaccttggagaaggccagcctgattcatccacagaggaccaggcacagtgtgaaacgcttagcattattgcaaagatgcctcccgtctaaattagcctctctgtcagtaagcatgcccctacgtctcagctaca

SEQ ID NO: 18847 - DNA, 1164 bp, Mus musculus
tctgagggagaaagtccttatggtatcagcctgagtttgatccttggaactcaccgttggtggagaagaccaacttctaaaagttttcctctgacttaacacacacacacacacacacacacacacacacacacacacacaccacatacgcatgcatgcacgcatgcaaataaaataaaaataaaaatgctacaggaaaatggagactcatccccacaagggaaaggagagcctttcatcttgccccagagaagggtgtgcttaaacacaggagcccagcagtaccaggggaaagagaaccatacaaattagcatgaaaatctgttagtaaaaagtctggaagcccttccttaccagggttgcatgcaaagaaagtgctggggaaaagcagacagtatatacgtgtgagaaaggccaggttgaggtggacattgccatcccaatggacaaaagaggaaggagtccccagaccaggacctcagaacacttcaggctcggccaaggtgtcctaagctagatgaccaggcttccaggagagtgacctggtgctcagctcagtctcttctgtaatggatgacctcatccccatagtgcctgggtggctgcactctccttgagcgagtactgttttaggaacccagaaaaggccggccaagtcagtccctagggtcttggccagcgttttgcccccctttgcatgtgtctgaaacttaggaagaaggtctggggtgagatccttcaagcttaggggcagtctggggtcgggaagcacacttccccatagtggcttgtgtcggggctgctgcccttcccagactgtgtccctcccccatgtctgaccttgctggcagtgacaaggtgaagttcatcaacgtactcaacaaatttcccctccctacttcctactttatgtccgtccctgtgtccttatttacgtatgtgttcagtctgtgtggcaacagcccatgtcacctctatgagtggaaatggatagcacagaggacgtgaagataaacgtgccgggaaggaatgtccagctaaagccaggggaccttgccctgcgcagtctggccttgactctccagctctgcgtctttgggtagattaattctctgaaccaatgtttcttgtcaagacagtgaaggaagtggtgatgggagggtc

SEQ ID NO: 18848 - DNA, 1451 bp, Mus musculus
agtggccactccaggaagcaggttgagcggggtagaattgaggtggtcgcaagtgtgagccacggtaagagatcaggatttgtgagctgcacagatgtgtgtgtgtgtgaagtcagtccggtgccttagcttgcagctgtgagcacactggccaaacatcggtctctgactcttcccctctccttggtggctcatttttctttaaggaagagctgatgatgggcagcagtgacactggggggctgggaagcctgcaggttagacacctggtgtgcaacttcctaatcttctaggcacactgagtgagggaggaactgactggatgacaacaggctgcccttgggaaaggctctcagctgtctcttttcctttccagagcaaccctggggaagtgtgctctgcgctcaacctctgccagtcccttcaggagtacttggccgagcaaaaccagaaacagcttgagtccaacaagatcccggaggtggacatggcccgtgtggttgcccccttcatgtccaacatccctctcctgctgtaccctcaggatcacccccgcagccagccccaacctaaggttagctgagggtgggtggagtcagggcaaacacagcagaagcgccacagtgctggacagaacacaggctctcccttcaggccatgccccactgcctgccctttcagtactttggcctgagtgaatggccatgggttaaaagcctggttcccaggagctgctgagcctgtctagtgctgtggccgcttgtgagatatggctttctccctggagcttgttgctgttctcttgtaggctaacgaggacgtctgccaggactgtatgaagctggtgtctgatgtccagactgctgtgaagaccaactccagctttatccagggcttcgtggaccacgtgaaggaggattgtgaccgcttggggccaggcgtgtctgacatagtaagcctctatctagccccatggtttggataatgttctgagctagggtagcagcaggtagtgctaccttcccagtggccccgaggaaggtgcctcagggtttccccggtgcgtttagtgagacctagatgtaattttggttagttgaatctgcagtggaggaaaatcacgttgggaaagctgttttttcccctctgtcaccatgtactaaaatgtgtaccatgcacgacacatgcacggctgtcagaggacaacctgtgggagttggctgtgggtcctcagggatacaactcactctgtctggctccatggcatcccccttctagaacgaagggctgtggtctgtgaatgaggctcacagctctcttttcccacagcagtggggttgcctgataagcagcttgaaggacattgagttctgtggtctcagaactcacttagtgcccgagagcctgtgaatggccttggaagatccctactggtgttttgcagctgtgtt

SEQ ID NO: 18849 - DNA, 1742 bp, Mus musculus
ggtcttggcctctagcgcataaagctttgtcgttccttctcagggacgtgagtcagccgggcccctcctgtccttgtctgcactgtcacaccccatggatagcatgtgggcctgaggctgcccctcttgagctcttgttcattgctgtaggatttttcagtcaagcagcagggactgggggctggagtcctgcctactgcaggagtactcttacatgacagcaaggggctgtgcctctggttccgtgccagtgttttcagagatctcacagctctgagggccacaggtcctgttttgatagcatcctaggttccttagcttctgtgacgtcagcagaaagcaggtcacacttggagtgacgctgacaagcaagtgacgcgtgaaggcttgtcctgtctgacctgacctgtctccctttctcctcataggctgtcgatcattgcaaacgccatgtgtggaactagtttcccagctgcagaagtcacctacttgtgggtctagggtaatgaacacatagatctatttgacttaataagtaggaaccccctttgcccttcccccatctcctctcccttactgtagcatttctgtcatgtaagaggtgctgacagccacttccgtgtcccctttctgctcgaaggatgaggataccttgggcatcagctccccggctgcccttttcacccacctgctggaggggggtggtgagccagagggcaggagcattttctgagccctttcttggtgtgtgggggatctatggccatctcctaccatgagggagctacccagcttcctgtggtaccaaggagttattttggatgattagaagcacagaatgatcaggcctttagagcgatggaatggccattgtcatagcacagagatttcagaagcacctgcaggtggcttgcttgggatgttgctgtccctgggtcagccttccattctgctttcctgtcttcccgtctgccttgttggggttctgtggggtagggtggggaggggaaacttgtgaatgtaacttgcctgtgccgtgtgacggtcacgtgggcctggtcttttgtgtgtgaggcccttgaccgtgtggcctctgcctggctgtttggggtcctgcacggctttcccaccacctgtagctcttgttgacctgcctgttcacctcatgagtgaagcgtctgcctggcagtgggccatgaactgaggggtctctgtgtagagtagaagcttcctgtgcctccggttgccaggagacagcctgtgcagttaaatggacctagattttgttttgcactaaagtttctgtgacttaataaagttctgttaaccaacagatctggccttgtgtctctttgatacctcagccagaagagagtgggttctgggtccccttccccttccccttcagctcctagcagccgctctggccaaggggctccctcccatccccccaggaccttcatacggcaccaagtcagggtattgctggttccatgtgagttgcttttctttttaaacagagcattccagagactttcactgagcatcagttaaacaaaacctggaggaaatcctgagggagtaacttaatttagaaaagggttacacacaaacactctacattcaacacccagggggagggacatcagtcacggctgtcacctgggcacctcaggacgatggggcggatgctttgttccctcatccactggtgtgtgtgcaggggcggagcgccaccctga

SEQ ID NO: 18850 - DNA, 1153 bp, Mus musculus
aggagacaggcacaaacccactcaccttggtgaaggcatccacgactttcgcctgcctttcaaagggttacctatgccagaagaggccttggcaatccacagtgcccctgaccctgtgctggtgtgccatttagagaatgaaccaactatgaatcctaaagtctatgtctctgtcactcagcctgggaggccagtaatctctgatgctgagggtgcatagggactattggggggcgttgactgcagccagggcagcaaggtcagaacagtgtggtatagtaggaatatttaataaatccaggcgtggacgaggaaggagaggctgaagccaccatggaagggagagaatatgcaggagagaggagccaccatggcagaagaccgtgcaggagggagaaggagagccgccatgtcaaaggaccaagagaacacggctcagagggcttcttcattgggtcaagagcagccaagatggaacacagacattagtaagcagtaactcggagtttattggtaggaaagtggattctaacagcatggaggctattgtgctgcttatggctgtgtgtgtgtgtgtgtccgtctgtctgtctttgatctgggaacataaaccactgaagcgggtagcaaccccgggcctggatttattaaaatattcctgctccagtgtggtagggaagagccctctcctaaccggcacaggctcagtagagaagcctgtggtatcccagaatcctattccgttcactttacatggaccactgtggctatggaaatctctgccaggctggggctgccttccaagcctgtcacttccctatgggaaggatgggttgtgaggaggcttgcaagtaccgagctctgggcatcccctgtgcagtagaaggtggcagctgactggaggcttaggtctaggctagcattatgacacgggtccatgatcttttcctgtccttgcaaaaggctagcattgtgctgctagatcccaggatgactgatctgggtgtgcaaacattttcactctcttctggccatcagaggttggatgacttccctgactaatcctctggggcctgggcatctgtatggagttaacggcaagcaaggaggccctcctgagcctgggtgttggctgcatggaagatctaagtat

SEQ ID NO: 18851 - DNA, 1131 bp, Mus musculus
caattgatatctcctaacaatttctgaaaatcattcaaggtatgcattttatcccatctctcaatttagtacctaaatagtgttttacttctgtcttttgaaccttttctggggctatcaccaaattccacttctccaactatttagttagagtcccaaatacttcttccacttccacattagaggatccacaaatcaaaatatcatccatactacgctttccctttttgtctccctcatctttaaaggggggaggagatggcaacagaggggctgacagttcgggcggcctacagcgcctcaacctccagcggaacatccaactacagatgtcactgttgctattggtcccatcgctgtcactagtagacccttcagagctagattccttcttctctttttttatctttggtttgttgtctaagctgtttagattttcggcggctagcctgagaagcaatctcagcattgttctttccgctagcgtccctcaagcatgccctgaccaagatccaaatggctaacatttttactgtcattttagtcgcagttgaacccatatcgtttaaattcccttcgtctctattcctgagaaccttagtgctctgtccccttttttctgggaaacctatcaggcctatgctttctttacttgctgaaattcctttcgtctctattcctgagatccttaatgcttcgtcccttttttcccgggaaccttaccgtcatctctatacctgagaaccttaatgcttcgccccttttttcctgggaacctcacaggcctgtgctttctttaaatacggttgcttaccaaaatttccttacctccgtttactaaaatttcctactgctgtttatcactgcttaccaaaaattttttacttacctttgccgacctacgcgatgagttccccgttccccgtatgggctaccatttgtcgtcgtcctactctggccagcgacaggaacgacagggacacaggtcgggttcatgcagcaactttacttcaggctttttcttttacagctctcttccccagcagcttcttcttagggcaagggctaagctactcttattctacttctggcttctacctagggcaagggctaaacaaactctcttcacta

SEQ ID NO: 18852 - DNA, 1787 bp, Mus musculus
tggcccctgcatccagagtgatgcacacaccgccccttggacccatcctgaagaagacggctagcctcgggttctgcgcagtttccctctactttgtcacggccttcatcatccccgccatctccaccaatatccagtccatgcacaaaggcaccggctctccatggacctccaagttcttcgtgcccctcaccgtcttcctcctcttcaactttgctgacctctgcggccgacaggtcacagcctggatccaggtgccaggtcctaggagcaagctgctccccggactggtggtctctcggttctgccttgtgcctctcttcttgctctgtaactaccagccgcgctcacacttgaccaaggtgcttttccagtcggacatctacccagtgcttttcacctgcctcctggggctcagcaacggctacctcagcacgctggtgctcatctatgggcccaagattgtgccccgggagctggctgaggccaccagtgttgtgatgttgttctatatgtctgtgggcttgatgctgggctcagcctgcgcggccctgcttgaacactttatctaggagggggcggcaaggatgtgggtactgtgtgagtgtgtgaggcttgggtccttaggagatggacagggtaagccaaggtctcgaggtgttaagcaaggggttgacattttgtttgatgcagagcagagcccactcagactgcctttctctcagactgcttgtgagccacatccttgcacatcttgggcaaggagacattccaaacacagcccagcctggctcatacctgtaatctcagcattcaagagaatgaagctggaggcccactgtgagttcaaggccagcctggttacatagtgaaaccttttctcaaaaaataagctaaaaacaaaaaccctgagacattccaaacacttccagagaacactccagagccgactgaagggcagggtgaggttgtagccaggatctagcccagttggtaggatgcttgtttagcctccatagagccccagctcctatccccagccccgaataagctgggcatgttagtgaaagcctgtaatcctagctcttgaaaggtggaagcagcagggtcagaagttcaggtcatcctcagctatttagggagtttgaggctaacctgggctacaggagacactgtctcaaaaaaaaaaagacgcaattgtaaagagtggggtatgttacagtcatagctcataagtagcccatctctaatttgtattgtcacaaggccagaagccagcctcactctttccagctgacattgaggtgggagagaatctcagggctccctgttctaagagaggctcctggatttgaggtcccctctgcaatggccagtactcagacttagggccctgtcgttgtcctactctggccagcgacaggaacgacacagacaccaagttgggttcacgcagcaactttacttcaggctttttcttttacagctctcttccccagcagcttcttcttagggcaagggctaagctactcttattctacttctggcttctacctagggcaagggctaaacaaactctcttcactactactggcttcttttacaacagctaacttctaccacttacaacagcagcttttactactccatccttctcgcagcaagggctaaacttttctctctactcgcaccgactcacttccttctagctccacccccacctcatccaatcagaattcacatatgctccaggaatgagcttaggtcgttcacagataggctgacag

SEQ ID NO: 18853 - DNA, 1175 bp, Mus musculus
ctcccattaccaagacagagagacaaccaagtgagcttgcaggcctgatttaaagcacattagggaattctggggtaggtgatctctatgttaatctgttgggtcccagtctatggacattccattaccaggatgtgggggctggaaacttgctagggaagtctggaaactgtggctgaggaagtagctgaggaagtctggggatggctgctgacccattgtccttgcctcaggccaggtggtgggcagcttttgagacctgagctgcttgcctggacttgcccagttcttggagtcagagagttaggcctagtctccttaactgcccatttgaagcctgttatgaagtcagcctagccttctcagtcttgtcactgaggcaggtgacacactgtggccatgatagagtagaggcttgtgcaacttttgggggttacagggtaagatggcaggtgtcccccagaagtcccatgtgggaaggtcctaccgccactatcaggtgtgcatctctgaaatgtacccgccatgcgtgggtaagtataaacctcagaggacaatcctggatgtcagcctccttgccctccatcttgtttgagccgctgtctctttgttgtttgtctctgactatgccaggctagctggcccatgagaattctgactctgtctcccatctccctacctgagccttaggattacagatgtgtgcttcagacccagttttacctaggttctccgttgtaccttgggttttgtttttgtttgttttgtgtttttttttccctagagttatctgaggataactcaattgagaaaacgcctccctcagatcacctcataagcaagcttgtgggacatttttcttagtgattgatgtggcaaggcccagcccactggagtcagtgtgacccctgggtaggtggtcctgggtggtataagaaagcagcctgagcaagccatggggaggagcaagccaccccaatgccctcagtggcagagtatgacctgggcattgaaagatgaataagccctttcctcctctgcgtgatggtgatggggtgtgtctcagagcaacagtaaccctaactgagacatgaggatttacccactgggccagctccctcatcccagccttgggcttttaatttgtaaaaatggggcctatcccaggcctgcct

SEQ ID NO: 18854 - DNA, 2450 bp, Mus musculus
tccagatacttggatagttcctttttaagaaaacaaaacaaacaaaaaaaagtaagaaaaggaaaaaaaaaaccttttatccttgaatgtggctaagagtggctatgcttgtgatttgggccataggcgagtgcacttgtggacacatgtgtgtgtgggtgtggtcaataagagactgcacagggaaaggctttgctatgtcaaggcctcagtttccccagctgtgcagggagctgagacagggttttagccatggccctgagttctaaagtcacaagcagaagctggggcctggtggccttcgtcctctccggagccccctgcaggtgcccttctgtggcctcctctggctttggagggtccagctgtggttctgggagactgttcaggtctgtttggtgattcctggtctcgtgatggccaaaactcttactgagagggagggggtgttccagggagggctctctccctgggtgaggctgggtggctctgtgtctaagctggcactagccggtctgcacccctgtgcctctagccatcattttacccgctgatctccctactggggtcaggagatatgaaggtaactaagtagacagctgtatacccactcttgaccacagcgcattctgggatgttccatggggccagtggaagggatgaattcttgtccctttcagcccacgggcagtgacagggactaggatcactggtattgatcctattgagatgctgacttccctgaactgcccttgaccagcctgaaagctttgaaagttggggcctctgtgaggaggcaggtttcatggccacagacccagcaagcatctctgccctggttttcctgaagtggggctctgagacagaccaaggtgcccctggcatctaggtgaacagtgcctcatagagtagtcctcagctcctcctgccaaagatgctcatccctgtgggcatactctcactggtcactgttagcccgcacatagaagggggaagccaaggtggagctgtgctgtgtgacttcaggcacataactgctttctctgggcttaagtgtccttttatcctgggatgctccacgaggccccttgggttcccacgcttctctgagaatcgagtagagacaagttgattgtggtctgcatgctctctcctttgcccgtcctcggaaacctgcctgtctgggacctgagggagcacttagtgagcaagtcccagcttacagtccgactcttacttagaaggtgctcagcatctggggcacagaagctagagctggagcctggggtagggctctaaccagacagcccaggtaaggtcaagccaactctgagctgagccagacagggctgttgggttgggtttccattcctgcctccaatgagatgaagcctctccccttcccattcctagccagcttggcgttgctgggtcctgcagggtatttctgtgtcatcttgggtagtatgtgtgtttgggagcatgtgtgtgtgtgtgtgtgtgtgtgtgtgtgtgtgtgtgtgtgtgtgtgtgtgcatgcctgtgcttttcaacttggcacatcagggcacccctcccagaacacgcacacctatccccacatgtggacatgacctctgtgcccaggtttgtgccactggaggtgggcgtgcctgtttgctgtccccgagtcacagtcagttggtgtatctcctatgtgcctctctgctcttctcaatggggccaggtgtctgagttctggccataccccttgagggacagggacccttcttatccctggatctttcagggctctctggtcccccatcttgaggctcccaggcatccgagacagcaccttcctcccaccctcagaggtcaagtgggtgggagctcaggtgccggggtgtggacatggctgtgtgtctgtgggttctgatatgcaggggacggtcccggccctgttcgtccattctgtaaataacttgtaaatagtctttagcattcctcttgtaacaagattaatttttatgaaataaattatatttcctagtctaattaaaaaaaaaaaatccaggtcctggtctgatgtcttctcggtgtcttttaatggcagttgggagtgtcctgttctttttgtacgtccacagcagctcagagctccagaccttgatccagctcaacagccccatcccacaaaagggaaacagggctttctgacagttacacagcaagttagggcccctggatctcaccttgctcaccagccaagccttaaagcacacagcagaggagaggaatgtagagagaatagggtgtgtcccatctgaggctgagtggtcagttgaatgccatacaggcaggagagtgatgggagtacattgggatgtgtggctgggtgtgaacctggtggtttacaccctaggtaaataccccatctaaggaggagagtgtcatcagtcctgccacgc

SEQ ID NO: 18855 - DNA, 2550 bp, Mus musculus
actcctttgtttccttgtggggcttttagtttgaagaccctgaaggatcccactgcatagtgagtctgtcctggttattaatgttaccctagaaattgctttaaccttatttttctctaacgtctttagcatcgtctttacttaatcattgtgtggtggctccgacctgtcctgattatttagggaaagtgtgagatagcaagagggtgtctctgctgcctcagtggggtgttctggccatcaggcaggaagcagttatgtaccgtgttccctcaggtgggtgtctgtctgtcccacgcagggggaggttcagcctctgcttcaggagatgcctcttgtcctcaggatcactgtcattacagcttgctttacttttccaagcacacgtcggccagactactggcctctttttttgttttatttttaaataactggagtatattcccttggcagggtttgaagtgctcctttgtcttgtgcatgaccatggctgctgccatctttggagatgcctgttggcagtcatatacttgtttgttcttattactgtagggtaagaaatgaacatgtttttcagagaatctagggctttctggctgttggcactgcctctctggatggagtaggggtagatcactcctgagccctctcctgggccagaggagccacaaccagaccctttcccacattttcgtgaatagccacataggtaagcgcctacatcctgcacatgtgggcagtagtcttccccttggacattgccttaagccttcatgtaatgagaatctgcttttattgaagaaaacactccacaagtgtccttgacttcctcattgggtgtgaagatgtgcagaggacacttgctccatcagtgtgtgttcttcctgccccttccccccttattcagcttccaaaggtacgacagcattttagcttcaggtactggacgttcctcaggccccgctaaaaggaagcagacattttggagtagaaagggatggctacagccattacacttggggcctggggttccttcttaagactgattgcccagggctatacagggacaggaccaatccctggccaatttcccatttgcttctcccttttagggattgggggctctgaagtaggcagagccccgttcagctctgatgaccgtaccatgtgcctttctacccattcagtgagtgacaaccctcgtcctcacccaggccctggcagaagtagaccactctttgaggtgtgtctgcttataggagagaacttgggacagatcaccagaagccatgctctgttccttccccttctcagggattcctgagtattcagcctgggcattgctcgctgggagagccagaccaccaggctcttcctcaccctccttaggaagtggtcttcagcactgttctgaccccaggtgttaccagctggttcatcacagggcatgtgtatatgtccacttccctcctgtatgctctacagtgcattatgaggctcagggatggttggtgtgtcagagagaggctgaattcctgagtgtacacattaacagtggttagactgttggactcctctgggcctcctctctggcttacaagtggctaaaatggagaagcatcctttatagtctcagcagagccagggaccaagccgctcccttcctttgtggtagcactagcatggggtgctggtgtttttcagagggacccgctgcagccattttaattcatgattaggaaccttagtgtgacttaagagtttcattgtgtgtttatgtgtgcatgacatgcctagtcagtgacaggggtgggtagggtgtctagtatcatggtatcacgtggcttagtagatgccacagtagcttctgcaaacactgtactgtcttgtttctgtattagatgtcggtaatcatgtgaatatactgccatgtcacttttaatattaccagttttatacttggaaaatggtacttgcctctttgaaatctattttgtctctaatgtccctaccatctctatgttctttcctaactgcagcaataacccttcaaaagcaattgaataataaatgtcccaaactgtaatcattggatggttgatttttagatagatagatagatagatagatagatagatagatagatggatggatgggtgggtgggtgggtgggtgggtgggtgggtgggtgggtgggtgggtgggtgggtgggtggatggatggatagatagatagatagatagatagatagatagatagatagatagatcacaaatacagcagttgctgaatgggaaactggtgagcattcccccatttccctttccccctggaggcatctaaattgtgacatacctgcaacagtggccatcatgaggcacttcagctgggagcttcattgtctccaggagctgtggttatgtctttctggagaggtctataatcttggcccttagttccctggggtcttggctctgaactcctctctatccaatctaccagaacatacttatgtgccaggccttaccactgtctgccttaccactggg

SEQ ID NO: 18856 - DNA, 1099 bp, Mus musculus
gactcaaggagtacagctccatgggtaagcattggtccaggggtgctgcctccatgcttactggctaatgttggcataggtcaagatcacttggcactcactacacatactgtagctttaggggactctatgctcttttatggcttctgagggcatttgcactcaagtatacatagtcccacatagacacacaccacacatacaattaaaaataagtatttttaaaaagagtaaaagagttgagtagaaactcaatcctgttcttctattaagaacaaaggaatttcagtaatgacttaccacagcttatttttaaagctggaaatacaggaagatgtaagctgcctgctatgggcactgggaactgaattctaatcctctgcaagaatacatgttcttaactgctgagccatatgtctggttcctgaattttaggtttttgtctgtcctgtctatattaatccctgtgtttccagtgatgcctgctcgctgacagagtgacctttactgtttctgcagatggttcctggcaagaagggaaagcctcaggagctgtgtacaatggggaaccgaagctcacggagctgctggtgcaggtgaaaccctgggtgcttatgtgcatgggtgccattcatttcctagttcgtgtaactatttaatctctttcttgtaataataatcacgtaagggaaatttactgttgaaataaaaccatagagattaaaaagtttcttttcacttaaattggtaaatgtgaataataatgtcaaatgcatcttcaaatttcagaaaatgtgaaatgccacttatacctctggactttgctgtgtcctctgtatttctagcctttcatttgaggatactgcttgttttttgagacagggtctttacattggtcctggctgtccttgaactgcttatgtagaccagctgtttcaaactcagagatcttcctgcctctatctcccaggtgctggggctgaaggtctattctgctgtgcaggacttcattttgagattttccatgctatagccaatgttgtttgatatgggagttggggcaaggctgactcaaagcacactccacagatgagcctgg

SEQ ID NO: 18857 - DNA, 1733 bp, Mus musculus
taaattatttgccctcttgttctgtttggggctgtgacgctctttactcccgtgacagggttgggggaggagagggagatcagggactgccctaaccagaaatacctcagctagcagagtccgggctccacttcccagagtttttatatgatttgttcctctagtctcagtaatgccccttcccatacccactgggccatacagggctgaagcccatgcaggagcctgtcagagattcttgcttgtccatgacttctgactaccagggaggcctgtccagccatacacacacacacacacacacacacacacacacacacacacacacacacacacaccaaagacaaagcaggactcaggaggtagggctgcacacaggcagacttgggaagggtccgggatggatgtagaggtgaggcttcatggctgcagggtcgggcaggggagagttcttctcaggcctggctcttgtcagctgatggctgctaatctcgggcagagatcagttcacctttgccggccatagtgtcactttcgtggcccgatctgtccctgtagatgtcactgctggtgactctaggtaacagactgaccctccaatgtcacacccaagtcaccagaggaggaggcctggatacacagctttgacatccaggagttaacaagctggggcttggtccctggttagaccaggatcggtgacttcagtcatcacgggggcttgcaggagacccagcctgaaaggtgaccaccggaaagatgtcacctctaagactgtccccctcagtcatcactctctgctgaagtctactcctcctggagttgagggcgggggctcttcccttctggcttaaactgggcccgaatgcgtgatgctcagaagaccagtcaggtggctagcgacttgagaatccactcagctggactgtgcagagggccctggcaggatgctagctgctgttgatcccaggttagggtagggaagatgcgtagagcaccttccatggtcctcagactctcaggaaattgcctagaccctcactcagtttgagggccaagtggcagaggtgcttgtctatccaccttcctccgctggaggaaggaaagcccctggcctgcaagctctggagagctgggatgctgggaactctgcatgctcctcccactcctgtctcctgctctgcaggtgcctggagctaccctgagtcaagtcatgtgtggaccggcctggagatgctgatttttaaaacgttacctatttattaatattgcccttggtgttttgtttttagaccccaaaagtgatgctctgtggtgtgtgtgtgtgtgtgtgtgtgtgtgtgtgtgtgtgtgtgtgtgtgtgttttctgttttggaggatggggacagtgtagccagcactctaagagctgggcctagcagttgtaaggtgattgcagatgggaacaaacaaggaagggccagaaagacctgaatggctttgggcaagttaccacaccaagggtggagatggctgggaggtagctttggggctactcaagaaaagtattttaatgatcagagctttgcaactctgcaaggggtagtttccttggatggtggtgaaccaggttgtttgtttgtttgtttgttttttgttttcctggaaggatccaagcagaatctgaatgccaagcaggaagaagggttgtggtgcatcttactggacaaaaagctgatgacgtgaacgcact

SEQ ID NO: 18858 - DNA, 1241 bp, Mus musculus
ctccagagcaatatgcagacttgagttaataattgcctgccagtgttggtcggctcatcctgacaacttgaaccataccatgcaagatgccagtagtggggggaatgggtatggagtgtatggggtgtccttactgccctggcaacctctctgccaaccatacaagtcatgtatctcttctctggaattcttgagagcagaaggtttgaggtttggagcgtttgcatatcagcagctgcaatcttggggcgaggattcaagtcgaaacctgaagttcacatttgcttcatactccccttagatacacagccagaaggtgatttttacacgatatttttagtgcacctgaatatttgacagtgtcccatcacaagcccaggtgtggaattttccacttataatgtcccactggcattcaaaaaaaaaatcctcacgggagctccttttgcaaggctcagcagtcagtggggagatgatacctggtcacagtgctaacagcatgccacttgagtgctcagccctagacaggacacccttatcaaccccagtaccaaggcacggggaacatctcagaagaggaggcagaggaagatgtaagatggaggaataggggagaggcggggtgaaatgctcctgcctggacatgaactatttctagtgtggtcacctgcacaagatcggtacaagaacaagccaatcaaaatccctacacagatagggcagaggcctctgtatcaaggaatcgaggcagtgaatagtcacagggacttgaagaaccattctttattgaagatgggtccattgacacatgctccgttagatggctccatgcccatgcgcatatgaatagcactaactagacttggtggatgtgtgtgtgtgtgtgtgtgtgtgtgtgtgtgtgtgtgagagagagagagagagagagagagagagagaggaagttgggagggggatgaggagagttggagggacatgggggaaaaacgtggtcataggtcattgtatacatgtttgaaattcttaaaagcaagcaagcaagtcaggaggcaggcaggcagggctgcctcttctgtctggaatggttgctaggattcaggcagggagttgatgcaaggaggatccaggtgggctgggttagcacttagtggcacttggcgcctttgcctctgtgtgaccgcaggtggccttaggctccagggtcttggttcttggcaccatgcttacgctcttagcctgaa

SEQ ID NO: 18859 - DNA, 1207 bp, Mus musculus
ttctctgcccccactcccttccctggggctacaatggttgcttgtgttggccaaggattatgtgtccagacccttctctactgagaaaggctttgttagggagagggcactggggacacaaggtaaggaggcagctgggtggccttactccagaatgtgaacagggctgtgtggagcaaccactgccttaggctggagaccctcctaggaaagcgagttctggcatttctcaggctaatgccttaggactttgcacaggaataagtagcttggtggggaaggcaggtggcactctctggggagtggccttcccacacctatatccaatgttcaatgccaggttccagtgcagcgaatgctaggtgtcatttgtccccagtcagaggagattggctcatgttccagtaagctttgagtcaggtgagagaaggctggaggatagtggatgggggagaagggttaagagtaaggatgctggggggggggggcatgagtgggggtggtgcgtggggggaggagcctagagaagacaggaaagcccagtggatagcaggacattgccctgtctggggggagggccatgcacagagaggaggtggaccagcctgcctgtagggagtgtcccacacagaaggaaaggcagcattagctagatgctgtggtctagttatccaagaggggagggggaggcggatgggaagagggaggggggagaggagatggagcgctgaaaagtaacactgcagtagcaagtgtagagagaatccagagcccacagacaaagagggtgtgcctgacctccaacctgagctcctctgaacagcccaaatcccaggagttggagggggtgggggggctacaggaagggctcgccaactgtttcctctctatctcaccacaggacaactgaggtcacactactgagtaccagtagagtcagacctctccagctgaggtccctgctggctgagctgtgaaagaagagcccctcaccaaccaccacttccttcccgctggcctgcttgaggtcttggggtgaagatcaggtggctcaagtttgagacacaatgtatgtttattagggagttgccggtgtacgtgggagacagagctgacctagaggctgctgttgttacagcatatatccagcaggtggctgctgcttgctgggcatcagctactgttagagacttgacatatctgatta

SEQ ID NO: 18860 - DNA, 2095 bp, Mus musculus
gcctccgagcccagcaagggaagggcggtttgaggacagtaggcctgatgctacctccacccctgatgcccctatctctgccctctccaggtggcaaccaaagctggcatctatgagatcctcaaccagctgggcttccctgagctggagagcatcgaagagcagcccctgtcgaggctccgctaccgctggcaggagcagagtcgagacccagagccctgtgatgttggggacttcctgtaggccttctttggagacccagagccctgtgatgctggggacttcctataggccttcttcttgccccttgctaggcaggttgggggacctgagggtctcattgcttcggatggacacttgtccgcttcttggtgagacttgaggggccgagagcctttgggaagaggtgttttttttgtagggtgtaagatggcaccaccattttctgtcaaccttcggggtgcgtaatggcctctggccaggcctagcacatgtacctcacagaccaactggcaagcagccttcagggagctcgatccccaaacagccagtcaccacctctgtcccctcttcactgttggtcgtcagactgcctgagtggacagcaggctggtcgcgtttgtattttcacttccttcctctgactggcttgctcttgtctctcagtctttcatcccaggcagctgcctgaggtaggtgaggaggatggtgagccaggcaggtctacaataaaggcagctctgtccggctccttctggctcgtgagtgtcaccggcctggaagactgagggaatggctcccctctctcctccccgtctttccccagttccttccctatgttggcccatgtgcccagggagttggaagcatcagggagaccctcttagtgtggggaaggaagtcagagaccattgacacagtgaagaggcaggatcatgtgttggaagcctgttagcaggaccaaggtgactcttgggagagactcttgtggacacaggccgtggtggcttgtcagaccttaagggtccaggcccacccctgccaggatccctggtctgctttctccaggacacactgggacactgctgagtaatgagcagcttattacacacaatgggaagaggggcagagagggctgtgtttggttgagtctcggctgggactgaagtttgccataagtagtggttgtacatccaggagcctggctacctgtcttaccccttgaaggacaaggatgaatctctgggtagctgtccttcaggaagatgccagctgtgctatttgaagaggccaaagttgttcccagcctggggagagtggtgaccctcttagctgaattcttttgcaagctgctgtatgtctgtccacgccttctcaggtttgctggtgtctattttgtacaagtcagtgcttttcagaaaaggtctagccagtgagtcagaggccagagagacccttcacactcttgtggttggcactgacttggagatatgctgggaccaatggcagatcactttacctctctgcctcagtgtcactgtctgtaaaattggagaataatacttgcctacctacctcacaggggtgttgtgaggaatcctttatggttttctgtttttttgtttttgtttttgtacagagcttttgagcattaaaaccatctaaacatgtaacatactgctttgctgattggtcttcagtgtgaggcagacatggaagccgtgcggataaatgtgtcccccagagtaagggtggatgcaggagaatggaatgtccttgttaccagcacccctgatgtttagaggctgcgggtgttatagatgtcacatcctccttccttgtcattaatcacagcctaccatcttatactggatgtttaaagtggacgtgctgatccaccatccactgtcaatcaagagaatgtaccagaggcttgccttcaggccaatctagtgtgtgtgtgtgtgtgtgtgtgtgtgtgtgtgtgtgtgtgtgttccttacttaaggtttcttcttcccaaatgcctctagcgtctgtcaggttgacataaaactaaccaacacacacacacacacacacacacacacacaca

SEQ ID NO: 18861 - DNA, 1170 bp, Mus musculus
gatgctgctccgctctggatggaaccgggcccaggctccatctgggatgtacctcctccatcagactcactgcctgggaaagtcccagttgacattccacccatttcgagttttccccccaccttctgtccatctcagcttctcccagccttgagacagaagatcccaacagcatgtggtaacttggcttctgcccctcaccctccagaatcagtctttcccagatcccttcctgcttcagcaatccacttacatgttaatcagaagccgttaagagaacatggcttagcattcggcattggggctgctttgggcaataaagggaccccaggggctacagagaagcggaaaaataggaagtccctgctctgtgtgtgtgtgtgtgtgtgtgtgtgagagagagagagagagagagagagagagaccctccgtgtgtgacgtgagcaagtatagaatggaaatctgggcgtggctggcttgttagtcatggcaaaatagaactggtcctggggtacagcgggactcccagagcttgctgagctgagatgccgggactttgattttagccttctcattctgatctttgtacacacacgctcccctttcctcattggtgggacactgtaggctctgagtacccagtgggctgtgcctgaggctaggctcacttggcatgtgccgacgctaagccgtgttctatcgaggtgaagaaaggcccacggatgcctgtctcggcttctggacagtccatgatggtggctgagcccttcataccactgtgattggtgttgtatggtggaagtcaagtgggagtccttctggggcagtcttatccatgttggcctccacttacctcagttgctggccttagaggcctagccatgcctctctattctccagggcaactatgaggctttgtctaggctgggtgctgtatgtgtaggcgcatgtgtgacagggtctctctctcttagctttggctattctggaactcactctgtagatctcacagagagctttacctgcctctgtctcccagtgctgggattaaaggtgtgcaccaccaccacctagctgtgctcacagagttttaagaactgcctcagaggcccagtgagtaaggccgcttgccaccaagactggtgttttgagtttgaccccctggacttc

SEQ ID NO: 18862 - DNA, 1168 bp, Mus musculus
atccacggaggggggtggggtgatcatggagaaaaccctgtgtgactgaggtggtatccgtgtggcagctgtaggtctgtgacagatgcggctgtctgtgtggtttgcctttccgggacttgctggtgtatctgtgggcagggtctgcctggcatgtgtggcctgtggatgttgctgtgatagttgtcagggctgttgccttttgcttggctctctttgggtgcatcgccagtggagtgctgcctcctggtggctggtcaggcaaggacacagcaccagactggaaaatttatgcatgcatcaaagttggcatactgagtcccagaagtgtgttgtgtctccttatatgcccagtcttgggtgcatgggatagagacagttatgggggtgtgcatgaacacagctgttcatacatgcatggttttgtatgtaacctagtgaactgtgagtgtgttatgtgtatcatgagtcaccaggggacaaaaatctggggttaccatttggatggcagtccccattgtgaatctggatggccagtggcactcttggactcaaactgtggtcttgtcaccccaggactttgaccggctgcttgaggccctgcgagctgctctcaccaaggacccgggcacaggctttgtcttcagctgcctcagtggccagggccggaccacaactgccatggtggtagccgtgctggcctgctggcacattggggtgggtgtggtcctcaccttccatgtgaggtcagaggtcatccctggcaggggtgggtactggcaatggtgagtgtggaagggcagaggtcatgtcatctaggggaccttctttcatcagtcctggcagaccctcagcagggtttctgggggtggaggctgggggtgtagaatagggagaaactccatcttagcttcgtcattcctcagggctgtcctgaggtgggcgaggaggagctagtgagcgtgcctgatgccaagttcaccaaaggcgagtttcaggtgggtatgcccctccccccaacacccccacccctgcgggtcacaagtcttgggtcatgttggcagcttggtggggtggggctgtctgtctgggaagcagactgtggctcaaaacagcttgactcttaagcctctgtcacagtagatggggtctagatccttccttccgc

SEQ ID NO: 18863 - DNA, 1398 bp, Mus musculus
gaatgaaaataatttcctatttttgtaccagaagctaagttttcactttagccagaaatagtaactctgcctttgccccagcaaatgcaaactgaccctccctccttcctccctttcagagcctgctgaaacgataccaaccccaccgggttccttccacgtgctgtgcccccgtgaagaccaagccactgagcatgctttatgtggacaatggcagggtcctcctggaacaccacaaggacatgattgtggaggagtgtgggtgcctctgacagagccagggggagtgctgaaattggcttgcattccacaatgctgatgaactccaaggagactccattgtgtctatccagggagcagaaacgttagaagagttctgcctgctggagctaaagagaaaagccccgccccctgtgcatacagtgctcttagacctgccaagccagagagaggctaccgtggcatggcaggatggggaagccttgcaggggctggctcgctgggctccctggaaatagggtttatgaactgcttgaaattgtgtgcaaaggctggggtgtatatatatatatgtatatatatatatatgtatttatttttgatgccatctgtaactttcttgtattctcaaaagtggtctgtgacctgctgtccctccctcaagattagtatatattttattagattataaacgagccatttggttctccctgcctcaagctgtggtagggaagacccacaaccttctggctggctggcagtgacatactggccttggtcaggggctctctgatctctaatgacttgcctaaaaaagccactgtccagttctccagggccagttggtgcctttgaccagagaggtgggcacttgtccaagaggggactggccatggtggactttagaagccagagtcctgagatgtatgcttggcagacacaacccaagtctattaaaagtctgtgacaattcacctctgtctcacaatgtgtttctaggttcctgagttccgatccagcaggggatgggcttgtggtcttagcttttgcagaggttatgtgaggtgtggggaactcactgcctggcatcccctagtaaaacaaaaagtgggagagcctgatgcatatgtgggaagtgcctctgagagcttgggaatgactggcctagtagcagacacttgcttagtacacgtaggaccctgagttaaaccccagcatgaaaaagtcaggtgtgtagtggagcacacccttaattccagcagttgaggcagaggcaagcaggtctctgagttctaggacaatcagagctacacagtgagaccctgtctcaaacaaaaagctgcatgacagggagggccatggggcttcatgtcctctaggccttctccatctgagtct

SEQ ID NO: 18864 - DNA, 1146 bp, Mus musculus
ataagctattaggacagacttctatctgcttgtcctagggagaggcggcaggaagtgaagattcccagatctacaccctcaactgccatcttctcaagaatgcttgctttgcaggtctctgaggcggccgctttaagcattgcttaccacttctgtttgcctttagccacgaattgactaaaggaactgggggcattctggggagctgcttgtcaggcaggtaacaaaggatgttagatgttaggttcctgagctgcagaacaaacagcagttccctttcccttctggtgatggtgtggaagccaggtgccaggtgagtcagtgcattggtcaaggtctcccacccagaagcagcgtctctgtgagccaggccagctcagcatgcagaggagcaaacgaacaaatcacctcctgggtgccttgttggaagtgtgctcttaaagaaacctgtaagagaagcttgagcggtagctcaccagtgcctcggatctcacgggatgtctgctgcttcctgctagctggtctcgccatccttcggtggaagctcttgttgggattggtgtgctgtccttcactagcagtttctttcttgtagccatacttgctttagcgtgtgctggaggtcctagtggactgtgggtttgggccgggggctggcctgggtactgtctccttgggcttctcggaccttcccagttgagttgggttccactgagtgtccagacacccagctcatgcacacggctccggtgttggcagccatgtatcggggatggaaccttcttcccatctctatcttgagtgttggcggcttgagggggttgtgccatagccctttcactccctcgagaaggaaggcaccactgtcttcatgtatgtagttcaagttctttgatgtgttttctggactccatgcccacggcagctatttattaatgtgcgaaactcaatcactgacccatccttaccacaggaaggtggggccttcccatgtagtgggggaagaccatttcttagggcagaaggttctgtctgaacttggagtggggcatggttcctccaacccctagcctctcatcttttactgtcgggaattgggtttctgctgttgactcggtcctgcagtgcttagcagtgtttcctgct

SEQ ID NO: 18865 - DNA, 1297 bp, Mus musculus
tgtgttttcaaaaggaaactttatttttaattcttaattgaatattggtgatttttttttcttaaaatagcaaacaggcttgtcagtgaggaacaagggtgattttttttcctttccttttaaaaaaaattttttttaaatgttgtttttattaattctttgaggatcttttacagtgtgcttggattatacttattcctctgccctgctgcctcccagatcccacacctctacccacccaacctcatattctctgttcatatttctctctcaaacccgtcaagccctgtccgtgttggctgactgttcctgagtgtggggtctgctctggagggggagcagtaagccaggtgtcggtcgcatcagtagagaagactgactcttctcccagccagagtcagcaccagcgtctcctcggtgaggatgaagcttcatgtccacttccctttatgctgggatttggcctgatctgggcatatataagtctcatgcaagctgtctcaatagctgtgagcccatacatacatccgccctactgtgttcagaaaaaggctgtttttccttggatagatccctgaaccttgtgtgtgtgtatgagggggttgtaatatagatgttccatctagggctgcccactccaaagtctcatactctcaactcagttgagatcagttgttggttttctgtgttaactgccatttacagcaaaaaaaaaaaggaacttcccatgaagctggagagatgctccaatctatggatataacagtatgttattcagagccatttttagtgttatatccatttagcagaatagcggtcttagggtctcccctagagacatgatctacctagccacaggctctcggcctggccagcagtgtcaggtatgagttccgtctcatggagttgggtcacaaagtggttggttacttcagataacggttgtgccattgatgcactggttggcatatcttacttacagggttcaataggggggtgaggttcacagggggtgaggttcatggggggtgagtttcacagggggtgaggttcatgggggatgaggttcatggagtgtgagggtcatgggggtgtgagggtcatagtaggtgagattcatggttattcttcttctctggtgctatgcatagcgctttccagtctggtaagagctagcaagtaggggtgaagctttccattgagtgtcagctagattctccatgctctatgtctgactcatgtgatttcttcagcagtagggtctccttaccaccgggttctggagggaagtcaagcc

SEQ ID NO: 18866 - DNA, 1108 bp, Mus musculus
cctctgtgctctgcgtagccaccccccaccccagcccttggtagctctgatcatcggttcttttaaattatttttattttatttttagttaaaagaaatttaaacttacggatgagtgtgtgcacactcgcagacacacacacacacacacgcatgcgtgcacacacggaactatcttggggaaatgtgatgctgtttggtgtggtgtgccagtcagaaaggacaactttcaggagccctcggggcttctccttcatccttgctgaaacactttttttatttttgagatagagtctcccgtagcccaggcaggattcacactcactgagtacctgaggataaccctgaacatctgaccttcctgcctctacctctctacctactgagggctggaattgagtaccacccccttccagtttatgcatgctgagaaatgccatcacagccctctgcatcttagcaagtagtccaccaatcagctgccctcctgtaccccagggcacgcctccccagcatacccgacctctagctggccacgctgccagcttcttgggttttgtttattgggactcatttctgcccgaggttatgtgtcattcactgccagaatggatatgttgggtagcctttcataaagtcccagggctttgggaatggaaggcctctttattaacactaagtagtgttttaattagaagtttcggggaggggtgtgctgctcagccttcttgcagtacgtgtaattacgaggataattaagcctggtgttcaccggtactctcttccaaggaacgtctctcttgatgctcagctaggtgctgcagggcatgctaggaaaggaccctggagcccagatgtgccccagtatggatggaggggctcagggtcgccctgctgcttcattacccaccaccctccacagctcctggcatccctctgtggataaatgccaccaggcatcacaggacttgaatggcagaagccttcatctctggggcaagaggaagcctgggagaccagagaaggcagaccaggaaggtgggaacctcacggagagagacctcagggcctttgcccatgctgtttctcttccgaggttacctttctt

SEQ ID NO: 18867 - DNA, 1107 bp, Mus musculus
gaaatatctttgagatctctgagtttctgtaaagattttactcagcaagcagagtaggctctgaggcagctttaaacgcttagaaggatgctccccatccccagccttgagggccaccccccaaccaggcctcctatctgggtcctgaaagacggagtccagtagcatctgtgctcagcccagccgccctgttttccagtgagtgccaccatctgattccactctgcacttgacgctgctctggcctgagaggaagaacaagggcatggaatagcgacatcctgggccgtctgtggtgggctaagccaaccgagaggagttgggacgcttctgtcagctttccgaggttcaggatggggtgccgcctgtcctcagagttttccagtggctgaatgtcctcaggtgtcatggctgggaagtatgtggcttccatggctgtgtagacaggtctctggtctgtctgtgactctactgctctgtgctctccccaatgtagcatgcctgctaccccatgtgcactgcacgtagtgtctgcagattaccggccggaaagctcaatgccacagagcagggatttgaaagcctcaggatgcctgtaatgcccccaagaccaagtcaggctgagtctttcagctgcaggctgtgatctactgaggaactgtaaatggtaaattagtgggttgagaccacagggttttttttttttaatagagtagaaaatatcagggcacatcacatgaagcatggtaagttgttacttttgtgtcttttaatttcattttcactgtgtgtacactcaggtgtgtatttggagtcatggtgaaaaattgtgtttcttaccgtgggtgtgataaaaactaccagggctgtcaaggtgtaatgtgcttgctacccaagctggtgagatcctgaccacctgagtttaatcttgggggctcacataaaactagaaggagaaaaactaacttcacagaaggttctttgaagctgaacatagagggcatacatctcaggatttgggagacagagccattttggtctgcatatagtgagtttcaggacaaccagggctgtgtagagagaccctgtctcaaaccaaccaaccaa

SEQ ID NO: 18868 - DNA, 1184 bp, Mus musculus
ctgtgtatggtaggagattgttctaggtttcttctgaatccttaagaaactgcaggcagctgggcatggtagcacacttttcccccccttgctttcaaaccattttattattattattattattattattattattattattattattatttgatattttcttcatttacatttcaaatgctatcccgaaagtcccctatacctttcccccaccctgctctccaacccacccactcccgcttcctggccctggcattcccctgtactggggcatatgatcttggcaaaaccaagggcttctcctcccattgatggccgactaggctatcctctgctacatatgcaactagagacacagttttggggggtactggttagttcatattgttgatcctcctatagggttgccgaccccatagctccttgagtactttctctagctccttctttaggggccctgtgttccatccaatagatgactgtgagcatccacttctgtatttgccaggcactggcatagcctcacaaaagatagctatatcagggtcctgtcagcaaaatcttgctggcgtatgcaatggtgtctgggtttggtggttgtatatgggatggatccctggatggggcaacctctggatggtactttcttctgtctcagctccaaactttgtctctgtaactcagtggcacacttttaatcccagcactggggaagcaagggcaggtagatctctgaattcagggccatcctggtctataaagtgagctccaggacagccagggctatacagagaaaccctgtcttgaaaaaaaaagaaaaaagaaactgcagtcttccttcccatcctctccaaatggttgcctatcacatgcccctcagtaactccctcatccctggaaaacatttcatggtcctcttgatgtgcccatggctgcacccagcaggcagtgaggcaccaggcatctcagagaggttaaaacccaggcactgtgggcatgcagtatattctgtaatcccagcccttgagagataggagtgttagggagtttaaggtcatcctcagctacctagtaaacctgaggcagtcatgagctatctgggaccctaagtacacacaggggttgggggaccggctgagtcagaaaagtgcttttcttgcaagcataagaacttgagttaagat

SEQ ID NO: 18869 - DNA, 1192 bp, Mus musculus
ttttgagtcaggacggcactgtgtagccatggctagcctagaactcatagggatctgccagcgtctgtctcctgggatcaaaggcacatattgacacacctagtttcattctctgttctgaagcttacatttagcttagcattatatgcataatcgaagctccaacatttcattataattcttctctatagttaaaagttcttaaatggaaattgtaaagtttgtttgttcgtttgtttttttccttgacagtttctctatgtagtcctggctatcatggaactcattctgtagatcagtttggccttgaactcagaaatccgcctgcctctgcctcagctgtgcaggattctaaggcgtgcacccccacatccagcctgtaaaagttttagaagcagctggtagctggtttgtattttttcagcagatctcgtgggggttgcacttgttcagcagcgtgtgtgtgtgtgtatgtgtgtgtgtgtgtgtgtgtgtgtcagagtgctgcactctaaccctcgctttgttttagacatgggaagacccaggacacagtgacaagcacactggctgctgtggtgacaacgacccaatcgatgtttgtgaaatcggaagcaaggtaatgaagttgaattttccctgtgacattaaaattaacgactcataccagtttctgttttgaaaattaatgtgaatgaactgtgagcactggtgaatagtcaggcctcctgaaggctttgggacgatctgtgaaggactcagccaggttctccagatgtgagaagtgggctcttgttctaaaattcaagagctcaagctcggcagaataaggagcaactcaaaccaatgttgttagattccattttttttttttttttgaaaaaatgtcatttatttttatttatatgagtacaccgtagctgtcttcagacacaccagaagaggcattagatcccattactgatggttgtgagtcaccatgtggttgctgggatttgaactcaggacctctggaagagcagccagtgagtgctcttaaccactgagccacctctccagctcttttgttagattctttagtcagaatttctgtctgttttgttgtggttctgggggttaacctcagaatctcagaatgctaggcaggtgaaaaatgtaaggacatatgactagcttagttcaatggcttcaa

SEQ ID NO: 18870 - DNA, 1104 bp, Mus musculus
gagacagaggcagcagatctctgtgagttcaaagccagcctggtctacagagtgaggcccaggacagccaggaatacacagagaaaccctgtttttaaaaaaaaaatcaaaaggggcaggggtgtgtgtgtgtgtgtactcgcgaggggaactgactggacagtttccaatgacctccacatgcatgcagtgtgcaatttcatgtgtacaactcccccacctccatcacacttcgtgtgtgtgtgtgtgtgtgtgtgtgtgtgtgtgtgtgtgtgtgtgtttaagacagggtctcactgcatagtctgtgctctctggccttgaactcacagaaatccacatacctctgcttcctgagtacaaggattaaaactgtgtgctatcatgcttgacaataaaagtatttaaaaaaagcttgactcaagtctattaaatacacacacacacacacacacacatacacacacacacacacacacacacctttcttatttcttacttgtcaccatccccaagatagaacccccctgctttcgttgtgtaataccgtttgtgccgactctggctgttcctcaggtgtgtgccagaggtgagataatcagggtgaaggtcctgggcatactggccatgatcgatgagggcgagaccgactggaaggtcattgccattaatgtggacgatccggacgcagccaattataaaggtaaggaaatgggaagcctggaaacagaacgtcttctaacccttttgtctctactcccagttgctgggtaaaggtagcactggttatgatgctttcaaaaagccacgaatgaagaaaaaaaaaaaaacaaacaagcaaacaaaagccacgaatgctaggcggtggtggtactctcttattcccagcaccaggaggcaggcgcaggcaggtctctgagttgcaggccagcctggtctctagcatgagttctaggacacccagggctacataggaaaacactgtttcaaaaaccaaccaaacaaaaaaaggcagtgaatgatgagagtccatgcaagaggcacacaggcattctgtaatccggagcagataatacccatgagaccacataaagtacaaatgca

SEQ ID NO: 18871 - DNA, 1274 bp, Mus musculus
cctgcaatcccagcactctggaacctgaggctggagggtcacaggctgaaggccagtccgtctgggttacatagcaaaaccctgtctgaaaaaaacaaaacaaacaaacaaagaagagaaaaaggaatccataagtttcttctgttgagaaaagggccctgctggcatggtagtgcgtgcctttaatccctggtgtccaagagtttggggatgacctgggctccataatgagtttcaaatcagctgagaccatatgaaacctcatctccacacaggaagggagagggtagagtgagaaagcctttggctaaacgctgctgagttccagccctgcaactgtaactttgcatacgtgttctggaagtctagaggaggagccttgcagagcagtatatctagtattccttgtttggcaagcattctgagttacatcgccagctttttctttgttagatgttgataatttgggtttttaacagattccaatttgtctttttttttttttttttttccccttctggatacagtggataaatggttccatcagcagaaaaactgaagagcttcctctggaacacgagctgttacggccgcatcctgttcacctggaagcattagatgcaaaagattttccaagctctaaatttctgtagctcaccgaatgaagtagactctgctgtgactggtccactagttcagaactggttcagaaggttagccatctagacacctcacatctcaaccaagacagcttttattaaaccttagctctcaaagccgtggggacatggaagtcatttgtgcatggatgtgcagtgtggacacctattggatgtacatgtttactgtgttaggaaataaaattattttactgaaacttggcttaggatagtttcttattctggagccaacattcccacactggcgtcggtactgtgtttctttcctaccagtagtcttagaattcagttatatactattaaataaagactgcacagtggtgcacacctttaatccttgtactcatgaggcacatgtaggcagaactcttgagttcaaggccagcctggtctacattgcaagttaatataacatttcgagtacctgttgaaaaaaagcaagctgtttgtaggaatctgagaatggaacctcttgcacatacagaaggcttgttccatgtctagttcccagcatcccattcgaaagcaaaaacttttaaattactattatgttagcagacagtgaaatctttactgaaggtggaagtcaacaat

SEQ ID NO: 18872 - DNA, 2228 bp, Mus musculus
aagccacacgtctgtctacgctcattgcccagtggtgacatgtgctcttctccacactgcctgctgttgctgccgggcagtgtgtggggactggggctggcagcatttgccagggaaagctgggtgccatcatgggacacccgagaagaaaaacatgtctcaccactggttgatttcaaaagaaagtgattctattttttaaagaaagtgttgttaatgtaattggtatcccttctctaactttttcagttcacaatttacttggtccagattttctattctttttttttaactagtaaatgaaatttacatacttcataaaattatgaacagatagcgcattgggctctgctgtgtgactgcctgttgagggtggtacccgagacaagagcctggagaggacagagcctcggccttccccagggtggtctccaccatggtaaggggagtcctcatctggagtgggtgaagtatcatggtcacgttgtcaactttatttgcagttaccagtttcagcaggctttgcttttatactgttgtgaaatttcatctctctgtgtagcaccttccttttttccattgtagatataaaaagtgacttttgcctcatgaaagagttacagacatctgtcatgtagaccccatgctgtgggtgtgactgatgcttttgaacatagtctagagggacggttctgaaccggagggtgcagctcaaaatcatcagcttaaggctctgaattctgtgcgattctcatctggcagcaacaagagaacccaggaaaaaccctcaggggactctgtgttttctccttcagaaataacagaaaacccagatggccttctggcagcagcgagtgctaacatgaaagcagcagcggccctgtgaggatcatgaacaggctttttatatatatacagatagcatttggttttcttgctgccgtgtgtgatgttaactttatattttacccttgagtgcatgagaggagatggtctgcagatgggagggtatcttgattctgatttcctttaatgcaaggtgagagtaggttcttaagtggagattctgctgttgctgctgctgtattctgacaggctcgtgtccagcaagagggtagggaagctagaagcacactcctggagagtgacttaccacattttagttttgagcactgagcctatgggacagtgttttgttacactgccgggtttccaatgcagaggcttggtgaggtgtctgtctgcaaactgcatgcactgcgttcacccacgtacagctgggatgagaactgtcagtgtggaagggcctactgttaaagccctgagtgagctaggtaggtgactgttgtgcccttcattgcctttggctaaagactgtccacatgtctgtccaggcacatgacaggtgtgagggcctcagcgttgggttcttcatctgtctttctcgtttgtccctaattgctcggtagcaacctagaagactggactctgcccagggtggctctttgtgaaagtggtttattctggccaccggagaaagatggctgaacagtggcaccagtctgcttcatgctgcacagaacaccgtcttaagtaaggtggccaaaagaggttgctgcagcaagtgcaactctgccagggccatggccaggggctccaatgaactgagactcttcattctgtttatcagagtgcacatgtgtcctgtttcagcaaaagtaaaactgtcatttacaaaaggtcagtctgtatcctaagcattttaataaaaagctaaaatgaacttgcctctctccttttttaaaattgatttattctgagtaagcatgcgttgttgggaaggaaaacaagaattcttacttatagggaaggacatttaaagagaatgtgagtcttgaattgctaccaggataaaagaccaagtaaaaaaggctgagcactagtagcaaatgcagtactgtttgatcatgaagtggcccaaggttgttggtcatctttgcaacagtgctaaggactgtgcttgcacgtactagctacacgttcagagccacacttggcgaaacagaagtctgattccacatttacattacagttgcttatagaaagcaccagaagacagaacaaaatccgaaacaaaacatgctggatgtgtcctgagatcacctttacaggggaaggagactggttctgtgggcaaagggtatatttgccagggacagagagagacc

SEQ ID NO: 18873 - DNA, 1164 bp, Mus musculus
ctgtccaagcatcagcaaggcctggtcacagcactcacctggttatggtcaggcatacacagctttgtatagatgtgtgatgtgttgggaaagcacatctggttaagtgtagatttcaaggttgatacctgtacctgtattctgacttcagtccatagcacactcattcattctctctccctctctctccctttctccctccctccctccctccctctcaaaataagacactctcaatatgcccagagctcacagaggtctgcctgcctctgcctcccaagtgttaggatcaaagatatgagccaccatagccagcccattccaagacttgtctctcgtattgctctcttcccagtgctaagacaacagaaggctagcttgtcaattgtttcctgtgtccccaggaatgtggcaatctggggacaagtggtgtttgccactcaggagacctctccatatgacatagcagtggtgagcctggaagaggagctgaatggtgttcccacgcctgtccctgctgggcacttccatgaaggtagaggacaaagggactgaagtgatggtggtgtgtgtgtgtgtgtgtgtgagagagagacctgatagccagcaggcagaaatgggcaaagcctgccaagcaagagagttgggagcttaggtagggtttggggcttcttagacttccctgtatatcagacgttgacacctcaagtgctgagccaagtggataccttattgagggcctgaagcagggtgatatggggtcctgggccttgggaactccagtgccataatttgggtggcatgtcttagatttttttatgttttgagacagcatcatcataaatagcccaagtgggcggtaaacaccccagacggccaaggctaaccataaacttctgattctcctgcctcttcttctggggtcacacatgtgctatcacactcatttcatgggatacccagggtttgtgcacgctaggcaagcacaccactgactgccccagcagtctccagccccaaagattctatttcatatggtgacaaaagagagagaggtcctctagattagcatctgtcctctgccgtacattcttaacacacacatacacacaccatctcagtttgcccttttgtcaaatggggctggtgcgccttcgggtgcag

SEQ ID NO: 18874 - DNA, 1185 bp, Mus musculus
atctttaattcaaccccagcactcgggaagcagaggcaggtggatatctgagttcaaggccagcctggtctacagagtgggttccaagacccagggctacacagagaaaccttgtctcgaaaacaaaaattttaactagaggtatagcttaatggtggaacatcacccagcatgcaggggactggggagagaggtgctaggccttctcccaagcgtttcgaaaacaacgacgacaacagtaataataattccattgaaagcttggctcctcagatccagtaagcaacctttcacatgcgcagcagccctgagcagcagagacaccaaacacttccatcactggcggttcagagaaacaacagagtgcttagattgtcgctctgccgatctccaccataacaaaatagcatacaagagttcgtgccactgccactgggccccaggacaatcctggtgaggagggaggcccagcgtgaatgtagcttcttgacctagccgcttggcttcgaattcagtgcttctcaaacatcctagtgctgtgaccctttaatacagactctcaccttgtagtgaccccttaaccataaaattattttcgttgctacttcatagctgcgactttgctactgttatgaatcacagtgtaaatatctgatgtgcaggatagctgacttgcaactcttatgtgaaggggtcatttgaccccaaagaggtcaagacccacaggttgagaaccattggcttaggtgcttataaatcttagacacaaaagactacaggggcctgtgggctcccataatcattgttatgataccaggtgtggtttggtttggtttggtttggtttggtttggtttggtttggtttggtttggtttcattgtttgagacagtagctcttgtagcccaggttggcctcacttgtctatgtagccaaggatgaccttggacttctgaccctgcagtgtccacctcctgagttcctggattagttgtatgctattgggcctcatttattggtcaaacccagggcttcctacgtgtgactctctacccactgagctgtatcaccgtccatattgtgttagccgtttctttcctgtttactgtttccccggcctggggtatggctcagaagcacacgattggctgacaccctgagttcaacccatagacaccctccgata

SEQ ID NO: 18875 - DNA, 1201 bp, Mus musculus
tgataagggggttcctggctgaggggcaccggagggggcgcaatgacatggaaagacagtgtgcttatttatgcacaggggactatgaactaagtcaaaggccaggaaggagaagaatctacagctaggcttgaaatggcctgtggggcgccgcgttagtaacagggatgacagtgctctgctttccagccactgttgctcttgtttttctctgattctctatggggtgctgggaattgaaccctgggcctcctaagcactagacaagtgtcctaccactgagctacaccacccactccactccttttacatatagttccattttctttatttttatatttatttaaaatctatttatatatgaccatattattttattaattaaattattttatttttaattaagtaaaattatttaattattaaatagttttattaatttttataatatatttaagaaatttattttagtaaactgtttaattaaaacattaaatattaaaatagaaaattaaaatatttaatataataaatttcttaaatatattgataaatatattatatatgttcattcttttattttcgagacaagagactgtaacccgtgctgccctcagattctctgtcctcaggcctccctaatgctctgatcagtggtaacaggaggggtgtgttcctgtgtgggtccactcttattctgatgttgtcattgctgagctgtgactccactcagaccttttgagaacctgggggtattctgagttcctaggtcctccctgcaaagtggggaagttagtgctggaactgggaaaccctcaagtcagggaaagggtcagtttcaataaagtacaacgtgagatgggccatgtggctttggattgcctatgtgggttctttcctccttaaaaaaaatagaacattctattttgcggctgctggtagaaagatggatgtagaaagaggaatatgttgctgcctggagtctttgttacatttcacttctgagtgtaaccacagtgaaattaaaatgtgtctggagtccctgccactgggatgggaagatgctggggcagagtcatggggccatcccgagggctcatcagaccagatggaggcaagtgtgaggatctgagtttaggtccccagagcccacataaaggctcccagagtcaaagcagagacctgagacgccctagagcaa

SEQ ID NO: 18876 - DNA, 1179 bp, Mus musculus
gaaggcttttaagctagcactctctgagccctggtatgaagccctgggattcctaggcaaggcctcagctgtcccagctcagtaagcctgtccctgccttaccttaaccatatgcaaaggcccccattgctctcctaggggctatcacccacccccatgaataaaagactgcttatcactgctctgtagctgggactacccagggggaccccagagttacagagaggactttccaccctgcctgggaagccaggagccaggttaggggagaggacatccagagagagcagcctggtgggttctggggatttcagagcataacttatccaatcagaggagagagtatggggtttgtctggagtccccagcaataacgtgggcaggttcctggttctctgctttccttccatccttgtagacactgggcgtgtcagtgttgtcaggattgtggattgttttgttctgctctttttcttttttctttttgtgggaaagggttttggcttgtagcctaggctagcctagaagtcattgtgtaactcaagatgacattaaatttacaaagatcttcccatctttacctgctgagaactggaattgcaggcaggagacctccgacctcctccccacaacacacacaaacacacacagagttactgcactgatattgcaacagagtatcccatctctaaagtagcgaatgctgactttagccgaggctcctcagcggtgggcaggctgtatgggcaggctgtaagtgttcttttctaatggctcaggtaatgctgacaacccttcttgaaagcttcaccattcctctgtgcgttaggcccagaaaaggaaagtcacatgctcatggtcccccagatagaaggtgacacagctggagaggacccttgtgtgctgtgtctcccgaggctgaagctactgatcatatgacagggcggtcttccaagtagatattggtcccatcctatagggtgagacacatcaccttcccagaccatgtggtgattttaagcaccttctagtcttatcccatggaaagtctatgtgatggggatgttttccctgccatagttcaggaaatgaacagagaaattaggaagcttcttcccactcaggcagctgctaaggagcagggtttcccttcaaagtatccattttgccttaagtcaa

SEQ ID NO: 18877 - DNA, 1560 bp, Mus musculus
ctatcttctaggtcagtctcagggatgccacctcttcttgggataaaataagaggcgccccaatggaagcttggaaactttaacagaaaaaaaaaaaaaaaacagttgcagtaagaaaagtggagtttgaccctagttctggccactccctggtctctgtttgctgtgtctttctatgaaaaagctgaactctgtctctgggatggacacaaccatctagggaaagccgttctgatgaagtttccgtctcgaaggcgctggcttgtctgtcattctatctaccctccctgatctctgctggcgtggggtagaaatcaatccttagaataataagacaagcctgctccgccgtctgccactgccgcctgtgctcactgagtggttcatctggccagaaaagcagactacacggactccagggacctgtacctataatccaagacaagatgtccagcaagggctctgtggttctggcctacagtggtggcctggacacctcctgcatcctcgtgtggctgaaggaacaaggctatgatgtcatcgcctacctggccaacattggccagaaggaagactttgaggaagccaggaagaaggcgctgaagcttggggccaaaaaggtgttcattgaggatgtgagcaaggaatttgtggaagagttcatctggcctgctgtccagtccagtgcactctacgaggaccgctatctcctgggcacctctctcgccaggccttgcatagctcgcagacaggtggagattgcccagcgtgaaggggccaagtatgtgtctcacggcgccacgggaaaggggaatgaccaggtccgctttgagctcacctgctactcactggcaccccagattaaggtcatcgccccctggaggatgcctgagttttacaaccggttcaagggccgaaatgatctgatggagtatgcaaagcaacacggaatccccatccctgtctcccccaagagcccctggagtatggatgaaaacctcatgcacatcagctatgaggctgggatcctggaaaaccccaagaatcaagcacctccgggtctctacacaaaaactcaggaccctgccaaagcacccaacaccccagatgtccttgagatagaattcaaaaaaggggtccctgtgaaggtgaccaacatcaaagatggcacaacccgcaccacatccctggaactcttcatgtacctgaacgaagttgcgggcaagcacggagtgggtcgcattgacatcgtggagaaccgcttcattggaatgaagtcccgaggtatctacgagaccccagcagggaccatcctttaccacgctcatttagacatagaggccttcacgatggatcgggaagtacgcaaaatcaagcagggcctgggcctcaaattcgcagagctcgtatacacaggtttctggcacagccctgaatgtgaatttgttcgccactgcatccagaagtcccaggagcgggtagaagggaaggtgcaggtgtctgtcttcaagggccaagtgtacatcctcggtcgggagtctccactttcactctacaatg

SEQ ID NO: 18878 - DNA, 1190 bp, Mus musculus
gtgactcacaggttgagaaccattgctctatgtagtccaaagcgcactccacagagcgtctagcagagtaagaatggactaactgtctggctcctgccttctggggagggagccccccttaggcctcagacctagggacttcctttcttttggtgggctttgcaaacgctagtggaaccagcatctctagaatgtgggatggaggtgagatgctggcttcagttatggagagagtgccaacctcagggtacctactcactgcgtgcttctcccctctcctctcctgtccatcctggtcacctttttccaggtatggttaggggagcacaggctctgagattttgtgccttggttggtcccaggaaggaagcatggttataggatggccatgggggggggggcagccgggagtcttctggttggtgcctcaattccaaggaaacttcccctggactcatatgtcttgtcttaaccttccagggctttttcaacagaggccacggcgcacctccagggggccctggaccccgccagcagcaggcaggtgcccgactgggtgctgcccaatctcctttcagtgacctgaaccggcagctggtgaacatgggcttcccacaatggcaccttgggaaccacgtggtggaacctgtgacctccatcctcctgctcttcctgcttatgatgctcggggttcgtggcctcctgcttgtgggcctggtctacctggtgtctcacctgagtcagcggtgacctccgggggactcatgagggcgggagtgttcagtaggattgactggactgggctttggtgcgacatcatgcacagggggagggagcttgggtgggctcagaaggtgtgatgggcatgagaccggctttgtagatttttctcccgctgcaggaggcagagggactctctgggccagcattgctgaaaaagagagtcctgtggtttcctggaatgtttttagggggcatagggcttccgctaaaaagcacaagcaggaataagaaaggcttagtatgttgtattctcccagaacacaaatcttctaccaggcgcaaacccggagctgagagcagctgggaactgtccagagttttatagcaatccttcattttaatggtgtcctttttttattggctgattttatgtataaggaaggatattgacattctatttatcatga

SEQ ID NO: 18879 - DNA, 1310 bp, Mus musculus
ttctgggactcagattcagcggcctgggcctcctgcatgctgaggcaggcgctctaccagctgagtgagctgtgtttgcaggcccccgctcaccctttctctagcacatcttcctaatttcagtcaacccccggttctcgagcctcatcttcctcctctgaccttctccccacgtctttcgcctttgcagcttctccagaatcatgcaccaaacagtgaaggaactgtcaccaaagtgtaccgtgtccttcctcctgtctgaagacggcagcggcaagggggccgcccttatcacagctgtgggcgtgcggctcagaggagaccctacgaacgcctaagagccaggatcctcccagcccccagcccgccacccttccagcactcctctctagaaccgacgaccacacaccgcccccgtgttccacccagcaagctccgctgggagacccagcgccggcacccactctgccgcagagggaggaaggggactgcagtaacggagcatcacatagaataccacccggagcgcgtgctgttgatgatctgatctctcgcctggacccctcatccctgccctgccactttgcatgattcaagttcgacctggccatgcattgcccaagcgtgaacgtagtggcacccacgtctaccgcaggcgtccagccaggaaagagcgacccccctcttggactgtcttctgggcccttccaagcccatctgtggagtcgcctccctccttccccccacccccgtgtgaagtgtgttatcaccagcagacactgccggactcctgcccacaggggcgtggcctgaagggcgagtgtgaacatggcactgctgttcccttccccctccctgcacccgccgcagcctgccatcccatttggatgtatcaatgccactgagttgtctgtccgtccgtggagccagtcctagccacattattgacagtcttgcattttgttttgtctcgtgatggtggtggtggtaggggtacgcttaggtgggcagtcctgtggggaaaacatcttgtctccatcttgctaggaagaaccaacccacaaaacaacgccatcactggaatctcccatcgctttagtgagccattgtcgtatgtctagtaaactttgtactgattcaaaagtcggagtggtgtttccttggggtgggggcaagggcttagcatatggtgacagccacgctaggggctttatggactcctgggtggggagaaagcttcaaagctccccaggtatgcctatagtcccagcacttgggaaatggaggagtgagttcaagtccctccttgg

SEQ ID NO: 18880 - DNA, 1197 bp, Mus musculus
cacagccacctgtacctcgagctccaggggatctgacacctctggctgccgcaggaacctgtaactcatgcacacagacatacacaattagaagccgaagacaggagagatggctctcaccccttctgaagttcacagtgtgattgtcagctcgcacaatcaggcaagtcacagcttcatatagctccagatccaggggatctgacaccctcctctggcctctatgggtacctgtggcgtatacatagacacacctacctacaaatgtgtgtgtgtgtgtgtattcttttaatttaatctatttagaaggggaataaacccctgggatgccattcatagacaagcagaatgctttggaccggtccttgttccaagggttccatgggcctgctccatccagctcactgggcttttgtgctccacagtgaccgattagcgctgctccaggtgcgggccatccttcagcagctgggtctaaacagcacgtgcgacgacagtatcctggtcaagaccgtgtgtggggtggtgtccaagcgggcggcccagctgtgtggtgccggcatggccgccgtggtggaaaagatccgagagaacagaggcctagaccacctgaatgtaaccgtgggcgtggacgggacgctctacaaactccatccacagtgagtgtggcttcctctcttggctggggagttggttgagggtcacagggtgtcggcacagttcctcacggaggcatagtagcctggggcatttggagacaggagcctgagacggtgagtagccctagtactttggggagccagaggagggcttcagctgggccagcctgcaggagtgaaactctccctgcttccctttggccctctgaggtgtgtgtatgtttgtgctataagtgtgtgcactggccagctgtgcttggtaaaaggaaattcagaacgaggcagaacaggagcagggtaggcccgggctctgtggcagggagaaatgtttttatcagaatcataagccctgtacttgagcccgctcaaagctagggtcttagggacagtgaccacatctgaacagaaaccctgtgcattggttagcattctatagaggaagggacctgacagaatgaatctatattcaaagtagatccatcattccagctagtccaacaatggctgcctcccaacagaaaggccaagaatcttatag

SEQ ID NO: 18881 - DNA, 1117 bp, Mus musculus
gcctgacatccatcatccccaacctgctgtgtctatggcaaccttcctgactgagaaaagagcaagccaagtacaactgtttgtcatctttttttttttaaaggccatttgtaaaaccaaagtaatacaaaatgtaatgtccaatctaagtcccggcctatgcaccatcccccagggatttaggcttgtcagcatctctccttggctgctctcccagaggactggggttcaattcccagcacccacatgacaactcacaactgactggaactccagttccaggggcgcgatcctacattctcacacagacgtacacgcaggcaaaaccaccaaagaacataaaaaacaataaaccattaaaaggaaaacttgcctcagggaaaccctttaagtggacagacagacagatccggctctatcttcattgtgacctggtaaaggccatttgtcactgagggtgtctgctttgtccctacattcactgccttcaattcacttttccattctccttctcaggccgtactgatcacgtggacaaagcggttcaaagccagtggcgtggaaggggcggatgtggtcaagctgctgaataaagccattaagaagcgaggggtaatttctcttgggttgtgcatagtctggtactgggaggaatctccatctttaaatggtttaagagtcatgttgtcaggtgtgaggggcacggagtgcttaataccctagcagagaacaagaatcctatccgagggagaaagtcagatgtgagctctccgaaatgccatcaaaagatacctagtctgcagcagagaccatccccgtggtcttagagcagccttctgcatgcacccggggggaggggggggagcgggggggcggggggggggaacggacggactagagggaggagccgccgtgcgcatgcgcatgtgattcttaggtgctcctttggaagcttgcccaggaatgtagctccatgagtaaaatccactccctgaagaatcctaagccagataattaaggggaccttgccgtttccataatgtaatcactgctgtctaatccaattaattgagtcctggccgcagtgaagccacccatcagcttggttgtgtgagaa

SEQ ID NO: 18882 - DNA, 1892 bp, Mus musculus
tctaggagatcatcctgtggagaaaagcacccgagaaactgagaaaacagaggacgaactttcaccagcggtttgaatctccagactcgcaggcctctgcggagcagcctgagatgtaagcaggtgggcagagcagcaagtgcaagaaccgggccaagagagcagctcagctggctgacgacagtcgcagcgtgcggacatcccaactccacgtctgctagtcttccttatcctagagtgctgcgtttattttacagtatgattaaaggttttgtgtatatacattttaaaaagtgcttcttggaaacactggagaattcctaagctgccttttttgttttcttttttactgcacactgataagcactcagaagcataaacattaaggattttcatgtgagtagactggtatttgtaattttgctttctttatgcataatgttgaaaatccttttctctgttttcatgctaatgattacctcttattctctatgtgcaaaaaattaaatatttttgttcaagtaaaatgagaaaaacctgagcagcccttatgtcctacaaagttttaaggcatggctcctcagtatttttgagaattgtgtttatttttacatgtggatcagaaaccaacctggtgttacatggtaggcacttctgggtctaccattcacagcctcctgaattttaatctttgggatctctgaggtatatgaaagattgtcaccccagggatgacatggtttgtcatcgtggccctcttgccccttattgaccacgtttgctatgactttctgtatcatcatgtaggttctgcagtgtggagttgacacattggcattttagaacttgttaaacctgtatcattttttttccataaagactttgaaacatgtatatattttttaatttaaggactactttccatgtgtatgcaaatcgtcacctaggaatgagagagcttgggagaaccagccgaagtgtccatagccggacaatttcttgttaactggaatattggctagttcaaacttgacttcacgtagtctatttaaaaaaacccgaaccaaacagaacaaaaaacactaaattcataccattctctgaaaagaaggctgcagtcagctgagcacagacacacaactgaggcgtatggggcaggaggaagcctgtgtgggggccactctcactcagggcttgttggtttctgtaccagtgttccttgatacacctcagtacaggtttgtcagttaactttactttctaggaagctcaacagcccaacttatgtttccttaaacctattttttactatgatggcactttgataaaatggccagcaaccagccctggccaaaggttcacataccacgtcctggagcagctattgtcaatgtgggtttctaaggacggccatgttctccttcatgtaagtgcctgttcagagtctcaaagtttcaaaatgccaaatattttcatggtcacttgcatgtataatctaggaaatattcaaggagattttgaaaaacaattgtatttaaccagcctcaagttgtgcaaccatgatatataaaataaataatttgaaacagaaacttaagtttgtagtttaaataaaatgactttattctcaaatcttgtcattacagcattgcccagtggttaggaagacagtcacaacagtgaacttttattagtagtactagcttcaggtttgttaaggttttgttttgctttgtttttttaggttttatttattttatatgtattgctgttttggctgcaagtatgtctgtgcaggcatgtgggcagtgcccaaggagggcagaagagagcattagatctcttggagctgaaattacaggtgtttgtgagcggccatgggggtgctggga

SEQ ID NO: 18883 - DNA, 1192 bp, Mus musculus
tcaaagatgtcaggattaagggtgtgcattactatacccaacttaaagacagttcttgtcaaaataattaggtattgctgtcaaaactgtcagttccataaaaatgtcatagaaggagaaatttgagaccttgttagatttaatcaagacaaagcgattattactttcattggcagttgtttcaaagtgacatttttataactttttgttgtttctagtttgctttattagggcatctttactatttgtctgtagatgaggacttgatgcttaatgatggtaaaattctttgacctggtggctctgggctgcccacactgaccagtgctttttttcctgttacaccactgaataaggtgtgtgtttagtctgagattatagttcatagctgagctgcttaggtgagggaagtctgtatagtacttgtcagcagtatggataaagactccattcttctggcaatcacaaaacttagaaacttggtcttagatcaacacaaaattcagtaacaaaatgtccaaatgttttgctgtcttcctgtgccattgtaaatggtatatggtacattgacacatataagttataaagatagcactatttacttatacagaatatcatatgctgacatgtgagctttgagactgctttgtttaaagaaatgtataaatagacctgttttcccaacattcagttttcctcactttttaaacatacagcctcacctatttctacacaaaatccttattcacagtaaaggggaaataccaactttaaattggagagtagtggtgtacatctttaatccaacatgtgagagacagaagcaggtggatctctgtgagttcaagaccagcctgttctacatagtaagttccaggacacctacaactacatagtagatgccccctttcccctcccaccaataaagagcctggacaactgcccttaactgagtgattggaattagcagcactaatgttgaaacaagctaggaatggcaacacttgtgagagttaggggagtgtaaggccatccttggatttatagggtgcttaataccagcctgggctatatgagacttttttcaaacaaacagaagcagacgttatatgcttcctaatatagacacactaggaaaagtacaactttataatgttcttgctaaaaatacaagagcagagcagaatcctag

SEQ ID NO: 18884 - DNA, 1170 bp, Mus musculus
ctaccagctcttcctagactccctgagagacccaaacaaagtctttcctgagcacatcggggaagacgtcctccgcccggccatgttagctaaattccgggtagctcgtctgtatggcaaaatcatcactgcagatcccaagaaagagctagagaatttggcaacatctttggaacattacaaatttattgttgattactgtgaaactcaccccgaggctgcccaggaaatagaggttgagttagaacttagtaaagagatggtcagtctcctcccaacaaaaatggagaggttcagagccaagatggccctgacctaagccttggtcaaaggaaagagacgtgcagcttgaagccactcccctcccctatagcaaatgaggcccagccccacagtcaccttcgccagggccagagggatgcactctgggctccagaagcaggcaggtacccgagtctatgctaggaccttaagcaccataaattaataatttatacctaattatgtaagttgccttgctaaagtgacaggtgttttgcattttcgatcgcttgttttcctgtttaagtataaacatctcctgcctagagttctaaatgttaagtccttgctgacagtacttgttagatttcatactaggaacaacactgggtagtgtacctggtagaagagcctgttgctgtgttgaatgtgagaaagtcacttcagatgtcattctttgtaaaatacttactttcttaaactccaaataaatctttcccttttgaaaatactaaaaacttaataatgttgtaaaatggcttaattataggactgaagaacttgcacataataaatttacttgtttcaactagtaattacttttattacctcttttttccttgtaagaatggttctcttttttttttttaagatttatttattatatttaagtacactgtagctgtcttcagacaccagaagaggggggtcagatcccattaccgatggttgtgagccaccatgtggttgctgcgaattgaactcaggacctttggaagagcagtcagtgctcttaactgctgagccagctctccagcccataagaatcgttcttttaaaaaaaggtgtgtgggctggcaagatggctcagcagttaagagcactgactgctcttctgaaggttctggg

SEQ ID NO: 18885 - DNA, 2614 bp, Mus musculus
ggacctccagacggatatcgaggccgcatgggtcagcgtgatggcagccgtggtgctttcagaggacagcggggtggaagcaggaacttccggggacagggacagcgaggaggaagtagaaacttccgaggacagcgaccaggaggtggcaacagaggccagaagcggagttttagtaaagcgtttggtcagtgagtagaggccagaagggactgttcccactgtggaccccagggtccaccctgctgacaaagcccgagtgcttccttcctttttttaccacttctcagcgccccctttcttgcagagaggcttctgaactgtccactaaccatcacaaattcttcattttgaaaaaggataagaattcattgcatcgttttccaacatacttttagatttacaaagtaaaaccaaccatggatctgcctatcttggtgtgtcgatcttgtaattttatctttgtgtgtgtgtgtgtgtgtgtgtgtgcactcactggggcctaagctcagaacctcacacaggcagagtatacacacgccctgcaactaaactgcatctctagtccctatacatgtgtcctactcatccttcaaagtgagtccctaggggatgcctcagtctctggaggattgcaagagccagggcggaatgtgtttgtttgcattccttggcatcctggactcttgcaaacaattgctgtgttcatatgtgtctgctgaggtttgatgctgagcagagcttttcaagagccgcttcagacttagctgattgaatagtttgtgcccggctctgggtgttgagcgtagaacagacagcagattcactccagtgtcttcacacactcattaggtgttttctgttccagtgaagtctccagacaagggtatatagaaagacatttttataggacccagtgtaaagttcaggcccaaatgcctaacatgtctaggtgtttttgtcagtaatgagactggataaatggtatgtaagtgcttgcaccccacttttggaagattaatttaccaagaagcatggggttcagttggtgttgctgacaaatatctcaaaaaagccacaaaggtgtctttgatcgtgacaggtgaggaggtggagaagcgtgctttgagtggtgagcaggtcctgactcgtggctcctggaggggctgtgtctgctagtgtgcagtctggggctgttaaaggggcacagtgggacaggcttgttttcagtggcttagatcttaaaccacaacgtaaaatctatttctgttaagcagcttctctgaaaaattatcacagctcagagagcccttctatgacaagctgtgccattttaagctcttactttgagggaactgaagcatagcccctgcctactgctggtgttctttatttgggaatcatcccgcctagcacagaagcttgagtggtggggtcctctagctgtactagagattctgcgcagggctcttagaacaggcttgggaggaaagtcagaaccacgcactgtcattttggtttttttttaatttttcttaattgtttggatcaactaagaccttcattttagtatggtccttacctcctaactggcctttacctggcattaaagggctctgataaccaatcagctcccggtagctgaagcagtgcccttttttctatttaaattcagttttccccttgaactctgaccagatggctcatcctctgtgctcaggatttgttgggttttgtttttcttgttttctttgttgataactgtagcttgtaagaaatgtgggcatggtttaatgaagcatgtcactgttgggataaaagagtttgccagttcaagatgatgaaaggacatactggctctgcttgcaggaggaaaggctaaaagacattttgaattaatgggttaccctatagaaaaatgatctgtcataaaccaaacagtgaaggggaagaagggaagaattccaattgacacaatttaaatgaaacatgacttttcaaacaaatgaagtttcttttggattgcagaaactaagcaatatttatatgtataattcaactattatttggtttaaatgggcttgttgggaaatgttatcatttttactattttctacagagaaaatattttccactttatcaaataaatctggactttgaaattacagcctgtttttatgttccagctgtctatgtatgttttcctgaaactgtacataaaatgtttttacattaaaatgaattgctgtataaagtactgcattatgccataataaagataccgatgctttatatttagttcttggtggcttttattttatagcagtgactgctaggtctgtaaatctagtagcttggcttgccttttgtgtatactgcattaaagcagatcaggttataacggggagttagccttggctaaattgtcataaaaatgaacgcaatcctatgttaacataccttcactgtcttcagacacaccagaagagggcatcggatcccccattacagatggttgtgagccaccgtgtggttgctggggtttgaactcaggacctcttggaagagcagtcactgccatccccccagcccttcagtgggccattttctacag

SEQ ID NO: 18886 - DNA, 1189 bp, Mus musculus
gtctgtgctttctggattgcaccatctagcggcctgatttcagtctttggaaccttgtgtttgaattagataaacaaagtggttacgttcagagttcagccactagtgggcagcagagcaatctggtgcgtcatcttgaatctgtttcatcttaggctccggtacctagatgaattcatttcacccaaagcgggcctgtacagtagttattgcaggttgtattttaagtggatgaaggggcatagcatgcacaggcctttcttgtctgttatttggtttcctgcgggggtgtgggaaatagtgtttcctgattacattagaatgcaatgaaaccagatgctctttggaaaaaggataagcctggaggaggtagaccatgctgctcctgacttgggtttatttagtttccttttttccctctaagccatggtggcagcagacagccctgtaaggtctgcgtttacttcctgtaccaagcattagatgtaagagttgagaagggagctgcaatgtccatctaggctttagtaagtgttcctttctctcttcagcacctggcgattaagtgtcactggacagaaagggcagcggtgattggggatgtgatccgagtgtacagtggtcatcaagggcgcacgatcatcttctgtgaaaccaagaaggatgcccaggagctatctcagaacacgtgcataaagcaggttggtccttttcatacctgaagcctgggtcttcagtgagtttttatcttggactctgctttcattctggatttcaattatccagtgacttccatgttgtgttagattaggggaagtgtctctgatggtcagggtttatgaaatctaccagtcctgcctcatgggtggtggttcactggtaaagctacacctacaaagtaggtatagtctcctttgggtgatattctcaaccttggagagtgtagttagaaagagttgatgtgggctggggagatgacccagcagttaagagtactgactgcagaggttctgagttcaaatcccaacaaccacatggtggctcacaaccatctgtaatgggatcgaatgcccacttctggtgtgtctgaagacagctacaaagtactcatataaataaaataaatctttaaaaaaagaaacagttgatgtaacagctgagagctacaaacagtttgaagattttttcc

SEQ ID NO: 18887 - DNA, 1196 bp, Mus musculus
caggcgcagaggatgagcactctggtcctggtgtttccatagagtagtcacccttctgtgccctctcactttcttatgcccactcagccaccccacaggaggtgcctggtttttagtcttgagtgagtgactgcaggaaagaaggctgagttcaagaacattccgaactacattctgatgccctgtctcaaaacaaaccaaaataatactgtttctatttctctaagagtgtcacttatggtctgaaggcttgacattttctgccagccgaacaggaagtcgttcttgtgccactgtttcctggtggatcattttcctattgtgttagtgcactggcccagccattcagggaggggtggatgccccttgttgctgtcattaactttgtagctgtgtagtaatagtttagaataaaaagtatttaaatggattctccatggttgataaaaggagtttgaaaacaaggcatctcttttcgttggtatttttttacagttgaacgaatgcggagtgggattgatatcctggttgggaccccaggtcgtattaaagaccacttgcagaatggcaagctagatctcaccaaacttaaacatgttgtcctggatgaagtcgaccagatgttggatatgggttttgctgatcaagtggaagaaattttatgtgttgcatacaagaaaggtaagccccaaatttaagggactggtggaggggacctcaggaagggtcatggtgaaattgtcttctaggagataataaggacactcgggaaaacttgttttttgatacagggtttcctgtgtagccctagttatcgggaattcagtctgctcaaggctggccttgacctcaggctctcctgcctctgcttcctgagcactagcactaaaggctcatgccactactacctggctaaagtttggaaaaattaaaaaaaatttttttcttaacttggaaattgaaaaaaaataggttatataattcacaaaagcttgggagaataaaagaaaaaattcgtattgtgccagcttgatcactgttcctaacagttttcagtgtatgtactgttaagatactaaaattttgtcaagtgatttattcaaccacctacctcgttttataaccgtcactcataccagagggttctggtcacagttggagttctgcagtacctggagttggttctataacacaga

SEQ ID NO: 18888 - DNA, 1186 bp, Mus musculus
gagaagacaaaatcaaagaccgaagaagcaacagaaggaatggaagaggccgtttcctccaaagcaaagaaaacaaacaagaaagggccttctgaggatgatgtggatccccctaaatccaggaaggccaagaagcaggaggaggagcctcaagacgacactgcttctacaagcaaaacctccaagaagaaaaaggagccccttgagaagcaagcagactctgaaaccaaagagataataacagaggagccttccgaagaagaggcagacatgcctaagcccaagaagatgaagaaagggaaagaagcaaacggagatgccggagagaaaagccccaagctgaagaatggactctcccaaccttccgaagaagaggcagacattcctaagcccaagaagatgaagaaagggaaagaagcaaacggagatgctggagagaaaagccccaagctgaagaatggactctcccaaccttccgaagaagaggtagacattcctaagcccaagaagatgaagaaagggaaagaagcaagcggagatgcgggagagaaaagccccaggctgaaggatggactctcccaaccttctgaaccgaaatccaactccagtgatgctcctggtgaggaaagtagtagcgagacagaaaaggtgagtgtgtgcctgtgctctctgtgtgtgtgtgtgtgcgcagacaacacttgcagggccagtgcgagggtcctggggtgggacttgggttgtcaggcttggggataaatgctttccttgctgttgtcctggctgctggcaaagctgtactaggctgtttcattgttagagagaaataggtagtaactaagcataattgcaatcattttaaaagtgtttgggcagtggaagtcgaacccggggccttgaacatgcatgctatgttaacagtagaagaaaatttgttatatcagcatctctttggggtatgtatcagctgcagaggggctctggcctccatatgcaccagcatgtatgtggttcacaaacctgcaggtaaacacccatacccatccataaataagtatacagagtatacagaaactatagcctgtcatgtcaagacactgttcacaaatgaggaggtgtgttgaagttcagggaaagccttgctccacttgctaagtctgaaagcagctggaaagttccatctgggtcc

SEQ ID NO: 18889 - DNA, 1166 bp, Mus musculus
agattttcagatgaattctccccatctcataagtcaagaagaaaagacctgccaaatggagatgtggatgagtatgagaaaaggtcaaagcgagtgtcatcctcagaaaactctcacaagtcaagcgataaagcagaggaggtacacagcagactattgcatgtgttctctttgaaatgtaggcccgcttgacctgtgaggttcattaggattgattctgtgctgttctctgcttcgtggcaagtgttgctatttgaaccatagaaccagtatggctgaaaccccagcctttggctcttgtttctctcattgtgctgtccttaaagtaaacatttattttgtgtagaggtcagaatatagcttgtgggagtcatttttccttctgctgtgtaggtcccaggaatcaaactcatgttaagtttggcagcagctatctttcactgaaccaacttgctgctaccccacctctttatctttcttggggtagaatttcactggatattaaattttgggaagtatagtagactctacttcaagacctacttttgattattcatttgtttgagatgggggtctcatagtagcccagacttgtctcaggcttgccaggtagctgagggtctttaccctcctaatgctgacttccaagtgctgagattgcaggttcctatcaccatggtgagtttttattttttatttttgtttttgttttatttctggagatagtgccaccatgcccagttgtgctgggtttatatctgctgtatcttttagaatagttactttcttaagtatatgagtattttgtttgcatgcattgtgtacatttttgatgcctactgaggccagtaggagggtgtaagaactcctggaactggagttacaaatggttcttataggctcaaagaaaggattcacctgcctctgcctcctggtgccaaacctggctagctccttatttgtttttttcttttttgatatttatttatttatttatttatttatatgctgggaattcaacttatgcttcctgagtgctagtattaaagacatgtactattgttattgtgcctggattctttccttgataaaaacatatactcttcaaatctgataatagctagtaatttaagccctcattagggatcagacctgggatagtcagt

SEQ ID NO: 18890 - DNA, 1221 bp, Mus musculus
atctcaccagcccctggttttgtttttataagatatacttatttatatgagtacaccgtagctgtcttcagatacagcagaagagggcatccgatccatcccattacagatggctgtgagccatcatgtggttgctgggaattgtactcaggacctcttggaagagcaggcagtactcttaaccacgagccatctctccagctctttgtacagttttaagttataaatctgttactttgtttttgttttcttgaaataggtctcttatatcccaggctgacctcagttggctgtcaccaaagatgaccttgcatttcttgtcctccttcttccaatttcgttgtactgcgattagagtcatgttccactatgtttggtttataaagtgctggaaatctgtgtcagttaactagaggacacacagaaaggcaattctggcctccatcacatttcgagtgggtgtcatacatgcacaacataccattttcctctatcactcatgtctggcagctaagttattccccagaccctgttacctgttactttttttgttttctttaaagaatacgaggctagggaagtggctgagcatgcaattaagaggaacttgttggggctggtgagatggctcagtgggtaagagcacccgactgttcttccgaaggtccgaagttcaaatcccagcaaccacatggtggctcacaatcatctgtaacaagatctgactccctcttctggagtgtctgaagacagctacagtgtacttaaatataataaataaataaatctttaaaaaaaaaaaaaaaagaggaacttgttgctgttccaggagcctgacccatgtcagtttccattacccatgtctcaaggctgcctataactagctcactccaggtgctctgttgcacttttttgactacattggacacatgtgcacatacagatacatactcatacacattaataaaaaataaagatctcataatgtacttgaatgccttcagtctcagcattagggaggcagggacaggttcaaggccaacatagtctacatagtacgtttcaagcccaagttacaaagtgagaccctatctaaaacaaaaagaaaaaaataaaaaccaaaagaaccctaactcaccaagaacacttcaattgacaaattgtcttccttaactaaagaattataattgggccaagcttggggatacacacctatagacc

SEQ ID NO: 18891 - DNA, 13647 bp, Mus musculus
acagagccctcaggcatcaacctgtctcctttaggcagatcagaccagggatgtcctcctggcctttggtaacaacagactcttgctactgtagggcaatggacccagatgtggccccagtggcaccaccagttcctcacatcagaaaaatccagtgctccaagcttagatttctgctcttctggctagcagaatgacttcctagaacagtgtgagctcctaggtccctcgagctctcccttctgctttccagcatggtttggaaagtatgtgtcaatattcttttaatgaatagaaagaaaaattatatgttggtctttaagtattcaaggaaaaccatataattcatcatgcctgaatcaaactattttgatgcaaggaaagttggagatagcataaaaatcgctggtggcaaccaagctttacattttattatgtaatttatattggactgtaaaatgagaacaatccccacaattcctgcagctgaagaacaagtctaatgaagtacgtttgacttttagataagtatataaaactttgctaaaggatatacagtttctgtaacctgaaacatggaccctgcttagaacttcggtaatgggaacttggcaggctagcccaggaagactgagttcaagcctagccaaggatacatgtgaagatttcgatgactcaaataaagccacgtagatgctgggaaatgaacggttcagccctttctgctctttcaggcgctgtgaatttctgtgtgcatacaaggctgatgaaaagagcaaatgaagccctgagggtcattagtagtgttctccagtataaatgctaaaaattgaggaagactgagaaataatactaagaagacgattaatgcaagaacctaggttaaacatatcatgttggctagtcttgaacccagtcctcctgggctagcatgccaagtgttaggctcacagtaatgcttatttaaaactggataagaggttacatgcttatctttatagcttgctttgcattcaggaatcttgtctgtgttcattgcaagtgttcagttctattcagtaagtaagtgtgccttttattctatgttggaatatattgttcactatatagatttactatgttatactttttctacccactgtattatggtaagaatgacttatatgtccaccacatatggaattaattgtagtggagtttgatacacgcttgcaactcactttaacacaaccaacatagtattttaaagttacattatatgtattatctttttctataggaaaaacagcttgaaaagaatttacaagaattggctacagtattagctccactttacaagcagatggctccagttgcttatcaaaatcaggtattttttttttagaaccttcacaatgaccttaagaatatttcaaatttctatgtcaaataagttactattcatggaattttttctaagttcctcttaaatatgtataaatagttgtaagtttgtgtttatgcttacttgcctgtgtgtaaacacatatgtagaccagaaattggggacgaggatctttttttagcattctatgtctttgagacaggatatcttgctaaatgtggttctcacacttactggtagccctcaaaccccagtgacgctgcttctaccctttttgggaaaaacatacacagaaagctaggctttctgtataggtgctaaggtgcaaactcaagtatgcaggattggatgtcaaacatccttagagtctgagccctctctcctggcctgaatgatcttcaaatgtacaatttcttattgctatctttcaaaagtactcaagtaggggtttcctgttggttttgttgttgttgttggtggtggtggtggtggtgttttgttttgttttattttaataattatttatttattttatttatatgagtacgctgtagctgttatcagacacaccagaagagggcatcagatcctattacagatggttgtgagccaccatgtggttgctggcaattgaactcaggacctctggaagagcagtcagtgctcttaaccactgagccatctctccagccctcctgttgggatttgagagagcctcatatgctactgtctagcctagacttctaagtgtcagtgactgaattctgccttaggcagaagtggggcattcagttgtgaggtagtgcatccgtatcctttgggatctgcagaactgccaaagataaacaaaactcttggcagggacagacctaggttggagtccagcctggtgaacaagagtcctagtttctcaaagatggctcagtggttaaagagtacctgctctgctggggttgatggctctaaacttttttaatctcagtgcttggaaaccctgcagaaaaagacatattatttctgagttcaaggccagcctgttctacacagacagacaggggctacatggagaaactctctctctaacacacacacacaaacacacacacacacacaaacacacacacacacacacacacacacacacacacacacgaacttcttgcccgcatattctattcatattttttccattttatgtacagtagtattttgcctgcctgcatgtctgtgtgagaatgtcagctcttgaaatctgggacatttgtgagctgccatgtgcgtgcagggatttgaacctgattcttaatggaagaaaagtctatgttcttaaccactgagccatctctccagcccagcacctctgtatctgattgggtgttcattgtgtttgtttggaggtggagagttcatggctgcaactggtttctaactcggctcccccaccacagcacagcagcaagtgccttcgtccactgagccatcttacctacaagaccttgatatactttaattgccctagctgggtacttccacatatatcgagacacaaccaaactcacacacagaatagtagggcagaaatcttgcatggcttggtggttgggttatttaggatgttggctgatattttgaagacatggatttggtacccccattcacgaggtcactcaaaactgtcccgttttgtcaccctcttccggcatctgaacatgtgtgcatgctgtacacagacccatatgcagacaaaaccacacaatacaaatcttattttacagttttgacatttatttctaaggtggaatatgaagaagttgctggagactgtcgacttggaaatgaagaggggcgtcctttctctggtgtcacctgttgcatggatttttgtgcccattctcacaaggacattcacaacatgcacaacggaagcaccgtggtatgcactgagtactttaatcctttatgctttaggtgtgctcctaaaatgtcattgtattcaaaaagatttttgattgtaaggtgtgtgtcttagttagggtttccatctctgtgaacagacaccatgaccacaccaactcttataaaggacaacattcagtagggactggcttaaaatttcagagattcagtccattatcatcttggcaagaacatggcagcatccaggcagatacaatgctgcagaaggaacattttgatctgaaggcagccaggagagtatctcttttgccctgggtggaacttgagcataggacctcaaaagtctaccctcacagtggcacacttcctccaacaagaatctatgggggccaaactattcaaaccactagagtatgtatagaaaaccatacatacttgttgttggacaaggctttaatcccagcaatcagtatactaagactcttggatctccttctaatagatactttcaaatatatgagtctaaggggccaggttgttgttgttttgtttgtttgtttgtttctcaaaatcaacacacctgctgtagtttggtagaacaggccttattcctctcctgtccctcaggtgtgtacgttgattcgagcagatggccgtgacacaaattgtcccgaggatgaacaactccacgtcctgccactataccggcttgcagacactgatgaatttggctccgtggaagggatgaaggccaaaatcaaatctggggccatccaagtcaatgggccaaccaggaagaggcgactacgttttactgagcctgttcctcgatgtgggaagagggccaaaatgaagcagaaccacaataaatcaggtactgctggtctcagaaggaagaggatctctgccagcccaaagggagccccaggtgccaaatagcttctgtggttgttttcacgtttgttgggtgtaactttgtgtctatgaactaccagtgagatagttttttgttttttgtttttttgttttgtttttcaaggttcacacaacactaagagcttttcatcagcctcatctacttctcacctagtgaaagacgaatctacagacttctgtcccctgcaggcttcctccgcagaaacatctacctgtacgtacagtaaaacagcctcaggtgggtttgcagaaacaagtagtattctccactgcacaatgccttctggagcacacagtggtgctaatgcagctgctggggaatgtactggaacggtgcagcctgccgaggtggctgctcatcctcaccagtctcttcccacagccgattctcccgttcatgctgagcctctcactagtccatctgagcagctaacttctaaccagtcaaaccagcagctccctctcctcagcaattctcagaaactggcttcctgtcaggtggaagatgagcggcaccctgaagcggatgagcctcagcaccccgaggacgataacttgcctcaacttgatgaattctggtcagacagtgaggagatctacgccgatccttcctttggtggcgtggcgatagcacccattcacggctcggtgctcattgagtgcgctcggaaggagcttcatgctaccacctctttgcgctcccccaaacgaggggtcccttttcgtgtgtcccttgtattctaccagcacaaaagcctaaacaagcctaatcatggttttgatatcaacaaaattaagtgtaaatgcaaaaaagtaacgaaaaaaaagcccgcagaccgggagtgtcctgatgtatcccccgaagccaatttatcacaccaaattccttctcgagttgcatcaaccttaacccgagacaatgttgttaccgtgtccccatactctctcactcatgttgcgggaccctacaatcgttgggtctaaaggcttctctcatgtaatgcctttgctaatgtggtgtagtgggtatttttgtttgtttgtttgttttcttttgtttttttgttttttccggtgctgttaaaaagaaagtcattctgttgtttactgtagctttgtttcgcccatttcaactccgacgtaaatattaaaaaaaaaaaaagggtgaatacttaactgtgattacattttgagaattggtagaaggtgaacattttcagcaaaaataaactttttatagttttaaatacttaaaggaacatcttggttaggtgttggccatgctagaaccatagagtctggtgctttcccccgggtttgtttactattcagagggtttataacaggttcctgcaataagaagtaaagaccaagatgtagtgttaactctacacagttcctggtgctttaaccacatcaacacacggagtgatgagctgagtgattgttttctggtgccattgctcaagcctcttccaatcattgccatcgtgtctgcacatttctttgaagtaaaccaatgaaatgctttttctcttaaaacatttctcctatataaagtagttctctattctcatgatggttggaagctgttcgctaactataaatgtatatattttaaaaagcactttctacttttaagagtaacttgaaatagtatagtagcagaatcctattgtctattatgtgtgcatatttgaataccagagaagtcatttgttcttgctctgtagagtcccatcccgttaacctcagcctgtactcaaataacacacggcttctgttctttacttatagaatagagggtctctaaaaaaaaaaatttaaatacaagatgctaccaatatcaattttccctctttaactagaaaaaatattgtcttctgaagtcacctcgtcaattaactatatgacccaattacaggtgttttcaaaggaaaaggaggcaaattgggatcagtcaaaagttcccagtgtttcaagattagaaaatacataattaagagacatgtccttcccaaatgagaaggaaatattctatagagataattgaggggacatgcttgcgttagcattgtcacccttaccctggagttccatggtaatattgagagccaaactattcattaatagtgccctatcaggtttaggaaaatgggaacccaaacttgcttagtaatcctctattgaaggtcacaactgaaatcagcatcctgattactttgtgttccagtgttctgcccattgtttaattgacttctttatataccaagaatgatttccccaaacaaaaaagcctagaaccaagcgacctttctgagagatccaaatgcacaggtgctattgccattgcttgggttgaagtctttggatctggattaggattcctgtccttcagggaccctgatggtgcttctcagagatgccacaagaagcccacaactaccacaatcttggtgcaaatgtaagccgttgcagtaaactccttagggaataacttattaaacacaatacatggtgcaaagtgtcagcctctgactgaggcacgttcaggaagaggaagggactgtaaataagaacgtgtccactgactttcatcccatcctgcacagggagctggatgctcttgggatccatacacatgtggatctgagttagtgttctgtgtgccttagagttctgtttataaacctttttttaagtttcttatgtcggtatgtgaatgtggtcctttcttgctgtgtctgcttcagttaggtatttatttgttagtgtagaccatcagaaatcctccctcatgagttaacctttgaggtttcagaccttatctagaaatcattttcttgccattatgggatagaatcgcctcttcctgcctttatttgtccattcatctgtccgctcgattagtttgttttcccttgaattaccccttatcacacaaacttataacgaatgcttggaactgctttctaagaacataacaaactacctataaatgaagagctacagtaatatatattcaagctgatgtgtttttaatgataaggccacattcttggtgcttaatcagttgaatacaccaatgttgatgaatgggactgttggtgtttatgaatctagttgcagtttgacaaaataagtacatgaaactaaccactttcaacaaaaatgttgtcattccatcgctagagttagcatcagagatggagtgcctcagccaacagccctctgtggggacttcattatattactttcatggtctctgatgtgctttgtaggcatcctctacttggttggtgttctactgcaccatctgctggctatacacggctttaagaatggactttcttaaaaacaaaatacaaccggacagtggtagagcatgcctttaatcccagtacttgggaggcagaggcaggtggatttctgagctcgaggacagccagggctacacagagaaaccctgtctcaaaaagacaaaaagtaaaatacattggtttgagatgacagtcacttatctgacaatctttctacacctctactgttttaattagattgcgttcctctgacctcgtttgtggagctctgactaagactgttctcgctgtgaacattggatacattgttatatgacttccacagtagccctggtgatgctacaattcattcctgcctgctttagaattagacatcacctgccctcttaaaaccatttttggtgggttttggttttatgagactggatctctatgtagttccggctgtcctggaactcatgtagcagaccaggctatcctagaattcacagaactatcttcctgctcctacctatgtgctgggattaaagttgtcctcctccactctcctagttcttttgttcttgtgcttgtcagcctcgtgtatatcctgtttccagttctctacaaagtaccaaataagaccaggtactaaagagactgttatcactgtcattgaaatatagtgtttggacttgaggataatagaggcaaatttttgggaacaagtccacatcttaagtgatttcccaagcataacgttgcatttgtgagacacagaacttcattaggtgaaaaccgtaagccattcacttccattcaccccgttaaacagttaactgagtggctattattctgtaaatgatgtactggcttgattcacatgaggtaacctactacttctgattatcatttcacaagaacatgtacaaaactaaccccaaattattcattcatatatataaaatgagacttctgtgtggggtggagctatcaagctatcatgtcatcacatgacctcttctatcgattgtgggtgcatttacctttgtgccaaacaagtaagtgtatgcaaccttaacacaaagctaccctgagtttcaccccctcaatgcatgggaatctttttgagtctagatttaatacaactgagtttcatctatactagaaatgtataacaagaattatgacaaaggatagtgtggtggctgttgctgcaccaatagtctccttagaaggcagagctcaatccctgagttctcgggacagacagcgcctaattgcttgagggccattctgctcttagagctgttcaagacaaactacttttctcactcagagaggattatattactaagaacttatcttgatttttgtccaagtcaaaaataaaacaactttctgtcctctggtgaggttcaggacaagaaagacattggtgagattaggtcaagattgcctttactgtctatcctaggctttgccaggagaacctatgacattaacctactaactcttcccgatgcagaaggcaatccttgtctctgccattccctctggaacctagtattaggaataaatacccaaggagttcttgaggactggctgtgggaaccattgagggaagcatgccttcactgtatatactctgtagccgcggttgcacagtccctactgcccctcccctacttcagtgctggcagctcactgtgatgtggccgtcaccataaacaggcgcgctgcttcacttctctgtgctggtcacgttggcatatttagccatgtggtgtggtcattgcttagtggtttgagatgactaagtttttttttttttttcaaatgaaatgggtgtttcatattgtatttcatcagaaaacagtggcaattgtgaagaccatttagatagtcactgtatcctcccacaaaacctaattctgtatattttcttcaaaattgttaaaattcctaagcatggttttttaagttttgttttgtttttttggttggttggttgatttgtctttgtgtaatagaagttgggcttttattaaattgtgagcctggacttccttaagaatctcatggtggcgtatagcacagttttgaactatggctaaggatgttgagaacgtctttttccctttctttgcttctggaactgggtctcactatacagacctggccaggacaaagatcaagttgctcttgaacctgcaagggttctttctgacctctggctgtgccactcttagtttctctggtgctgggattgaaccaggcctttttgtgtgtctggtaaacaccatcaacattccctcccatcctagaccttggggttttttccgtagggaatcatcatttgtgtttgttttcagctctacaaaatcttagcatgctgccaaatccttttctgaaccttctggttcaggtgatctcttattgattgctagggtatagacacagggctccctgcccagctaatgtacatttgtattagcccagctcttttctcagataatcagtttgttcaaaatatgtgttactcataaatctcacattgaccctgagaccccagtgatcaaaattaccttgtggcagtctgtaatgtttccagcttcaaaattacaaggttaataatttatttattccttttctacattcagatttccttatgattaaaaatcttctgtactcctgtatgtacaccctggctccaccacccagatcatcccatatgcaaatatatctgattagttccagttttccatttctctgccttccttttgcctcagcaccttggcttatctttttcaaccatgtgtcataaagtctaacaccatgcttggctcaagtgtgtgtgatcccaactgcttgagggactgagacaggatgatagaaagaaaaggaacaccagcagggcgcagagctgcctgccatagagttcatgaaagagtggtgcttgccaaccttgctggaagcaatccctagtactgcagaaaggaccaaggatgtgtatgcagaacttttcaattaggagtaagtacaacttaagtttcatattcccattcttttggccttttccatctccagctgctaaaattgaaacctgcaaggcagttttagtcactggatcttatatgcagacagagtttcttttccttctcctcattttcaacaatctcattctgttgatgggagcctgtttcctaaggtaaattaactctagaagttcttcagctgtactcgtcccttaataatggccctgatgtactgcaagtaggatcctgtctccaaccccagctcagacagtacagccccacatccttacacataatctagtttcaaacataagtccttggtgatgagctaccagaatccctggtgaggaagtcatggggattaatagttcttgtctgccctcttctaattttaactgaaaataggtgatcttttgacaataaataggacatgaacaaaaaacaaaaaacaaaaaagcttagcatctctccctaggtgtgatgtgcccatctataattcagctcccggggaggcagaagaaatgggatgggatcatgtcttcagagctctttgtgggatttctcaccagtactgaactcagaaagcagttcagccgccagcgagaatagccaggagcttactccatgtcacacagcaagtcaagtaatacgagtgaaatgtagttgcctgcatgtatgtgtgtgccttgtgtgttgtctaagtagagctgataggagaaaaacagaaaacttataagcctgtttcatttccgttgtttagccagctgttgcacatatgaaagatctcaaatccttatttatgcatcaaagcttaggtttatggttttgtgagtgtgtgtgtgtgtgtgtgtgtgtgtgtttaaaacaggttcacaatgttgctctagctggcctggaagatgctgttctgtcctcaggttgctttggtcctacgtcagggactgcaggtgtaaacctctccattcagtgataataagcagagagagagagagagagagcgtgcgcatcctgttgccattaataggaagacactttcaccaagtaattttctaaataggaattttaaagcccctcataatcaaagtttaatatatttaagtatgctgaaatgaaggtttcttgaaggagatggtgctagctgaacaattttagttcctagcccttcattataaatatgcaaaattgttgataacaggttttattaactctggattatatcttttgtcttgttgggtgtttggctttttgttcgtcctggtgtgtgagtgttccctctgctttgctggtagccatatcaatctttggagcaagtatcctagagttaagagtgctgagatgtatttgtaaagttcctagtgatttgtctataggttattttaacaacctctctatatagaggtatattttgactatagtgatacattctttggcacaaatataagggaagaggccaaagaaccgtgaatattcagtatggcctcctcttacgttggtgagtcgtcttgccaacatcagtttgtgctgtgataaaacggctgactgactatatttgactttacaaacacagctcataggaaagattaaatatttttattgcgatgtatggtcatattttttttagctttatggagttaacattgtgataggtgctttaagagaaatatttttccagaaatggttttatagctaaactatgggcagcttttgcattgtgatgtgtgggtcgatggctctatttgggttactaggaaatcatgaagtgttccctatggagatacctgtccgcatccatggcagagagatcagcatgaagtctcagttgactcccttttctctcatagagtgagctagcacgtaaatgaccatgtgtggcattacttggtttacaggactcagcgggctggttagcggtggtgggaataaggcatcaattcacattcctcaccacatacagtggggctgagtccgtttccagtctcttatgtgaaggcctccccagcagtccctggaagaggctcgctgttcattttgatggttacaattctaccgttgcatctcagtaattgaaggcttttatctttggaaatgctgttaaaattccaaaaaccagtttagttcttcacctatgaggaaaatagttaaagcacttcatgacattaaagggaaagagaatcctatacccatgatagtttcaatacctaatcaatattgagtcctctgcacagaatgggacgcttcgtagcagtacttgaatacctgtgagttggaattgcatgttacttgaaagatctaattaagctaaattttggtgcacagcagttgtacatgatttcatgtttatgtagcaaaatacattgaaatgtactaggattgaaacataaatgtaaaaatagttgtggaaattgtcttattttccttatgtctcatttgtttaaagcataaattttcttttaaaaaattctaactaaggataaaggaatactgtaattgaagatatattttaaatctttgtcatgtttttttttttaaagctattgcaaattgtatcattcctgactatatagaactttgtgggtggtataaaataaattttatacttctattttgcacctggtagtctatttttttcttcttcaaaatcttattttaaaatataatatttagtattcccatcttaactgcaaaagacttatggtttgagcaaacaaatcatgtttgagtacaaagtcagctccagctattgataacagaacacatatttaacatactcaaagtcccaactcactccatagcaccaaaagcagggtttgttttgttttgttttgttttgttttgatgtctctgggtgtgttgctgcagatatagctggtgatgaagtgcatgtctgtgcccgtagaagccacaagagggcatccaatctgctgaggttggagtcacagaagattcaccctaatggtactgggaaacaagtcctttggaagagcaaccaatgctcttaacctcctagccatctctccatccccgtaaaacagatttgcatcacctcccaaatggtctttgttcatctgtcaat

SEQ ID NO: 18892 - DNA, 1192 bp, Mus musculus
ttcgtggagcatgtatttcaacggctgtaagtttgggaggagtgaaaaccccagaaaattcagacttgctccaaactaccccttacatgtgagtttccttttgcattttcagtgtataatctacagtatataaccctgttgcagtgcctaaatgtctcctaaaaacagtcataaattactaaaatacgcatgtcactactatgagtccaagtcaggtaaagacgtcaactcttacagttgcccattagtctcactgctccccagcaccagagggaaccattaataaaagaacttagggttttatgggcaaccagagtcaaacaaactcaattgccagcattttaaaaactaagaaagtgccgggtggcagtggcgcatgggtgggctcacatggcagaggcgggaggatctctaagtttgagaccagtctgatctacagagcaagttgcagcactaaacaaagaaaacgtgtctcaaaaaagaaagcaaaaacaacaacaaaactaagaaagtgtactttccacagaactactataagagaattactggaatgagttctgaaggaagtgacgtgaaaaccgggtggatcattccagaccgcaagaccctcataagcagagaggttagtcaagttttttattcagttttttaaaattgaagcatgaatttataagtcattcttgttgaaccagatggggaggttggggagcagctaaggctgaataggtttggaaatgttctcctgttttgttagggtaaaaattattcacgtcagagatggtgggttgcaaacatgtccacttgtcatccctaaataggctcgtttaagtagatcagagcactccacctaattgcatgtatgaatctctttctctgatgcatcacaatatttttgttaaactttaaaaaaaagatttatttattatatctaagtatactgtagctgtcttcagacacaccagaaaaggtgtgtttctgatctcattttagatggttgctgggatttgaactcaggacctctggaagagttgccagtgctcttaaccactgagccatctctccagtccttaaacttgtttttaaacgtgtgtatgtgtgtgtgtgtgtgtgtgtgtgtgtgtgtgtgtgtgtgaatttcacatgaatttcacatcatgtactccaatcccatttatctctctgcttcccctca

SEQ ID NO: 18893 - DNA, 1266 bp, Mus musculus
ccacacttagaagatgaatcctggggtataatcacttcagccaagcaaggcacttgaggccctcgtgggtgacacagagactctttgtctcagcaacaggcaaagcaccttagcctttcctgtgcaaagagtttccaggccttgagcgatggatgcctcagtatttaagagcatttcctcctgctcttacagaggtccaagattcgggtcctagcacctacatggtgttccaaaactgcatgtaactcacactacacgttcatatgtgttatatatatatacacagtaaaaacaccatatacgtgaaagtcaatagaaaaaaattgtttgtttattttacagtgagtctgaagcctgggttatatattacttcacccccacctcccaaaaaaaaaaaaaaaaagaaaggaagaaagaaagaaagaaagaaagaaagaaagaaagaaagaaagaaagggaagagaatgaaagagaaaagaaagtctggctcctgatgtataaagcttgtattgatgaatacattctggtctttcaggtgatcagaagaagtggtcctgaagagaagcttatttgtttggttcgtgagcgtgtagaccatcactgttcgacggctgtgatagttgtccttatcctgctgtgggaaggtatccctcgcctgatggctgaccgcctgtacaaagagctcactgagaacttgaggtcctacagcggacatcccacagaccgaagatgtaccctcaacaaaaagtaatcagacctgcattgttctccctccctctgttgtgagcagcaaattgataagtaactgccaactgagactagcctgtgagtagcaggactctaaagtaccatggaaggaaaacggacccacagggtcccgtgctgcacaccgtgggaggcagctggacttccatgagttggagctacatctgcacagggagaccttgtgtttcttctccccctacacctgcagtgcaattaagactattttgctgggactggcgctcaacagctcagaacactgaccgcccttccagtggacctagtttaaattcccagcatccacatggcagctcacatctgtccattattccagttcctggggagctgacacccttacacaaacatatgtgcatggaaaacaccaataaatatatatatatatatttttaatgataaaagaaatttctgcttgaggccctattttatgtatatgagtgtaccattgctctcttcagatacaccagaaaagggcatcatatccca

SEQ ID NO: 18894 - DNA, 1816 bp, Mus musculus
caggtgttaaagttctgtcttttgataataccaataattgtaacgtgtaacttcctggtacatgtttacgatgagtacgtagttgtgcacatgtagtagggtgaattgttaccagactcactttcagtagggtatggaagctaagcttctcagactagtgctcttccttaacgttgttatagaaacctacaaacgctggagagggagccaggtgtgaggccagtgggggcaggagtgtcaggttcaaggccatccttggatacctagtaagagtgtcttgaggttctactaagacctcatcttactaagtttagtcatattaataaaaaagctgggagaataaatacgccccccccctttaaatttttgttctctcctctgactgctagaagaaataagagccagaagtccaatgccagcccctgttgtcttatacgttaaaagttgaaactaatccaaacaaagagaacaaagcccctgtgctatttgtaaaactgggtctaataatctgattccttccacagatggaggtacacaaaaagaaaaaggcccatattatacacaccttggggcaggaccaagtgtggctgctgtcagggagctcatggagactaggtgaggaactctgcttcccgctaacccattcttcccggtgacctggctcaaggcagagaaaagggcttggagtggtcctgaggcgaatgaagacggtcaggagtgtgagttggatggttcttaaggctcaataggcccagtcctcctgagtcctcccaggagtggggccctggagacatgccctcactcggcaggcctatttgatcaatcaggaagagtgttttcctactactgtacagtgatagaaagagctgagatgactcccacccatgctttaaccctaactcgcccgtcttccgagacttgtgttgaggtcaggctatttttatttagagtgacccttatgtaaacagaattgggtaacaaaatcagactgccacgtaacagctggttttagccaatgtaaacgataactgtttcttcttttctttttaaaaaaaaaagaaaactgattcatgtgtatattcaatgcatttagatgtgaaaacatggagacttcgagttcggatggtcactaattagtcccaccctgtactgtgttctgtaccaggtttggccagaaggggaaggcaatccggattgagaagatagtgttcacggggaaggaagggaagagctctcagggctgcccggtcgccaagtgggtgagtgctgccagcagacttcgattttcttggtactttagaaaatggatttttccagggcattaaattagaaggttttgctttgcaaaaatggagaccagaaaacttttcatgcccacagggagatggtggagaagctgtgcgtctttcctgggtttttgatttcctaggtagggtatttaaacaaggtgcgttcaaacccactcagtaaaggtaaaaactccatccctccctcagggtctcccaaggatcacacacttcctcaggcacagcaagtgacattatagtcactgcgtggtttacttttcctcagtgtatttgctgtctaatgagtaagtatatgtcaacaggttttcttctcctcttcataagaccctacctatttggggaacaagagccttttttttttttttttttttttttttttttttttgagttttttgagaccgggtttctctgtgtcgccctggctgtcctggaactcactctgtagatcaggctggcctcaaactcagaaatccacctgcctctgcctcccaagtgctgggattaaaggc

SEQ ID NO: 18895 - DNA, 2880 bp, Mus musculus
ctgggattgcaggttgaactactatgcatcatttaaatgggggtaggggagcctgggcatgaggtccaggacttcacacgtgcttttttttgaattatgggattccagataggcgtagccgacctcactggtaatcccgggactgaaaccgagtctggagcattcctgcaaagtcctagtcatcttaggtgcatagtgggagcctagcaacaacaaccacagccacagcatctccttgtagacattcagcgggtggtggaagtaacttctgtgcttcctttacagacagactttaacaacaaaccagtaaatggccccaaatcagagtccatggactgcagtagacgtggtcatggggaagaagagcaaaggttggatttgatcacacatccccttgaaaatgtaaggaagaatgcaggcggcatgacgggaattgaggtggagaagtgggcgccaaacaagaaatcacacttagcagagggtcaagtcaaaggaagctgtgatgccaatttaactggggtggaaaacccccagccctctgaagatgacaagcagcaaaccaacccttctccgacatttgcccagaccataaggaacggcatgaaaaatgtacactgtttacccactgacacacaccttccgctcaacaaattgaatcatgaggaatttagcaaggcgttgggaaataattcctctaaattgctgactgatccctcaaactgcaaggatgccatgagtgtcaccacctccgggggggagtgtgatcatctcaaggggccaaggaacaccctgctcttccagaagcctggcttgaactgcaggtctggtgcagaacccaccatctttaataatcaccctaatacacacagcgctgggagtcgacctcaccctcctgagaaggtacccaacaaagaacccaaagatggctctccggttcagccaagtcttctatccctaatgaaggacaggagattaacgctggaacaagtggtagccatagaagccctgactcagctctcagaagcgccctcagagagctcctccccatccaagccggagaaggatgaagaagcgcatcagaaaacggctagtctgcttaacagttgcaaggctatccttcattcggtgagaaaagacctccaagacccaaacgttcaaggaaagggccttcaccatgacactgttgtctttaatggccagaacagaacattcaagtcacctgatagtttcgctactaaccaagcacttataaaatcacaaggatatccaagttcacctacagctgagaagaaaggcgctgctggtgggagagctccctttgatggttttgagaattcacatccattgcccatagaaagtcacaatcttgaaaactgcagtcaggtactaagctgcgatcagaatttgagttcccatgacccatcatgccaggatgcaccctacagtcaaattgaagaagatgtcgcagcacaattgacccaacttgcatccacgattaatcacatcaacgccgaggtcaggaatgctgaaagtacaccagaaagccttgttgcaaagaacacaaagcaaaaacacagtcaggagaaacgcatggtacatcagaagccaccctctagtacacaaactaaacccagtgtaccatcagcaaagccaaagaaggcccagaaaaaggcaagagcgaccccacacgcaaacaagcggaaaaagaaacccccagcccgaagctctcaagaaaatgatcagaagaagcaagagcagctagctatagagtatagtaaaatgcatgacatttggatgtcatctaagtttcaaaggtttggccagtctagtccacgtagttttcctgttctgttgagaaatattcctgtctttaaccaaatattaaagcccgtgactcagagtaaaacaccctcacaacataatgagttatttcctcctatcaatcagataaaattcacaagaaaccctgaattggcaaaggagaaagtgaaggttgaaccatcagattctctgccaacatgccaattcaagacagaatccggtgggcagacatttgcagagccggcagataattctcagggacagcccatggtgagtgtcaatcaggaagctcaccctctgccccagtccccaccatctaaccagtgtgctaatataatggctggtgctgcccaaacacagtttcatctaggcgctcaagagaacctggtgcatcagataccaccaccgacgttgcctggtacctcccctgacacactcttgccagacccagcatcaatcctcaggaaagggaaagtgttacatttcgatggaattacagttgttacggagaagcgtgaagctcaaacatcaagcaatggaccactgggtcccaccacagacagtgcacagtcagaatttaaagagagcatcatggacttacttagcaagcctgcaaaaaacctgatagctggattgaaggaacaggaagctgcaccctgtgactgtggtaagtactcacttgtgtgggtgttttcccgactcatcttttgggggttggggggttgtccttggctctttctagtcgacctgagatgtactaagtaattctgttcttgttttactttgaaatcttatttattctactcagactgggaaaagaggtaaactctttcaagtgggacaagtttgcagtggttcattttcaggactaagaaagaattgcctttgcttagccacatttacttctgttctatccatgtcaaatacagttcaacctagagggtgcatagacagaccgtaaaatcacgcacagccgcagtgatggtgagcgaatccacaccttctgcatcttgggctaggaaaggtgtgcccacatgaggagattctatagcctggctg

SEQ ID NO: 18896 - DNA, 1304 bp, Mus musculus
gtgacaagagagtcaagaccaatacgccatacattatattatttaataaaaacaaaaaaaaaacttttcaatttgtttttgagatttgtttactctgactttgttttgtcccttttagccctggctgtcctggactcatttttgtagagcaggctggcctcaaactcacagttccacctgccccagtctccctaatgctgggattaaaggcatatgcccagcttctttacttgggtctttgttctttgtgtttgaagacagggtctcacaatgtaaccctggctgtccttgaactcgtggtgtagattcatctgactctgcctcctgagtgctgggattcaaggcctgcaccattatgcctggcttgatgctaggtttaaatttatcaaggacaacataaacaaaactacaaatatgacacaggagatatgtggaggtcagaggtcaattcatggattcagttctctgcaacatttgtcacaggaatggaacttgggtcactagacttggatatagtcacctgcaggatgtatgtagttcgggttaaactagaacttcctgagcagtagggggtcatcttgaactgctttcctgcctctgactgcaggtgtgggccaccacgccctgtctatgtcttacattaaatactgaaagtttagcattgggtgtgagtgctctcaaggtataagttacactgtgaacctcacaggcttcaggtttcttggggtgaatgaagctcccgtcgtacgtagagtgcatgtctagcacccacaaggccctgtttgacccccagagttaacataaagtgacacatggtcacagtcccagtatttgaaggcgcgcacattctggaggtcaatgttggattgcagacctgggacaagcagccgaggagcctgtctaaccaaagagcacctggcctctaggttctcccagcatgcctcagcccctacctgttacagggtatggctggcatatcccgtcctttaccctgaattttccagcctaggtcctgggctttcccccatttgggaccggtgaacacatctgagagctgtccccagtaaagctgcctttatactttaatttgactttaattggcttattttgccctcaagaaaacttatcaggttagcagttcaccagagtcctcattcgtgcgcagagttaactgagtcgattctcagctaaaatctgatagtttttaaaaaattgattacatattgaaatcataattgaatgcactgatttagaatgtgatttaaattaattacaggtgtttctgtgggcctctgtaactctgt

SEQ ID NO: 18897 - DNA, 1237 bp, Mus musculus
agttcaatgtcaagggggtatcagatctgaggcttcccactattttcatgcctcagggtcaaggtgactttgtagaatgtgtaatgaggctatttcactacccccgcccctttgccattttgagaaaggtcctactgtgtagcataggttggccttgacctgcttctcctagttccacctctaaagtgctgggtttataaaattgcaccaaactgtttgtgtgtgtgtgtgtgtgtgtgtgtgtgtgtgtgtgtagttacaggcagttgtaagctgctagatgtggatgctgggaaccgaacccagatcttccacagagcaacaggctctcttagccagctctcgtgttgtttttataatcccaagtgcatacatacagtgtgatttgctgcttactgtcatttcaaatgcctttctcgcggttctttctctgaatgtcagccttgattgcccacagctactacaattatgtatcacccagttactgcaagtggttcattgagccagttcttgctttccttgtaatagttccatgggtttattatttgttttacattttattcacctgttctgtttatgtgtgagtgtgttagtttgtgtgagcgcccatgcatgcacacatgttgactgacctgtgttgacgtaccatatggagatccaaggacactttttactagtttcactgaggtattcatacttggtggcaatcatctttactcacagagccttccttccaaccccctagtagaactgtttttagtgtaaggttttcgctctgtattttattacatgtatgtgtaattgtgtactgtacttacacaagcttccttattttagggtgtataatgtcaaacttattcactagatcaataattgtttttgctatttgatactagggtttgtttggtttggtttggtttggttttggtttttcgagacagggtttctctgtatagtcttggctgtcttggaactcactttgtagtccaggctggccttgaactcagaaatctgcctgcctctgcctcccaagtgctgggattaaaggcgtgcaccaccacgcccagctgttttttgtttttcttaagacagggtttctctctgcatccctggctgtcctggacctcactaaaatccatatagagttaagggctgcattaagggctgagcaactctcctaggctggagtttagttttgaatctcgcttcagggctttgaatcccaggcctgaaagtt

SEQ ID NO: 18898 - DNA, 1170 bp, Mus musculus
atttatgtattttatgtatatgagtacactgtagctgtacagatggttgtgagccttcatgtggttgttgggaattgaatttttaggacctctgctcgctcagtccctgcttgctctggccaacatatttatttattattatacataagtacactgtagctgacttcagatgcacaagaaggggatggcagatctcattatgggtggttgtgaaccaccttgtggttgctgggaagagcagtcagtgctcttacccactgagccatcccgccagccctgtctttctttttctttttttttcttttttttttaaatatttatttatttattatatgtaagtatactgtagctgtcttcagacacttcaaaagagaacatcagattttgttatggatggttgtgagccaccatgtggttgctgggatttgaactcaggacctttagaagagcagtcggtgctcttaaccgctgagccatctcaccagcccctctttctttttcttaagatacttggattataagttgtttttcttgctgcctttattgcaatataatttacaacacacactctctctctcgtcacatacacacacacacacaatcctgtagcttttactatatttacaattgtatcatcatgctcaatttaaaaatatttttattactccagcaccttagctcttgctgcctacaagtcttccatctaccttaacccacagtggtcactaacctgtctgttttgtggggttttctctcagatatctcatataaatgaaatgatacaaatcttgtctgttgctgtatgtctataaatcaagcacttggaaggatgggacaggaggatgactgtgatttcaaatccagcttgcagtgtgtggcaatagtctttcttaaaaaagaaatcgggctggtcagatggctcagcaggtaagagcactgactgctcttccgaaggtcctgagttcaaatcccagcaaccacagtggctcacaaccatccatatgagatctgacgccctcttctggtgtgtctgaagatagtacagtgtgtacttacatataataataaataaatcttacccaaaaaaggagaaaaaagaaattactgcgagggagggagccgtctcagtggttgtgagcgcttcctgctgaattctctgtccctatctat

SEQ ID NO: 18899 - DNA, 2910 bp, Mus musculus
cagaagagggaatcagatcttgttacagatggttgtgagccaccatgtggttgctgggatttgaactaaggacctttggaagagcagtcgggggctcttacctgctgagccatctcaccagaccctgtggtttcctttttaaattttttttaaattaagatttttctctgagatggggtttctctgtgtagccctggttgtcctggaactctgtagaccaggctggccttgaattcagagatccacctgcctctgcctctaaatcgctgggatcaaaggaggagtgcgccatcaccaccatgcaaaaatttgtgtttttgtgtatgggtgtttgactgtatgtttgtctgtgcaccaagtgtgcatgcctggtgcctaaggagccaagaagagggcagcagatggcctggaactgaagttacagttgtgaatcgccatgtacatgctgggaattgagcccaggtctactgtaaaagcaggcaacagccttaatttcaagccacgggtctaggttcccttttatttgagacaggatctcgtgtagcccagactggcctcagattcactatgtagctatggatggcctcaaactccgatgatcctgcctctacctaaatatctgggcaatgttgtgactcatgcaactaactcagtctcccaaatgctgggaataaaaatttgagccactttaccaagctaaatactatctgcatatggtagctatacagagaaaccctgtctcgaaaaaccaaaaaaaaaaaaaaaaaaaaatctcagttttctagttattaagttattagcaaatctctttctagtagagtacaaaggactaataataatatttgctattgttattttagaccccaaactcaggtgaccaagcttggcaacacctccagattctcctcaaaaggaagattttgcaaaggaccaatgacactgtgccccgcatccttgcatctttacttactctgcagccatgtctcggtcccgccccgcaaagccttccaaatcagtcaaaacaaagctacagaaaaagaaagacatccagatgaagacgaagacatcaaagcaggctgtcagacatggggcatcagcgaaggcagtgaaccccggaaaaccgaagcaattaattaaaagaagagatggtaagaaggaaacggaagacaaaaccccgacaccggcgccgagttttctgacgcgagccggggccgcccgaatgaatcgggatcgaaaccaagttctttttcagaacccagactccttaacttgcaacgggtttacaatggctcttcgaagaacctctcttagctggcgactctcccagcgcccagtagtcacacccaaacctaagaaagtaccaccttcaaagaagcagtgtacacataatatccaggacgagccgggggtaaagcactctgaaaatgattcagtccccagccaacacgctaccgtgtccccaggcacagagaatggtgaacagaacaggtgtttagttgaaggggagagccaagagataacccagtcttgccctgtatttgaggaaagaatagaagatacccaaagctgtatttccgcatctgggaacctggaagcagaaatttcttggccactggaagggacacattgtgaagaactactttctcatcagacatctgataatgagtgcacttcccctcaagagtgtgctccattgccccaaagatcaacttccgaagttacctctcagaaaaacactagcaatcagttagcagacttgagctcacaagtagagtctatcaagctgtctgatccttctccgaatcctacgggaagcgaccataatggctttccagactccagttttaggatcgttcctgaattggacctgaaaacctgcatgcctcttgatgagtctgtgtatcccacagctctgataagattcatcttggcaggctcacagccggatgtctttgatactaagccccaagaaaaaacccttataacaaccccagaacaagtgggaagccacccaaatcaagttctggatgccacctctgtcctaggacaggcctttagtactcttccacttcagtggggattttctggtgctaacttagttcaagttgaggccctgggcaagggttcagactcaccagaggatcttggtgctattactatgctaaaccaacaagaaactgtggctatggatatggataggaatgctaccccggacctgcctatcttccttcctaagcctccaaacacagttgctacctacagtagccctcttttagggcctgagccccacagctctacctcctgtgggcttgaagtccaaggtgctaccccgattttaactttggactcaggacacactccccaactcccaccaaaccctgagtcaagttcagtacctctggtaatagctgcaaacggtacgcgagctgagaagcagtttggtaccagccttttcccagccgtcccacaagggtttacagtcgcagccgagaatgaagtccagcatgccccattagatcttacccagggttctcaggctgctcccagcaaactggaaggagagatttctcgggtcagcatcactggctcagctgatgtcaaagccacagcgatgtccatgccggttacacaggccagtacctcttctcccccatgtaattctacgccgccaatggtggagaggaggaagcgcaaggcctgtggggtctgtgagccgtgccagcagaaggccaactgtggggagtgcacctactgcaagaatcgaaagaacagccaccagatctgtaagaagaggaaatgcgaggtgctcaaaaagaagccagaggccacctcacaggcacaggtgagcgcagcccggggctgggatctcctgtgtttggcgcagcatcagtccccgcccctaagaatttg

SEQ ID NO: 18900 - DNA, 1182 bp, Mus musculus
atttctctcttactgtatttccatttcctataaagtgattatgatcactaatgagtccgcagtcaatggctaatcaaaataaagatgtagggaaaaaatcaaagctaatttgatttctctttggtcttgaagttggtttgacacctctaggatgtcacctggatgacccgactcgcttctggaaacattcgttttcgagatacctttactcccatctgattagagatactctgactcccatcactgaaagagatggtgacctgtagatttcaacactcctttgacctaagaaaaaaggggagggagcgcgggcggaatttcaggaaagcctaggaaggagtggacaggagaagggtcgagaggagtccggctccgatttgggaaaatccagctcgcattttgcctctcgctcagcggtacagggtccagcaaaggctgtgccccagctacactcctagaggtctgtactggggagacaccgctgctctgggggggggcgagggctgacctggctgggagtacccgcgcactccgctcgtggaacactgcactctgcaactggtttgtacaatcccggggtctgtattcgcccctggacgtcctctccctccctggtcatgtacctctacctgcctcttctacgggaacattcgcggagcagctccccaacccgggtgctcgggccctgaccgtgccggatggtaagtgtccatcctaggcccgcctgaactccttggcgcgtgccggagcctcaggctccaaagttgcacggaccaagacccgctggaaagtttgtccaaggattggtgcaggcttctagcaggggtgacccgcgctgccctgggatccagaggcagtttagggtgagctggggcggcagcaaagagccggggagttgggagagggtactactccgtggcgggacggagctggggggcggatctcgatcgggctaggactttgcacgccgcgatgcttggtgatgactcgtgcgagtcaactccgcgccacgaccccctatcccgggccgctccgggtctttcgtggcgggtgactaacaatgctcgcgggggaccttacagcgctccccagaaagtttagttagccctggctaggatcggttcgcatggggacctccagacttggcatcaactggagatcctgtaggggaaacgcatgtat

SEQ ID NO: 18901 - DNA, 1190 bp, Mus musculus
gaggtacaatgctatgaatctgctgagccttatcactatccttctgtcagctccccaaatcccacccaccaaggtttttttaaaaaaacaaaaaacaaacagataacccaggctaggttatgtttggctacaaacttgctatgtatgcaggaatagaactcagggtttaaggcatgccacacaaacacactaggaatggagtagcagacccagtcacattctcttggaatcagtttagaacctgaataagaaaatgtctttgggatcctgtagcggcaggagtttcctgagtatctttagttattctgaacaatcctgttaatcgctggggagtttatgttaaagagcttcagggtggaacatctgtagcctctggggaagggtagtctccaaaaggacagacagatttactggatttcaaccttcacacctttctaccaacttcctggaaagagggtggggggttcattgggatccctcaaaaaaaaaaaaaaaaaaaaaccggcaggcagatcttttctgagtcgctgaggctgagggaaggatgtaggtctggagagatcctggaagcctcttgctgaggctgagggaaggatgtaggtctggagagatcctggaagcctcttgcatcatcatgctctgcatctgtcctggctgagtgtcttcattctgccaactgtgagtaaagcatgtggacctgatgggtggtgagtgggtgggaactcctatactgcctttcaaaagcaggtataacaaactagcttatggcaatggtattttgtatttcaagtgtgtgtgtgtgtgtgtgtgtgtgtgtgtgtgtgtgtgtgtgagtgtgaatctggaggtgacacacttttaatcccaggattcagcggcaggctggtttctgagtttcaggacaactacggctttataaagaaactttgtcttggacccaccccctcaaccgccccacacacacacacataaaagagggagtgtgtgtttgatctgaagctatgaagttggttcaagccccacttgtctttttttttaatttttttcaagttttatttattatatctaagtacactgtagctgtctttagacaccccagaagagggtgtcagatcttattacagatggttgtgagccaccatgtgggttgctgggatttgaactcaggacctttggaagagcagtcagtg

SEQ ID NO: 18902 - DNA, 1160 bp, Mus musculus
cggatttctgagtttgaggccagcctggtctacacagtgagttccaggacagccagggctacacagagaaaccctgtctggaaaaaccaaaaaaaaaaaaaaaaaagatgagaaggggaaaaaacaaggaagaatcccaccccgcggtttgattgccttttctggagttaaggatgttagtgaatcaccatgtgaatgctgggagcaactcctgtgccaggaatgctgctctagccattgatccatctctccagctccttccctctgcagttcacactgaagtcctcttctccttcctattcttgtgtgtgtccctattcttcagtgaatgtacccttgtgtgttattgatattgctgttattttgaaacctctgtgcaggtctccctggttagcctcaaactccctctatagttagggatggtcttgaactcctgctccgtctgcttccatcttgtcaaatactgcatgcactcctaagaccagcaaactgcagtacagccaggactacatggtgagaccctgtctcaaaacaaaacaaaacaaaacaaaacaaaacaaaacaaaacaaaacaaaacaaaactcatcacactgccggatgtgggggatcaactggggctcagagtaaaagtaggttctttccatccaccatgggtgggttctgggaatcgaactcgggtcatcaggcttaatcacaatcaatttgacccatggaatcatcttactaactaacccttattgaattttgagacaagggcttgctttccacacaggactgagttcacatttaccgcagagctctgctagcctctaaccactgagattccaggtgtgacccactggatcttgctgccttattaacttttcttcctctctctgtctgtctgtctctctctttctctcaggtttttgttttttgtttttcctgagacagggtttctctgtgtagccctggctgtcctggaacacactctgtagaccaggctggcctcaaactcagaaatccgtctgcctctgcctcccaagtgctgggattaaaggcgtgcgccaccaccacccagctcgggaacagactgcctggtttctttttaacttttcatgtgtggcgagctgagtcaaaaatgtggttttctggatgccaggcacactctgagcgacat

SEQ ID NO: 18903 - DNA, 1166 bp, Mus musculus
gaagccctggatctggagttctagacaggtaagacctgccctgtgggcactgggatttgaacccggtactcttgaagaagaatggatgctcttgactgctgagtcacctctccatgtcccttagaaaggtcttttttcttttctttttttcttttttttcttttttgtgagatagggtttttctgtagccctggctgtcctggaattcactctatagggctttgaactcagaaattcgcctacctctgccttccaagtgctgggattaaaggcgtgtgccaccattgcccaggaaaggtttttctaagaaacaactttagccatttgaggtggtccacgcctttaatcccagcacttgggaggcagaggcaggcagacttctcagtttgaggccagcctggtctacagagtgagttccaggacagtcagggaaacacaaagaaaccttgtctcgaaaaaattaaaacaaaacaaaacaaaaaaaacctttaaacttcttttagaaaacaggcctttgtggtttaagcaatttgaaacttggaagcctgattgcctaagggacttgtgtctatgtgtccgtccttggcaggtgaatccactagaggttgtggattcctcccctccccgactcctctcctagctctgcagatcaaggacagtagccagccaagggtgtggtgactgtggaggtcacctgagaggaaacaaccctccccctgaagggtaaaaagagatattgactaaattatctttggaagtctaggctgctcacctacattaaaggactatgaatcaaaaaagaacccctcccccagcttctgtgcttccagctgctttgccctgtgcttctgccctgtgtctgagcctggctgggcagcaccttttgtctttactcatgactccctttatgcctggaccttgggatggtaatagacatccttctgtactggggactacatttatttatttttcttggaatttgaatcacttttttttaaaattaattaattaatttatttatttatttaatgtaagtacactgtagctgtcttcagacgcaccagaagagggcatcagatctcattacgggtggttgtgagccaccatgtggttgctgggatttgaactctggaccttcggaagagcagtcgggtgctcttacccac

SEQ ID NO: 18904 - DNA, 1902 bp, Mus musculus
gctgcagagcaccattctgtctgaaggaaccatccaaacaaacgaagctgttctgggctcttgagttgtcttgtcaccttgtggtggcttgtcccctttggatggttgctatatcattttccactgcctttcagtaccatgcgggagaccatgaagtacgtctatggacagcatgggattcggagaggattgtaccgtggcttatctctgaactacatccgctgtatcccctctcaagctgtggctttcacaacgtatgagctgatgaagcaattttttcaccttaactgaaagaaaaaaaaatcatgatttgtagttattttcctcagtaaattctcagaaggatgtgtgtgtgtgtgtgtgtgtgtgtgcgcatgcatatatatatgatgataccttaattgtgaaggaaacattacttgaaggggacgttcgccctgatacaggaaccactggtattttaatacttgatttctttgagttttaaaatcacagatcaaaaattcttagcataatttgtttttttctttttgatgggatctctgtatgttgccctggctggcttggacctcactgtggagagacctcctctttgtagagaggcaatcctcttgtctctgcctcccacatactgaaattccaggcatgggtcaccatgcctgctccaacatatttattaatggcaaacgttataccttagcaccttgaaaagccatcttgggtaaagtgttatttggaaggaaaagaaggttcgcatttgagttcaagagattgcccttagtcctaccatactttccaaactctgcattgtaattgtggttactgagggggaggggctggaatcgaacccagggcctttgcatgccaagcacatgtacccactaggccacatccccagcctgccagcgccatgccactgagctatgtcactggcctcttcctttcttaggatggtgctggggatcacattcatgcatgctgattgtgtaatcgcacactgccaatggtccacaccccagcccgctaaccccgctcgttatttcccctcccactctgtcccttctctacttgttctggggagtaaactcagggtctctctgcctatcttgctagataagcgctctacctctgaactacatctccagccttctaacattgtgtaatgttatttaaatcagctgacttccttttattgtagcagaatgagaactgaaaatgtaaggtctgtgaaacagagccagcaacaaagtagtgttcttattatgtttcttctcagaattctctccagtgggtaaaaagacacctttccgtctagtggtttgagaagcacttccttccttgcgctctttctttctaactctctttggggattgagtccaggacgttgtacatggcaggcatgatgagatcccatcagaaagtcagctgtacactgaggtatatccccagttgtccttccttctcaataaaattactgttgtatttgaaaggagattgtcaacaaatgaagaaagtcccaggtcttgttcaaatgctattaccatgaactttgattatcatgccactgcgtttcccagaggcagttatgataaagattaaatatctttgcccttaaaaggagagtagcattgtagatgcttgtctaaaataacttggtatgtactaggaaatgtaaatggaccatcaatttagatgaagcaatgtttctgaggtattatgtcaagatataagttcttccatgtaatgtaattttagtgtgtcatagtccgaagcgtaaatataaaccacattttgattgttacattttaaaaaggttgtttagaatataagaattctgatcattgtgtttagaacactttttgttgtaagcatgacccatggagtagaagcatcaagccttct

SEQ ID NO: 18905 - DNA, 1335 bp, Mus musculus
ttgaagttctgatctttcggcagccccgggattcaggcctgtgaccccactcctggcattattctcccctcttctcctcctctacctccctatagagtctcgtgtatcccaggtcatcctacaacttagtgtagagcagtggtctagaagtcatccccctgcctccgccttgttagggctgaggttgtggatacgccatagcgcaccggcacattccctgactgtgtcttccttaattcatcttacatcctggaccttccttccagagagcatgagagcctcagccacatcctgggcgattgtcagcgagactgagacactgcggagactgccgcggcataggcagagactgcgccacgagatgctccagctgaggttttctgtgaatgccacccttaaactgaaggtgacttttagcccaaaggaggtgaatgtactgttttcaaggtcccagatttttctcttctgttactacgtaaattctactttaaaagtcttgatgtacccaaaattgagaactctaaatttggaaattcttcaaatatatctgtgtctgaccaagggggaaaaaccataagattttccactttaagttgtgggttagccttggggtctgtactgcaatgcctaaggttccattatagctcaaggctgagagttcacaaaagaaactaccaacttcgggtctgattcccaaatcatacaagttacatttaaacagtcagacagactggcccatctcattgcttgaagccactctgtgccagggagatcagaggactattactctatgaattttgggatttcctggttgttttatatttaatattagatgaggatttgatataaatgtatttctgatatatttctgaggcgttttggttcctgaattgatgttagcatacaaggtacatcctatttcaccccggtttgcctcttttaggttattactcaactttttcacttacgtacagatgttttttaaaaaataaattgatcagcaagtaattagcatctctatataatatatatggtgacatttccacatcaggtcttaatctcctgggggggaaaaacttctacctcactgagtggaaatttaaatatgttaaaatagttggtgcttctgtcttttttattatttaatgtacagttgaataaatctttttgtcctgataaacttcactgagtcatttttcattttgtgacttttaggtgtgtgtgtgatgtaggctctcctgtgtctcgggtgaccttgagctgtggtcctcctgcttgtctggttgctgcagtggtagggattgagcctccagctttgtgcaccctctgtcccca

SEQ ID NO: 18906 - DNA, 1099 bp, Mus musculus
cagctgcaggtctgatgccttcttctagcctctgggcatcaagcatgcacatggagacacacgcatgcacgcaggcaagaacactcacacatgcacatcttttttacaagagagaaatggagggaggtagaaagtgtctgaaaattccttccttatccgagcttgacagaatactcctgtaatgccagcactcgggacataaaagcacaatcagaacaaagatatttacactttcctacttagtgatacatatgtaatttggagggcttttttctccttttaagttatattttctgttttctactgaaggagtttcttaacctccaggatgaaaatcagcagttgaaaaggatttatcaggaacaagaacaagctctgcaagaacttggcagcaaactctgcgagtaattcctctcttccttcagctaagtgctcacaaacgggtgaaaggcacacacatcagctgtgcagagggctacttgagtatggggataaaaaccaaggctagatactttggagggatttcagtagttctgtgcattccagtagacactggctctgaagggttccagtaagtgagagcaaaaactattgcttgagttcttcagtgataaagactccagaaacttaattttgtcgggacaacaaaagctgaattttgaaaatgtccagggctttcagactattgacagagcaggtttgttgggaagtaaatgtagtttctatcctacaggggtcagtgtgattctgtagtagaatgctattgggatccatagtgaaaaggaagccaggaaaggctgtaatctcagcacctggaagggagacaggaaggtccggaattcaagccatcctcagttacacaaagaatcagggccagccttgagagcatgcctttaaaaaaaaataaaataagaggctggagagatggctcagcagttatgagcactggctggttactcttccagtgatcctgagttcatttcccagcaaccacatggtgactcacaaccatatgagatctggtgccctcttttggcatgcaggtgttatgttagatagagcactcatatacataaataaacaaaccttaaaagaacgg

SEQ ID NO: 18907 - DNA, 1102 bp, Mus musculus
tgtcttcaactcaggccccctgcccacatctggacacgcttctgtccaggcatgtcccgagtttctgacgtaactctgagagctactgtctgagccttgtgccttctttccttcattttgaacataagtggtgaaaatgagtcacaggaattgtgcacaggagaatgcctttctattttcatacttctgaagtaagagcaggtgttattgatttgaacattaacattcatctttccatattagggactggtctggttaaaagacaaagatgcaacccactgtaagctttgtgagaaggaattttcactctccaaaagaaaggtaggtaagagaagtgaaaatgattccaaacgttgtggcaacaaaaatggcttctaatttggttttattttccccggatttttccatttaatagcaccactgtagaaactgcggagaaattttctgtaatgcctgctctgacaacgagctgcctttgccttcttcaccaaagccagtgcgagtctgtgattcctgccatgcaatgctcattcagagatgctcctctaacatgccatgacttggaactccattctcctgcacagcaccacctgcagcgagggagggctgtgtgcccagtcagtactgtaccttgcctccagctcacaaacaggtttctaagttatatgggttagtattccgtccctgtacttaatcagattttaagatagcatgttttagcactacttcaactatcaagtaacctttaacaaaaggtcagatagcagagctaatgcacatttgccttaccttatagaggcctttttgagaacaaggccacagcttatttgcttctgaactgatgagtaggcacttgaaggtgcctgtctcttaatgcactttagaaagcgtcacaattctcagagaaaaactggaaatgcattcactttatgttatatgccgatttaacggtttttaaaatggtggcccacgccttcaatcccagcacttagatgcagaggcaggtggatggatctgagttcagtaaggccaccctggtagaaagaggaagttccagtcaggacagccagactgtccaggaagacagactgaatcaaagttg

SEQ ID NO: 18908 - DNA, 1214 bp, Mus musculus
gtgtgcagtgccacccctgggcaggtgggtcctggtctgtataagaaagcaaattaaacaatcatggggcacaagccagtaagcagcggtactccaggacctctgcttcagctcctgccttgagttcctgccctggatgttgtaacctccaagacgacataaaccctttcctcccagagttgcttttggtcatagtgttcatcacagcaccagaaactctcatctaaggggccagagagacggctcagtggtcaagagtactgtaagtcctttcggaagacctgggctcaatgccaagcacctacatggtggctcataggcacgtccatgtcccacagacctgtgcaggcaaaacatcagacatataaagtgaaaataaatcttttttttaaaaaacaccctaagacaagaactgtctccagagagctgtctaggacattggcatgcacacacagtcccttatataattatattgaaaatggtgataaggtttattttacatagacgtttcaacatacctttcttctctgacaggaatataaaatttccagctttgagcagaggctgatgaacgagatagagttccgcctggagcggactcctgttgacgaatctgatgacgagatagaacacgacgaaatccccacgggcaagtgcatcgcgcccatctttgacaaaaggctcaagcacttccgggttaccgaaggctcaccagtcaccttcacctgcaaaattgttgggatacctgttccaaaggtagggaagatgacctgccagttgatcatcaatagcatgaaactatatacgggtcttcagaatgtctcacggggctggcccgtagctccgtggcagagttgtcgccttgcctccagtggacaggctctagcacgtgtaccctcacccctggaacaaaaactatctcagagggctagagagatggcttcacagccaaggcacttgctgcttttacagggtgggaatttagttcccagcacccacttatggtggttcacaaacccctgtaactccagcaccagggcattcgacgccccctaccggcctcttcctgaactacccacacacccactagagacacgttagaaaggaaagtccctggcttggtatgtagctcacaatgtagcaagcatgaagccctgggttcaatcccccaaaacatataaatcctggacatggcctgtaatctcaacacttag

SEQ ID NO: 18909 - DNA, 1187 bp, Mus musculus
gaaaactgaagttgattttgtacttgaacaaaaaatgcaaaagttctaaaccaaatgccaataaaccggatccagaaacatatcaaaaagataatagattgtgaccaggatatatttatctcttgtttgtttgtttgtttgtttgtttgtttttgagacagagtttctctgtatagccttggctgtcctggaactcactctgtagaccaggctggcctcgaactcagaaattcgcctgcctctgcctcccaagtgctgggattaaagatgtgtgtcaccacagcccggctaggatatgtttatctcaaaaaaaaaaaaaaacccaaaaactgagtttctcttaatattataaagcccgtattctttgctatgttaacaggaatgatgctggaagaaatcgatgatctccataggagaaaaaaacctttaaattctctcttactattttttttttaaacttaggcttggacaatgattcagcagatgaagtgctttctgtgtaagtaggagagacagagtctagctctccaacaatgatgtggtgggtggagagaacccactcctgctgttcgtcctctgaccttcctgtgcacactgagacacatactgaaaagatcagcatagggactttgggcaggtcatgaaacactcaccccttgggaagggagaggctaattagcatttctcagaccgctgggtgggagcagacctgcaggtgggggcacattccccagggctgatcattgctcactttcagacaatttccttgtcacctcattccctagagaccaatcagtttaaagggctcactgttctgccaatagtattgtgcctagttgctgatgctctgttctgcccctggaaaccatataaaaactcactgaacaggtgctgggggtcgccacctctcttttgggtctaggacgaccccagtgcactggaacaataaacacttcttgctttttgcatcgatcccggctcctgtggttcactcacctggtccctggtaagccaaggctccccgagtcttaaaataccacacatgtgtgtgcatgtatgtgtgcacacatatgagggaagaatacaagccagggtcaatgaagcacacctgcaaccccaaacactgtaggaggctggaagtcagaaggcagattcccagaggctctctggctagccagtttaggcaa

SEQ ID NO: 18910 - DNA, 1144 bp, Mus musculus
tcctgggggactagagaaatggctcagcagttactggccgctcttccagggaacccacccgagtcctgttcccagcatgtatgttgtctcacaaccatctatatctccagttgcaagggatccaacacccttttctggcttctgtggataccaggcatgtctgtgtaccgcaaagcacttgtatacataaaataaaaaggtaaacatttatttagctggcatgatggcatatccctttaatcccagtccttgggagacagaggcagggagatctctgagtttgaggccatcctgatctacaaagtgaatacaggacagccaaggctttattacacggagaaaccctgtctggaaaaaaaggaagagagaaataaatggggtcctgtaacgggatggggggtggggtggggtcagatacttgttagtaagttcttgccttgctagcactaggacctgaattcaattacgtcatcacatataaaatgccaggcatggtgacacatgcttgtaagtctgacattggtgggacagagacagtagaattcttaggatttgctgaccagccaatctagcctaattggtgagctccgggccagtgagagaccctgggtcagaggtggtccctgagcttgtcctcttgcttacacacacacacacataaggagagagcagctcactgtgttgccaaggttggccccaaaggccttgacataaatggtccccagccctctcggatttcctaatacctagggtgtgattaatggtatgaatctatctggctaatagtgtttttaggtagacatacacatttaaatttcatgaattctaatttgttgcctgtgactattataactgaggaaatattgcccaaatccaatgtgttttatcctttggtcttttttcttccaagaatttttataggtttagcgtttagatttggattttgacctgttttgatttttttttcccaatttggaggattgaaccagggcatcatgcatattagaaaagtgctttgccaacgaactgcatccccagcctttgtttttgcgacatttcattttgtagctgaggctggtttgggactcatcgtgtagccaacttggacttggaacaacagtcttcatgtgtcggtcttgaaagt

SEQ ID NO: 18911 - DNA, 1259 bp, Mus musculus
ggaatctatacaatatatatttctaagaaatagctattaagcattctttcaagatcatctttaagatgtttttgtttgcttgtttggtttggtttatttttaatgaaggaattagctatggtttagtgtagcttgggattggtttctttttacccattgaactctatactcatttttctgagtttagttgaaagtagcaagaaatgaaggagcaaaaatgtaatgataagcattgggtattctccataaatggtgcgtgtgacttgtgcatctatgcctggcttttatttctaggcaggagtttgttgatgcctatgtggattacatattcaataaatcagtggcatctttatttgatgctttccatgcgggctttcataaggtctgtggaggaaaagttcttctgctcttccagcctaatgaattacaagctatggttattgggaatacaaattatgattggaaagaactggagaaggtaaggaaaaaccaatctctacttgtcagtggaaaagcaaaactatgcgttattggaaatctagcccttgtgtgcttttgcccttcctatagctccttgctgtgcttattgtagacacttgcctgcccctcctgccctacagtgcactgtgtggcggcactggtgaggtgattgggaggcgtgctataggaaccctagcccaagactgagtgactttctacccatgcttaattaaggcttttgtttcctgtttttctaccaaatcccagtgttaagcttgaccatggtgggagaggactacaaaaggaaaagccttggtagcatttgaaatgtaaatgaagaaaatatctaataagaaaattgtttaaaaaaaaggaaagggaaaagccttggtgctcttaacacttttgttttaaagcggggaaaggggctggtgagatggctcagtgggtaagagcacctgactgctcttccgaaggtctgaagttcaaatcccagcaaccacatggtgtctcacaaccacccataatgagatctgatgccctcttctggtgcatctgaagacagctacagtgtacttacatgtaataaaaagggggaaaaaattagtagaaacattctgatttgtcttcctgaaaatagtacaagaaacatttacccagtcccatgtttgtgtttaataaacctctcactattttagtaaactcttacttacaaaggtgacgggtctgttcttccttcctggggagtcagtatcttcacattgtaaaatgccagggtt

SEQ ID NO: 18912 - DNA, 1136 bp, Mus musculus
tgtatctgtgccgagtataatgtatacaggtatcccggaaggccagaagggtatgccatgcgtcagaccccctggagcttttatagttgtgggctttatctatagagctcaagtgatgtctgcagttgcctgagatcctgtgtcaaagaaacagcgttggagaactagagagagctgggagcgcagcttagcaagggaagcctgacttggagttcagtccctgggacccacatggaaaaggagagaacttagaaagcttaactaaccagttttctaaatggctcttccaaaaaggatttctaaaagcttttgccattgttcatcaagtattgagtacttcctttaaaataatgaatgcaaaactagactgtgttgtctaaattgttttccttggcagtatttttgacaggtagtgatcggattcccattcttggtatgaagagtctgaaactagtcatccagtcaacaggaggtggtgagagctatctcccggtttcccatacctgttttaatcttctagatctcccaaaatatacagagaaagaaaccctccgatgtaaactgatccaagctattgatcacaatgaaggcttcagtttaatatgaccttggacttttctgtttagtacaaaaaccactcgtgtttctcttgtgaattcagcacagtgagagttacttctgtaattcttacttataaattgttcactactgtactgatgaaagcccaaaattaaaaactgtgcattaatactaaactgtacagaaccatgaattgtccatcctcatacaagtattgtgaatacattaaagttttactcacaggaattttaagagtttgcatatttcggaaattacctgatgtgtgggtgcatggaaatgttgcttactgtttcttcaatcactggggggaaagactacgatggcctgcccacagtcatttgattatttttccattttgtaaataaaaattttgtaataaaatagtgacattcagataccagtagtttctatggttgtaattgaacagagttttaagggttaaaatttatgattcagtctcacttgcagattctatctgtaaaaatcatggtggaaatgatctctagacagggtttctctgtatagccctggatgtc

SEQ ID NO: 18913 - DNA, 2178 bp, Mus musculus
atcaagaggttgttaatgaagctatagctacaagacaggaattgacagatgtaaactatccatcagacaaatcataacactattgaagctgtccggattcaggaattgctccaccagcattgggaactttagcatgtcaaaaaatgaatgtttacttgtgaacttgaacaaggaaatctgaaagatgtattatttatagactggaaaatagattgtcttcttggataatttctaaagttccatcatttctgtttgtacttgtacattcaacactgttggttgacttcatcttcctttcaaggttcatttgtatgatacattcgtatgtatgtataattttgttttttgcctaatgagtttcaaccttttaaagttttcaaaagccattggaatgttaatgtaaagggaacagcttatctagaccaaagaatggtatttcacacttttttgtttgtaacattgaatagtttaaagccctcaatttctgttctgctgaacttttatttttaggacagttaactttttaaacactggcattttccaaaacttgtggcagctaactttttaaaatcacagatgacttgtaatgtgaggagtcagcaccgtgtctggagcactcaaaacttggtgctcagtgtgtgaagcgtacttactgcatcgtttttgtacttgctgcagacgtggtaatgtccaaacaggcccctgagactaatctgataaatgatttggaaatgtgtttcagttgttctagaaacaatagtgcctgtctatataggtccccttagtttgaatatttgccattgtttaattaaatacctatcactgtggtagagcctgcatagatcttcaccacaaatactgccaagatgtgaatatgcaaagcctttctgaatctaataatggtacttctactggggagagtgtaatattttggactgctgtttttccattaatgaggaaagcaataggcctcttaattaaagtcccaaagtcataagataaattgtagctcaaccagaaagtacactgttgcctgttgaggatttggtgtaatgtatcccaaggtgttagccttgtattatggagatgaatacagatccaatagtcaaatgaaactagttcttagttatttaaaagcttagcttgccttaaaactagggatcaattttctcaactgcagaaacttttagcctttcaaacagttcacacctcagaaagtcagtatttattttacagacttctttggaacattgcccccaaatttaaatattcatgtgggtttagtatttattacaaaaaaatgatttgaaatatagctgttctttatgcataaaatacccagttaggaccattactgccagaggagaaaagtattaagtagctcatttccctacctaaaagataactgaatttatttggctacactaaagaatgcagtatatttagttttccatttgcatgatgtgtttgtgctatagacaatattttaaattgaaaaatttgttttaaattatttttacagtgaagactgttttcagctctttttatattgtacatagacttttatgtaatctggcatatgttttgtagaccgtttaatgactggattatcttcctccaacttttgaaatacaaaaacagtgttttatacttgtatcttgttttaaagtcttatattaaaattgtcatttgacttttttcccgttaacttccattgttcatagcatactagcccagtaagggttgctatcactaaatgcctcaagaaagtctatcttaacacatttgttacctgtgtttagtaagactgagggtgttggttttctagtgtcagaccagagtgaatccaaagctggccatgtaaaagacacctggcaaagaaagctaaatacaccaagtggagaaatggtttaatgtggtctgtggttccccctcctcctccaatttggaaagaatgccaaatgagatgacagtacaaatagccagagcctcacccagaacactgctgggtgtggtgggcatgcccacagtaggtgactcttgtacatacacagggactaacttactaacttaagatctcattttttgtagggaggagtgcgctttgaaggaaaaaggtgtgtgtcccaactaagcatttttagacaggagtccgttttagtgaatagcccaaatagc

SEQ ID NO: 18914 - DNA, 1099 bp, Mus musculus
ttagcttgtaagggaacagatagattttcattgcattctggagggagaatcaataggtcctaatgaccaattacaggtgtgaggatgcaatggatcactgcaggtacttggtttggatgactgaatagatggtggaaccagcaggaagacaatagcacactttggggaacctcccattttaaatggttaattctctcacagacagttattatgggtgagttgtaagattatttaatgatgtgttatggatgctgaaacagctttggaaagagtgcaataaagaattgggggatgattgcctaacaaagagtgaacaccccatatcctagattcaatgaatcatgtacagaaagaatattgaactacaaataaataaatactaagaagtgcatttatttaaatggaagaatttcaaggctttatcacagcttgtgaataggtaagttttttggcatgaaatgttctcaataagcttcagacattttggcttattaattgctgaataaggtagaacatagggtcctggacttaaatctagtcacagtcatttaataaaggttagagatgtgtcacaaacaaggaatggtgcatggtttgttggatagtaatgtgtgtcttccatttgattgtatttcaggtttacaagattgtggcttaagaataggcagactgatttggtcatagcatgaagcattcatgagtaggtagtaacatatgacaaaacactgctctttcaagtattcttcttaagcaaggtgaggaataagctctttgatgggcagatcttctctattcttagtcttggcgcagcatctaagtttagggaagcagttcatttctccatcagtattatattacagttaggtagctacattcactgctaacaggcagctgtgtacctggcttattctttattatcttttgcaatcaatcccttgatttactgatacaagctactaatactaaaaatccaggattgtgacctttcaggatgtgggtcactgctacatctatagttatcagtgctaatggaattgtatggaattactgcatctaacaataccattttagagtaaaagtttcaaatactattttaaga

SEQ ID NO: 18915 - DNA, 1204 bp, Mus musculus
ccatatcaagactcacaactttctgtaacttcagttccagaggagctgataccctcttcaggcctttctggatacttgcatgcatgtggtgcacacaaactcatgcaaggggcatggatacatatgcattaaaaagcaaaccaaccctgaaacaaaatggcataaggaacagggcctggagagatggctcagcagttaggagtgctcgcttctcttctagaggactagagcttggttctcagtacccacatcatgcagtcacagtagcccatgattctagctccagaagatctgataccctcttctggcttctccaggcacttatgtatatgtgcacacacatacatgcaggcacttacacatatgtgcacacacacatgcatatgcacacacacacatacacacacataaaaccagtattgtgtcatcaaaaaaacccatgaagttgaaacaccgaagatggatactctatctgggtcattcaacagctgatgttgacaagaccaaaaaaaaaggctacatccttatgtgtgtgtgtgtgtgggaggttctatacaaagcagttcaaaaagaaaccttgacgctttcaacatggctctggggtgggagccagaaatgaaaaccttccttgtattggaaccacagacacattcttgtggttgttgggacctgactctatccaatgactgaagggaaaaaaaaaaggccagggagagaatttaatccaaggtggcctccttatggttttgagccgtatttgaggcatgatctcagcttctctctagagaaacttgacttcagtccaaactaacagcagttgatgagactcagtggatactaaccacgtgttaatttcaatcatattaagctacaaaaaatatgtatcgcagaagcagtgagatacagttatctcctggggagaacagagcaacatgtctcagaatgaagcctttgaaagtatttatgtgtaggaagggaagacagggaggagatcaagaggaagtgaggccagttgcaagagggtcgaccacggctgctcttcacctcagcgttgcagaatagatgccacacactgttgcatacaccactagcatcaaagctagctcaggctctttagagtaagggcttaatgccggttgcccagtaacccagctcctggcatcacatatagtgtagagagtgggtataggctttggtgcggtat

SEQ ID NO: 18916 - DNA, 1266 bp, Mus musculus
gccatagctggagagatggctctgttttaagaatgcatactgctcttacagaggacctggattcagttcttagtgcctaagccaggtgtttagttcactgcagcctgcagtgccagctcctgggggtacaataccttcctctgatttccaagggcacctacgtgcatgtgaacattctttctcacggatacacatacacacatcatttgaaattaaaaaaaaaaaatcctgtgaaaaacaaaaaggaaccagaaataagctgattactacataaacaattgtctacggccacctcagttcctcataggtcccctccacacacactgtgtgtgttttctagggctaaaaaaatgagatcttgctatcgtttctagcaataaacactttagcacatagaggtctgggacagaactaactcctcatgtgttttcagggatcttattccatgtgtcaccaccaaagacttccacagtattataaaacatgtaactactctaaaatgacgtcagcccttggctacatcgtcttctttctcttttgtacatttggagaaatgcctgaaccttaatggtattactataatactgtcttatattaactgtagggttttttcattggaatattgtctgccattggaggggcgggggagacaacgaatgaagatctaaatacagaaatctgaacacaagttccaaagcgtgtcctctgacctctcccttttaggttgacttatttgtgaaacaggtaaaatttgagagggtcattgttttgtggtttgtactatttcttaagaaacataccctaagattaaattttttctgaaaagaaagtatctttttttcctaagtacttctcaagttagtcttttagtgggaattctgccgattaaccttgacttaacatttttttccttctaatatatattttttaactctgtgtactttaatactttaagtggaaataattttataaaatctctgttaaatctcaagccccaaatgtgggtggctctgcatgtgtgttttgggaaacttttacaataaagtaaactcattttattagtggcagctgagtatttttttttctttatgtgtctgaatatgtatgttgaagtctgtgaattgatgtcctttattgttcgttattagtaacagagaacatgtccatgtccttcagcttgcagcaagtcaggactgttgttactttctgtaaagcttcacttgggctgaggaaggagtcctgggttgtgaagtctggatgctaaga

SEQ ID NO: 18917 - DNA, 1127 bp, Mus musculus
acgtaacaggcttccagaaaaatgccatcttttattttattttattttattttatttttgggtttttttttttcgagacagggtttctctgtatagccctggctctcctggaactcactctggagaccaggctaaaggccttctttttaatctaacagatttagagggattgaactcagctccttttaggttgccctactaactggacattgtggacactaaatcatattggggtgatgaataatcaaattttcaatatcaaacaatgcttacatgggggtgcctgaatggcccacacacacaatgacctcttgatactacgaatattttctacacagaatcacattgttaatatttttaacacgaaataaaaattcaatctttttcctccccaatttaatcttgtatctccatctactttgctttgactaatagcctcttcctttcgaaaaggattctttaatttctattcaaacatctataaagtcccacaataaattattggacaggatgtattcatttctcatgaaccagacctgctctgaaccaatgctgtgcggcatgggtggttttccctgcagaggccgtgttacctgataaggtgatgtgataagtacagtaagttactttgtctccatggggacaaattggcaagattgtatcatattcaagtccagtatcagtattaaacttacccttaggagctaaggatagacaccatgcttgaggtacacaaggccttgagttcaatcccaaaaccaaaaaaaaaaaaaaaaaagatagttaaaacaaacttattattatttaatgagtttgtatactatttgtttcttcttttgacttttgtttgtttgggtggagggtgttttgttttgtgagacagagtctctctgtgtagccctggctgtcctggaattcactctgtaggtcaggctggcctcaaactcacaaagctccacctgccgctgcctcccagatgctgccattagaggtgtgtcccaccatgcccaagttgttttgagactaagcctcactctagccagcctgaaatgcactgtgtagcccaggcttacttccagtatatggtcactctggatgcctccgccgccttttttttttaaatattt

SEQ ID NO: 18918 - DNA, 1185 bp, Mus musculus
aattgattagcgcccccccccccttaaaacttgaggttttttttctctccaataataaatatctcctaggtagtttcttttcattactgaactctttcaaaacaagcatagttctcacaccacatttaattattaaaattctcttttaagaattacagtgaatgcaaaagggaaaaggtaattttgtcttttgtaattaaaattggttatgtaagcaggtggtattgtacaaatttgaattcccaaacttatttgtaaatagttgagtaaagaaattgtactaatgttatgctggtcagtttgttagatttaatgtttgttttatgtcatggattaggtactagaaccacagaatgtcgatccttctatggttcaaatgacctttctagatgatgtcgttcactctttgttaaaaggtgaaaatattggcattacatcacggcgaaggtctcgtgccagtcaaaatatcagcactgttcacgtatgtatgttattagtaatgcattttaataaaatacttttccttaggttattcaaaatcaaatagtaatataatcattgttgatttatttttagggtcattatacacgtgctcaagcaaatagtcccagaccagcaatgaactctcaagctgctgtaccaaaacagaacacacaccagcaacagcaacaaagaagtattcgtccaaataagaggaagggttcagatagcagcatacccgatgaagagaagatgaaggaagataaatatgattgtgtatcacgaggaggtaggcccactttttttttttttaaagatttatttatttattacatgtaagtacactgtagctgtcttcagacacaccagaagagggagtcagatcttgttacggatggttgtgagccaccatgtggttgctgggatttgaactaaggacctttggaagagcagtcgggggctctcaactgctgagccatcttaccagcccccttaggcccactttttaagagttgcttttgagagagagagacagagacagacagacagacagtgtctcactgaacactccttggctatcctggaattgactggctggctagtgtcagactcagagatctgtgtgttgagtgacaatggcattagttagaggcatgcctcatcctgcatagctagacctgctttttttttttaagggcatgtcta

SEQ ID NO: 18919 - DNA, 1122 bp, Mus musculus
ttcctcctgtgtgactcatcctaatgacagatttacaaagtacactcttgagttatattgggtcacagtatagaaaacagtttttaaacatgtaattagaggtacgggctttaacatgtatgccactgtcaccatataagtactagcttaccagacacagcacactcttatggaaaacataactttgtcaatgcttccacgcctccctctctagtggcctaacggggcctggcttacagagacagtcgaacacatttaggccttaaatgaagtgatctgggagttgtgcatatactcttacattacaaagttaattaccctatgggaaaaattgacagacaaacttgattataatttttgcttctagtggaataacatgttaggtctaacattctggttttgttgtaagcactaattctggttttaggatcatagggaatcataaaattaggtccgtgggcattgtttatacacttcatatctgcttttagtgaagaaatatttttagaagttactattttatgttgatttgttttaagttgaatgtaaaaagactgtatgattaatgttggttaaaagttgaatatttctcaccagattcatttaaaaataccaggttttataaatatactatggtcagaagtcttgctatgaaacttgagtgctaggattaagtacatgacagtctacccagctcaacaatttaggtttgtgtttttctgttgtgttggtaactaaaatgtaggtttttttggttttgtttctaatagaattctcccagtccttggctacatcaacccactcctgtgacctcagcggatggtattggattacttagtcacattcctgtcagaccttccagtgcagagcctcatcgacctcacaagattacagtgcattccagtcccccactgacaaagacattagcagatcaccacaaagagtaagcttaccagtgtttaacacttaacacatgcctttggctttcgtggtttttttttttttttttttggttttttttttttttttttttggtttttcgagacagggtttctctgtgtagccctggctgtcctggaactcactctgtagatcaggctggcctcaaactcagaaatccgc

SEQ ID NO: 18920 - DNA, 1133 bp, Mus musculus
agactgaacaaatacaaggaggaacatcgtcggattcttcaggagagtattgatgtggctccatttacaaccaaaatcaagggtcatgaggttgaaagagagaattactccagagtagtaccatcatcttctagtcctaaaagccatgctatcaaacaagataaagacgtagaccgctccgtgtcagagatttataagatgaagcactcagtgcctcagagtttgccccagagtaactacttcactactttatctaatagtgtggtcaatgagccaccaagatcctacccatccaaagaagtttccaacatttacactgagaaacaaaataataacctttctgcaacagccaatcctcaaactcattcttttatatcatctctttcgaagcctccacctttgattaaacaccaaccagaaagtgaaagtttagtgggcaagataccagaccatcttccccatcagagtgcatctcactcagtaacaacgttcagaagtgattgtcggagccctacccatctgactgtttcttctactaatgcactccgcagcatgcctgctctgcacagggcaccagtattccatccaccaatccaccacagtttggaaagaaaggaaagcagctacagtagcctttcccctccaacactgacaccggtgatgccagtaaatgctggtggcaaagttcaagaatctcagaagcctccaactctaattcctgagccaaaagactctcagtcaaattttaagaattcttctgatcagagtctaacggaaatgtggagatctaataacaacctcaacagagagaaagctgagtggcccgtggaaaagagtagtggaaagtcccaggctgctgtggcatctgtcattgttcgtccaccttctagtacaaaagttgatagtgtgccatctgtaccattagcttccaaagatcgagtttgtgaaagatcttcatctggggcaaataaaacagattacctcaaaccagaagccggagagactggaagaattattctaccaaatgtgaatttagaaagtgctcatgtgaaatctgaaaaaaactttgaagctgtctcccagggcaacgttcctgtttcagtcatgtctgctgtaaatgtagtctctactac

SEQ ID NO: 18921 - DNA, 1203 bp, Mus musculus
ttttcctcaataaagataaataaccaaaaagcctcatcaaggtggagacttgtactgaggaggtactgttagggcgttgtgtctgctataggcctccctctttctggatcttgtacctaatcggttgtgtttagggaagtgtaattgaaacattagtatttagcatgctgtatgcctccctcgtacagtacatcagtttacactctgaaggcgttctagaatagtgttgcctagtttaaggaaagggtattacagtgttcttcacaacttaagaattttgtaccagtcagtggtgttgcatgcctctaatcttagcccttgttaggcagaggcaagcagatctctgaattcaaggtcagcctggtctataggatgagttccaggacacccagtgctacatggagaaaccctgtctccaaaaaaaaaaaacactcaaaaactaaaaaagaagaaataattttgttcttccaaatttttatataatgcaagtctatatttttttttaaaaaactgtattgttacctttagatatgaagactttttaagatgtctgccattaccagaatattgcaacccagaagggaagttcaatttggcctcccatttgccagggttctttgtacgccctgatctaggacccaggctgtgcagtgcctatggtaagtatatgttttcgtttctctttaagttgagactctgtgggaggataacagactttagtccagaagccaatgtccagtggctttacctattactaaaacctgttctttaagtgatgttattgaaacccttcttaatatcaaataatgctatatgaattggcaggtagtatacttaagtaatacttcataattccttgtaacatttctatgtatttttactgaattgttttgtatgtggccttcccattgatagttttaggggctagtgtttatcacaaggcaaataaaccagacttgtcattagtttgttgtaatagactgttgtgtgggcataaatctgtgcattatcagatgcgcacagtgcactgcagtaaacgacctcacgtccacacaggtgttgctgctgctaaggatcatgatataggaaccacaaatcttcacattgaagcttctgatgttgtcaatgtcctagtctatgtcggcatagcaaaaggaaatggcgtcctctcaaaagcaggtaaagaaaactaaagagcagccg

SEQ ID NO: 18922 - DNA, 1099 bp, Mus musculus
aataactgcaaagtgctgttaaacagatttccattctgtaggtctgactgtcctggagcccactttgtagaacaagtaggcctttaactcagagacatccagctgcctctgcctctagagtgctgggataaaaccactacacagcccagccttccttactttcttaggattcagaacagtcattaacttttttgtttgctctgaggtttattttcatttttctgtgtatagatgttttgctagctttcttgtctgtgtccctgtgtagacagtgcccaaggatgcattacagatgttgtgagctgctgttgctgctgacagtcacacccagatcctctgcaagcatagccaggatgattgaccactgggctgtctctcagtccttagccattgttttataagagtatgagagcaaaaacccaatacaagtaatgaagatttttttccagttccttaagttggtatgcacaattttattttaacctatcccagatttcaaaagaacaaggccttgaagttctgccagagcatgatccaatccgggaccaaagctggtatgtgaatagaaagctccgccagagactgcttgaggaatatggggtgagagcctgcactctgattcagttccttggtgatgccattgttttgccagcaggaacacttcaccaggtacatatttatgtgattgtaacttctctgtactgaaaagaactgatttgaggggaaaattactctgtatatagattgaaaaaatcaaagaaaatgttacttaggaaaatgcacatcaccattgcatttccattagaatggtagtatttatagtatttgaaacctaaagcagttaaacactttgagagcttaagctgttgacttaagctagattgccagtttacacattctccccactgggctaggaagaagctggccactgcacatgctcaccagctctgtagagagcatggagagcggttgggctttgaatttgtgaacattttgcttctcagtggcatgctagtataattaattctaacatttgatgaaagatagtgtacaatttatatagctatctgcccacagaacttaaaaatgtacattaata

SEQ ID NO: 18923 - DNA, 1198 bp, Mus musculus
agagagagaaagagagaagatgttgtttttaatctagcagcagctcagtgacagtaaatatgtctcttttaggttaagaatatcttgtatcatgcagtcaaggaaatggtgagagctctgaagatgcatgaagatgaagtagaggatatggaagacacctaattgcggttggaactgggatgccccttgagtgacgctaggtctgacttaagctccattaaaccatcagtgccaagaaattctctttgtagtaattacttgctactgacaccataccagtatagcattatgccacagcccctgtgattcaatgctagctataaaccaagctaaatttaaaagcagtactatatagctgttcctgtatcatagtgtatatgatgtttgtgaagatgccagatttaaaatgatgtatttatttttggtaaaaaaaaaaatctatgctatattgttgatcaagtgtaaatgtgctgttgtacagtttaataaaataactgatatttttcactacattgagacagttactgtgagactaggacacaccagctgttgcctgcgtttgggaaattgctggattgcacagcagtcacgtcataatcagaaaattactgccaaataattgtaaaatgtgtaaaatacaaagtacataaagtagatactaaactcagacacttcaatattttgttgaagctattgactgtacaattaaacgttttcaaaaggtgtaatttatttaaaattgtctcattttggtaaaatttatgtgaagttttaaagctaaatattaaacttaatatgctatgtaaatatatacatatatacatttaaggatgtatttttttaaaacattggcttgcttttgttaaagtgcaagtgttacatatggctttgtacattacagttgaaaggggttttacattttccattaaaagactttatcaagaagctggatgttacagttctccctctctggtttgacactgctgggataaagtggagcttgcagccacaggctgtgactgggagccctgcctctcattggctctgccaagtttgttcagtttcagtagctgatcactgtccctcctggatagcctttgccactgaagtctgtggttctgtgtggacacctgctggtgttgagaaggagtaacccaagttagccactttgtacttgatgtatcacttagcttcactc

SEQ ID NO: 18924 - DNA, 3543 bp, Mus musculus
gggctcttctctccgccccctcgcctggacgatggatttactggagtgaccagcgccacatcttgaggaaccttggggaacacggcccactggagtacagccaccaccgggcacggttatgggggcgggtgggcggaaggctaggttgattcctggtatcctcagtgccaccaaggctttgatttaagggaaccgggcagggaccctaaagcgcttccatcctaaagccataatgaaaccatttttgtttctcattctctacaaaatacactaagtagttttgaatccctcttcccttcggtgactcagatttgttttctctcctgcccacgattgctccttaatagtttaatttattactgattgtgcatgaccttgaattgttcttgttttcttttttttttttttttttttttttttagttattcgtttggttaaaacacacacacaaactactcagcatctaaagtgaggagttctgaaaagacatctttctagcactggggttcaccctcataactgtgcgtgttgaggacgatgtctttcctcccctggcttggtagccacttctggtgtactcaggtaacctttagtaagaaggtcacatacgcgaattctcttgtcaggcccttaaagctcgtctttcccttgggtctcaagatctgtcgtttaaacaaatttttttgttgctattggggatttgcctttaaagcaaagacgattattatcctcagctgactttttccttgacgtgcttcaaagatgatacaataattatgtgttttctaaccagacgattccgaggagcggaatctgctatgcttccaaataactgaatgtaaaggccctggccacctgttgaattccatactcgtatttacttccagcttcttcctaggaaagaagagaaagatactcttgactgtttgttgttgttgttgttgttgttgttgttggttttgttctgttttggttttttgtttttgtttttttgcgttctctgtggagggagcctgcagaggagctgtgtggttccagctgtgctgccgggagatagcctcccagcactcccttaaacaagagccagtgctgcctactactgccttctcttgcaggaagaggtagagagcatgtagtaccctgggaggggctctggaagtaggctgctggctaagcaggcaagaagccctgggctcaatcctcagtaccacataaaccaagtgtagcacacagcatttaggaaatataggcaggaggatcagaagtcaaggtcagacttggctacatagtgaatttgagcggaaccgtggatgcataagacaccatcatataaatgtgtgtgtatacataacatatgaatatgtatatatacacatatacatatgtatgtacacacacacatatgaaatggatacatggaatagatgcttgagaatttagccatttagggcaccaagattggagactaaaccctatgccaacactgcagcaaaccctagcgctgctgcagtattatggctggcggaggctcagcccctttaccatgtttacagacgtgtctatcgattctgaccatggaccaccagtttcccctgtttactatgtgtagggttcctttttatcacaggccttttcataaagacaaactgtagaaatcagatgtgcccagctgtcttctaagctctcttgatggctcatgtggcaatagaatatactaatatcggcaataaatggagacttactgtcatgagtgacaaatgtttgttgacctggcagggaaacaaactgcttttggctccatgtatccaggatacacatccaggctgaaggggtgtccttcccggtgcagtcattaaagtggtacgagacagcaaattattgctggcttggcttgtggctttttgtttgtttgtttgtttgtttcattttaataaaaatgagaacaacaggccagtggaaacctgctttaaacctgacaaaccatgagcaacacccaaacacttccaccatggctgctagagttcaagttctttctgatcatggtctttaaaatgcctttggagcctctcgaagcagctctttgagccactcgtatgaacatctagataggaagtgatggttttaaatttgactattttcatagaatattaataatgaatatggtttttcagccacatacagattttgaattgcagcaaaggttgattcctttacaaggattgttgagagtcatgtgtactttacagcatactctggaggtcctttcatggagcctgtagaagtctagcctggaattgggctagtaataacaattattatgaaggccttcattgcaaaagaaggaggagaaatattaaaggtttgttataagcagtttggaaggaaaaaaaccctaaggtgcttttcaaaagagtaacgaaattgttctgagctaaaacagcaatactgtgttcctcattagttcaataggaacagtgaaactgtcatttcactaataaactgagtaaacttacggtgaaaacagtgtaatatgttttaatgagccacttgagaaagaatatgctcgttactaagataaaatgtgcagaaaaatccttgcacgtctatgcataaactattagctataacttctgccgttgtgtttccctgtaggtctacaatatagattgtggtctagaaattaggataaaagttaccttctccttttcttagaaaagaccaatgagcacaatggtgttaagtcacttaactgttctgatgaataataaatgcaataactagatcctgagtgagacgctgtctgtctgtctgtctaaatacactgaaccttttcaaccttgtagttctatcagtgaccagttatatcgatgtaagattttcataccttcctactcctttgagaattgatgggtttactaccacatgctgctgattacattaaaaaacaacaacaacaaaaaaaaaaccctgccttttaggtaatgtgttttctatgttaataggagtgagttctcttgagtttttaacatgactgtcaaaatgtacacctttccttccccactcgatccttgcattgtcttgtaggttccttgaacttgacatctggggagaacctacctgctctgatggcaaatgagtcaactgctttagctctcctgtcctgcccagcagagagacagttacccccacttcgtcactctgccactctcctgacagcgtttgctcctctaccgcaggcctgaattcagagtgtagggttatacagaacccagattggtccattgtgctgaggtttctgctgtcaaaggagatcatttcttaacaatacccagtcttacagtgcaggggtgtttacgtttctgagtaagatgtgtgtacttatgggaaataaaagcatgtttaaaattacgtagaaataatgttgcttattgcaaagtggagaagggaaacataactattactattttaattattgttgaaaactcacagtttattccataaggttgtattgtatcaaaagccagtgacctacagatcccccaa

SEQ ID NO: 18925 - DNA, 1198 bp, Mus musculus
ggagtggacaggtgtccacagaagactctgggtcctctcctgtgtacataacactgtagtcaaacaaaacttcactaaaatgtagtccctcagattttgtaaaaaaaaaaatgtcgatatcaatatttaatagtatagctatatctcctttcttggatcataagaaacatggaagacatctaccacaagagactgacaaaggatgcctgaaggtttcacttgatgtagaagaaggacacttttaaaatacatcagaagctagaatgccaagcacctctgaggatgactgatcgttttaatgacactggtgatcatcagtgagcctgtgacttggatttgggaggagaggagaggaatgtacatggacaatttctgccaggtcttccaaagagcccattctgatttcaatccattattaaacgtaatgggtatccagggggtctggcacatgctgtcctttaagtttactgttgtgggtcagtttacaaggagtgaccgcacgggcctgtatcccttcctatgttcatgtctctaacttgggtgtggtgccagctgacattctctggaaccccactgagtactgatgggaccagaggcttgttctctgtagaacatgtcttcagacggtggcttgcccactcccatcttctctgaaaatgcctgagcagtcgattgcccttgatctgccattttccatcacatacttatataatttagcagtagttcccagaacaacatgctctgaacaggatccccgctcacattgccctctcctgtcggtccaactatgtcgggttttcatagacttctgtcatgagctgggtttttactccagactcctggaatctttcttctcagcaggttaagaagacaagttgggtataccatctctctgccttaagccctccatttgtcttccagcacaaatggacactcacacacttcaccatgcctgttttccacaatgttctcaccttaggtcatcacaccatgtcctccaatgctcgttaactctcccttgaatgctgcctatctctttgattcctttgttggaggtaaagcttgctctgacctcactttgccttgtcttcagagggcagtttaccatgtccaggggtgatgttaatcgctccttatctaggtgtggattccctttctcacctcctgaatgctatgctttgacagtaaggacttcact

SEQ ID NO: 18926 - DNA, 1099 bp, Mus musculus
ttacatttatatattacatattacatgttacatttacatatatattatacacacacacatataatatataccataggcctgtctcttccaacaaggggttattacttttatcatttgaatttccctctgtttgtaaaattatgcactatgttttaatatcttagaaattactcataaattgtttttttaagttttattattatacataagtacactgtagctgtcttcagacacaccagatgagggcatcagatctcattacagatggatgtgagccaccatgtggttgctgggatttgaactcaggaccttcagaagagcagtcagtgctcttacccactgagccatctctccaacccctactcttaaattgtaatcacctaaataaacaataagagatcatttttactttttctaagacagcatgaaagctttagaaggatagcatgtgtttccctaatctgtgcattcttgctatagaacataattctgtttgtttctgagtgtcacggggtacattgagcttgacctagcttaaccccatgctctgactgttcataggggacaacttgacttctatatcttgaacttgggatttcccccacacacactttctttttctcaaaacaatctttagagtttcttttagaaaaactttgggcagggggtgtcctgggacttttgacttcactcttgaaaggcatttttacgggatatgcttggtactttcatttctgtccatcttgtccccttggttcagaaggaatgattaagtactttgagatgtgttgggtacagggttgagagtggccatgaaacatggacagagtgactggggcagtgagactgccctggggatgtgagcagagagggagctggcaggtgccaggtgcatggacgataccatacatggaccgtgggcataggaaccctgcctaaggcaggtggtgttttataagtgtagagattgatactcaggttaattgagtctcctagacgtcctctttcttgagggaagcacagagaagctgtggttgttttattcctcagtagtctgagactgtaagaaagcccaggtaagaggtggcaggtggaggca

SEQ ID NO: 18927 - DNA, 1150 bp, Mus musculus
aaacttgaagaataggtggccgtggttttgtttttgttttaatctaacagggtctcaaaagttttggtggtaattgccatttctttctttttaatacttactttatgtatttaagtacaccatagctgtcttcagacacaccagaagagggcatcagatcccattacagatggtcatgagccaccatgtggttgttgggaactgaactcagcacctctggaagagcaagtcctgagccatctctccagccccagtaaagttgtattttttgcttgaaaatgcctctgttagccctcaccgatatcttcaacaatgcccatgaacttttgatgcaacctctttttttttttttttttttttaattaaaagatgctgctggcaaaattgcttctgattcctggcacccaagtgcccccgtccctccccgctgtgcccctcacttactgtgttcctctattgcaggccgggatttaaattcaccagccacttctgatttcgtgtgcaagttgccgctggaagaatttagggtgtgtgtgtgtgtgtgtgtgtgtgtgtgtgtgtgtgtgtgtatgtatgtatgtgttcctggagacactctggaggagttgtgttctcagagggcagctttgcaccaggtctgaaaccagcctccttcccagagcctcatggtgagtgaagctctgcccaacccccaccagttcctggaggttcctctctgtatcactctgctcatcaaatgctaggtcacgcccaccccgcacaacaaaagaagttaggacaggcttgtccttctctctcttactcccctccttctaaccctttccaccttccttccctcttgtctcacgttccttcacaacttaaaaatatccggagatactgacttaaaagcttccaaggaatttttaagaagttttccctcatttgctgaactagaacgcagagcggagggatgcgtgataggaaaggtgaggcagctttgtgtgagcaggtcgtcctccagtgtccttccgaatcatttcttcgctaacagatcttgataacatttaaaattggagaaacttaatagaaaaaaatcccagatatttcatattaaggtgctttccatgacggagagataacgtctctggcagttgcacttacacctcta

SEQ ID NO: 18928 - DNA, 3732 bp, Mus musculus
atcaaactcaccaagttcaatcaatgcaatgtatagtaaaacttaaagagacctttcattctgacactattaaacaatccagagaaggaaacactgttaaactgtatatattcgcttcttaaagctacccgtatcactgttggctcacctaatttatatacaggtagttgtgtttccctcccggttccttcttgttcctgccctagggttttttttgttttgtttttgtttttttttgttttttttggtttgtgtatctgtttgtttgtttgtttgttttttaattaaacagcatcccttctgtttgtaggtcttttgatttgttttgttctgtttgtaaggctgactgattcttctagttgtcaatgtgtattctatcaaccccaccccaggccccgtccccgtccccaccacatcttcttttgagcagctttgggtggtcaagttattgtttacaaattgaagcaactgattttagtggaacagactgtaaagaaccccccccccccccggagaacacaagctagcttaaagcctgtgcctttgtgggtctgcgcctggaggatgctgcccctcttaagtgggatggctatctgaaagagtttagatactgcttcccccggccaaatgctttgctttgaagtattggattatgtgaaaatgttaagcattgcactcaccttatctaggctgtgaacccgtcctacataccagagaattcagaaaacaaaaaacttgttggtgaaaagccactgagtggaccccacttcatgggctgaggagaggtttcaggaatttcaaaacttaggacaagagccagggtaactcatgccagtgctggaacagcacctttcaaatggtctgcagaaaggggacttgggaaagggtagtgtgtaactcccaaggtctgaccactgggctacccagccaggccttggcccatcaagggacagagtgattgccatcatcagatggcttcttgggtttcctagtaagattctcccaaggagacatctttgaggaataattggatgacctgtttgtgaaagaaagccatcttcttgggtgtctagggcctgggtttgatgagtatttgtccccgtaaagtggtttgtatcaagtttttcaccacgtggccatgctatctgctttggaggtcttttgactggcactctttgccaacgattccatttgctcccaaagcacaaaatttgctccgtgtagcacgtgcatccttagaatggattctcgttcccatccgcacccaaccctgatgaaagcttctttgatgaagtccgcagccctctgccctcttctccactaacgccagtagactataggaccatagttaactctctctctcttttttttacctctgacatatttaagtctatgaaacttgatgacggttttcaacatctctgaataggtaactgaactacaaaaataatcaaaaccagtgaccgtgaatctacggctcttaacgcaaagccatgcatgccattcgttcttattgaaatgtcctcatgatatgaagccaaatagtccatgtagtaacatgctatccaaaggtggaaacaaaagaatgtagcgacccagtgttaagagttccattcgcttcaattaattatttaccttcctgtggaataatatatataaatatatattatatatttaataggaccatagatagattagtataacttagctcataaatgtgcacatgcagaatattctgctgttgttgcacaagaaaaagggtgtgtgtgttgggggtgggtctcaattccagccagcatgatactggccaggacacagtatgaaaaagtgacgctagattgaatagccacagaatcagaagaggagaaaaggaaccagggattctgtagcagacatgggctggatccatacacggtccctgtgagttcatttctcaatgcaaaacggcgatgtctgtccccacacaaaaaaacccaccaccaccacaagctcacccatttgtaagatggggcgactgatttcctcagtgcggtgatttgtgatgtgttcgccaagtaggaattcaatcacgccattttcaaacaatgtcaacatatccagctattttttttttctcatctcttctgagaggagactcactatttctgttgtagggagctcggaccctccgtgaaacatcaggaccaatgcaaagacctgggggccggggagggggggttactctcccagtagaagtagtgtgttatttgttttcaaactccaaacggagatcttggagatctttcaaaaagaccattgaatttctcattggctgagaaggacattttttaaaagtcttaaatctggctttgtttgcattgtttgagttcaaggggccttattattgaatggcattgcacaagcctttcttttttgcaagcaaaccattgttattagttgttctgtaaaggaaattgtggaatccaattggcactggagtcctaaatccatttaccaagtgtggcttccgagaaatgttgtaattcaaaatgtatcaagcccgtgaatttgttggggatttggagattctaaataatatttaaaaagatgtcatctctaggcaacttcgggggtctcacttttggaaattcaacttaaaaataaagtagaaagtaaaaataaaaataccacaacagcccaaccaagtgttaagcttaaagtatttttttcttagtaactgattcaaacatgtagcgtttgccacaggtcagactggttcatttcctagctagaagctcccggctttacttgttcaacaggacatcgacagaagggtttgtctcagtgttgagctcacacagctttgccctctggtgcatgactccttgggtcctgtatttcactgtgtcggtgtgtctgatggaagtttcaaggtggtcccacgaaatatattttatgtagtgtgccttcaaagagaaccatttatctctcttctcgtgttgtcccactaagtcacatttggtggtggccagccaagtcccgtgtggtctagtctgacttattatcccgggctgagaaaggaacgggaatggttttgccccagtgagacccacaccgctggagcagggactttgagcatctccgctccggtgttgactgttgatgtatttgatattctgcttatctcccaatggcggaaagaactctgaaaaaaaaatagcagcgtaatctcttggctgtttatacttttttaaacttccctgtgttgtaaatattgtacactctgagtaaccccagctatgtaaccttgatgctctgtaaggtgatatttgtatatagcaacctggcccagtgatgttatataatttcccaatggagaggttattgagtagccttggcctctagttttaaacactaccagaagaatgctgagccaactataaacactcaatttttgtatgttttccaaattgtacttattaccgcttttgatactgtattctgtctgtgccaatggtttcccaatcacatagcaggcaagagatattttgtactttttgatccactgtaatatttaataaaaaatgttactatctgtttcctttgggagtgtctgtctcttattcctggggagctttgtggccagagcaaaggacttccagtctctgctttccaaattggagatggtaatgttgataatgagcgtagcttattggggacctactagaagcttccttcgcctatgaatggtta

SEQ ID NO: 18929 - DNA, 1285 bp, Mus musculus
catcggatcccattacagatggttgtgagccaccatgtggttgctgggagttgaactcaggacttctggaagagtagtcatcgctcttaattgctgagccatctctccacctccttaatctattttctctgaagataatatgcatgatcagatttaagatctggagtatttaaattagtttacaataattagtccatctattataactgtgtttataaaaatgctatggggtttttcctttgttggcttgacgaaggggttgtgtggacactatcatgaaacactataactgattgctactttttcagttgtgaataacagatggacatttaatttctagggtagatataattagctagataatgtgaagatttatgttttggttttaagctgtctgggtgcttatcttataatttataacaggttaccaaggtgtctgtgtgtgatttaagtatcttggagaggtaaatagagggcaggcttctaaatttatttccctttttctctctagaaaatgctagtctatgatcctgccaaacgaatctctggcaaaatggccctgaagcacccgtactttgatgacttggacaatcagattaagaagatgtagccctctggatggatgtccctgtctgctggtcgtaggggaagatcgtgttgtttaccgttggctctcttcctgtcttgtatagttttctttgtttgtaaactgtcatctggacttttcttaatttcctacgtataacttaattaacatgtaaatattattccatatgaatttaaatataattctgtatatgtgcagatgtcactgtggtggctgttaattactataacacaagtgttaattactacaacataagacttgagtctccctagacttcccagcagccattcctgcagctcggagcacagttgaaggagctgagctcaggcctcgtgatgctttcaagtgcctccgtgttctggatatatatgattcctggtcagtttcttgccatttggaaactacaacccacctacggacagtgtttttctacttgtgcttaagcagttgggatgagaaggccaaagacccgaggatgtctagagtaatgacccccagatggaagtgcaccaaagctggctgggtttcacagctagagatcaggggctgtccagagcaggacagcttagaacatttatgaagactccctatttttaggtttgttgtaaagctgttgtctagttggattcctgtgctctgcatggtcagaggtaggttagaggatttgccttggcttct

SEQ ID NO: 18930 - DNA, 1177 bp, Mus musculus
tttttcacagtttatgatatgactcgtctttaatggctgtaactgctgctgacctcattgcattgttcattgaggtcattcactattttgataaataaactgtagttctaaatcactaatcatttgaatcccctcctaccgctttggcttagatttcttttcatttttcttttttttctttttttttggtttttttgagacagggtttctctgtgtagctctggctgtcctggaactcactttgtagaccaggctggcctcaaactctgcctccagagtgctggtattaaagttgtatgccagccaggtatatgccacccaggtatatgccagccaggatatggctgctttggtcctttgactttagagatctgaaaagcaagaggtctatggtacttacccactaatgagcagaaatcagaaataaaataggttcaacttagtaatttgcatatagctaattgtctgaagttcttggtgacacctgcacagcttcctaaaagacaaccgtgtgtggtctgtcctgtgccaggtagtgacgctgtggtaccgatctccagaagtgttgctgggctcggctcgttactccactccggttgacatctggagtatagggaccatatttgcagaactggccaccaagaagccgcttttccacggcgactcagagattgaccagctcttcaggatcttcaggtaattgtgttttatacctaagctgttaaaagcctgtatggttaaaataataaaggcaccgtgtatgtgataggacttttgcttcctttcagagctctgggcactcctaacaacgaagtgtggccagaagtcgagtccctgcaggactacaagaacacctttcccaagtggaagccggggagcctcgcatcccacgtcaagaacctggacgagaacggcttggatttgctctcagtaagtgagctgttctttatggttcgagcgtggtgcccttgggtgtcagtagtgacaggtaagggtgactggatgtactcagtcctggacttgtcagcacgaagacacagcagctgagtcggatgcccggtaatcctgtagtgacagcgagctgcctttgaggtgtgaagtgcctggtggtctgaggagcctctggtgttggactttgtcatttacttctcatccggtaggagaggctggactcaca

SEQ ID NO: 18931 - DNA, 1243 bp, Mus musculus
cctcgccagtgacatccactgccactcaccggtccagttgggccattccccctttttgatgaccttagataggactttctgaagccatcccctcctgggctcactctttaacttgttctagagcagtggttctcagccttcctaacaccacaaccctttaatacagttcctcctgtcgtggttactccccagccattaaattagttttgttgcttcttcataacaattttactactcttatgagtcataacataagtatctgatatgcagaatatctgataatgtgtgcctctccaaagagctatcgacccacaggttgagaaccaatgttgtagttgaaggatttattcattttcttccaggcagcctcggtattcccagtttgctctgggcctcgggcacctctcacagcttttcagctgtgacctttgacctgcttttctgaattctctggcctagaggcttgtctgctacattgtgcctggctgttctggattctctggggggggatcctgaatagcggcttgttgaaataatttgaaaattacatactgctgtcgacgttttcttctgccaattccaagtactcagtgaaacctgcgaatatgtgtttgtcccgtgttagcattttcttacgtagtcacctgtgtattgttggtcgccatgcccagcaggacagagaagactgtctcgtcttcaggttacacagctgcctggctccatgtggttggtggggccttccttggcattcagtaagcacgctagaaacatttgtttttgatgaggtttaatggcttttaccaggcagtgttatcaagactttacccaggataactgggatcttactcttgctttcacttgtatgacatttgctaaaattcagagtgtgtgtgtgtgtatgtatgtatgtatgtatgtgtatgtttgtgcgcgctcattcacacaggtgtgcatagcccatggaggccagaagtgttacctcctctggcattgcatttacaggaggctgagccctggtgtgggtcctggtcctctgcaaggacagtgtggtctaaaccccgagcctccccagccttacctgatactttcccctcctcaattattacttaaaatacttcaggatctaaaacaaatgtttaatttcagaacatctactgtttagcttatgaatagtgccctgttgcagttaactgagaagagccaggagttgagatactcagaacaagcagttctgtgttgtctc

SEQ ID NO: 18932 - DNA, 1234 bp, Mus musculus
cctgactcagtttgaccctgaaacccacgtaatggaaggcaagaactgactcgaacggttgtcctctgacctccacaggtgccctttggcacgtgcacactaacacacacaagccaataactaaataaagccgttcccttccctcactttaaggacagtattggtgacatattaggcctcattgtgcaggctgtgtccattcaaacaagatgccatcatcatcatgggtggtaaagtgggggggggggggcgtgactcacctgatagataagcttcatcgcttaatgcactgaacctgggaggcagggagtgggtaggggtcatgcttacatcgatcatcaacactaattgagcttgcttctttggtcagcccctgcaatggggaactaacctctccctccactgtttctttcttctgtatggcagttaaaaaaataaaataaaataaaacctacaggggtgcctgggaaggagattacaccatgagagtctcttttctccctgatggccacatagtcaagagggagggcttctgactggcttgttctccacctgcaggtgaagatgccatcacaggggacactgacaagtatctcgggccacaggaccttaaggagctaggtgatgactccctgccagcagaaggttacgtaggcttcagtcttggagcccgttctgccaggtactgtattatcgctgggggattttcttttttttttttttttcttattcggtgtttgcttacaacaaccatgatctgtcatgagccagcatcattcccatctccctcacggctccagaatgcactctttggatgccatgtgaatcctgtggcatgttcttgatgtgaacacacacttgtgcatgtgcacacaagcacacacactggtttgtttgttttttgttttttttttcctcatcatttgcagtgtgtagtctctctcgtgtgctagaacaggtcaatctttgctcttcccatctccctctttgcagttggcttccagcagagtaccacatgagctccccgataaatgggcaaaaaccaacccgagtctcatgtttcaaaagtagcttgctctgtattggaagacctttcttgttacgctgtgtaagaaatttgcatacggaccatttgctgtattggttggtgaagaattaaattcgtggttcccttgatgataaaaacaaactgtaaactgtcttccatgcattggcaatttaggttgtgccatca

SEQ ID NO: 18933 - DNA, 1126 bp, Mus musculus
gtcgagttcaagggcagccaaagttatacagagaaaccctgtttgggggtggagggtggaggtctccacatctaagttaaattggaattccatacacctttttatgtaagcatagacacaattaggagtccaatcacacaggctttctagaagttaaatgcttattaagtacgctgtttacatgtgtgtggactcttgctcttgtttttctggatttcacattagtgcctttttgatacagatatgatcagaaagctaatctggggtgaggacacagctttgggaagttgtatcttcagggcctctcctctctgtcctttcagtctctgggtcaaagtgacagagagtaggaattctagtctcattttctcacctgtcctccctgccaccaaaaactccctgatcctccattacagggataaggggttgagaaataacctcattttaggtacctacggcttaggttttatttcattgttttgaaacgtgacctgcgggagcccaggctggacttcggcttcctttgtgcctgaggatgtccccgaactcttgatccacttgcccttcccccgtgctagcattccaggtcagtaccacaccatgcacagttatgcagtctcgaggatcaaatgcagtcttggagaccaaaccgggggcttcatgaatctttaccgtctgagctgcatctccaccctcccaggaagatccttagttatccctgacagataacctttcctttgcatcctgtgaggcttgctttccgtagaaacagcaatcgcaggatgcctgctgcactagactcatgtttgtgttcaccacagatgccctggaaacagaatttaccatgtggactccagagtctttctttgtggctaattctcttggattggcacccttagtgtccccggctaacttaagcagcgggtcctaaaaggttaagaaaattacccacagtctcataaaagcagcagaactaggaaataagtcctaactgactccctcccgaatgctcctcctcagactcactgcagacctgacctggcgggtcgccccaagtcaacaggaagcaaatagagaaagaccatcatctcggtctccgaggttggggtggatgggttcagtcact

SEQ ID NO: 18934 - DNA, 1122 bp, Mus musculus
cccggcgctgcagtactgcccgagtccgggcggggtctctgttccctggcggagcagctcgcgcggccgcgggaagcgccctctctttctccgccgccgccgccgcgcgtctgcgccctgccgcccgcccgcgccgcgctctgagctcccccgctccccagctcccccgccgccgccgcgcgcccggccccgcgcccactcgccgcgcgcccactcgccgcgcgcccggccctcggcgcccggctccccgcgcccactcgcccagccatggcggacagcgcgagcgagagcgacacggacgcggcgggcggcggcccggcagccatgcagtcgtcctgctcggcgacctcgggcggcagcggcgggggcggcggcgggaagtcggggggcattgtcatctcgccgttccgcctggaggagctcaccaaccgcctggcctcgctgcagcaggagaacaaggtgctcaagatagagctggagacctacaaactcaagtgcaaggcgctgcaggaggagaaccgcgacctgcgcaaagccagcgtgaccatcgtgagtgcaccccgcggaccaggggggacccccgagtgcgcgcccccgtgcggggttgcgggcctgcgggcacagagagcgggccttggggccacgagcgccctccctcccttgaggtgttggaggtgcctagggagactccccaacgtcccctcgtcgcctagggtggaggtccctccgagccagggctagaggctggcggcgtggctggggggggggcggggtgggactttctcaaccctagggtgcctgaaggctccgaatagagggacaccctctccggagcccccgtgagtggacgaagctggggtctgtccaggggttagttggggagacggggtgtgccactgggctgggtccccagttggcaggaggacggcgctttgctggatcgccggcgctgggggagggagagagtggcccggaatccgggaagtggagttttctggccaggatggaaagggaagggcgggcactgaggctacaccagcaccccgttcggaatcactgtccttttgggcccggagggtgggcgggtacagagtagtggggagtgtaacgtctggcgctggc

SEQ ID NO: 18935 - DNA, 1145 bp, Mus musculus
ccaacaacaataataaacaataatatataacataagataaagacaaacacactggaataggacaaagcaaaccaaagaaaaagtacaagaaacacatagagacatacacctttgcacatacagaaattccataaaaacacaacactagaaaccatactacatatgcagatggcctgtatgggacaaaaagaaggaggaggaaaaaagaaaccttaaagtgttatgtgacaagaaacctccaaagttgccactaagttcattttgcatttggccatctgctgctgggcatgggtgtctgtccataagagtggcttctacacctcgtgagccaccactgtagagaactaagttgtcttctgtgagtggttatcacttggagagagcttttgggttagccatggggggttgtgtgtccacttcccctcttagtgctgagatcctgtccgacttagatctgtgcatagactgtgtgtgctcccatagtgtgtgtgtgtgtgtgtgtgtgtgtgtgtgtgtgtgtgtgtgtgtgtgtgtgtgttcttaacgtgcatctctcggtcctgctgtttccctggtgtcctccatcccctctggctcttaaaatccttctgcctcctcttcttcagggttccctgagctctgaagggagtgatttgatggagacatcccttttagaaccgcatggtccaaggtctctcactttctgcacattgtccagttgtaggtctctgtatttatttaacctactgcaggagggagcttctctgatgatgggtgagcaaggcagtgccctatgagaatgtcagaatgccaacaggaatcattttgttgctacattgctttagtatttggatttccacaggaccctggcctatcgatactgtcttaggttcttgggtgcctgagcagtattggagataagctccctctcatggagggggccttaagtccaatcagacagtggttggttgctccacgagctctgtgccaccattgcaccccccgtgtcttgtaggcaggtcactgttgtaggtggaaggcttcgtagctgggctgctgtttatggttctcctgatggcctgccgtgagcactggtccataggggtgaagtctgtctgtaggcatcggctcagcttctctgttgt

SEQ ID NO: 18936 - DNA, 4767 bp, Mus musculus
tggtagggataatgtgacatcactatcatcatcattggctgtgaaggatgcattttcattttgtgttccgtcctcacaggcttgggtgtgaacacaacctcctttcccctgctagttcaggaaccaccgatgacagagaaggagcccatggctctctttcccgactcggggtgggttccgccctctgattcatgccttgtcagaactgaccccgtgtccccatcttccccgcagaggccatcgccacggagaagcagcagccctgacaagtttaaacggcccacgccgcctccgtctcccaacacacagagcccggtccaaccgcctccgccgccgccaccacctcccatgcagcccgcggtcccctcggcagcccccacgcaacccgcccccacgcagcctcagcatccggtgcacccctcctcccagccttaatgcatgagcttagtcagaatctccagttgggactcgtctgatggagccaccttctcaacgccaaaggcttctcctctcccggcgtacttggatctgacgcgtttgcattgaggttacctatctacctttccctcctcgtcgtgtcgtgaatgttcgtcggaaacgcagccgaggttgcgggtccgcaacactaaccagacgactttctccaccagtgttttacttgaatctccgcgtctgtcattccctggctggaacgtcgctgtctggtatctggtaatgagcagcggtgtgcaaaccctaccccaccccctccaacccttcccccccaggggggccccagggctgctttttttcttggcttttaggtttgtaaaataagaagggagatcttttttataacacttctctgtggatttgcaggaaaattaccgagctgtttagaaaccttccttctccaggtcagtgacgtttaccgaacataaccaagaattcagcactacagttcagaccttttgcagacctaactcactgtaggattggaagttagatgaaccagtgcccacaacatgtagtctagagctttctacagacacacctttttacagattgttttctgatgtaaattgaccaccatgtcctttgtaaaacagcctatagaaacaaatcacacagccgtatctcccccacgtgcgtgggacgggaactattgcctattaagatgtgatttttattttcctttctcaatgttaatccacctaagccggcgccctctagcgtgagaggagagacgctttcccaccaagggtctcgatggctgactggaatgtaggcttagatccctgctgcgggtgggccgtgagattgtaacagccaatgcggctaaacccatccattcttttgtgttgtcctgagacagagggtgcaaacaggtactttccaggtgcaaaatgctgttaggaaataatgtctgaggggtaggcgacagacaccctagcatgatggcgcttggcagatcatagcatagcaagcagtgctctctggccttgacgggcgctcacttagccaggagagcaccaagaaggttctgaactcaatccgccattccttcagcacaaatccttctgtttggccgggggtgggtgtgggtggggacaccaagtggctcttttgtagaccttcgtctctgtctgtccgaggttactttgtgctttagtagtcaagtgcttcccctgcccgtgtttgcatatttatatatgccgtggatggaaataacttactagagaatgtatattttatgatgagaagcgtgactctgttagctgtaatcagagaactgaaaaattaatttatcagtaatttttaagagttcatgtttgtgacaaaccatctcttaacagcacgtcctcatggaacacactcccgaggacaaggaacataccttggtgatattgtagataattaatattgtacagtctagaaacctccattttttgccttcgaatgcatatttaagagttaacagaatggaaaagtgttatcagataatagtgtttgacagcgttttaagaacttgagagtaagaacaaccataggacctttcactcttctttctcgtccacccctaaactgagaatgctgtatctccagcgaccgggaagaaactgtcagcctataaaagttttattttcaaggtgtgtgatgtataggccatagtgtggttagcagacatgggatggagtctgatatctcctgtcaaggcattaggttttttcagtgtctgactaaaccccgggcattttccaccagctccccaaccctcttggtacatgaccattccagggaaattctgaggatagacagaggaattcttccttcatggtacagtcttgattttttttttttttttttttttgtcctttcgagagaagtacggtatgtgtttacaaaatcttttctgggattgtagatttcagtactgctggctagcagctttatcctccagcacacaggtccgttctggaaagttcttccctccactgtctttatcagttaagttacctcctagaagcacaagtgtaaaagcaccggcgtatggcgagcggagcctttgagacgtaggttcttgacattgatgcataaagtgtacctgggattcctgtagacccatcagttcacctcaaacccagctcttcccacaagcgctttgcagtccgagtcagtccccggtccctgcaggggttaagaaccaagagaacaaacactagaggatctgaatgtagggtgtattgtgtcacttttgaagcacatagtgataggtaagagaaccagatgttgagcccctagggacggtagccccttgactgtgggctgggcgtggcttctacaggttcagtcagtagccaccctcagcagttgagagcaacagtaccttcagtggcttcatttcctgtcttgttgacagagaccctcgggtaccactgtgctgctaatagggccagggctctgctccccgacgaccttgcctttgtacagaaccaagtccacgcacccagcaccccaccagcacctctgggctctaaactgctttctctcatcaagcatgctggcattcaagacagatttctcgacctttggcagacatggaagtgttttaagattttatttaaatgtctttgttgacccagaaggacttttagattctgagatcctaaggacccccccgccccccatgaccatggggtgaccggaatgtggctttgatggctcaggctgctgtgccttttatcattggcttctgattcaaaccagaaataattgataatgtgaatttgtgttgatccttcagttgtaggaaaactgtatatctatcccccgttgttaagtagacatgagcctgtcccctgcttgtagagattgaccaggaaaacgggaggaagcatggccgttgcgtgtttcagaaagtttattgtttaaaatacagaaggaagttttctttgtgacttgatcttctgtctagtacttgtctaatcagttaacccacgctgagagcttgtagcgatgcctaccaaagacatgcatagtaaacctcctgtttccaaattattaaagagccagccattgatgctgctcctggttctttctgggagccattgtgagagactaaaagattcttagggtgtttgtttgtttgtttgttcgttcgtttgtttaagttttaatttctctctttctaaatttttgattacaaatgtgttagcctaatgtgttggggagcatttcccagaatgctcagcagttgtgattactggtcacacccaggtcacctcttctggagtgatcaacgggatcctctgtgcgtgctagcatgggtgctgtgtgtgtgcacgtgtgcgtgtgtgcattcatgccttaacttgggttactgctcagctttgccgtctgacttggtcctcaccagcatcagattgtattgtgcatcctgatctgaacttcattctggtaaaaaaaaacaacaacaacaacaaaaccacaaggttgcaggtagcacaggctggaacgcattcctttggaagaacgtctgctcagatggaccctgagatgtctccacggactttatttgggactttgtttggaaagaaagccgactgtaacttgggcagatgtcgacaaggaagaggggagagccagatgccaccatgccctctgcctctgcatatccgtgtgctctgtgtgttgtgtaggctcatctacagcttacctggcttggagttcaggtaatggtggccatcctgacattctctgttggagtttagagagatgtaagacgtccagttaatgtcttatttactttatgttgatcagtctttaatacatgtgctgaatcagaaaaacctaaataaagataattttttaaaatgtactcctggaactgtcaaatttgtttcgtcctttctgttctttgagttgggaatgatggttggttagtgttggcaccaacagacaaaaccagattctattacaaactcttaacggcatccggaggaagtacttgtaggtagcatcagtagggccagtgtgggtttctattttttcctttttctaatttttttaaaatatacttaggagaaaaaagctacacgtatggatgttttttgcctgcatgtatgtctatgcaccacacgtgcatgcggtagccagaagagggcattgggtctctcacacctgcaattacacgtggttgtgagttatcatgtggatgctgggaattgaacccgggtccactggctacccaccctgatgttgaacttgtaattgaactgtgttttcaaa

SEQ ID NO: 18937 - DNA, 3412 bp, Mus musculus
cacggcttggctcatagtgtcagcccagcagcagtgatggtggcattcaggactgccttcatggctagcaccagcatggccttacactcggtgtaaataaacatggcttgtcccacctgtccctcactcctctctcccaagtcctgaaactaacagcccatcagtccttggagaatactttctgtcaaccttgtctcacctaacatataaaaatgatttctgtattcccctgggtgcatggagaatgacactaatcatgtccctgtagattccattccagagatggattgctgttttctaagtaaagcattgtcatgttctttctcaggcatatattcagcttgctaaagatgataggattcgttacgacaatgaaatgaagtcttgggaagagcagatggctgaagttggacgaagtgatctcatccgtcgaagtgtgaaacgatccggagacatctctgagcattaagatggaagacggagttgtcattgggattaggcccaagaaaccagttaggtctcaaagccttaaagtgtcaaactagaacggataaaggtggttaacctttgacattcagatcatttttctgtagccatggactttctgttaatactttgagccttgacagaagatgatgctgagttctgccttttgcttaagaactggaacggagactgtccatgcatctgcatgcagtggtgaatcattctgcatttgatgggctagatagactgtgaagtgactttcacactggtgacagttgtgtggtggttttgtgatgtttttacactgatgaccgttacatatgggtgtggcccttgggtcccaggccggacctgctctcccagctgtggcagagctgtggataactgcattttcaaagaagctgccaggctttcctagatgaaatgattcctagacataaatcatgtgtaagttgatgtttgtatataataagcgattgctgatgtcctgatagcattttatagtagtaacagagagatttacacatctttctcaaattaagaaattatgtaccaagtctatgcataggtttttcttgcatagaataaaaactctaattttccaaacatgtttctgaaattatgtattttaagatgaaccatttggttaacagattttttttttttcaattttaggtagggactttagaaattacttttcatttgagagtattcatagagcttgtgtggtataaatttttaaatgagaaaatgtgaaaaacaagtctgcaaagtcagaaatctgaaagcttatccatgacagctaaaggcctatgcaggagaaagccaactgtggtgagccagccaggtccagctcactaactgctcttcagggcctactcatcaagaaatggatttatgttctaaataggtttttaaaaaggaaagtatcagtgtgaaaattaatatgatctttagtgtttgtgaatagaatttcttggaacacagccacatgctttcttgggtttgttgtgtgtgggtgctctgtgctccagagactacactgggaaaccacagcatacagggatggcccttcgcagacagtttgccaccatggtgtctcacggccactggccatgcaaggcttttcctcagatgtccttgatgtttctgtgatattgtcaccctatcttggggtcatcactgggtccctataagcctaactgttctctgtgttagcaaggaaaatattctttaacctggaatcctggtgtagcacagtacagaagaccactgtgtggagcgagaccctcctaatctttactgttgcacaggaaaaagtgtcttccccactttgagctggcaaatcccataagcccttagagaactcatggcttcaaccaccacaccactgagcagatctctgagacacaggacaacagagttcatactcatgtatgttttgtattgaggaggcttagagattgtacattttgggaaagtaagtttgcagtcactgaacttgacaaggtaggaacagaagaacgcatggaggagagatgtaagagttatatatgtaaaacagggtatttgagctgggtagaaaacttgcctagaatgtacaaggccttggatccaaatcccagaactgcaactctccccagaagagataatcagaattttagagatgaatttaagaaaatataatttttcccgtggattggaattctgggttgttggatggcatgggtttaagccatagtttgaaggtggtggaaggaggccagtgtgaaccagtgcagtctgtctttccaaagtgcaaatccaggagagacgtgagctctacacgcccctggtttctggaaaggaactaactccaagctgtccttagaatggagaaaatggtgactcagagaattgaccatgtgcttcagagcaactcaggagcagcaggcactacagcgatacagggatgcccggacctctaagatgtaactacttagctcctagctttccaggcaccctgcagagtgttcaaggactcggagctcagtctgggaagggaatgggaaaggtagaggcctgggcggaagccttctcatggtacttggttcagtttggttttccttgtttgtaaaacaagcttactgataacattgtaatctgctttccatgtcctgttttctaacgacagagtctcttttaagcaaaagcagttgccagaggatcggggaggtgttgggaggagctgaaggcatgcggtgaagctgcacaagctgacaagggctcagtgctgtttctacttattgtcatgtaactgcaattgggctgccctgttttccagtatccttaaaaacaacaaaccctagttggtctaagtgtgaacctctgaatttaaagctggtgttagcatacggatgtacagtagctagaaagccttcctgggttcacccgcacgcactggaccaccagggggcgctgaaaccacagctttaatgcagacggagccatagtgcccatcagttctgtttggccatattataagaattttcttcctctgatagcaaccctcctttctcccaggttttgtttatttgtttttgtttgtttgtttgtttgtttgtttgtttttcgagacagggtttctctgcgttgccctgcctgtcctgtaactcactttgtagaccagctggctgtagactcggagacctacctcagattaagtgctgagattaagagcttgcctcaccaccaccatcaggcttcctccctcctcttccgaatttgccaccagcctgtcactgacaagtttgcaaatgctaaaacagtgcctgtatgttttgaagtgtaaagaacatatttctttttttgtaattgagcttaagagataaaatgaatgtattactcatttgtaaaacttcctaagcaaaaggtaaaattatgcaca

SEQ ID NO: 18938 - DNA, 1561 bp, Mus musculus
gttcgggtttttaaaatgtcttttttttttttaaagaaaaacatgatttagatatatttttatgtagattgatcaagaatttaagaacttaaaagtcgtctgtttttgcttttatgtttgcatgcatttgtgctacccaccccacccccacccccacccctgcaccccattgccggacaacccaaatggcaggtgtatgcgtgatggtccccatgaagaggcagaagacacaattctgagcagaattgcagaggtctctgcaggttaaatgtctgtgtttctaatctctctctttttgtatgtctacagatacaacaggcacgcaagagaatggactcagaaatatgcaatgtaaagtttcaaacactttcacttacgccagagtactgtaaaatctatgtcttttccagcgttagcattaagccgggcgccgtttgccgtgtccttcgttccacgagccctttggtttttactcattttaagtgtgtttctgaagcaagacaaaacaaacttccaagaataccctggaaactctgctgagagcatttagtattctgtgctcattgaagaggacctttctttcggtttccgagacacttggaccccctgcatctccagcaagatctgtgacgtgactgagaaagcaaccagacgcttttctttctctgaaacgagacgtttttcacccgagaaacattgtatgtgccgtccaagatgtcgtcacttttatacatctggattcagatctcattcttcgttagctcactttataatttgtatttttttactgtatagactaaatatattctatgtcaactcctgactcctcctccccacccccatcccccgtgaacagtattgaagctcccaacagctgatgatgaattaactgcccccgccccttgtcttagcatattctgtgggttgaatgcgtatttcttaaaccggaactgatctgcacactgtatttctcagtatactgattagaatggagaaacacttgtttgggttttattgtacttgacttaactttattgcaatgtgaattaattgcactgttaggtaggaaggtgtgtgacttttttttgttgttgctcttcacctttgacctttttttttttctgtataggcaatattatattgacaccttttacagatctgactgtagccttttccatataaataaaatgctttttctactattcgtcttgactacttaatgcaaaaaaatcaaaactgcttgatctattcttcaggattgaaactccaaataacttggcatgaaaactgtctggaagatgtgggctcatttttgttgttttgttttgttttccattaaaaagaaatgttttcacttatttagttggtggtgaagatcagaggacaacttgtaggagccagtagtctctttccaccagctggttccttgagatccaactcagggctcgtcagccttggcagcaagcaacccctgaccacctcacctctgaccttggcgtttctcctaagcactaattgcctttcatatagatgtcacagcagcaggtcagcatcctcttta

SEQ ID NO: 18939 - DNA, 1122 bp, Mus musculus
ttaactcaaatgcatagagaggacctgtgtcaggagacactttgttctgacatctctctgttgaaagggctctagtctgccaggtgaggacatcgccgcgtggactataagctcataaaatgtttatttatagacaaaccaaatgtagctcctatatcccttgagaggcaacaccaaattagggggcggcgagatgcagaccagtaagggtcattgactcatttggggttttgaggtagaagtgttttaccctgtcaattaattgctggtgaagccaggggaggttaaaataacgctctcctgtgcttggtcctggataatttaaatttgcagccataaatcagtccctgtgcctggccgtgtgctgtctgccagctgcatgcagccatcacaggctatatattgtctcacaggcaggttcagaccttctgcctgttacagctagacaaccacaacagcatttttcagtgtgcccagcatcagttctgcacaaatatttactgcacagcatcatattaagccttagggaaaataaggccactctggcttgcccttcccctctgctgatgctgatgttggagccaagagatggacacaggctccttctctccagtcccggctctccttccctgtatttgtttgctttctttgaattaggcgggcctcgtcgacttttagatgttaagtccctagaggcaggggctgtgtcctggttggtttgggggagaacacttggcatattgtgggggtgtgttataaacacgccatctgtgcccatttaaattcagtagaggcctcccaatgcttctctttgtatcttgctgattatagaagtctgctctggaatagacatgcttagcctcagaaggctctagaaatcccttaagttcactttttttttttcagccttgcaaggttttttgttctttgttgttggtttcttggctggttgatttagttggttgggtttttttgtttgctttggtttggtttttgttgttattggtttggttcttgtcaagctataaggacactggcttgtaacctattaatagcttgtactctgaaacttagataccccctactgtacatccatcacaagaacttagaaaattgcttctt

SEQ ID NO: 18940 - DNA, 1322 bp, Mus musculus
cacgtgggttctgaacaactggaatggaggctgacccaaacactgtggcctttaatgcttgagtctcctgcctctgcctctcaggtgttggcattgcaggtgtgtgccaccacacctgactacaaattgattttaatatgataaacttgaactcttgcaactagagccatgggcataattataggtagagtgcctgcctggtatgcacataacctgggattcaatcctcaccatacttctattattactattattattattgttgttatcattatcattttcattattattattattattattaggcagtaggcatagataactagaactatagccactgagtggtcagaccaaagccttagcctgcatcaccggacgtcagaagtttgaatagcagtgggtattttcctgtttcttcctcctgctcagtgaagttcatgtgctaaccaagagaaatacaggctctgatgtgtgggaatcaggtgtcactacctgtctgccaagcacagatcgatgtggggatcagacatttcatggtgtctctctctctcttcctagttccccttctgcgatggggctcacataaagcacaacgaagagactggcgacaacgtaggacctctgatcatcaagaaaaaggaaacctaatggacagttgcgaggctgcacccagcgtgttgtgatgtcacctgctgatttacgtagaatggcacccaacccaccgtctgattggcctccccggttctagatgtggttggtccctgcaaatcacagctctcatatccatggcatcggccttgctactgaaacatgtggtgcacgtttgttgaaagaagaagaaaggctaaaccaacctcgtgctatatgggttattttggtcttgtaaggatccgttcctttaaaataatggtcttagaatatagttgtatcttgaggttaaagtattaaattattccaaaatcatgtacatgtacattgtacttgtcagtttaagggagaatcttttcttatcggttcgttaacttggaaagtaacggggtgtgatgaaattgcgttgatttcttacaccatgggagaaccctgccgtgaccctcactcctcctggttgagctggtgacatggatacactttgtgtgctttaatgttgttctccttaaacttgcccgggtcaccaataaaggggcagcaacttccctctgtgttcatctctgtggctctgtaacggatccactatagacaccgctagcagaaatccaggccacggggatgtgggttaggtagtcaggaagaatgttggggcgatggctctggattgagtgccc

SEQ ID NO: 18941 - DNA, 1113 bp, Mus musculus
gtgttgggaacagtctctaggaggccattttggctgcgtctgcagtgctttctcctccccggccccaacccttcccctgaagattcaatccagggaagcatgcatgcagaggaaccctgtcatcagcccctgcccccctgggtctgtttcttcccgtgtcagttttagtaccatgtgtttaagagaatttgtttcatagctgttgtggcatttgctgaggggaacctcatgtctcttcttttgaatgttcatctattcccaataatgatcttttctttttccttatctgtttaatggatgctcaccggttttcttgatcagtcacttttgacttgattgatttttttttttttttttgtctgttgctctttgacaggattatttactgagacactttcttgctgtatccctcaggctgccctttaactctggaccctgctccctcacctagccagtgcagggattgccatgcccagcatccagtttctatcgaactgacttttggttcatatcacgtatttaaagttaacacatctttcttggacataagtgtggctccttttcctgaatgataggaatattgaatgttgtcttcttacatttattgattttgatttggtggtgggaggggatagataggcagggtgcccatggaggggagcaaataacttggagaaggctctcccttcccaccgttcggtttacagggcttgaactcaggtccttaggtttagcagtagtcacccttacccgctgagccctccaccagcagccgctgttagacatattgaaagctacacatttcacagcaagctgcgccatgccaactttgtctttgcttagcacgtggagcacgttctcacttctgtggtttcgatccacatgtaattacagtggtgttggttaccttcctatcattcggcatttctccacttgtcttgcttttctgctgtggtttgagggcatctctgcaggattccaatcctcagagatttggggcttggtaaacagagcgcttttacccttgaagggctttcgtgttctgctggacagttttgcctcctgtcccctcctccagacgattctgaactgtgcagggctttctacctcaac

SEQ ID NO: 18942 - DNA, 1145 bp, Mus musculus
tagtttcattgagaatttggacaggattgctttccgtaggaacagggagaactatttcttttcttccttttctcctcatacccaaacccatgctttcaaggtaatgtgtgagaaggagcttttgttgagagacagcaagttttctgtggcagatgtgtgcaggcgctgagatgggcggtgacagagcaacagtgcgtgtgagagtagcaagagagaagtaggtggggtcacttggattcagtccccagtttactgatgtcaaacttcacaaaatccttaagatcctaagaaatctcattctgagccagacagtgttgtgttggtggggaggtgcccacagctttgtaatgctgggcctccccttcgctccaatgatgtctggtcacacggagcagacatttgtctgttgatgctgttaccatgtccattggctctagatctacctaagtctctcacctccagcatctcctctttttgtttttctctgggggttgtttgaatggtacggttgcctgtcattaattaaggtttttctccaatagcagatgtgtacctaaaactggaagatgtgactcataagtttaacaaaccctgtataatggacgtgaagattgggcggaagagctacgacccctttgcgtcatcagagaagattcagcagcaggtcagcaagtaccctctgatggaggagatcgggttcctggtgctcggcatgagggtaagaacggtttccgtgacgctttccttacgcaacactccatgtagtgtgagctaaaaggacaggcattttatccgttgctctatggtctgtagtcagcaacattagttctgacacatagtaggcaattaatgcataatggccagaccctaagatgcatttgttttagggttgagaaggttgaagtttgagtgtataataaagattaaaagtgaacatgttctttgtacttttcctataagaagagccatttataacttttggctttttgaaacaggatctcactgtgtggccctgactgttctagaaattgctttgtagaccaggctggtcttgaactcagagactcacctgtctgcctccccatgctggggaaaagaactgtttgtgtttttgtttaaagatttatttattattataaataagt

SEQ ID NO: 18943 - DNA, 3562 bp, Mus musculus
tctatattaaaggcagagtgcagcgcagcgaatgaaagaaaggtgcttaagccagcagggctccctcccggtcctgtctgctctgtgctgagcatcatgggaaggggagtgtcaggtggccggcagcagctaacagcacaaattttcctccctagggtcaagagaagagagatatttgtaaagaacatattacccttttctttcttttgttttaaagaatttcatttatggaaaagtcttcatttactatgttgtgaaagctgtcataaaacaccctctttttattaccagtgaggctcccgagaggtgaatggtggaaactttgttttatctcttctttaatttttgagagtcttccattttagaaaatccattctttaaaatgtatccccattgactttttaagccttagcataaacattatctctcagaatttggttaagcatccacagaacgctgtgcccagtgcactggaggaaccctgcttaggtctcacaacagaacgctgtgcccagtgcactggaggaaccctgcttaggtctcacaacagaacgttgtgcccagtgcactggaggaaccctgcttaggtctcactcccgtggtgtctaacagagaggtcctagttaatttcactcggagcaacaggcaggcaacttttccttgaaaaaaaagatatttataagtgtcatgtttattttaccactaccacctttttcaaagctgtcgttaaagtgttttcaaaactgaaattaaatttgcaaatctttttgctgtgcttgcttgccctttgacccgctgatgtgataaaataactgaacagcttgtcctttttagacaagctttgagtcacgacctgacctttttttccttttcacctcttttttccttgaggtttacaaatcaaactgcaaaatccaagaaccattttctgtaatgtggaggaacttttacagtccaaatgtagtttgcaaatgcccacgctcaaatgtgagccggaaaggaatgggtcattaaccagagtgggtctggttaacgtgccttttaggggttttctctgggaggctgcaggtgttctcagacctgcaagaacgacacattctctgcccaggtgtggactggctatacctatttttgtttctctcattttgtgggagtgaattttaagtgataattattagaaaactttcagtttgactgtttttcttacaatattgacttgttatctgggtgtgattcaggaactctcaagcccatctgctgaacactattttggctcttaagaggcagtttgagatggtatcagcctatatatgaggaattgggaaacttgagtattcgaagctttgggcacacttcagcttagtaaagtctctgatctacagctgtttcaaacatttcggaagccagcatcctgccttttcgacaagtaggttttgtctgaataaaacaggaagtgattcttccccctgcttctcagggaaggggtgagcatccagttcttctcgtttacagtttcccaactgctggccactttgtgttactttgtgctccttgatgccatgatcaacatgttcgtgatgtaagcaacctgtggtgggtgtttcccggtctgtcctgtctttaaaaatgatgctgagatttgccactttggggaagaggcatctgtcactaaccatgcatatgtgaacacacggatatttaagaaatgagcaaatgaggaggtggtttgaactggtggtgatgctagccgccccctcttagcccccccaacatgatttgagtgtgttccttatgggatgcactcatggaaaggacttgtgggtgtgaatacatttctcaaataaaagtttaaattgtaaaatagttttataataaagtatttacattaattattttaatatggatggaagttgcataaattataattgtgaactatttagtctttcaagagagttttgaaaaatgtatgtaagtggctctgatggctgtggtgttaaattagtatgcgatgctttgttctgtgtgtttggagggggctgggcactctacctgtccacactacagacagacagttactgcgggccgagtgagaaccgattcctgaatgcctgccggcgtcctgtgatgcagttgcccgagatctccacagtgttgccctcgctgtcaggcctctgaactgtcgaatttataacatttggggggaaatgaatttctataattacctctgttgcaatctttttattgctgttaggatttggaatgtgtaggcaggaggaagggctgaactgggaactgactggctctgactgttaataccactccccttgaggtctgatgtccagacgtgcttggttgaaccagccgtttacacagctgtccttctcttgcagaccctcaaccgaccgtggcttttgtgtatccatagcttccgttgccctttgtcttgccccctacaatggttcagttacccagaaacatcaagtcccttttaagaatagtccatttggttactctcagggtagtgtctgggggccttggcctctcagttcactcagactcaagtctgcacctcaccaagtattttcaacccctctccctgacgtgtgcgttggtgaagcagtcaggactgatcgtctccagcaccctgtctaggtggagaggctcacgaggacgactttaaaacagagacacaccaacacctgtatttcaagctgttaaagctagtgtttgggtaaagatgaagtgctaagtattgagctacaacagaggcagatgattgggggctgagatcaagggaaccgctgactctccagctggggcagttacagacagcctaaaacagcctgaaaaagagcgctcttaagacatgcttgtaaaggtacattcagccgtcgcctttggaataataaatagcacagtgtgactatggttgctcctcgctggtgcaaaccttttaaatctcaagttttcagattgctgggatttcagacttgtcagcggacatgaaggtatttcttgacttcagagcaactctgttgttataacatccaatactgatatctggagacagattcagcctcttggctgtcgatagtgtgtcttcccacttgcttcgatagcttctatcaaaaaccaccatgattcgtgccagtaaatcagacagtcaaattaaaaaaaaacaaaaacaaaaccaaaaacagtagaaacgtgtggtgtggtgaaactttggcctggtgtccacttaaaagattaaaaggttagttattgaagatagggtttctggtcccctgtagcgaaaggcacacatagacacttggctgtgggatctgtggtggaagatgggaaatcacacccagttgtgtccttagtaacatccaggcagcagtgccagtccccgccccctgttacttgatgaatgaatgtatccctgtactttggtggaaatgtctctagctttctttttctcagtgtttgtaatttgtactattgatgggatagtcttggagtgcaaggctcatcactgtgtttgtagaatcatctaatgtgatataccaatttttat

SEQ ID NO: 18944 - DNA, 2316 bp, Mus musculus
gccagggactgcagctaagtcatatgacttgcacctgacttcctcatataagacacaaacatcttgagtgctgcgcaggtgtaccaggatacaggtgaatccaatttggtggagatttgcccctgctgccctgattagctgaagctgcgtgcctggtgaggcggcgtggcctgctgtgcgtggatgggaactgagagtataaaagagtgagaggcccagggttcgggggagatataaaaacaagggagatataaacaagggagatataaaaacaagggagatataaacaagggagatatatggagaaagaagaaacaggactgaataaatgtgtgcagaaggatcctgtagcagcgtcgttcttcctggccagttgagcgcgcgcaacagttttggtatttaaagcaaaaacaaacaaaaaacaaacccccttttggtacctgcactgcatccctcgggtggggtggtgcctactttggaagatgctgcagcctgcgaggggatctgctggggcttccccttcgccacacagaagcctgcttagtgctttctgcaccagacaacctgttgaggcgtataacctgatctgtacatttttttaagtgtgcagggcagcctggacacagcttagtattctatgtgtatagttctccatgctcactaactctccttctctgggaagcagatgtacatactacatacatgtcacatactacatacatgtcatgtactacacacatgtcatatagtacatacatgtcatgtccatttaacgactggtcacctgctggggacccaggcatctgccttgttttcctttttctttcagttttggactttggaccctgcacagccgttccccggggtctgaaacttacctgtcacgcacaggtagagcagtgctagctagcattactggcttcctgctactttttcgttttttaaaaattttttattctgattgctgtattatatcggggatgttctaaacaaccaaactaaagctgtgtacagattgggtttggagtggtgaggacgtcagcaggaaacggcagtgctttgctgcctgactcctggttgacaggagtttgctgtccttgacactccacacgtgcgggacgggacacagagctgactgagcgtgggacactccacagccttctcatgacttgtgaagaaggtttataggaacgaggggtatgttttagagctatgagaatctagtcagcccacagaggcgtcaaacctgaagcttgggccttaattagcattgtactctgatgaaaggactctttcataagcatatttatagctttctaatctatacacagtctatccatagatgcatattttaccccaactggctagagatttatttgttgtaaatgccgtatagattttggggtttttttttgttcttcctctcttcacttatactggtgtggggtttgttttagttttctttagtgaatttatgctgttttggggggcggattgagaagaatcttccgtagcctgagctgtccctcctgttttgacggcacatgtgccagtcaagggacacgggacagtcacaccactttgcattcccaccggactcatgtacctcccgcagagccgtccccgtcaaggtgtggggctcctttcatgcatttgcttcttttccagagtgtggatttgaactacttccccctgcacagggccgcgtgcaccctgccgagctgcgtatattctgtactgtgtacaataaagaagattgctttccttacgcaaaaaaaaaaaaaaacaaaaataaaaaacaaaaacaaaaataaatatactcgaggtaagatctgttttaaagaagaaaatagagaagttgtaataaagatggttctgagacaaattgttcctgatgaccagtgtagggtgcagaaatgggcatgacttgctccatgtttctctgtgaactcacaaaggtcaagtgtggtgatgatgctttgctgatagacctttccagctaccatgaaacctcactgcaaatttggacaatgctggcttagcatacatctgaaccttgggaacatttagcaaacttgtagcatcatgttgttactccatctacatttcccatgacagtatgagaaagagggaagtctccactgcattttcaaggtcatgtcttggtcagggtttgtattcctgcacaaaacatcatgatacagatgcaagttgaggaggaaagtgttattcagcttacacttccacgttgctgttcatcaccaaaggaagtcaggacagggacacatgcagggcaggaacctggaggcaggagct

SEQ ID NO: 18945 - DNA, 1141 bp, Mus musculus
gcatgctgatctctgtattcaaggtcaatctacagagcaagaacaaggatagccaagattaggcagtgaaggatttagaaaacataaagctagtgataatgtaatagtacaaggggatcatgttctagttcctgtaagcagcagaactcagcagcttcagccatgtggctctggctctagagttaagaatggaaggaactactggggaaattgatgctggttagctggaactaaggaattagcagtgattaagaagagtccagcatcactgaggtgaaatcttctggaaattgttttctgggagcacaaagaagctgtgttccagagatactcaaggttgtacctcatgctgcggctggacgtggtaatctgtaagagtcactcaggtggtactgcttgtgaagaaatgaagggatcatggagagaaactgaggcttagcactgtgagaggccagggaattccattggagaaggtgaagcctcagctgtagttgatggcccaggactgaaggggtcacgcaaaggatttgaggcttggcaccctgaagatagcctatgagaggctattggtgaagcctagttggagtggaacaccccagtgtattggagatgtcagtaccatgggatggccaccaagaacagcagccgtagtggagtggatcaacctgagcttagagtgctacagagggcagagctggaaaagttatgccagcccttaggaggagtccaaaagatcaagtggaatcccagacactgaaacaagaagctgtaacattgaaattgccttggagactcaaagatgttaaagatgccagagccatggtttacatgctgaggaaagctgctaacagggagtggaaccagcccaggagaaagcagtttgttgcagtcaacaaagatgaaaaaggagtggagatctgaagacccctttgacatcagccatggagatgcagagttttaagtttgcccagctggtttcctaccttgctttgtggattacagttaattaaattgaacgaatctcagaagagaccttgaactttggacttttaacattgttgcgactgctatagactatgaggactttgaaagttggactaaatgcattttgcattatgctatgtttaagtatggtccccat

SEQ ID NO: 18946 - DNA, 1260 bp, Mus musculus
aaggagagagaacctttgtctcaaaagcaaaggaaagagaaaaaaggaaggaagggggaagaaggaaggaaggaaggaaggaaggaaggaaggaagcagggaaagagggagggagggaggaagggagggaggggaggagagagggaggaaaggaaggaaggaaaagaaattagtttcaaatggtataagcctttgtcttcagtcaccattcctttgagtgaccagcaaagtgtattctcaggatatgatggtggggttctacttacattgtggtaatgctttggaaggctattcaaatgcagagggatttattgttcataaactgccaagacactgcagtctgtggtttccttctgccttctctgctcaatgaatacatcttctaaagaaattagcttccggcagaggcctggcggaagacaagatggcgcggcagaggtgttccgcccgcggtctgcgcctcgtcggtttctgagccgagtttttctggaagggacggcggcaggcgccgtctgtgcgcgatggcccggcatcggaacgtccggggatataactacgatgaagattttgaagatgatgatctgtatgggcagtctgtggaggatgactactgtatctcaccatcaacagccgctcagttcatttactcacgccgtgacaaccctgaagaagaatatggctatgaagatctgagagagtcttctaattctcttttgaatcaccaattaagtgaaattgaccaagctcgcctgtattcatgccttgatcacatgagagaggtactgggggacgctgtgcctgatgacatactgactgaggcaattctgaaacacaaatttgatgtgcagaaggctttgtccgtggttctggaacaagatggtgtgcagccttggaaggagaagagtgagcgagcagtgtgtgcaggacagccttcaaaaggagtcttattttcttcctttggagtttcaccccaaaatgttcaccattcttatcttcaatcagaaaatcatttggatagcagtagcaaaccttttgattgttgtagctcaatagcagaatatggatcccatagttcttcacttgagccacgtcactatttacttcatagaaaagagaaacatgacagaccccaaagtgaaaaggaactagaatcatgtaagttaacaaaagagctggctctagctcacctgattcatgatacgccaagagattcttgtgcacgccagctgtcagccagactgccaccctcagacagcgggc

SEQ ID NO: 18947 - DNA, 1099 bp, Mus musculus
tggctaagaacacaaaagtatggtaacaactagagataggctgacacggtcagcttcaacacctgttatattatgcatgtttgtattttgaaagggacaaagaagaacactggtttggcctggaacaccttttctactgagaatgagaagtggcctgatatacttatagcttgacaagtgagatggtttgatgatgtcttcaagagctaaggagaagggactgaaagaaatttagttaagattgaaagctggttgtgaagcctgttagcagatcttcaggatggacgtagtgagatgcagcaaacctgttctttgcctgaagaacctgcaacaagactttgtggcctggattgttgacccattgcatggatatggactttctgggaaaccttagattgttggaaacatttatgggaataggaatctttcattaaatacctcaattttctttgttgttgatgttgttgttatagcacaatctaccgtattctgcctgatttaagataaagagcataaaaatagtgctagcttgtgagagttagcctgccaaggactgtgagggctagatagtgagaggttggaattgagccaagacacactgatgataaaataggtggaggagtagtgaagatagttgctgaagtatgccaggctttagttttatttagaaaaaaccataagcctttattacatttctgtttgataattatctgagcccccaaacttctcctcaaatagtctgttttaaaagtacaatttatttacttccatttatctgaagatatgtgccttccatttctaatttgaaagtgctcagagtaaatcttaggataggttagttaacatcagctgatgtctttgtctacttttgagtctgaggacaccagtgatacttaattgggtcttactctgtgctttcatttttacttgactattgttttaaagcctcatttccaaacaaagtcacaaagagccactgaaggctagatttttgtaactattaaacagtaaaaagtatgctacatgtataagatgtataaatacttatttaagaattatataagagtattctgaaacttacgtgtttagttgctatttt

SEQ ID NO: 18948 - DNA, 1749 bp, Mus musculus
aaaaaagcaatgcagaagacaataaaatataaagattataattggaaaccttggcaaaggaggatgggtggaaagttaccagtgatggaattctatacagcaggagacctttggattaatattgactgcaaagtatatatagtgcctctataagcactagaactaaactgctatgcagaagaaagttaaaacagcccaactttttctttctgtttttaattgagatctcttccaatgtaaggttaccactagcaaattactaggctaaaatgatggtgatggtgctgtgttactgttcctggtattttctaaacacatgataaatgataaaatatgtcatgatcagaatcctttactaatacattttaagatattcttctgaaattactacaatttgaaatattagattgaaaatgttggctagaagataatagttcacagagctcattgttaatttcacctttatttcctcagatgaaaggatgagaagagagccgtattcataccctgcttgggctgagaccagattggttccttcactgttgtatctctaggcctaagcctggaagtttgttgcctctgtacaatctaattctccaagctgattcaatctggcatctcttggcttttcagtgaactgttgtgttttgtctcatgctaactttgacagtatattctggcttgttctgtcttcacctgtgtctaacttgctgtccttgcaacctgtctctgtaaaagtgtaccagtgaaactcacacgcatgcatgcacgcacacaggcacgcatgccacaaccacccttttctctcgctgatcttcagtagtctctcctcttgtcctctctttttctttgtcttctctccctaccagatgtgaaagcaactttatgcgcctgctgtaattgttgtctgaggattactgcgagtaagctcaccctttgtagttactaaactggccggctggctgggtcagctccgctgtactggttcataacccggcttcaagttgactgattcaaaggggcctctcttggcttctgactgaactgctctgcttggaaagtctgatggacttcaggaacagaactgtactgactgccctgactcagctgaactcaactacaccaaattcattggttctctctgctgtactgctcttaggtagcctctctcctgtgctgtcctcctgagtcgtgctgtcaaatctctctctgattcatcactttgcccctcaattagactggcagtttcaaacacggcacttaacatttcagttgtagtcacttgatactgcattccgaacttgagtctattgaatccagaatgtgaatccatgcctttgtgactgtgacctcactctcttcagtattgtgtaaaagttttaggaactctccaagtaaatacttggtaattgctcattgatagaacagaaaaatgctgtgtagataataaataaacatataactataagattatccagtgtccttgttgcattttgtattctttaaagtatttagccaggagtggtggctcacgcctttaatcccagcactcgggaggcagaagcaggcggatttctgagttggaggccagcctggtctacagagtgagttccaggacagccagggctacacagagaaaccctgtctcgaaaaaccaaaaaaaaaaaaaaaaaaaaaaaaaaagtatttagaatactggactcaaccaatgacctctaccaaaagggctcagtgtgcagcatgtttact

SEQ ID NO: 18949 - DNA, 1128 bp, Mus musculus
agggagggggaagggaagggaattgggaagggaaggcaattgggaagggaagggggaagggaaggcaattgggaagggaagggggaagggaagggaagggaagggggaagggaagggaagggggaagggaagggaagggagaaggaaagggaagggagaagggaagggaagggagaagggaagggaagggagaagggaagggagaagggaagggagggggggagggaagggaattgggaagggaagggaattgggaagggaagggggaaaggaagagggaagggaagggaagggaagggaagggaatggaagggaagggagaggggaagggaagggggaagggaagggaagggagaagggaagggaagggggaagggaagggaagggagaagggaagggaagggagaagggaagggaagggagaaaggaagggaagggagaagggaagggagggggaagggaagggagggggaagggaagggaattgggaagggaaggcaattgggaagggaagggggaagggaagggaagtgggaagggaagtgggaagggaagggaattgggaagggaaggcaattgggaagggaagggggaagggaagggaagggaattgggaagggaagggggaaaggaagagggaagggaagggaagggagggggaagggggaagaggggaagggaagggaggtgagagagtaagataaaatcaagtttgccagacttgtatgacttgaaagctgggttacttcctggatagtcacactatgaattgaaaattgttctccagtaattggctctccctcatgtccaagatgtagtttatggagtctccatatgtagactttagaaaaaggtgggaatacaaacattttactagggcaaatttgtcttttatccatgagagcttcccacagtcctgtacctgaatcaaatataggctcagagaatgtcactccagtcttcagagtttctgctggactgagagtaaactggagattctttctagttaggatgccagtgagtgggaagttaggagaaactaaagaccggggctcatttgtttgtttgatatatagctaaaactataggctaggaagaagaaataacctaagagcaaagccaggactt

SEQ ID NO: 18950 - DNA, 1866 bp, Mus musculus
ggcccatgatgttgaatacttagctctgggaatggatgcctatgtttaattaaaagtgtatcactgtcgagtagcagcggtgctggtcccatgtgcaggagctccttgcagtccagtttcttggccatcgcctgctccccccagagcatcaggatgagtcccgtgcctgtctgtccaaggagatctttctcatctcactcaactgcgggaaaccgggctaaagtgactgaatccgcgatggagaaaactttagaaactgttcctttggagaggaaaaagagagaaaaggaaaacttcagcaagctctttcttggtggcttaagctttgaaaccacagaaaaaagtttgagaaactactatgaacagtggggaaagctcacagactgtgtagttacgcgcgatcctgcaagcaaaagatcaagacgatttggctttgtaactttctcatccatggccgaggttgacgctgccatggctgcaaggtctcattccattgatggcagggaagttgagccaaaacgtgctgtagcaccagaggagtctggaaaaccaggagcccatgtgactgtgaagaagctgtttgttggtggaatgaaagaagatactgaggaacaccaccttagagattcctttgaagagtatggaaaaattgatactattgaaataattaccgataggcagcctgggaagaaaagaggctttggctttgttacttttgatgaccatgatcctgtggataaaattgtcatgccaaatatcacaccataaatcacacaatgaagaagttagaaaggcactgtctagacaagaaatgcaggaagtccaaagttctaggagtggaagaggaagaaactttggtttgggggattcttgtggtggcggtggcaattttggaccaggaccaggaccaggaaacaactttacggggggcggggggatctgatggatacagaagtggacgtggatttggaaatggctataatgggtatggaggaggacctggaggttgcaattttggaggtggccctggttatggaggaagaagaggacaatatggtagtggaggacctggatatggcaaccagagtgggggctatggaggtggttatgacaactatggagcagtaaattatgaaagtggacgttacaatgattttggaaattatagccagcaaccttctaactatggtccaatgaagagtggaaactttggtggtagcaggaacatgggaggaccatatggtggagagaactatggtcctggaggaagtggaggaagtgcgggtctggtggaaggagcagatattaagcttcttcctacttaccatgggcttcactgtataaacaggagaggatgagagcccagaggtaacagaacagcttcagtttatcgaaatagcaatgttaaggaaactcttatctcagtcaggcattaatttgcagtggtatggcaggagacaccagagcagatgcagagagccattttgtgaatggattggattatttaatatcattaccttactgtggaggaagtattgtaaaaaaaaaaaaaatcctttgagacagtttcttagctttttaattgtttctttctagtggtctttgtaagagtgtagaagcattccttctttgataatgttaaatttgtaagttttagatgacacgtgaaacctttttacagatttttctcaaaagttttgaaaagctattagccaggatcatggtgtaataagttataatgtttttcctttaaaaatttaagtgcgtgtgtagagttaagaagctgttgtacatttatgatttaataaaaataattctaaaggaaaaaaaagaaatatcaatgtcatctgggcactgtatacctgg

SEQ ID NO: 18951 - DNA, 1206 bp, Mus musculus
ttaacaggttaagcctgctgtggtgaaagcaccttattcaagtaaccccttgctatcatctgtaataaatcccagtgaagtaatagcttcttccagagagacctttggagcaactatgccttagtgttcaattggagggcttaggaggaggggtagcccctgtttatgtctgacccagagaatgaattttaacaacaccatatttctgagctctgggtttgattgagagtgactgtctctgtaagcatttccagggagagtagccgttctctgagctctcaatttgattgagagaccctgtcttgataaataaaacggaagagtggccaaaatgattcttgatatcaacagtgggtttcagcatacatgcacaaatgtgtccataccaatgcaaacacccatacacacacacacacacacacacacacacacacacacacacacacatgaaggtgggaacagccactgaacagaaacaaagagccacatctgaatactatataaaattaagggttatgacttgagtgagaacagtaatgtatatgtacatataaatgtgtatatgtatgtacacacacacacacacacacacacacacaaactcttagaaactgaattaaaagttacatatctaagtattttctttctgtcagttacttaacttatgcctatcactgaccatgttagccagtggacattgaggtaccagaaaaccttggtaatgttgtacatacatatacagtcatgtgttggttgatcaagctgtttctatgtggactaaatcatgccatgtaatgaaggtagcctccattatcacagatgtagccatgtagttttgcgttactctggtgtcctgtgaaatcactgataagctgtgactgtctctctgagaaccacgtggctgacctttacaaagctgctctttattgaagagaagcattatatgttcagaactagaacttagcagacaagagaaacgcaaccatataatgagcttgaggccactgcactattttgagaatcagaacatgtattcagaatgggaaaattcctttgaaattactgagtaaattttgtagatgaattaaacagagatcgcccatatctatatatttagtttttgtgaatatgtgtggctatatagagtaaatagactgatttacgcatgtatgtagcattaagtaataatattggtttctatagcag

SEQ ID NO: 18952 - DNA, 1150 bp, Mus musculus
gggcttcttttttgagtgggatgaggtggctctggagggcgtaggccacttccgcgaattggccaaggagaagcaagaggatgcctagtgtctccttgagttgcagaacgatcacgggggccgtgcactcttccaggatgtgcagaagccatttcaagatgaatagggtaaaacccaggaggccatggaagctgccttggccatggagaagaacctgaaccaggccctcttggatctgcatgtccttgggtttgcctgtacagaccctcatctctgtaacttctttgaaagccacttcctggatcaggcggtgaagctcaccaagaagatggacaaccacctgaccaacctccataggatagcagggccacaaccagcacagactggcgtgccccagggatctctgggcaagtatctcttttggcgcttcactctcgagcaagactaggaggcctctgtgccttccaaggggctccacctctgctctgcaccagcctgccttgggacctccacctgaatgaacctctcaagccactaggcagctttgtaaccgctctggagcctctgtcaagtattggaccaagtaaaaataaagcttttttgagacaaaaaaaaaaaaaaaaaaaaggaatgaaaaccacccactctccagaaaactgtgaggtttctatcaccacattcagactgctaaggaatcaggtgttgtggacaggagagctgcgaggttttcaatttctctgtctaccctgcatgcctggttgtactacctagccactaacataacaatctcctgttagtacacacacacacacacacacacacacacacacacacacacacactctttctcctgtctctttgtgtctctatctctctttctcactctctcacactcattctcttgctatttctttctttctttttctttttttttaactatatttttattcaggacatagggtaggaggagtgtagaaataatatcacatctatttgagtgattctcaatttttaaaaagatgtcctagaaggcttccaaagggagtttccttactttatccttagatcctgattcagttaaatttttttttacattttttaagatattttctttatttacatttcaaatactatctatcccttttcctgg

SEQ ID NO: 18953 - DNA, 5441 bp, Mus musculus
ttagaagctgtcttgagagttaacaattaccaggtattccttgtgactcttgtaactttacacttccttgtgactcttaactggtatctttggtatcttccaacaacgccctccccacttccttgagtttcggtttcttcctttaaatacccccttacccagctactcggggcgccacagtcctctacccctgcgtggtgtatgaccatgggcccgagagcgctcttgaataaaaatcctcttgcaatttgcagcaagacccgtttcttgtgggtgattttggggtgtcgcctctcctgagtcagaacgtgggggagccctcacattgtgggtctttcatttggtgcattggccgggaaacgcaaccacccctcacacccgagaaccgacttggaggtatggggatcccctcttgcttgcgtgtgtgccggccggtgtctctgttttgagtgtctgttttctgaaacgaacattggaacatgtgcttgttgtgttgggttgtttgtgtcttgtcctatgtttctgaagtacggcgaagtctgagtttggatccgtctgagtttattgaacttgtgccttggttttccggtttcgagatcgtgggttcgagtcccacctcgtgctttggttttacacctggcagagttagaaacaagtgagattctctggttttggttgtctaggtaaaagtggacgacggtgtttgtagacgatggggtgatggggttttctgaaatgcgcgcgtctgtatttgcagctgtccttttgggccgtaaggaccggaggactgtggtcggcagacatgctaagaggaccacaggctgtggccctgggggacgccctgggaggtagggagagtcagggacgcctggctgtctccggagatcagtcagagggaccgagttctgttgaagcggaagcttccccctccaacatcgtctaattcttttgcctgcttgtggaagacaagaaagggtcgagtgtgtctggatctgttggtttctgttttgtgtgtttttgtgtatgtgtttagagctatgtgaaaatctaaaaaaaaaaaaaaaaaaacaaaagcaaaggtaattctcataggtgctttataccctgactagagatagtttacacctgagatgtgagagaatgggttttaagaaaagtagtactctccgactatctgggggtaatttggtaataaaataaaataaacagtattaattggtctttggagccctgcatctgtagttaggaatctagtttggctggaaaagccctgctaggcgctgattataaacgctgctcttatagggacgagcagcttctcaagttctatggtaaggaaacagatggctgcttttcctacaaaaatctctgtgcttgtgattattggattcatcaggtaacaaggtgctcctctcttgaaattacagctagaaaaattaattttgtttggtttaaatgagcaaatgtatacggccatttcatttttgtttctaaatagtttcaaaagtataaatatgttttatatgtcttggttatagattagtggctcataagttattggttatgattaaaaatttgtaacattggtaacaaaaagttgacttaaaactggtaactctgagttagagtaattcagaacatgtggcatgagccaacccatgggaacaggtctctaaagatacgcctgaattgggtaatattctgtgtaattcttatcctaaaaacccgattataatagatatattggcggctacaccttgtgtttgtgtgcaggaacggacagccaaaactttgtagcaagtaatgtttttggagttcagttttaaagaaaatagattgttttcactgttaaaattgggttttgcttctcaaaattgtggttgtactctgatgttacaagaaaaattaaaggcttctcccgaatcggagccaccagctaaatcggctcctctaaaatctataaagcctcctgagtggcctagtccacaaccttccccttatccacagcctcgaccccagccaccgaggaaaccccaaaccccttggggcgtcaagaggcggaccgctgtgagtacatggagccacagggagcctcagagcacagcgtctgggcggactctggtggacctgcccaaactttaaacccttcagtactggtcattttcctctgctggtatttataactgaaaaattaaccaccccctttctcaggatccccaacacctcacagggttggtggagttccttatgttctctcatcagcctacttgagacgactgtcaacagcggttgcagatgctcttaacaacggaagagcgagagagaattctgttagaagctagaaaaatagcccgaaagccaacggcggtctacacagctacaaaatgagatcgacatgggattccctttgactcgccccagttgaaactgcaacatggctaaaggtagggagagcttaaaaatctatcgccaggctccgatctccaaggtgtctcaaaacaggcccactaatttggctaaggtaagaggtaatgcaggggccaattgaacctccctcaatgttccttaaaaggcttataaaagccttcaggcggttcactccctttgatcttacccagaagatcagtggccatggcttttcataaggcagtcagctcccgatatcagaaagaaacttcagagattagaaggtatattattacaagaaggagacagttatgcgatctagtaaaagaggcagagaaagtgtgtgtgtgtgtaaaagagaggcaggaggcaaaagaaagagaaaacaggaaggatcgtagacaagaaaaaaatttgccacagtggtaagaaaaaaagaaaagacaggatctagacaggaaacctgggcaactgaagaccgagcctcagctaaagaggctcagctgtgtcagactgaagttacttatttgagatacacccttcgaggtgaaaagcagtggctaaaaaagccagaaaaagactgtaactcagatccccaccccaactataccaaggcaagtaagagaattcttgggtactgctggcttctacagactctagatacctaggttggcgaccttagctgcccagttgtaccccctaaccaaagaaggggaggtgtctgtgtggaccccagatcaccagaaagcctttaaagtgattaaaaaggccctactgatggccagcctatgcctgacctaaccaagcctttcactctttatgtgaaagagagagcaggggtcaccagaggagtccttactcagactttgggactttaaaaaaggccagtgacttacctatccaaaaagttacaccctgttgccagtaggtggttttcttgcctgaaagctattgctgccataatctgcttgtcaaggatgctgataagctcactctgggacagcaaataactgtagtggcatcccacactcttgaaagcattaccaacgctcctgtgacacatcagagctttttgttgtctaaatgagtgaccttcgcttcattccacctgctgtcccactgtgtgagactgcacctactcatcactgcactgacattctggcaaaagaaatgatctgaattatcagatcagccttggcctgagggtacgagctggtacactgatgacagtagcctcgaggttaaaggtaagcaaaaggcggggacagcagtatggtggtgaacagaaagcaagtgatctaggccagcagccttcctgagggacgtcggcccagaaagctgaacttgcgactttaagacaagctctataaatgacaaaagaaaagtctacactgacaacaggtatgcttttgccactgtacgggacaatatacaaagagggctgttgacatctgcagaaaaagacctaagatgctgtggctaaagaaaatcagatggcagatctaaccgtcaagcaggtggctcaaggaacaatgatcctgacagtcaaggagtctaaagattattatgacatcagagagaccagctttagatacaccgctgaacactatcaagctatggacagtatttggcttggcctgggggccaagaaattcaaaggtgtggttaggtcctttgactactatgttacaggactctctgacttggcaaaagaaatagtcaaaagcttcaaggcctgtgctataatgaggtagaatttctaaaagaaatcttcccaaggtaatggacctgcctttgttgcccaggtaaaccagagactggccaagatattagagatcggttaaaagttacattgtgcacgcaggccccaaagctcaggacaggtaaaaaaaattaataggaccattaagggatccttaccaaattgacagcggagactggcgctatgattagatagctctcctaccctttatgctcttcagggatagaaacacccctggacagtttagactgacccccctataaattactctagagggggcccccctccactggtaaaaatagcctctgtacatagtgctgacatgctgctttcccagcctttgttctctaggctcaaggtgctccagtgagtgagacagcgagcaaaaagcagctccagaaggcctactcaagagaagaagacctgctacattagacgtctccaccagaaaaccttgagactccggtggaaaggcccttatcttgtactcttgacagccctactttctacctttatgggaccccttttgattttgcttctgcttttaattataggtccatgtgtgttaaataggcaagtcacctttattaaaacagaaattagtgcaatgtggcttttagttttaagacaacagtaccatgccctaaagtaaaggatcgagtatgtcagaaaaaaaatagtgtctagttctaagattagaactactaacaagtagaaggggggaatgaaagtataacaacgtaaaaacagaattctaggcctttaggcccaggcttgggaatgtggcctttgtaaaggtatgctaatcataaaagagatagcgacattcctctacccacccgcttcctgggttcaaagagtgctcattcaaaaaaagtcaccctggccattaccagaacctgcaatgcaaatgtgctattgttagaggctcttagaagctgtcttgagagttaacaattaccaggtattccttgtgactcttgtaactttacacttccttgtgactcttaactggtatctttggtatcttccaacaacgccctccccacttccttgagtttcggtttcttcctttaaatacccccttacccagctactcggggcgccacagtcctctacccctgcgtggtgtatgaccatgggcccgagagcgctcttgaataaaaatcctcttgcaatttgcagcaagacccgtttcttgtgggtgattttggggtgtcgcctctcctgagtcagaacgtgggggagccctcacattgtgggtctttcataa

SEQ ID NO: 18954 - DNA, 1104 bp, Mus musculus
accttgttgcctcaggaggctgactcttaatgcagttgaaggtggcatgcaataaactgagatgtgaaacaaggggcttttcataaagtgtgtgccaaggcctgatggatttggggtactttacaccattagtgtataggtcagtccctgtacagaacacattttcgtctgtgtatgcatacttctgagatgcacagtggctagaaggatgggagtttattggagttccttagaggagcatgagtgagcagaagtgtaataaaaaacaaaaaaaacaaaaaaaaaccccactctcatgtagactattcaccaaagccaaatctctgcagctctttacacaatctgcaggcagataggagagtcctcagtgttgctggtgtttgtcagagtcttacaatggctgtatgtcttacaagctggctttgaactcacagtctgcctgaataccaggattacaagtgtgggccacttgcctagcttgaagaccttttaaatgctttactaaacaagaagactctcactggttgtcgttcacatctggcagtctgtattgttaccacagcaggccttggagaggccttccatgtgtggagcagcttatagattatgtctcagggccaggctttgccaggcaggaacacagttctacaactggtaggtaagtgggtaggatgagggatccataaagacctagtcatggtcacagggtaagtgctggacatggcccatagcacgctctggttcctccagagtgaggtcacgtgatggggttatgggtggggttctgtgtcctgccttcttgagaaccgagcgatcatacttgagatctgaaagatcacactgcatccctctttttcttttccctcagaatattgacatcacaaacttcagcagcagctggaacgacgggctggctttctgcgcattgcttcatacctatctcccagcccacataccatatcaagaactgaacagtcaagataaggtgagccaaaaccagggatggtgcctcactggttagtgggccactcattccagcctcgcttcacaatagcctgtcctggctcattcccctggactcattgtttacacttcagctagcca

SEQ ID NO: 18955 - DNA, 1620 bp, Mus musculus
aggtggcacactcagtgggtgctcagccacttgcctgtaacaccagggaaaagactggtcacaaggagttctcctcattgaagttgttgttttattataagcaatattggtgaaatagctcctgttagtaccaaagttaatcgtttcagtaagcatagaactaaaacacagactgggcattagcatgtgagagggagggttcgtgcagtagggaaaggggggtgctttagggagccagagattcaagttgtactggtggctgcccctccagggcaggagttaagacagtgccttagccctgcaccaggacagctgagcctacacccacatgaggatcctgtgtgctgattgggactccaggagaagtggctctacgctgtgcctgggctgtggggcctatatcacgagccaaggccttacccggtttgttgatttctggctggaatttagcagcctcttttcgagaataggaagcccttatttcatgtgcctgacacagaagctgttgtttgaacaatgtcaagacctgttgctccgggatacacttgtttgtcacctgcaaggcaccatgtggaagactggccatcaataaaaatggggccacagcttcagtaacaagatggatggtgggaatgtctcccaggaggcatgccaggccaaacatggactgagtgaggttctgtattcaagcataatgctacagactaggaatctgttgtatctatggaacgtagagaaggaagcaatttgaaagtagttattgggaagtgggccgtgtctgtttgtgttgccatcagatggccagtcccacccctccaccctgcttaaatgtcccaatctggcagcttatgctgcagagtgtaccaggagaccctattattctgtctgcccagtgcctctctggccctccttggcccagttctgttcttgttcttgttctgctgatgaactccgttggggtgaccattgtgtgaaaatgactgtttccaaatgagtctccactgaactcctctgagcttccagcctctgctgtatttgccttcactgaggccttccactgtgcaccaaggtggtggatctgaggccaggttttatttattatcatgaaaaggggttgtcttgttagagactttcctgggcttgcagttcacaccttctgtcccctgctggctatgtgatcctcatggcagtgtggaagttgcccgagttttctgaaaggatttggagtaagtcagctgctgctgaacgagtatgtccatgtagaggtaacattctgttttggaatctgtgggcctgggctaggcctggagccagtgcagggacagacagatggtgggctagaccctctcacatgcacacacagactgggtgtctcacagccagggccaggctgcccacatttgtgtgagggtccacagtcaagtgctgtcttcagaccactgctttttgccttctctaataggccactaaagagcactgttgaccctctgggcatgcttgtagatggccatgtgctattaaaagtagtatttgggagttcttagagtgcctgtctacaatgcacgaagccctgggttgatccctaccaccacatacactgagtgtggtgcatacctgtca

SEQ ID NO: 18956 - DNA, 1124 bp, Mus musculus
agcccagctggccccatgattagggctgaggagttgggacctggacatacagaagggtgggcagctgtaaccttcagggactgccttgaggctatactgacaaaccaaaacccagagctagaaaccaggcttctgggggctacatgtactgtcaaggggcagggcggttcctgtttggtctcaacacatataactggggagggagtcaggccaagaccaatgtgaacttttattggcttggaaagcctgagccatcttcttgtggctctacacagtgtcatgacatggagctgaagccaagcaggctttgactgtcacggccataggacacagtttctgtggtgagatggtacccatcagaacctaagggtgaactggccactggctttgttttcctgaggaccagtattggaaaggaggccttactccgtgggccaggcatcaccctctggccccgtgcttctcaaacttcctaatgctgcaaacatttaatagagttcctcgtgttgtagtgacacccaaccacaaaattctcttctctctctctctctctctctctctctctctctccctccctccctctccctctctcccttttcctctctccctctctccctctctctctttcttccctgctttgtaacagtaatttcctgctagtataaatcataatataagtatttttggagatacaggtttgccaaagggattgtgactcacaggttgagaaccactgctctaggagggtccccctggagaaaggtgctgggccctggaattggaatggttgagagagaggagggatccccagaactggccaagagttggtctctacttcatgagtccccatatccccttcaatggggcatttttaagatagtcatcccaggacacgagtcttgacaggaatgggcaggatagtattgctcccccaagagaactcaggaacaaacacgcagagtccagtttgagaatagaccctagcttgatcgtgtctcatccttacccctgcaaggcacatggcgacgcacgccagtgtcagggcagcccttggcactggtcctgcttggtgatggttttaggcttcttaactgaagctgagatggcagtgctccagtcttctg

SEQ ID NO: 18957 - DNA, 1400 bp, Mus musculus
ccttttgaggatgggtgctagagggcccgtgcccctaaaacagcaggcagcttcccccccaccctggtgtgcacaccaggagtgtttgcacagaatactgggtgtcttctgtcttgaagaaaggcagtgtccccgagtcacacagcacagcaggtagcatcaactagagctagttaatgtgtgttgttttgctcttgggatcgagacttcagtttccaatgtgtggggagtcagaccagaatagatacaggtactttgaaaccactaacccttctttacacggggcacataggccagtccgagttctttcttaacaagatggctgttctggcctggccagcagtctgcatgctgaagctgcaccaaagacaagcgaatgggtcatttctaaagagaccagggagcccactcctcatgggctctccgtggtgaagaacaaagggtaccccaatggcctctcaccatcactgtcctccaggggcctcggacttttagtactcaaggcatgatgtggcagtagctgcttcccctaccactagctgccccctcatggtcgtctgggggacagaggtggtctgtgtttacaagggcagtcaagtccagtcacccatattactcatcaatgttagacgaagccttgagctgaaggaggtgctgtcggctaggcctctactctgggtttcagagagtagtattggtttcagtctggtctcatttccattgccttaacgctgggtggtcagggccccaaggaactctggatctaagctcaggagtacacatagcagctatgggtatgggtgtcctcctctggtgtaactgtgagactaagtgataggaagaagtaaagccttcatagcgagtggatgggatgaggtgtggcacacatccccgggagtgctcgtgggaagtggcctccacagaaggtagtcatcttcatcctctaggacatttaaaacatgctcagtccctggacccagatgatggcttctcagggcaagtcataagttatcaggtccacttgtctggaagaataacaagaaagctgctgctttcgagatcacccgccagaggcggggcacgaggcacactgtgttatactgcatgagccatgaattgggctagaggaagccttgtcatcagatactgaccatagcatgtgacactcagacttctcagctcctgtgcatcccagtgtaggctctgaggccacatggaaactctagatggttctgatcactctagccaccggaggatgaaagggatcttttgcatagcagaggattttatacacaaatatattttgtttgtaatgagccattctcaataaatattctcaccgtacagtggtagcaccctttgtcttgtcgtcatgaaagccctattagcctgcagagttc

SEQ ID NO: 18958 - DNA, 1192 bp, Mus musculus
gggttccaagctgagaatggcagcaggcttatagcttagctacttaggaggctgaaacaggaggattgctttaacctgtaagtatggggctaacctattccccacggtgaggcccttgtctcgaaaaaaaaaaaaaaaaaaagacaggttagtcagggtcatttcagttaaaggtctttctggggagcggcaaagatgcgggggtgggggtagaggggggtgacttacgatgactttcttgcatccagcagcatccagacttcatcgtgaaggcacggcctcttttgacctgaagttgctcccactacaacccagggtgtgccctagacttgtctgtccctgcacctcccatctaaaggacgaaaaatgggttctctggctgagagcctggccccaaacagctaccatcttcagtgccaaggacaggctggactgggaagccccataacctgatggggattttcctaagagtccagagaagccaggtacggctcccaccagtgtgaaggtggaagataccagagcaagcgaagaccctcagagacatgaaagggccttagccttagagaggcatctctaatggcgagtttgcaggaggcaatgccggcaatttgtgaacccttggttggagtgatggaatatccaaatatccgaacctagtgtcctgcccttgggtccttgtacaagggataggcagtaatgcatgggcttggaaacaggggttgggagacccaagagaggaaataggggcccgtaaagcactcgcagggtcctaccatcaactctagacagacagacagacagaaaggagatatgcactcttggattgatgggggcccaggaacccacagaaaccagaacggtgaggtcatgtaggtatacccagtccgagagtcacagaagtaactgtgtgacagcagagtctggctactgaagcagaggaaagtacctgcttttcttctcacagacctgggaacttgacaaatcagggcttctcgctggctaagttctgggaacaaacagaccaggagagtgtgggatccttcctcagctatcaaatggttcccccccccgccgcccccccccccccgccttgaaaagctccattagtggccatcatcagtgggtggggagtggcaggcttctacggggcttgcttaagaggcccacgtactggactacatttcccagc

SEQ ID NO: 18959 - DNA, 1160 bp, Mus musculus
agttggcgggactccggtgccatgttaaacctatctctgttgtaggaccatgtggagctcacagccctgagaccagagcacacttggctgacagcatcgggccacgtgctcaccaagacccagtctccccgggagaagcgcaaagaacatgtaccctagtcctatgaatgccacatctagtatctgtgccttgaacactatggacccaatacctgtcctagcctgtccttctgactgagacatgataccggatagtcttaactccagaaccccacccccaacacttctccatcagtaacctgcacttcctttgtctattggttatgactctaactcctcagacttaagggatggccttcttgtcccgtcctagaactggagtacctatgtcccaagccctgcgttggaagctcccatttcagttcctcactccccagagcctgataaactgagacctggtgcctgccttcctgtgaggtcccccagagctaaactgccttgattcctgccccatggaacaacttgagagctcgggttggctcagtcccacaatgaagagtggccccggagcctgagcagtgagaaagagaactgtccagcagagaagagacctcttttgtaccccaggcttctactcttacctcttctctagcatactcaggaacgcccttccatccccatacaagaacacaagctcatgttacatctttcctggttcccgtctgtttgtgtttccccacggttccataactgtccgtgaggtcacccactaatagcatcagagtttgagccctgcctgcttcctctgctcctgcttcccatggcgtacgtagtctctcccgagcttttccacagatagggtgggatttagaagaatggtgatgccggggcggtggtggcgcacacctttaatcccagcacttgggaggcagagacaggcggacttctgagttcgaggccagcctggtctacagagtgagttccaggacagccagggctacacagagaaaccctgtcttgaaaaaaaaaaaaaaaaagaataagaataagaatggtgggtggtacccagtgggaaggccagtgcctgcaaaaggctcaactgggctgtcatagtcatgagatgaaagagtcaggtgccctctggctaatcccacctcctc

SEQ ID NO: 18960 - DNA, 1567 bp, Mus musculus
agaagccaacttgaaggagaggaacttagcccacttctgactgacctgtacttcagagggctcacggcagccactgggaccaagtcagagacttactgatgatgaagtatatgatccaaagagcactttaggggaacagacttaaatagatgggcacagtcacaagtgttcctggggtggaagtaaggtgctgactcatcaattaactgtactatatggcttctgacactgtcccactatttctgtccctctgtatgaccgcaggaaatatctgcgagatgctgaccgccaggtcctggcacagcgcgccttcatcctcactgtgaaagtgttggaggacacactgagtgagcttgcagaggtacgtcagcctatcacagctcaccccaggcctgtgcataagggccagggtaacaagtctctgcagcagccacagttagtggccaacacaagtcctctcttgatgtcagctccccgtaaggctcacatcgcaaagctcctggaaagccaggccatcccagaagcagcctgcccccacacctgcttatgtgtaagggggtggaactacccgaggaacagaggagaatgggtctctgggagagtcttgacggctggcacacatagccagaatggcattgggtagagggacccatggaggatctgatccaggcagagcacccgtaacttgtctggcttccttgtaggggtcagaacacccaggatccaaggcctgcggcctctctggagccaggatgaccactgatgtctcgcacaaagccagtcccgaggatggccaggaaagcccccaacaccccaagaagctacctctagctgatggctcaggaccagggcctgagccagggggcaggatgggccctcttaaccaattgccagtggtcacagacataagggacaacacagaccagggtggggagcagaaagacaaagagagtccccaggtggggcccactgaacccatggataccagtgaggctgctggtcgccactcagacttggaacagacatcacgtctgttgccgggccgccccccaagggaccggggccctgagagccggtctgctgagctttccttagaggagctgagtatcagcacccggcaacagcccgctccactggccccatccccagcagcccccaccacaactgctgctcccactaccatggcggccaggggagcggggcactctgaggaggcacctccaaggcctaatcggaaaaggaaactcctggaggacacggagtctggcaagactctcctactggatgcctaccgtgtgtggcagcagggccagaagggcatggcctatgacctgagccgcatcgagaagatcatgtcggagacttacatgctcatcaagcaggtaggcagcctgtgcactgaccctggggctgcaggccccttcattgcctgggccttttgttccctggaggttccttcttgaggccacatgtatcagggcccaccctgagatggtgttagggattgtgccccctgcttgaacactctgtactttgtgaggtttttttttggggggttgtattttta

SEQ ID NO: 18961 - DNA, 1234 bp, Mus musculus
gttatttatctttctagactgtacaaggaaacaaagcctttttacacacaagtggtgtgtacatttagaaaagtctaggaggatttgcctgttggacttttcctttcatcctggatgccagtgtactaaatgcagtgtctggcttcccttttccctcagcctgtgctgtagatctctactcgggtcactttctacggctccaatacaatccttttaaatgtgaactcaactttgttatagccgaccatacagaaaccccttattgcttcattgggtggccttataacagtagggacacaattatcctccaggtagacacactgaggtgaggtagtccctccccgtgagggaagacttgttccgagaaccgagaggaccttttgcagagctttatttgtccagctcctgcaggtagagggcaaacttgacatctcctgacctggaggaagggagaggtttggcctcagtatctggggtgcatactgccctgcagggctgccctgtgttccctgggctccttccacccctggggaggcagatttctaggatacagtccccgggttgcttaagctgtgtttttttttactatgtctgagaactaggctgttgcacctgtttgccatatctgaactgctgtggtctttagcttttgcctgcaaacttgccagagatggtatggggaagtggaaatattcctatgatgttggatttaaggcatggagaaagaattggggaccagaacttcctaaccaagtgactcggagggggtgacttgacattgtttctgtgtttcatgctacatatgaaaacgacccattccttctcccaagcagcactgggagatgtcagccaggatgccagcacaggcactcaatacacagggaggctgaaaggctgtgagtaagggtatccattctgtcagagggtgacaagccagaatggagtcaaatggcatagcttctgaccactgtccctcttcctcctgagtgggatattgttcccgctgaacttagcaaaactagggacagtgacagagccacacagctattaagcagtgcaagcagaagaactacatttaagcagctgcctttcccttaaatagactggctgtagggcctcgttttcgaggcagtatgacagaatccctctgcttgcatgtcccactgagcgtgtgggagcaaggtgctcattccctgcactggggctttacgctgtaaaggatgcctggtttttt

SEQ ID NO: 18962 - DNA, 1205 bp, Mus musculus
tttagttgctctactaggaggcgttgggatgctctgtcacagggagcgggatggctgtcgtgattttagcatgtttcatgtaggttaagaaaactggaccctgaggaggaagatgatccatttaataactatgaagttcaggcagaagccaaactggagagcttctccaatgtgggacctcatcgcctgtccttcgactcagccacattcatggaatctggtaggagtgggcagtgtgctctgtcactgctgggcagtcttccttccatcagcctgggacctgcctggcttctgctctgcagagtggttctagggtttcataagagttggaaaaagggctggagagatggctcagtggttaagagctctgactgctctaccagaggtcctgagttcgattcccagcaaccacatggtggcttacaaccatctgtaatgggatctgatgccctcttctggtgtgtctgaagacagctacagtgtactcacatacataacataaataaataaatctttttttaaaattggtggaggagctgcctgtggtcagctgagggatccaggtgcatacttgctgtgctcctgaggctgtagacttaacactggattgagaggcttgcctttgaaagtttaatgtgtgttatcacgtctattctgtgtgtaccatgtcccacacactgttttgtgtgtatgatctcattcactgcacatgcagcactggccagcccttttggtgttcatcttagacatgtgaactttgagaggcttgtttaccactgacaagggttggagccagcattgaaccctggtagcctggcatcaatacttcagtgtgaccttagcttcatgtagattgagtgggggaagcagaacacaaactgtcctcttccaaagagaagagaaactgaacccaggagggcctgttgattttggtgaggtggttttccttgtgtggacagagaagcaggatgtgcatgcgttcctgatggagaacctgaccaacgggggcctcctggagcttatgatgcgttatctgaagagcatgggccacaagttcctgctcaagtggcccccagggctggcggatgtcgtccttagcgtttaccacagctggaggaggcatagcaccagcctgcccaacccattgctgagggactgcagcaacaagcacatcaaggtgagtgcctcttaaggctagtgtctgg

SEQ ID NO: 18963 - DNA, 1148 bp, Mus musculus
acccggccagattggtttgttttaagtagttctaccactctctaatggacaatgatttatccctgacagaagagtttacaaactcaggtatcttagggaccagagagagatgcccttgtcctagggtcttgcctaagcacacctcacgtgctatttggtctcaagattgttcaaaagaagtgcggttcccgtactgagtttgaaatgatcacaatcatttaagaaactttaagcctttaagtctcctatagaaatgtatgccttgtgggcaactagctgggacgctcagagggaaaaacagagccacctgccgactgggagggccaaaggtagtgaacctgggaccagtaatttggagccggcacacgtgacagcggaagaggcgtatctctgatagccaatctagaagggccgagtctgcctggccaatgagaaacagagctgtgctctccctccccggccccgcctccctggccccgcctcctccccgcccctccccgcgctccttttctggaacctctactggctcccacagctcacccggtgcagttaccgtttggcgatcccactcttctcccgctaacatgccattcgttgagttggaaacaaacttgccggctagccgcatacccgcggggctggagaaccggctgtgtgcggccacagccaccatcctggacaaacccgaagacgtgagtgagggtcggcgagaacttgtgggctagggtcggacctcccaatgacccgttcccatccccagggaccccactcccctggtaacctctgaccttccgtgtcctatcctcccttcctagatcccttcctggttgtctttcccaggcgtgaccctgacgtgactgactcccaaggatcctgggcagtgtcccagacccggagccctcggacccccacgttaagaatttggcgcgcccccttctgaacaccagccatgccctgcccaagcttcaggatttaacttttgtgttccttgcagcgcgtgagcgttacgatacgacctggcatgaccctgttgatgaacaaatccacagagccttgtgctcaccttctggtctcttccatcggggttgtgggcaccgcggagcagaaccgcactcacagcgccagcttcttcaagttcctcaccgagg

SEQ ID NO: 18964 - DNA, 1297 bp, Mus musculus
acagtggagattgccatccgaaataccggagatgctgaccagtggtgccccctgctggagacactgactgatgccgagatggagaaaaagatccgggatcaagataggaacacaaggtatatacacagtacaggcacctatctttcctggcagaggcaggagtatcttcttcccaggaacctagtttcaagaggcagtttcagtggagatgaggccccagggtacattttctcaaagagaacaaagacaagtcctcaggccatgtctgccttttctcctagcaggtttcagggtttctagaaagataagtagtgtccatgcaaccaactggcagggtcaagaaaggctggagactattcctgctagattggccccacacctagctcctctaggaaaaaaacatagccaagaggaagacaagacaccccgagctatgaccagccccaactgacaacctgttcccctacttcaggcgaatgaggcgtcttgccaacactgccccagcctggtgatgaagacatccatgctcgacctctacggagcatctcagactgcctttccttcctctgtggaaagagaaaggcaaagggacagctggtgccatcctgaggactggggtaggagcctcctaggtgcctcccttcagcacacattccatttgctaaaccccaacactgtcccccagagtctagagtcggaagcagcctcattttgggttgtgttttgtttttgtataggagcccaggcagggctggtaacactttttaaataaaaagtaccatgttcaatttctgtgcagtagcataaaactgagagccaggagtccagcctgagctagaaccggtgtggatggaagggtatgtggccaggtggctgtgtcagtccttgcccttctgccctctggttctgagtctgcatagccaggccacagggcccctagagcagagcccagtcactgttctttcttgtgccttccagcttcccaggggctctctgtgctcagcaagtccttgtagaggttgacagtgtgtcagctcctctgctggccttagtcctgatgcatccagacaggctgctgccacctggagggactgtgctgctctagaatgaatcccttctagaggacttagtcatgtgtgggcagcacctggacaagacataatgaatatgcaagcagaagtctgtgccaaagttctagcagcccccaaagcgttaactgagtctatctcaactgtggctgggccaacttctccttccccaggctgttgtggggaatggaaatagcatgcctgccatg

SEQ ID NO: 18965 - DNA, 1787 bp, Mus musculus
agatacccctcactctggcggcgactagccactgtggaagaaaggaagaaaatagtggcatcgtcacatggtaaaaaaacaaaacctaacactaagggtgcgtcttcacgagggtttgtaaacctgtttcaaaaccactcgcttatgtcatgaagataaaacgttttcactccagtgtcttcattgcagcctgaccttagttcgggagggagcatcctggggcgggccaccctgccagagcacacacacctcaggtgagagtggctcaggaatagagtctcccgtactccactgttgtatgttcctggctggggcagtgggtgcgtgagggactggggccagggcagttgcaggtgctgtgaagacatgttggtctcaaaacgttttaggaatgctgagatttgcttcatttgctgtgagtgtgttgctgtagtcatccttgtagatggtggcactctctttcctctgggccttttaccacttccctccctcagcacatccatcctgtaaatacttcatcttgacaaccagtgtgctaagctcacatgcatgtacccattccgtgtggcaggccctgtgcctggggcttgccaggtgagcagtctgatgctggtgaaactagtgcgagctctgggctgtggcaactctgtgcagcgtgacgctgctcttcgtatattttggcgcctccagcatatgggtttgggtatgggtgcagtatgacatctggctggtggcaaaactgctttccactcagcaaagacaccctgtagagagctgccccaggcctgcatgcatgtgtgcatgcatgcatgcttgctcgctagcactctgtcgtctgtcttgtctgtaggtgctaatgtagttttgtctattatggtaaactgggggttcttttaatgcaggagccagagctgcttttattcactactaaaacatacccactgttgcctaaaacagtttttctttgtatcctttgtgccacaagtggaggacagtcactagtatggtgactgactagctctgcctacccttccttgagttcccatgaagtcctactggtctttctgctgtgttccttcctgccctgtaaccacgagagtcctccagtgacgctaagcaggtcctgtcaataactcgcagctcttgacaaaggtgctctagaaaagctggggctcacggcgtatgaagtctgtcttattttccagacagcacatctggactggctcggggacggtaacttctgcttaagtgaaacacttctttccaactctctgggctcttgttttaaaagaaaagtagtcctctttcatcccgtctcatacttgcattgtgttttagattgtggtagtgtcagacctcttcccactggggtgttactcagaagccttcctggcagccactaagctgcagctactccaaacatctctgcctctgagctaatgctcgaaggaggcgaattcctccagatccatcccaccggaggctttctccactagaatgtctaggcaaagcctcaggccagttgcccttttggaagacgctagcactcagcagtagtgagtttacaccttgctttcccagcctcctgcatgtgaggacctcctgtgctgtatccgtggttggcagcttgttcacactgctgcaggatgaccgcagtggggtctctctgcttacagatcatggatataccaccctggccaccagcgtgacactcctgaaagcctcagaggtagaagagatcctggatggcaatgacgagaagtacaaggctgtgtccatcagcacag

SEQ ID NO: 18966 - DNA, 1115 bp, Mus musculus
acacctgaatgggcaatgcatggtcctgaatagttttgacccctgttgctgaggcatttgaattgtttgtgccaagtgatctctgttgtcacagtaaaataaacactgaaagaagaggagaaagaactcaaggccccctgtgccctttctactctggccaaaggttattattatttgttttattttgttttgttttgtgggagacagttctgtgtagccctggaactcagtctgtagaccaggctggcctcgaacacacaagatgcacctacctatacctgccccccccccaagttctggggttacaggtgtgtgctcttttaaccttttttttttttttctctctccagaggttatggcatgatcccagccaaggtctctgaggaaaagtctgtgaaaaccgagttccagaggacagggaagggcctttggtgatcctgggatggttattttcaaactctgtcttgtgatgggtctcagagaacacaacctggcctgcagtctccattcgcttctccgctggcggtctatgtgtctctttctttcctcctgggctcgtggcaaacccctattgcattgcttgagttctgacagaaagacctgccctcgctgccccgtgcctaactaagccttgggctttccaaagctgaccggtgtccccaggactcgcgtagctccgccctgcactgggatagctccggagccctaaatccaggaggttaatggaagggcgagctttggcccctcccatttggagggcgtggatcagaggccccgccccagatcccgcccatttcacctgactctaaggacgctgccgtgttagttgcccggcactgagcgagcggctgctacggtccacgcttcttactcagctccaacttgatcccaccgcagtcatgcctcggggaagccgcagtgcggctgccaggccggtcaggtgagagagagagcgacagggaccccgtggggtcgggtgagggaaacgtgggtgctctcccaagggcgtccgcagaatgaccttggagtctgctgcgccatgttggctggggggtggggtgggaggacggggacgcagaagcgtgagtctaaacgagggtcccactggaccctgg

SEQ ID NO: 18967 - DNA, 2099 bp, Mus musculus
aggaccttcagagcagtcggtgctcttaaccactgagccatctcgccagcccccactagatcttttaagagggagacctctcaagatgggtacaaagacttgtccaaggacgcctaaccctagcggagcggggaagagatgcagtatttcccaaagccctcattctcaccaaagcccagcctgtcttcatagtatctgttccctggtgacctgtgccccacaagggtgctgccactccccaccaatcttgagcccaatccaaatgctagttagcagtgtttgagtcctaggtcaggagaatccgtgtggcacgagccaggaaagtgttgtaacttggggtagtctagccctgggtcactcaacctgccttaaactatacttgaaacatccctagctagggctagggagtcgggagagacaggaagcctccagctttggcacttacttgtgggtaccacttttgagctgacagttgcctcttgtgctcttccccaggcccctgcccggcctgcctctcaccccctgcagatggggccctgctcctatgagatcaagcagttcctggactgctccaccactcagagcgacctaaccctgtgtgagggcttcagcgaggccctcaaacagtgcaaatacaatcacggtgagcagtcattttggtgcatgtgggggtggaggggtggacccttcggtacctgcgcgggctggcaggctggcgagctgatcggctgatcagcgctttgtgctgtggttccctccacaggtctgagctccctgccctgaagaggctgtgggcctgctcatcgcctaacccctcaccgacagcttgatggaaaggagaggttccatgtgactgggagtaaggaaggatcgttctcaccccgcagactaacaggagacataattattcaattaaaaagtttactttagaccacagcctgctgtgtgcccatttactgccctgttggctggcgggggggggggggggggggcaggatcaggggagataggggaacagctatcttgttaatgtgctatgcctcatctttgcggaggtgggagagaggatgtgggagttggggatcttgttatagaaccctgagctgtccttgaacctctgggatgggaggaactcctatctgtctgcattgtggatagtcaaggacactcctaagcagggagactggagaggtatttgcaagtggtcccctgggacctaaaacctcaagaggagcctattgtctctgcccacaggaacatctgtgtcttttctcttcttattttgtccttgagttcttttttctgcactcaaatggggtggggtggggatctcaagcgctcggggagtggggggggggcaactctcacatcctgtctgtgacctttcccttcttgctgatgtaacttcttagtaaccgccagatcctggaagaggagtcctgctggattgctgtctgtttgcagttgatcataaagcagaggtcagggccagtccccttggattcaagtccagcttggctgtggtgtaccggctcatagaacctgctggaatggaagcaggcccttaagaccacagctcagaaaaaaaaaaaaaaaagacacagctcagattgcttcatcgtacagtcgctacgttcactgagttcagtcaacaacatgcattgaacacctactgtgtgctaggctggagaaacgtgggccagcttcctaaacgcagagtatgtgtgcctttaggatgctgatagtccagcaatactgtggggttttatctctggttacagtcctgggtgtgtctctgtgtgaaagtcagtaaagatcccttttggattttcctgggttcccctacctttttctttttctctttctttctttctttctttctttctttctttctttctttctttctttctttctttctttctttttttttttttggtttttcgagacagggtttctctgtgtagccctgctgtcctggaactcactttgtagaccaggctggcctcgaactcagaaattcgtctgcctctgtctcccaagtgctgggattaaaggcatgtaccaccaccgcctggcaaaatctttatttatctatctat

SEQ ID NO: 18968 - DNA, 3236 bp, Mus musculus
taatgcagggttttgtctgtttattttttgagggtttcttttgttctcatttagtgctggcgctggatcggaggcttcacaaataataagcaagtgctcacccctccccctccccggctaaggcattttctgaatgaactgtgagtgccatttgaaatccatctggttttcatattaagtatttggcttgacaggaggaaggtgtctgtgtccctgtgaatggaaaacaagttaaacctatttattagtatttcatctaaccctaaagtttgagagttctttaaaggtttgacgtttggtgggcaggctcacaaggccccacctctccctgaagatctgcgggcagttaatacttgcgaagggagggagagagacattgtttttgtttcttttttgagagacatcatcttaagtggtatagcatgggtaagtgggcaggcatacgtccttttcagtcttgaagccaaagaaggaatcctgcctgaatgcctttacctaaaagagtatccaaggaggccaagccattcctgtaaaacgcccgtgtctgtgaaagacccctgcaaacattcaaagcacagctctgtattctcagcgccacatgaagcagcagcaacggtagttagaaaactggggcggagcccacgaccatggactttgtttcgcttgatgcgtagggtagccagagttatccacgctggtccgttttggctcgctctgtttgaagaactggtcatatcctcatggaccacatcagtaaagcaagttgacctttcctgaggaaagaagccccggcatttgcggtttgaagtatattgaacttgagttataactgaaaaggtttgggaaaatggcatctgtccagtttatgacttgggctgaacttagttctactctcaagctgtaataagaacttgcccaataatactggacatagcgtggaaaccagagcagggtggctagaatttaaaccctctctgtggtctttgtttttcagtccacgtgtgtggttgagtgtgtgaagcttgcaatttgatgccctggtgcttttcccccacttggtgctagggattaaacccgagcgagggctctgccattgaaccagatccctagtcacactttgtgtcttgtctcctatttaagtggttctaatgtctgtataagttccctttgttggatgtgtaatttcctagttgatcacactaatactgcttgggtcttacttgaagcacttttgtgtgcaagatatgtcctaaatgaagacttgccttctcctgcctatcatactacttagctggtcaccagcctctggaggaacaacttctcctagaaccgtagagcatcctctgaggattggtcttcaacagcttcaggagcgctagctctttctgtacatctctagggctgtgtccttgagcctggccggggctacctgttgtcctccagcccaggtgaccagctgccgctgcccatccctccaggcgtctgggtatatgctggttagagacactggtcctgttcctttctttaaaggtatcttgttgggtgtggtagcacacactggtaataagagctcttgggaggctggggcaggaagatttaaagttcagagtcagcctgggctcttcagtgagttccaaattacacaggaaacaaaagaggcagtgtggataagttccttagataatgtccctgttccatttttcccttcctcggtttagtgaaatttccctagattccatgaacaaatgggaagaggttatccccaggccttggtctctccagactgagggagggacagaggttgtgagtatcttttgtttgctccgtgcttgaccattgattgactgtgatctgcctttttactattttgatgggtcttttcagtgtttttttttttggccacatcacactttttagcctgtaccattcctttaggtatggaaagggtatttgtcccacttgttctggtgaaaaatcccgtttatgaaataagtctgcagactcatataaacattactgtctatagtaaacttaagaactgtcttagacctgtgtcgagtgtctccagccctgcctgtcgcagtagttttctgtgtcactaaagcatgctcctaaagaggacagaattgtttactgctaagggaggccccagggctctggctcctgcctaccgcttctgtcccctgcgctgcccgacccaacctgacctgtccactgctgctgcactgttttgaccccccactgatcttgctattcctcagtaaattcccattttcccctggtgcagaggctgcctgggctgctgtcacagcgctttccctaagcctgcatggctgctacctcactcgtggttatgaagcttactaagatttttagagtgactagaaatgtcccctgcttctgaagcctcgtttactccttctcttggaaggcgacttacctctccccgacttaccccgcctctgcagtctagctacatttcctagtcacagactctgaggaagaaatcgttagcaagagctttggctctgtcttagaagtgagctagcttaagtgcatttttgtgcctcttaatacaaagacgtagagtgagctgagtctctggacgctttgttttataccgacagctccatctattttgaaagcagtgtcactttgttctgtttacacgtgtattaaatatttgtcaagattactattttgttactctgtgaagttggctgcttgatttaccaaatgaaagttattttgatgttgccaaagttatttataagaactagcaattagaggaataaaaaagcattttgtggaaaccttttctgtcttttttttttttttttactttgtgcactgtgtattttaggttaatttttgttttgtgtcttctgcagttgagtttattttactggttataacttctagtgatatgttcaataaagctaattaggcttctttaatttcatttttaaatcttatttattattgtgtgtatgacttgtgtgtgggtgtatctgtgccaccacacatgtatacaggtcagatacattttggggttggttctcttactctgggatccaaagatcgaactctggctggtaaacccccccccccccccgcttttaaaaattttctgttgattgttaatttcacactgtatgaactccattcctactcatctcccacccctccattccatatccatcctccaacctctcccacccagcccaaagaaaaca

SEQ ID NO: 18969 - DNA, 1613 bp, Mus musculus
ccattctccatgcccacagcccaggctccatgcagccgcacagcctcctttgtccagtgtgattactgaagcaggtgtgcctgctcgtctgtgtgtgtcgtcactaatgctcagcaagtgccattttggactgtttagttagatcctgtttcagaaagataaaccagcatttgatttaaaatcacttttgtagcctgtaacatagtgacgttaaactgcaagttctcatgagatcacagtattcatcctctcacgaagcacactgagttatttttatgagcagatctggacacatgagtggcagcctacagtcttctcattgtgctagccaggcctcttacacagctgagccgccatgggagtttgtctgtctagggtggacatagctgcagcctcttggctttgcatttgagttatgtgcctataaaacttggccaaaccatttttagttcattttatccaaacttgaaatccgagtgatctaatattgtacttacgtcagaaaagagaatgtaaaatcttttagatacttataagagtttgaagtcaagcatgaatctaagattatttttatataactaatcaaagattaatgttatcaagttggcggggtttagggacttggaaggatggagacatttatgaatcatatctacttcacagagacagctagattttttttctagagttagcctggacacgtgcttcagcgagttcagctgactggttctactctcatgtctcacgtcaggaaacaggacgtggcagagccctgttgctcctggtatcaaactgtggggtagtatgttaaaacatactggaattgtaataatcctgttataactatgtacagactccatgtaacttattggcctcagagtctagtggcagactggtagggttcgaggtagatggctgtgaagggacccgaactacctacccactgtctcaacgttgtcattttatatcagacagcacctgtaaacttttgtactgaaaactcagtggcagtaagaacgtatctggtaagttaagattttaagaatcatattaaaatgttttaaggttactctctgggaattctgtatatcacactaatttttttatatcatgttaataaaagctattgactttgtaattctgcattttgaaatgtgtgaaagggtttttaaaagtttcccaaaacaggatgtattttattacgcattatttctttcagaagtataaacacaattatgcttatcgtatgaaatctagatgacacacttatgtgttggaaaggaaacttaaaatctcctacagtccgacttacaagtaatagcagtcttagggttgctaagaactcaggaatttttagcctttaaaattttttaaaacaaaattaggaccatatacttcttttataatctgcttttgtacttaataaattacacaaatgtttgcatccgttacatacattctttacatgtcttaatgatgacattgtaagttgtgcagggctgcatgcagcccttcctgggctgctgggccagcaccgcctccctgcggtgagtcacctccctggtacctactttgatttccacagtggcatgtctgcctagcctcagctctgc

SEQ ID NO: 18970 - DNA, 1228 bp, Mus musculus
ttgagcaccattctgtggggcttcaggccatgtgctcacagtagaggacatctcctcagcatcttacagaattgcctcagctccggtcatgtatgcattgtgcttataatttaaagatagtgtgtgcttacaaatatctaagttttaagtaactattttaataatagaattaaaagcagcgtcccatgtcttgggaagggttctatcaggccatctgctgtggggaggtggtgttataaaggtaacatgggcctgagcgccctctgcacatggatggtatcacagcccattgcagcccagaggcctcctaatagttagtctgcccacctgagtaccctaggactctgtgctaaggtcccaaggtaaccagatagaaattgagtcacctctgataatagtattgaagccatactgtagagaggcacatggctttagagtacactgtcttgaccaggccacacacagagcaggtgctttagtgagggactgagcgtcagtcgagttccttgtttcttggagtgagggccctcgtcagcaggcctgctggtgttcttgttgcctaggcctccagatctgggaggacctcctccaagaaaagctgtcctgtcaatgaacggcctgagctacggtgtgatccgagttgacactgaggagaagctgtcggttctcactgttcaggatgtcggccaggtgatgcccggaggtaagaatcggccagagtgcatctgcatcctgccctgattgacaacagaaagagcattagtgcaccagcagtgctagctcactcgctgtacaccaggcctagtccttaacctcgtgcctcttgggggatttaacaccctgcagtttctatagggtacctcagaaaaaactgatgctgtaaatgcctggatgatgaggtcacccgagtagattgtcagaatcacctgtggtgacagatgtggaacctcccccaccccacccaaaaaaaaaagggaaggaaggaagaaaatcacatctgcaccctcctgcagatgctggcccgggcatttccctgctgctttgaggaaggacagggagaaggggtgttggagtggtcctctaagtgtcactgaggaatggggccagagtctggctcaggagcccttggaagcagggatgctgtcaaactgctctaagtttactactcttacagctactggttgctgccctggcaccccattcctgccacaggcagtattccactctt

SEQ ID NO: 18971 - DNA, 1228 bp, Mus musculus
ctgtgttcacacagtcattagcatgagtgtgaggaataacaaatgctcaggaatctcaaaagtaaaatctgcaaataagaccaatacatctccagggacggtgatcctgagagaacaaactctgggttcgttaagctatgtgactgacattgctgagggacatgtagagagaggatctgagaggggggcaagcgcttctgtgcacagtggcgcagtgacgaggccagacctccagagtcatgagtaggttccagacaggactcagtgtaaacgattatgtctagagtccattaaaatgtattcaagtttcatttgtaagaataaagtgcaataaattagtccactctccagacctttatatttcactgtgaataaagaagccaaacaaagtgccctctaaatttcaaatacttgtcttattttcatgaaaatagaatatcctgccaataataagactgagttgttttagaaggtttatgaagggtgaaagaattttacacagcctgtgctccaggggctggggtgtggctattgctccccttccacagcgctctgtctctacctccattgctttgtcttctgcaggatgcaggcagccagcaggttgggtttctcctgggcagctgtggggtgaccctggccctgaccacagatgcttgtcagaagggtctgcccaaggcaccgacaggcgaggtggccactttcaaaggtgaggctcctgggtcacagttctggctccgccttttacctggctttgccttctaggcatgctgtgccagacactatacccacagaggctgctgggtccacagcagaggacatacttgtcagggcttttgtctgattcggtctacctcttgtgctccatgcttctctgtctaaggaaaaagataagaaaatagcgcttgcctcccacggctcctggggctgctgggtgactgctgtgcacaggttccacacacgtggagcacagccttctgagcgcctttcatgacttatcccacgtgctgtcacaggttggccccccctcgcctggctggtgattgatgggaagcatctgacgaggcctccaaaggactggtacccgctggcccaggacacagggtccaggactgcctacattgaagtaagggcatcctcaatactgcacagacacatccctcacaggctcgggcctggtttttataaaaagataactacttaataccttttaggctaagtgctctcc

SEQ ID NO: 18972 - DNA, 1140 bp, Mus musculus
gtcctatgccagtcccccaggtggtgggcctactacttttgctgtagtgaaaacccatgaccaaaaaccaagctggggaggaaagggcttattcaccttacatttccacattgctggtcatcatttaaggaagtcagggcaggaactcacacagggcaggaacctggaggcaggagctgaggcagaggccatggagaagtgctgcttactggcttgctcagcctgctttcacatagatcaaaggaccatcatgcagggaagataccacttgtagtgggctgagttctcccccattgaccctgaattgagacaatgctttacagcctgataagaattaaaacggtagacagcacgttatccctgagtcagggaggcatttcctcaactgaggctccttcctctgatgactgtagactgtgtcaagtcgatacaaaaccaaccaatacagttaatctttgctttattctttgtgccttaattatatatgatacaaaacactgagggagaggtctttaatgttttctgtctaagcacagcctaatagtaaagtaagttttaattttcagtgaaagagctgaggtggcagtagttgggtgtgtggatgatggtttcaggctgggatgcctcctgcttcctgatgtttttttccttctgtaggctttgctgcagatggtgtttgatgagagccaccagatactggccttgtcagaaagccaggacccctctagtgcactgaacaaaggtgaaccacgtgaccccctggatggcttcccgagagacagtcaggccctttcggaggtgacaactgacaaaggagagaaggtaggagactgctggctcagtacacgagaaggaaccatttgacctgcccataacatggtcacaccactgcgatggctttgaacagccagcctgctcctgaccatagccccaggaagcacagagtacccagcagggtagctccatatagctttgcgcctttgcagcccagggctagctggtgcagcagcagcagaaggagagaaaggttgcccattctatttgtggtttttctgttgctgtgatcaagcaccatgaccgaggcagctcacagaaggaagggtttgtttcagaggaatagagtccatcatgatggagagc

SEQ ID NO: 18973 - DNA, 1172 bp, Mus musculus
catactataatgttttgtatttggagagtatcactgaaaagtagaatttgttcatttcttagaacaggtaattggaaaagatactaaatagaaacatggtgatggagaaagcagcacatgactcttcttttcttttcttttcttttctttctttctttctttctttctttctttctttctttctttctttctttcttccttccttccttccttccttccttccttccttcctttctttctttctttcttttcctgaggttagcagttcatacagtaggcgtttctgtgtgaagcaatgctgggcccggatgccttgtcgtctgctggggttgggggcagtggggggaggcggcagtggggtgtaggtgtttcgtgttttgaggcccatttagcccttaagtgacctcgaagccccagttgaacccagatgtggggaggggatgtcagaggctatggaggaactgttagccttgtagatgtagaggttgctctgttgccgcagccctgccacccagcactagtggcagtgacactgatatttttctagatgaaatgggtgatcttaaaaaaattaattatttttttacacttcatattttatcccatcccccatccatcctccaactgttccacatcccattcctcctctccacccacctatctccatgtggatgcccccaccccccaccccacctgacctctaaactccccggagcctccagtatcttgagggttagatgcatcatcgctgaatgaacacagaccactcagtcctctactgtgtgtgggttggggaaatggatgattttattttattttactttattatattttattattatttttttaatgtttgagtgctctgctgcatatacacccacatgccagaagagggcatcagattccctcttcaacatcagatggttgtgagctaccatgaggttgctgggaattgaactcagggcctctggaagagcagtcagtgctcttaaccactgagccatctcaccagcccagtgactcagatattaacaagttccccacccccaccccactcctctttctctcccttcctcctcttcttcataccctctgtatcttcctgtatgtagctgtgattttcaaatgtatctcaacagctggaggaagctcgccagctccatcgctgtgtc

SEQ ID NO: 18974 - DNA, 1177 bp, Mus musculus
ctggctttgaactcttgtccttacacctagggcgagtactctacctctacttgctgagccatctcccctgtctccaagcagggtttaataagtgcctgctcacaacaacagacacagtgggcgtcaggcgaacctgctgattccacgtgggaagatgcccttggagtaacttctccatgacccccactgcgtggcacagcaacaggtcacccttcatctcatcccgtttccagctcacacttctgcctctttctggctgtggttgtgtgagttagggtctgcacagggagggcctagtgtgcactgagtgttttaactctcattcctgtaccggtcagccttttaccctttgccctgggttcaagtgggcagttctgtaagcatggccactcttgtcagacttgccttggctttgagacatttcatttcctccagtgtcttctcagagtgttccccaggatgccagggctggcgtcccaaaatagcagggacgcgctgtccttgccgcctcccagattctgccgagccacaaatatcttgcacctgtctgcagagccaagctgcttctcagcaggctcatttaatggaacactcacggtcgggcggggccttttcaggatgaccgccctttggagtttggttgcacaaaacattctctgacttcgtaagctgggtcattttttcccctatagaagggcgtgacccatgaagaagtctccctggctattgaccctgatcaagaagtgtggtccagaagtagctacagagtgaccagtgctgattgtccagggctgttccgtatgttcttatataaaacccaaacctgttcacaggctaacccttgaaagtggtaagagactgtagttcgctttctgtagtgtgaacgtttgtactttactactgacaatgctcatcttcactcttacgcggtggtctttgtgcactgtctccccagacatggttggtctgttttctgaaaacatttgcaatagttttcgtgtatttttgttggatgtttagagaaaactaagtatagttttaaaaaatttcttgaaatatgtatttttattttttacttatgtgtgcacacactcgagtgtgtgtgtgtgtttgtgtatgtttgtgttaccagaagagggttttggatcctcaggaactggagttagttgcttgatgg

SEQ ID NO: 18975 - DNA, 1203 bp, Mus musculus
tctcggtaattgtgtgagctctttgcaatggggtgttctgatgtatcaaaaggttagaaggagcccacttcagtaacgtgaaatgagggaggttctttattttgtgaatggtagttagtgtggtttatgctgtttctgagagtcctccagataaacatggagtggacctgttgtaaggtttgacctggagttgcatgagtagtgtcagagtgaccgagtcctattctacgtggggacccatggtttcacagtgagcacacacggggcagatggtatagagacatatagctatagttcaggtctcaggcagggaggaggcatgcggctcgcaggcatggctgcacggttgaagctgcactgtgaacaaagtcacttcagttttttttattattttaatgcttatttttgagagagtaattgctgtgttgtccagtctggcctcatagggctgagctcaagagatttttctgcctcagactctagtagctaggacgactgttgatttttgaaggccccttggccttgcttggtggaggctgttcacactgctttgtttgggttgttgtttcgctgcccttcgtgctgcaggccgaggagctgagctcttactctgtgggcttcatgcctccttttgagatgtgactccctgaggcggcttacagtacagagccacacatgggccaccgcctcccggctcctgtggttctaatggaaacattttcttcttcttcgcagttagagacccttcaggcatcctatgaagacctaaaggcacagtcccaagaagagatcagactcctttggtcccagcttgagtctatgaaaaccaacagagaggaactgaatggtgaggacttctgtgggatgtttgatccttcagggctaagctgtgcagactggtgtgtttgtgtgtttgtgtgtttgtttgtggattttgaggtggcatattggaacctgttggccttgtacattctttttttttttaactttttaattgattagttttgacttttatatcatgtacctcagttctactcatctccccaacctctcctatccaccattcacccttgcaacctgctccccaaaataaaacacacacacacacacacacacacacacacacacacacacacactagaagacatctcattgtggaagctgtagtgtgtcacagtgtgtcccacagtatatccctctgtc

SEQ ID NO: 18976 - DNA, 1130 bp, Mus musculus
tgtggattggccgctcacacacttgagccatctttaaaatctctggggcgtactgtgcatcttctcagagtaaagttgtgcacagtggtgcagtccctgtcaccactgttaaggggcatggccaggagaagcttttccctgagtcactggggaccccctaagcccactacagggcctgctcagactctttagtctcccacaggtggtcctcagacagcaggcttgaaagggacggggaagactgtgtgtgagggtgggtccatgtacactcccatagcttccagaggctgatggtgctcccagagccaggatgctcccaggctacttcctccttgttagcccagcattgccaggccatctgagacaaaacatctgccaaatatcttccttctatcagatcaataatcatatgagaggaaaatcgtgttagaaacatcatctaggaaggaaattatgtgagctctttaactggtgcttttaacaaaaccaagtttctctggaaccacaccccaaggcgcactgaaagacaggtctgtctttatggattcttctctacctgatgggctggggtggagatggaggagagagagcaaccatccaaccctcccggagtgaacagtgctttgtaaacagcgtgtgtaaatacccatacttacacagcctgcagtgcccacgtgcatgcatgtggacctcacatgtacctgggccttgttatgattataaaatgttataagtatgagtatcttgcctgtgtgtatttatgtgtgcactcctgatgcccttggaggtcagaagaggacattgactatcctggaactggagtcacagagagttgtggattgccatgtggtgctattgaaagaaaataaaacttgagtcctgtgattcatgtaatagcccaaagagttgtttgtgagctttgaagcctgggactgagaacatagcagaacaggccaggacatgcctgggcaggcccatcattaagacattcctgaggctgcttggccataaagataaagagaatgcaaagacatgtccagactggcctggcgcctccctatctcccacccttctgacatgggttaaatgttaaccagatgctctgctgttacctccatctgcacatacac

SEQ ID NO: 18977 - DNA, 1515 bp, Mus musculus
agcctctgcttgcctgtctttgggtcattagcttttcccaagcagtcttgtcctagggctgggaaattcagtagttaggaccaccatccagggacaagtgccttattgctcattttttccatgtctttccaggagaacatctctggggtcttcaacaagtcctgtgccatcagctacacaagttacagaaacatcttccccatctgggccctgggccgcttctccaacctgtatcctgacaataccctcgccggccacatttgaacacgtgtgtgtctgctgcacctggccagcatcatcaccatccaggtcctggagagccccgtgtcttggctgggtgataagagccttcttagccctgcttaggcctcgttctctatttctgtagacaggaggctggggatagggtcagtgttggtgtctttagacacttgtcagtgtgcgcttaaagttcttggactagcttcagtgagaaagggaagaagatgagccttgagatccagagaggcgcagtggatggactcggaagctcctgggtattcgttctccccgagggagagaggctatagagcttctgtgatcaatgacttccctgtgagggagcagctggcttcttcactgcttcccttgttgattgtggagtgggcacttgagcatcttgtgtttgctgtgctgagggagttagagcagccatatggtgcaggggtgctcagagaaaggctcaatggcaggtgaggcaggtcccttactcattgtgccctgagcagtgtctggtgtccctagaaacttgctacccatgactacatcactatatgaaatgccagttattcagaaaggaaatacaaactggctttgtaccagaaatgctactaaaagtcatttgaatgatcaccgactcccttactaaacagaccctgggcgtagtaaagaacagcggctgctctctcagaggacctgggtttgattcctggcacccacctggtggctaacagcatgtaactccagttctcagggaacccaatgtcatcttctggcctctgtgggcactgcacacatggtacatagacatacatacactcataacatctatacacataaaataaatcctgaaaataaaatattaaaaacaaccacctgccttcctgagacatttcatcctggagtgtctatgctgagtctgtgtggcaaggagccagttgtagcatccaattctgcccccagattatatgcttatacaattgcattggtttcttacaagatcagcatcctgatgtccaggcttctcagtccttgttgagatagagacgcacacgtgggggagccattagggtagacagtggttgtaacggttcctgccatgggacagtgctggagcaaggacagctaatcatatccagctcaccacttagacacaccaaggcagccaggaaaatgcccatgacacccaaagatcgttatcagcccatatgccagctgtgctttgtgagtccaagtgagggccagatgtctgaggca

SEQ ID NO: 18978 - DNA, 3417 bp, Mus musculus
tcttaagttcctgattgtaactgtgtgtctggccagagcaggcagagttcagggtggaaactatgtgtctccttgaagttactgcctttctctctggccatggtgagcggggtccagctggatgcccctttagttaactaactctcggcatctgtagtgctttctgcactggtatctccaatcgctccctgacccatagtcttccctccgacaagcagaaagctgtgtctgatccccattcccctgtgcaggaccctctagggcagcctttggccatggtgcactttgtgccctctgcctgttgcccagctgccaccatcgacaccttgtgctgtgactcagggctttcctgccttagtggcccgtgctgttcacagcactgacttctaacctctgccaggagtagaactggtgaactcagctagatctgctcctagcagcagcaaccatcccttggaattcccggttacgaaccagatcactgtacattcccttaacaaacagactgctggcgagacgtgctttaggctgtagcaggtcatgctgtggagttctccggacatgctggtttaccagccccagtttagggagttctccgggctccgcggggggtgggggttggtggggggacactcaccagataactgtccagaagaagttcttaaggatgcttaaaatgaaagttggagcctgtcaggaataattcggaatgctgatggcttttcctgtggagtcacagcacatttccttggttaactatgatgtgaacctcaacacggttttgagggattctttagtaagaaatgttgacatttctgcccccccctcccccacgctgaagcagttttcctgtgtggtactcactatgacatgatcttcactacgtagtccaggatggcctcaagcttgagggtagtcctgcctccaccttcagagcgctgggatacaggcgtgtgccaccatcccctgctgaagggcttgatggttaagtctctctgacaaagtattttttccttttaaaatatgacttactgctaagtagaattgaatttactaagatgtttttatttaaataaatttttgctgaatgctgttttctcatgatctgttttaacaaatacaactgtatggtgatatatagttaatcagattgatttatttttaattagttaatttattaattggtttgagacagggtctcactgtatagctctggccatcctgggactcaatatgtatatagagcaggctagcttccagttcacagaagtccacctgcctcttcctccaagtgctgggattaaaggcatgcactacaatatatgactttcaacttgacttatttccatcttaactttattttatctctgtattttatgcagatactactactatctgtttttctaaagcttcagatgtttttattcaaaggtttacaaaaggaataaaacagaaaaagctaacaatgtgatcaaatgtacagttccaaaatggcctttggggctttaacagtgagtcctaggaaggaaactgcagtcatcctgacctcgtagataagtctcctggcaagggggtagtacccgtagaatgctaaaaattagctcttgatcatgtacttcactatgaaaatcttttttaaaaaatctgtataaaaggtctttataaatcaatttttaaataatggacatccactatgtgatatgtaactgacttttgttttatgtatagaggttatatttcccaaatctgacccagatgagtatggtactcagttcagacatagctagcagctgattttccccttctctcctgactgaattatcaacttcttgtctgaactaatgcaaaaacaatccagcagtgagagacctggaatgataaatgtgctaggtacacgatggagaggcgttcagtgtggactcccacaaagcagagtgtctaggatgtgtgggcccagtcacatcaacgcttcttaaaaggaaacaagaacaaaaccacatttctcttatgagtataattttcattaggatctacacttcccagtgcagcaaggatgcttgaaacgatgaaatgccaatgatacccatcatcaaagacaagcaatcaaggccaggcttaatggcacatgcctttaatcccagcacttgagaggcagcggcaacagcagacgaatttctgagttcagggccagcctggtctactgcagagtgagttccaggacagccaggaatacatagagaaaccctgtctcaaaaaaaaacccaaagccaaccaaccaaacaaaaagacaagtaatcaaatttaagaactaaagtcctcgaaagaaagaactgcttagccctagctctggagctagggggacttgcttgacagaaagagggccagcaacctgtcctagcacaaaagaaaaacagcctttgaggtagatagctgatcatacacagccaatcacgcgcacagttttggaaaacaacattgcttttaagaaattgttttgggtttggattcatggctcagtacttaagagcactagcttaattcccagcacccacagggcagctcacaatctactgtaactcaaattctaggagatctgacatcctcacaccaatgcacattaaataaaacagttaaaaagtattaaaaattgccttaataaaaaagtaacagtgaagtatctcatgttctgaagtagaaataattaggaatgagcaatgtttcaaaattgttttctttttcttttcacttgaacactacaaacattatgcagcaatgacaaataaagtgtggcactgcttggattcaagtcttccttttgcattttttgtctctgtgtgttattacatcaataaaattataaaacctaacgtaaaagtatggaaaaggcacatacattctcctaactgcaaaccggcctggcaaaaataagagtggagaagatgcaatgccgagaccaggtggacctgctggtgactttaaaaatgccaagtagagagagcggaagctcatgagtcagcaagcaacccttaatggttcttgccacacttcgactgtagggttgcttggtcagaggcaatactatgtggaataaacagaccaacctttccgccattgctttcgagttcctgccttccctcaaggacagtgacaggaaattataagcggaataacatctttcctctcttgctcctggtcaaaagtgtttttaatcacatccacagaaatcaacttgggacagcctgttaagaacaggttcttgtatcaaccgacaaagctcattggcatttgtgaatggatgcttcttctgaagctgtggagacttaacacactcaagcgcttcatcatcgttcatcatgctgggatgtgggactcttcaggaaccgaaaagtatgttcttgggccataatggagttcaat

SEQ ID NO: 18979 - DNA, 1231 bp, Mus musculus
gtggatcctgcagctcatggccactaagtaatagctcatcccctggacatggagaattgccctccccctactgcctcacacccatctcatcgcagaagaagtctgtgacgtgtctcccatgcctttttctgttccaggctgacgtctgaggtcaccgggatgggtgcactctaacctacccaaggtcctccactgcacacatcggatggctccagcccgcagcctcaccagctggcacactgtacagactgcctgtccttccttgcagatatgaatagagcgttttctttacaaacagatgatagtgcgtgtctgcccactcaggccctgtgcgctccgtgttagtgtagccctccacgcattggcatgcagctctttactttactgctcaacgtattcccaaatgtgatgtttcagagatttattcctcagtatccatgtgactgtctgtttaaaagttggtttgatgctttaacagcacttcctatgtcctgctgtcccttgttctcagagaccctcctctctcacccagtctactgactcatttccgccctaggttgtatgcagggatcagaggtacttttattgcaacctgcagggagtgtctggaagaggagggacttgggggtgtatctaaggagcagggtagagtgccagagggtggggtgggaccctgacttcactgggatatctcggggagggggcacttgtgccctccaggtgtcttccaagatggctaagaacaaggacttgccagaaagttcatctgcacccatcagagtttaataaatgtcgtgttcctcccccatggctctgacttctctctgctaccctgtcctcagtgcccatacccccctgtgagatgcactggtacccagcctgagaataagaagatctgggttctgttcttgcccaggtcctagagcaccaggtcccaacctgtaaagctgcccagcatggagactgcctgtgtctgacagggcaccatccatacagccttacaccacccaagggaccattcttcactgtcacccctcggcactgaagttccattcctcccttctcttagtggttaactcagagggccggggcagaggtgcagttgctcagggcacaactttgttgtagcccgtggcccagctgcaagggccctggtacctacccccaacctctgattggggggagggaggttcaggcaagaacggtatggcaggctaggagcagctcgtgc

SEQ ID NO: 18980 - DNA, 1176 bp, Mus musculus
catgggaaatttggctaagagcaaccaatgctacccatgtctttctctctccctccccctctccctttctgcatgtgcatgtgcatgtgtgtgtgctgtgttgtctttaaatctcatgctctctattcctcccagtggagtcctcatttccactgcaacctcatcagtgcccctcaccctccccaccctcgtccacactgctgcttcataagaatcatgtccaagctccacctgaatagtccatgccatttctagattggctctccaaactgctctcttaagccgttctaaagcctcatagcactcttgacggtaatatctagcaatgtccccactcctcagaaccatggtctctggtgagtttcccattaacagtgacctaagacgcatgggcttctaaaggaaaggcttattttggcccagagttctccagagttagcatcacatagttctccagagttagcatcacagttaactgtagctgcagcttctttgttcttaggactcaggtttttgtcatatggtggcagaaatgtgtgatatagccaaaccatttaccccataaccaagaagcaaataaaaggaagaaggatgagactgaactccgacactccccttcaaggacacgccccagtgatatcaaggcctccctctaagccccacctcttaaaactcccatcacctcctatattagagttacttttcttgctgctgtggtaaaatacccgacgaagagcaactaaagggaggggggcttattttggattacaggtcacgagtaccatccatcacggcgggggaggcatggcagcaggagcacgaggcacctgcttgcgttccatctgtagtcaagaagagatgagtgctgctattgtattcacgttctcttttttattcagtctgagaccctaggctgtgctatggtgatgctcatcttaaggcaatggtgtggtgagtgttcttataagagtatgtcttctcacctcagttgagccatctagacacctcctcacagacacacccaaagattggtctcctaggtgattctagatcctgtcaagttgacagacaaaattaaatatcccatctcctcaaagcaacacaggctagaagccaagcctttaacacacgcacccttggaggacattccaggtggaaactatcacagtgaattgg

SEQ ID NO: 18981 - DNA, 1240 bp, Mus musculus
acaaatgccaaaacactcaacaatcctatgcatttgggtgtgtccttatgatctagtgcatgcatccttagatatcacctatgtgaatgatgctcttgtcatgagttcactttggggtacagaatgtctatctgccctgttctagggacatggagttactttacatgtcaggagcccttggctgtttagagtcacaagctacccatcctgttctgtagcagagacctaggctcagcatctgctgatatggtctatctagatcagtctttcctgcaatgcttgtctgtgctgttggttcactatgcggaccactatgccttcccttcttccctgtttgcttatctggtattatcgggtttgctttgtgaaatccctccccccttttttatttatttatttttttttgagacagggtttctctgtgtagccctggctgtcctggaactcactctgtagaccaggctggcctcgaactcagaaatccgcctgcctctgactcccaagtgctgggattaatggcatgtgccaccactgcccggctcccgttttctaattcattactttctggatgtatgttgttcatgtgcctctgtggtttgggatttcaaatgtccagaccaggacagagatgagggtggaaggactattacttctctcggctttcttttccacaccttaaaaaacaaaactcaagaacatttcattattttcttatttgatgttttaagcttctcttgtacctagtctgcccaggccccaccaggatttccttcaaagtccttggttctttgtagtatggaaatatttaaagactgagttctggcataggggtactttttataatttactagtgcatttctgcttcgaggtctatagaagtcagcactaggaagtcactatgtatgcatacacacacacacacacacacacacacacacgagtcactatgtttatatacacatttaagacactgtgtacatatacccatgtaagacactatgcgtatacacacatgtgcttacatgttaagcatccaaatgtatatatacaaacatgcatgcatagatacagaaattaaaaaaaaacaacaactcaatgctacaatattctttctcttcctacaactccaacccctcaggtgacaatgatattctgagaccatcttttacttgttagtccctgtgaatctcttcctggttctgcttggtagttttcctgggtcaggagggtatgtgctcag

SEQ ID NO: 18982 - DNA, 1234 bp, Mus musculus
gagctttctgtgtattatctttgttgtttctctcactgagtttcaccggtgacacttttaattttagcattttacccagaagccttaggaccttatttttgaaaagcttatacaagaagagcttggttggttttaagatctaccttttcaaagcataaagtagtaacacttgtagaattctgtcctcattttccatccatactgtaattcaaatgtccttgtttacatttcccctgcagttctttaagtcttattatctcaccttagggcctctgccttcccagtatctcactttaggtccagagtgaagattgcctaagtagtctcaattacgggggtggggggggtggggggcatttatagacctagtttttcacccctggagttcctgttccttgtcatttcctgttcattattgaaccagttgctaagtgcaatttgctgtattatcccaccagacaactcttccaggcttgccaaagacatgcttgacttgttaatccatttgcctctccatagcatctggatccagccatagcttcctaactgaaaagcaaaaacaacttttaaaaaagatttatgttattttatgtgtctgagtgtgtggccttcttgtacatatgtgcaccatatgcatgtggaggtccgaaaagaccgtctgattcccagcaggtgtaaataaagtgtttgcatgaagatctgagtttagatgccagagcccatgtatgtctggacaaagtagccagcctttatctgcttttctatgcctgttatctgctgtaagagccagtgttcttgattatttaaggtgtcctgtggaacattcagccaagatcaaaagtatttaacaatatccatattatagtgttagaaaggaaatggacaatgactcttagcttcccatttcccaatgactcttagcttcccatttcccttcctgttaagactaaagaataataatatttggttgtgcctaccaggcctctaaaaataataatttctgacaagtctgaccctttgtttctatggctattgttaacaatatttggtacatggaaaaaagaaaattctggttaaaaggaattcacactaacactatattgacatctgattccttctataatataaatataactgattgacatctgattccttctataatataaatataactgcctgtttacttcctcacactgttctggtataatatgaagagaatagaagatatcaattt

SEQ ID NO: 18983 - DNA, 1489 bp, Mus musculus
gacataggcttgggtactctgggggatctttggggaattgataagtagcccttttatgttgaccatgctgtgagagaagagaaccagccatcttgagatctaccccagggcaaagcctgtgactcctcagtgtcctctggccacctggaggctgggtgatggagaacctcagtggaattccctaagtagggcaggggttgggacaagggtgggcacaaagcctgcagttacccagactctctttctttcagttccgtatctacttcatatacttcctgatgctgtctatcacctgctttgcctgggcggggctggatggcttaaggtactgccagcgtggtcgccaccagcccctggcccaggcccaggagctgaggagtcccttggagacttctgtgcaagcgataagcctacaggatggagacctaaggggaccgcagccctcagcgccacagctgctctcagaggatggcatggaggacgacaggggagacttaagagtcgaagccaaggcttgaccttcctagcttcatcccagttcagcggcgggattcctgactcagaggcagcccctcctgtttgcactccacctgaaccagcctgggcctgatgctacacacagtgctcccagtcgatgttgccttgagtccaagacatacagggggcccccgctgttgccttttaggagcctttaggttaggccacagaaccctccttaaggggccacctgttagcttatccttctgaggaccctaaacccagcctacttcatgctttagcaatggctgtagcctgctaccgacactcaagggcagctccctggctttgtgaaccacgtgccaggccactgcgagtctgggttgtctattgcttgccaagaagaacctgtgtcgggctcaactatgcccaccaggccattctgccttttttgctctgggaagctctgggcaaatcatgtctgccccttagggctagtgaggtagcccagatgccagccaaggtccgctgagcctgcagggtgccagttgcctgccctaggctcctggctatgctgccatacatccttccactatcggaggtgcttgtttaaatggttttctgatttcttttttaacttgacattaaaatggagaactaccttgggcttttctgttgtgagacactagagtcagaggagcactaggcatattcccatctgatgaggtagcggcagacttcagcccagcgtcctcccttgtccctcctgtcatccctaaatgacttgtcacacagcccagaggactgcaggtgtgccagccttgatcagaaccaaagtcttcctagaggggagtgcctgtaggggcttgcactgcggaagtgggtttcctggcttagctcttgaaagccatagctgtgaggttagactctgtggcaagcacacttttcccgatactttaaacggactccaggatgctgcggcttctcattccgtgctggcctagcctagcac

SEQ ID NO: 18984 - DNA, 2341 bp, Mus musculus
gactactcagctatactgctcagccatgtaaatgccaccgaaaagtactgatcctggaaggcagctctccagcatagcccttggtcacagaaggcacctgaactgttgaccaacagctggactgtcatcagaatggtgttgtacccacgtctctgcacctggcagccaagacacctgcttcaatgaccctgctctctgaagggtgacttggggagctagacacatgtgtctagtgcagtatttgagtcctgtccatctgcttttcccaggaggcacccgcgagggccctcctggcccctacacgagctgaatggctaagtcccagtagcagagctcactcttagcatgtatcaaggaaggcttccggaaagccagccctgaggtcctttggcccaggctgcacccctaacaccctcttcctctgcaaggctacacatctgagaggtggacctaagtcctgtaggtcacaggggccttttcctgtctcattgccctgctgtttccaaagacagcggctggcctccgtcttctcggccttagtggtgtccaggtagctgacagtctgtataccttgcaggccgcagaagagcgtatggcacggctcggaccccagtgggcggaggctgatggagagttactgtgagacatggcgaactgaaactactggggctacaggtcaggcctcctccctgctgtcaggcaggctcctggaacagaaagctgcgagctgccacaacagctacatcgtcctgtgcattgagaatagcttcatgacctctttctccaaatagggcctctgccagctagggtggcagacagaggccatgcagaactttgacacagcgcagggagcattcagtcagcacccagggctctggctgggatacaatcctgtatagttcccatttttatgtaatcctcaagaaataaaaggaagccaaagagtatatttttctaaaacatttacaacagacttcctgcccttcctctcccacttgaactggccagtctgtgtcacagtcccttcttcctccgtgcttggtagagcttcctggcgaagtcggaccacagctaggtctccaccggaggcgatgccctacagttgctgcctcagacctgcagactctatctagcctgggatctttctgtgcagatcgttcatacaacagtcacatgccatgtgctggggacagcacagggcaggcagtccaaggctcccttctcaccgcccagtggctgtgccaggcatataggcgggcacctgctcatccaggtggtaactgggtctactcatccttgagcagtgggaaccagctctcctgactgccccactctcctgcagccacactccctgccaggggaggttcccaagctcagtaactcactgtgaccccagatctgaccccccctcccgtcaccatgggcataggccaggaatgtggccagacttagcctgcgtgctcatttttccgagggccagacgtgacatggggcccatcctcaggtttgtctctcagactggcctctctggcgacccctgagatcctgttcagagaacccaaccccaaccaagcccaagctggacatcagcttgaagtccagaaatctcacagcagccacatgaagcacttgtcctatgaagggacttgtgtgcccagggtcacaagtggccaatcaaagccactgtgcctgcctcaggctctgctgtccaaggattgggacaatccagtgggtctggttctgtgacaatgtgtgctatgatgccatttcaaagaggcaccaaataaaaatgacattttataccaacgcttggtttataagctgccttccctgttacaaaaaggacgaatcacctgtgatgagacctgggagcctccgttcctgtacttgctaagggagctcagatgagcatggatatagtcgtgtgtacatggataccggcctgtgtgcacacacatgaacaggcagatacacgtgtatgagtacactgatgtacatggtcaggtgggtatatccactgttttggatggatacagactgcacatgggaccattcatgtgtgtgtgcacaggtgtacagtggcatgcatgaatgtgtggtatacagaagcatgcatatataggcaggtatgtttgtatacaaaggtaagcaggcatatgaatgcacacaatgtactgtacacacatgcacagatgctaacagtaccctccacctggtatccagcagtgcacatgtggtgacttcagaatcatgtagagggggctaggagaaatggctcatcaattaagactactcggtgatcttgcaggggaccagcgctcagttctcagcatcagcttgg

SEQ ID NO: 18985 - DNA, 1231 bp, Mus musculus
tataggtaagtttctgactgataaaggttgctcatcatttaggccttatctctggtgacttagtggttatcaatgaaattaagcacgcaggagccagtctctgctagtctgtaatacagcagataagtgggcagtgggctgtgtacctgctgtgcctctgtcctacggagggtggggcagccagggatggagagtacctactctacagccagggtggaacagcctgagctggcccctgtctctgctcacaggaaaagggatatcaggggctatcttgggggtctgctgggatcaccgtgcctgagactcttctttgatgctctaggctaagagagcccaggacagggttgcttgaaggttgtcactaaagtgactggtctcatccctccgtggactctgcctatgtgcgctttgctgtgggtgtgtaggccacagactagaggttttcttgcgacgctgcttatgatgtgaccattcatgacctttccggcagctccacctggtggcactgaacacccccctgtctggaggcatgcgtggtatccgtggagcagatttccagtgcttccagcaagcccgagccgtggggctgtcgggcaccttccgggctttcctgtcctctaggctgcaggatctctatagcatcgtgcgccgtgctgaccgggggtctgtgcccatcgtcaacctgaaggtaggtgaaacctgtcctgaaggttctggaaggccaaaagtctgtctccatttgtacccaggccttggtctccaatgtgaattcacagcagggctaaccattcccctaatattccttacaaagcccctcggatccctgcccctcccagggccctggctcctctccatgggcctttctaatggttcctgtgctactgaccatatagcccaaagtggcatggagtcatttatttgtgccacctagcctggcccttccgccatgggacccatcacgtgactctattcttggatctttcctataaagagagctgggattctcagggcttacagaccccacagtctcaggcttgtaagggtacctgtgggtttcactcactgtgataggccctaccttggagaagggactctctatgcttcagccccatgtgttccttggtgtcttgtaatctccctgacggtcattcctctgacctgatgtgatgagtgactgatgcccctgctgtgtttcttgtaggacgaggtgctatctcccagctgggac

SEQ ID NO: 18986 - DNA, 1191 bp, Mus musculus
atacatacatctgattggttaattaagctttaagagttttgatttacttggttactggaatgtgggactgccggttataggggattacagtggagagggaactagtggctctcgggacaagcgagccagatgctgcgggggctagcctcagagagttggcaggtccatttttttttaatatttcccgaaacactgcacagacctgctataggcaagatattctatcttatctacccagatgacggccctgggggcaggctgggccctgagggtactgggatatgccatttctattactctatcgcagagcactctggtcaaactccccatagtagaccaagacccccttgctgcttcttttgtgtgggtatctgaagaccagtggctgagccctgacctgtccttcctgccttgccattccagggtgagaagggagagccaggcactatctttagtcctgatggcagagctctgggccatccccagaagggagccaaggtgagaatgagtttggggttccctaatactatgaagacagcatgagtaattgcattatcccttgttactgttagctgatatcacctataggaaggttagtgatactgaccatggcccagtgtgctccgtcttctgctgggcctttttctatggaagttagaggggaccaaggcctgtggcctgcccgccatgggcaggcatccaactaccctgggtaacagatatctagacctcccccttcctgtggacctgaatctgtaggaagctgagcacaagaccgtggttggctcgctaggacttgctcctcatactgtctttggggttcccacccctgcaggccttccaagaaggcactgggggaagggccttggaaagctttggtgcctctgaggaatagattcttcctggtttacagtgttgttagaaggtgatctaataacactagattccccaggcccagagaaccttctgctctccaaggctctagagctgaataacacctgagtggctttagctatatgctttggatattgaacccactctcagggacttaaggaccattcatgtgccttaagttagacctagtccctaatgctagtgtccacctgtcctgctggcatggttatccgccttggttgtcagcctagcacatccacgtgggtgcagcaaggactctggcagtcggtaaggtga

SEQ ID NO: 18987 - DNA, 1214 bp, Mus musculus
caactgtggagaaccagagcgagggtttgatatcagcattgaaaccataacgatcgaatgaaaccagaaaaagctaacttgggagcctggctatttgagtctcctgagtttgatgtatcacctagctggctcccagagtgggagtagcgtgtgctgcctcctctctctttgtagtagagagaggtcttactccacatctgtgcttttcctacagagtctaggtctggagagtgggagactccacaccctgcttcctcacacccatcgcccatcttgagattgctttggcctgtgagcccatgggggtggtttcatggtctgtgtctcccagaatgccactgtgttctggtctgatcctgtgtagccacctcactggatgtctttctctttgcagagaatgttgctgaggaggtggggctgctgcagctccttggagaccccctacctgagaagatctcacaaatcgatgaccctcacgtcgggccggcctacatctttggaccagactccaacagtggccaggtggcccagtatcatttcccaaaactcttcttccgggacttttcgctgctgtttcatgtccggccagccacagaggcagcaggggtgctatttgccatcacagatgctgcccaggtggtagtctcactgggcgtgaagctctcagaggtccgagatggacagcaaaacatctcattgctctacacggagcctggggccagccagacccagacgggagccagcttccgcctacctgcatttgttgggcagtggacacacttcgcgctcagcgtcgacggaggctctgtggctctctacgtagactgtgaagaattccagagggtgccatttgctcgggcctcgcagggactggagctagagcgtggcgctggcctctttgtgggtcaggctggaacagcagaccctgacaagttccaggtaacctgtgctgccctactgcatgctgatccaggggaggagggggcagtggggactagagaaaacaggttcccccagttgatgctgaagcctgtgggcaacagcccagacttcccagtttgtgggtggagtggcatctgctccccaacttctgttgtttgatgacttgaaacatcacagtgggcttgtgtgaattctctgagaccccaggttgtataagagagctgctagaggctgtttctacccaggctcccattctgagttgatccagacca

SEQ ID NO: 18988 - DNA, 1192 bp, Mus musculus
tatgacatcactttagggtctttcctcgaccccccctcctccctgccatggagctgagcccccactactcaaacatgcaggagtagggggcagggttctggacttcggccctgggattttccagagatactctgaggcatgaaatcacattaggaaatcttcaagcacactgttcactgggcatttctcaagcagacgcaatcattgtggggactaacttggagatgtagagctcacaggcacagatgtgggcctatggctgcctcactcttagagagggacttggtatccagctgtttgcagctggactctgagccaaacggcacagccctgccctttagacaggcattgattgatgttgatgtgggacagttggggacatgcctttgtggctgtttcatcacacagaagcattgccactgcagccttgggggagggtggcagtaactctgtccacaccacagcttggagaaagtggagccaggagggacagctggctgaggctgtagcctggtacatgctacatccatgtgtacaagctggttacatgagtgtgtgtgtatgagtgagtatggtttttgtgcatgcgcaggctgctagcttctgtttcttctgcctctttgtctgtggaatgggcgctcacagggcctcacctagcatgtgcctgcctggctggtgttggggactctgctgggcttcatggctttgggctgtgtgttcctgtctatcctggttcttttgtcactggggaaactgagggaggaagccacagagggctgctggagtggagcccagtcctgctctgagttatgaatggaactgagggtagccagccttggcagcagcttccccatagttgatctcagtgtttccaccttcctgcctggtggccattggacacttcttttattgtcttgtcttttccctccctctctccctctctccctccctcccctccctctctccctccctctctccctctctccctccctcccctccctctctccctccctcccttcctctcttcctatgtgcattgatgtttcgtatgagggcgttgggtcctggagttacagatggttgtgagccaccgtgtggttgctgggaattgaactcaggacctctggaagaccagtcggtaaccttaaccactgagccaccctggacacttgttttcattgagatgttttgg

SEQ ID NO: 18989 - DNA, 1143 bp, Mus musculus
gtgtaacacggcctgtgcccacttctgcttcctcccacacctaaggggacctttaaacatagccgatgcctcgagctgaacctgttactagtgatcacacgggctgaatattaatctgatctcagcctgcgaggctgtggtttggcctgatttttctgttaggcagaaccaggccacttccctgaggtacctacctgccccagagctctctcccaaacctgctcactttttcttagtagcaccccccccccaagcctttttcctgtaagtcttggtgacctccatgtggttggtgagtcctgttccagaaccagtgacatccagttgtgtcattgcctgcacttgcccacacaggccaagaacctcaaatgacttggacttccacttgaatacttgtatcactatcaaacaaagcctgcagctacataataaacccgtggaagaaacacatgtaccagggatgggagactgcccactcgccccagacttgccagggacatttctgcatgtcatctttcttatgaaaaaggaaataaatgacccaggactatctgtagttatatgacgtgtgtgtgtgtgtgtgtgtgtgtgcgcgcgcgcgcgtgcagttatgggacttgtgtgtctggccatttggagacctcttgtctcagtctttcctggcattggctatgaccacaagaattagtgaccatgcattcccctcagggttttgtcttctgcaagcgaatgtgaactttaggatggcaaatgcttgcttgaataattccccttctctacaatcacagggacccctaagtctttaacggggcccctctggaaggtggagccaccatgtgctacccagagtccaagctagaggattcggttcctgagacatttgtatgcacagttgatattaaatagttttatttacttatttatttatttgtcttggtttttcaagacagggtttctctgtgtagccctggctgttctggagctcactctgtagagcaagtctggcctcgaactcagagatctgcctgcctctgcctccagaatgttggaattaaagatgtgcacccccaccaatagttaatattttaaaagttgtacttttgccaggattccagatgtggcccagatgtccacagcagtcca

SEQ ID NO: 18990 - DNA, 1166 bp, Mus musculus
tgaattctacaaacacaactgtgtggtctgtcctcctctgggaaggaagaccatcacttgtagctcttctagctctctagtagaaccccatcctgactgtaccaagcctttagtgaatctctgcagagtcggggcaacaatatccacccacaaggttgagtgctggaaggccacagtcctcaccgatccatttattattccttgtaggggatggcctgtcaatccctagaaggggccatccctcagatggcaaaaaaaaaaaaaaaacccaaaaaacccaaaaccctaggtcttctatcactgaattctgggaggccaagttagccatgcacaggggatactgtgaatcccctgaagtaggaacagggtagctcaggatgacagctagctacctggtgaaatctgagacactctagactctctgagccttgagctttgtccccaaggttccggcaactttgagacagtgtcacattcaggaggccctcaggggctagtggagcacttagttatgttgtttaggattttccctgtgacccctgtcctgcccttgctagataaggactcctgcaggggttgtcaccagagacaatccatgggaggatcctggctgtgatgggattcagcccctgggcactataagctaagatgaccatggtggcccattaaacagcgaggcaggctgtgtgcagccagatggccaagatcccacacgatgtgggagaggcaagaacctccgacagccatccatcccaggggtgttcagctctcctgtcctgatgaaatacacatctcccttggagctcagggaggtcaggttgatataggatgaaaagtcaggaatattagggggcatgggataggggaaggaaccgtcactgtggagtctgtctgaagcctcttaccaaatgagaattctagaataattagcatcattctccgggaaggctgataactagggataatgttccttatgtagaatgagctttcatgttaaaatggcagcatgttagaatagcgatctaggactaagtccctaatgtccttgggaaggacccccttcagccacagacactttgtgggaacctcacaaacaagcctgttaaccttgtttacattggagctctcctggcttcctgcattcctgagatctagagttttaacct

SEQ ID NO: 18991 - DNA, 1491 bp, Mus musculus
taggtgtggcgagcctcaggccccagagtttcaggagagtcacatgacatagcatgccagcgttcctcttgaatcagttggccacttaagtgccatcagagggccgggatataggagtcagggctggctgcattgctgtcaccccaggaatctgaaggaccttggaaaagggggctcccttagctatggcagcatgcgtgtggatggtccctgctgttgtcagggtgccgaggtggacacaagtccttggtgttagttgaacagccaggtgaaggtctgcaaggcacagtggccactgaggtagggactgacccatgcaggtgccagtgctgagggccccagagcctctggtgggtgggtgtgaccgatgcctccactgctggtcccgggtaacgtctccgtctcgttgctctgcaggttttttattggcacctctgtttccacattttcctttcggattcatgaagagagagagatcctggggttggaccccaagacaacatacaaccggttttgtggagaccaggagaaagcatgtgagcagcccacacactggaagattgcgtactgagggccacctatccaccgcctgccaatcactcggtcacagggtcccagaggaggcccccacatgggaggcaacacatctagagcccatgctcccacgtgtccgtgggccgacatctacctgtgtctaggctctgccaccttcaggattcacaactgtgtcttctctcaggacctgagaacccacgtccccatcacagatgtcacatgtgtgctagtccagaaatagaagaacatttgtcagctccgacacaggcctctcagccaccttcctgaacaagttgagcatggccagcctgtggcaatgccctcaggtgtggatgcgggctcctgaggtgttggggtgactgacgactgaggtcacttcacacatggccagcgtgagccgacaccaagccttgcctcagcctccacctgtggggctcccactaatttcctcctggatggaacgactcgggcactgttgtcatcagagtgacagccctggagccttgccagtgacttcctcgcctcacatggacccccaggttcactgcacacgctgagaaatagaattgagaagtaaaggaaatggccttcaaaaggccacacctgagacccgcccctgctttatgacacccttccctgggcctcatgctgtaccacaggaggcagagtcagcacagccgtggccagggcacccccaggtccctgacctggtacttagcagtgcacccctccccccagtgctgtgcactgagcagcccccactcagctactgccaggtctccgtcccaagcaccaaggtagactctgagcacagacagggccccgtggcccagtcagctgaccagctagaatcacatatttattttccatttgtacatccaagcgtattaataaaatactttttcaagaaagctgcagtcctagaaatggtgtctt

SEQ ID NO: 18992 - DNA, 1175 bp, Mus musculus
aactgtttgccttcagccaagccgcagcttcttgtggctctgacctctctcagcccaggttactcactgcctttccctgccctgctgtgaccagagaagcagatggtcccgcctggaggcagaacagcccagcccaggagcctcttggttgggtggcaagaaagacctgtgttagacactagtgagttctcagagtagcacccacaggccccacagctcatatggacccatgctccaccttatatctgggcgtgcctgtggcactactcaccctcccacccccttaccctctgacagtgctcccaagccttttacaagggtggtccacatactcatggctccttggccctgtgagtggagagcaggcagaacaggtgagccccctaggcctgtatggacacccagggcacttggtgaatggaagtgggtaagactgaataggcctaaactgggtgagacagaggcaggcagatctccaagtacaaggtcagcctggtctacagatggagttctaggacagccagagctacacagagaaaccttgtctttaattaatttaattaattaattaaaatagtgaattggcctggacacagactcaagttcccttcgtcagaggccatttcagcagactgctgagacactgcagctaccttgcttggggggcaggacaggctctcattaagagagcctaaacctacctgtggtgcaagcgccgtccagtgtgcctggcacagcttaggaagtttccaccttccttgtgttgtgtgtattaagatttctatgatgtggcttcaagcaactctggtctggccatggcgagcaccttttcagtatgcctctgctggggaacgtaggcccacccttcagggtcctacttgggagagcattccacaggccagcttcatgtacgggtcagttacagcaggtcagggggtcacaccaaccgaggacactaacgtgcagtgagcaggagaggagccaagcagacatcactgggactacctcagaatctgtgcaaaatgtggtccgacgtaagttatgtgtctaaggcttggcagagctgcacagctggccagaggctagacactgggcaggcagggctcgccccttctcacctgagacaaagcgtgtgttctcatgtggacggacacaggaagcagatcccaagaaag

SEQ ID NO: 18993 - DNA, 2021 bp, Mus musculus
ctgggaatgcactccccagcagagcctgcagagacctcaccaccatggccacccttgacctgggtgatccctccagcctctactggcaccagtgtggccttaagaggacaatcctactcttgttccctctgtgtctgtatgtaatcacctgagaccttaatctcgttgatgtcctttttggggggaggaagtatacttggtccccacactctgcaagccgattacgaagctggcagcctgaggtgctgactagctgctgagtggccttgctggaagattcacattgcaacaagcaagagtcatgtttactttgttaaggcaagaactgaccaccacccttgcttcctgaaggctgtgttttgtctgtaggcccactgctgtgatgggcccttgttgttgtaattttggtggcctcttggaaggcactgtccctaagtctggtaaggattgccttcctaacccagctccatccaatagcacaaaagcttataaagtcacctgaagtctttaataatccctcaggaagcagtcctaccaaaacctgccatgagacgtccaggcctcttggatgacatttttcattttcagtctttactagactgagaatttcctgctgtgggaaacctgagctctgaatttagtttgatcctcttgtgagtgctgaatgtccagcatgctggtgcatggactccagtgtccttagaagggctttgtggagggtcttggacatctccctccacagatcaggcagctgttgagttggtcctgtatgtatcatggaggatgaacagcatctccactggccatcccattgtgggagctgagtgtgtaggaagataggaggaccccacaccattctgccttccaggaaaactgcctgagctggcatagacacccacctcacttccaccctgcttccagccatgcctcctcacctatcgtgcctgacacatccgcacgggccctgggaaggttgtcaggagacactcgggtccctgagattccgtccacgctgtacatttctttgaaatccagatgtgtcctagtaagcagatcacaaccctgatggcagggtaaggagtaaagatattccctctgggaaagcagccaccagcagatgaggtggtcttactgtaggctccctcatgcctaagacctcacctagcatctcggtaaccttttcacctgtcagtctgtccagggattaatattttcctctcttcagatttccacaaagtaagggaataacctttaccacaatctggagtcttaccatttttctgctttgctaggcatttgatggaacttaaagccttgtcaaacatttcttaagtattatagcaggcattgagagttatctttctcctgtctattgaaagggaaccctccttacaggccctgatgaacttcgtattaatatgtcgcctgtataaattgtacctgttaggttgctgagctgatgttagagtatttaattctccagcctaaggagtgcagcaggtgctcgtgggagtggtctgtgcctacctttgagcagcatgaagccacagaaccaagcctgacaccatcacaccccgtgccttagtttttaaccactgtccaataaaatggttgaatatgactttgatttctttgttttgtcccaagggtggactggggctgtggctttccaggtaaggtggatttgccctgtcatctgtgtaccatgttccacagggactgactaggccagtcctgaagtggtcaccaccgtctaccctccatgtagaaaggttcttattgtcatctgccctgtccaatcccaccccaccaagctcagcattccatttttatactggtacaaaggtggccgggccgaggaagtggctctgcatggctgtcagctgacactggcccctgggtgcccaccatcggcatggtaggtgtagcatagataaaagtgtaggtgttgccgagtctgcctgtgacctgctgttggctgttgactcccagggtcctttgtcttagctcagcctggctgc

SEQ ID NO: 18994 - DNA, 1185 bp, Mus musculus
agccctccttcttctgtatttacttgctaattagagaactccaggccagagcccagccaggcatccttccgttggagggaagcaagcctgaggcctttcacctctgtctctgtttttgaacacacacatcctttcgggaaccgggttagaagtcagcatcttgggacctggagtgattcatgcttctcactagcggactttactttttctcatattggatgccaccctttggagaagggggcaagctctgtggacagtgctgctgtgtcactggtgtcctgggagtgagtgggcaggggaaggggaagggatgatgcctcaaggtgtgccttcaggttcttgatggagcctctctcctgccgaaccatttctcagactagaaggagccatgctcctacctaaagctgttaggacccagtgcagggcaggttgctttctgcaccctgcacccgagcttcctgacactagtctacctctctctccgggaataaaaatgttgctgaggacacccctgggaagcagggtgcttccatggagcatgctctgtggaaccgtgggggaaaagaaggctggcgtgaggacagggaaaaagcttgatctgcaagtagagcaagggatctgtttcctagaaataaatggttctcgagagctggagagacagcttagcggttaagagcactggctgctctccagaggaccagggttcaattcccagcacccacatggcagctcacaactgtctgtaaccccaagatctgacaccctcacattgacatacatgcgggcaaaacaccagtacatataagatattaattagctaattaattaatgattcccaaggctggaaagacagcagttaggatcatgggccattctttaagaggacctggttcaagtcccagcacccatgttactgctgacaaacatctgtaactccactcctagaggctctggcaccttctctggcctccttgggcactgcctacatgtgattcacagacatacatgcaggcaaaatactgatacacattaaaataataataatgaaggttaagaagttgccatgaattctttcatccactgtggctaaaataagcatcccacgggccgaacaacaagaggagttccttttcgaactgaacaatccaaattggcccagaacaaactttttgttcaaaatgtgtt

SEQ ID NO: 18995 - DNA, 2033 bp, Mus musculus
atcttgtcagaagtcgggtggataaatagttactgtgactctacagtaaccctttttctcgcatgctgcactccagccaaggtgactgggctgtgtctagtgtaggggaagctgtttgggagtgtggtatcagtgtgaactcacttctaacatttcctgtctcctctccgggccctccttgtcaacttgactagctggagatggaggatgaggacaccattgatgtattccagcagcagacaggaggatcagcctcccgagggagcgtccccacacccaaccgttgtcctgacctgtgctattgagcagtgaccatgcagccacacccaatcacacaagagtcagcagaagccagagtcaccgaaggattctccttttccgacgcgcttggagtgaactacacatagaccacactgcggggcgagagcattacataacatggccactaggagggtttggtttgggggaaatgaggtgtgaggctttggggtttgtttttgttttcatttttgttccctcccatccctaacatttttttccccaaacttgggtctggatgtagattctcaccctatggcctgagtccaatccctagaactgtggtttcctccagtgtgacttgtcctgatcaggtagagagagcttgtggtcatattccccaatgggcatgcctgtgggatgtggggaggggcagagaggcagaattccacctgttcgttgtaggcatagaatattaaaaaatgtgagatactgtaaatttgagctttgtcaaacatatggtaagttaaaggggaagaccagtgcttcttaagacagtgaggggtcttcctcctgtggccaggcgctcctgcacgtgcccacttcctgctcggtactggtactgggtacatgggtaagggtggtacagtgaaacccactctctcccctttttataatgtagaagaaagtaattgtcctgtctcatttgggaattgaatgtggcctcagatttcttctagtacttgttttcgatacataattatggtttctgtataagaaggtattggttaagtatcacgttttcagccatgttgtgtaagagacctgctttcaagtgtggttgtaaaagcaagcccaggaaaggtgacctcattctcacggactgtgctgtgcagctttccaagtgtgtattaaagtgacgcatcagtgggtagcttgggttccgcattgtggggtcagttcaatgtccatagttcctgcctgccatccttctgtgagggtccattgctgcttgatggccatctctgccttttatagtcacctgacactgacctacatctctcgcttgcttaaagtcttgaggaaaatgttcctgtttgctgcgtgggcctgggtgggatgtctgttggctctgttgtgtttactcaccggtttgtacattatctgttgtcctttactactgtaaacagtaaatatagtttggtattctgtctcttggcctatgttaaacactgtatttggagacgggtcatatgtcacagcccactgttgacagtctgtccagtgaggccacttagatggacagacaaggcagttgcttagcttgctctgtaccatgtgccccacactggtccagctgcctgcctgctggtcctgactttgcacataccacttggctctcctcccctaggtgtgtgaagataaggtgggctttagaggcagggtgtagtgtgaagtatcagtcagttcatgacctacttactaatctgctttgacatgaattgatgctaatttggctgtgaggggtttcagtacttaggttagataaaacccagggttgtcattgcctgagccatgttagtctatcagtcgagcacaagctccaagcacctaattcatccagcaggaatgtgtgcattaaaatagaggacagagctctagccattttctaggtctctcagaagtattagttactttctcagtgctgtcacagaatatgtggcaagcagcctagaggagcaggagtttatgttggcttatggtttgagggtgct

SEQ ID NO: 18996 - DNA, 1616 bp, Mus musculus
tctacaagatcgccaagcagattgtccagaagtctctggggctctgaggctacccctgtgcacactgagcactctgctcgagaacctgtggcgacagcgctgccatgccaacaccaacacaggcagtgcagagccacagcccccgttgtttcttcctttccacccaagccaggcagctccctagatcatgactgggataatgacagctgctgcgctgctaaagactcctcctgctgtgttgtgtgcgcacctcagggagggcccaggctgtcctcactacctctctcagccatggggtcctcacctctgctccttcctgcagtgccgagggcctgtcctgttgtctgccagggactggatactaatgctgctccctcttgggacatggggccttggaaaagcagtgcaggcctgttgtccctgcctctcagttcccaggtgtcccaggaagcattttgagcttcttttgacactttgcacttagaagcctaggttgcctttggcatggtgacagaagcttgctatatgagtcacagatgtcaccatagccccttccaggggatgctttgtaaatgggttcatgagaagaggggacatgggtcagcaagactgctgctttttctggttgcatccatgtctgagttagtggtgcacactcgaccgacaggcgggactgtcagagctttagtgtgggtctcctgggggccctgcatacacactgcaccagggttagctcttggattagattgttgttcgctgtcagggttggagggaatctgccactgggtgctcagcagaggagctccttctgaactggatgggctggggagctgctatggtgcaggccagggtggagggggtctgacagcaggacctgctgagccacagggcccgagccgaccccacaagcaataacagatgtggagtgcggtggatgcttggccttttctaaacaggttacatttaaacacgagtttctatttttaagatacagcttatcagggggtgtgtggccgatctcactgcgcattgtctgcttctgtcccatgcccacatgtcagtggccagcactgtgcatgtttcatggtgttcatagttcccagccctggggctccagggggcacctgtgggcaccttgtgctttccttctcgggggagcccagtctgtttgaaacgcaacagagtctggtgttgggaggtgcaggaagggggttgtaccgaaatagtattgcaggccactgagatgaaggcctctctgtaaggaagtggtctgtgtggggtgatgtccacacacagagtggtcacagggcatgtcgctgtcctcaggcctccctggcaagtgcgggaggaagagaggcagtctctttgcaaaacaaagtatttttattcatttgtatttattaaatgaaaaaaaattctctgttgtccctcttctgagatggactttaattgctgttaaataaaattgtgtacctgtcctcacagtgttgtgtggtgctcacttggaatctctgggaacctgagtgagccgaggttgccttccggggctggttggaggtagcccgtgctctcttgctccagctcatgtttccttctctctcctatgttctttcccg

SEQ ID NO: 18997 - DNA, 1166 bp, Mus musculus
acatgcttcagagtgtctggagatgtgtcaccccctcttctggttttcaggagaggtcctgaggttgggtgtgggttcttcttggtctgttcccactggggtgtatattttcctcccttgtacatcagctctgctccggtacctgacccaaggcctttctcagcacaggtgcccacagctgtgagtctctcccactgcagagcttgtgcgcctacgcactgtgatggtggagggttagtgtcacctgacagggtttggcatcacccagggaactcgcttctggacatgtcagtgagggtgtttccatggaggactgactggggagagaggagccaccataaatgtgggtggctccattccatgggctgaattcttggaatgagtcaaacaagaatgagcgagctgagcactggtgagcatctctctgcttcctcactgaggatatgatatggcagctgttccaggtttaccatgcctcccctgccatgaaggacgatggcttcttctgttgtggatatctcctgattacttctgggctgttgacttctcctgtggattcaatcaccttcaggtggatagaataaattaaaataaatacaaataatccagaataggagaaaacaaacaaacaaaagaatgccctccaaaaaatcccataagaaacatatacagatgcagaaatatatttctgatatatatcagaaagaaaaatgccaagacaaagcattgtctgagtagtgttcatggtactgtcatgtgtgttcatatgtttacacgtgtattgaccagctactgctaggcacggggcctgctcattaagtttggtttgtatatccagtgagatcctattggataaaactattttttttcctttttaagtggttatcagttggagttggggggggggggggaaggtcacgtctactttccctgtcagccctggcaccccgtgtagcttggacttgtgcaggctctgtggatgccaccttactctcagggagttcatgtgtgcatctttcctgttgtatatagaagaccttgcttccttggtgtcctccatcccttctggctcttacactcttcctccttcctcttctgtagttccctgagccctgaaggggaggggttagatggagacatccatttagggttgagtgtgccaaggt

SEQ ID NO: 18998 - DNA, 2105 bp, Mus musculus
catggagaaaggactgaggcccatcttttgagttctcacctcaggaggatggggctgagacccaaacctggcacttcaactctggactgagacctcctcttctgggaggtggtccaagcctctgtcattctgtgactatctcctcctgtctagtgtctagaccctgttgtcacatggtggctctcaggaggcctgggggtggggccattccctatgggtccatttctgacccctgggatggcttctaggcagcgctctgaggccctcaggtggccatgctgcttgcaaggatacacggagacatggttcatgtggcctaggatcctcccccccccccccccccccccgccattgtgtctagtctttggtcagctccagggacatggttttgactgtttccagggtggtgctccaacccctttcgaccggaactatgggaccaaactgggggtgaaggccatgttgtgggtgtctgagaagctacgtgatgtctaccgtaaaggtaggtgggtggactggccggacctggcgctctcggggtctctagaggcttggacttgctaacatgtacctgttcccataacagggcgggtgtttgccaatgctccagactcagcctgtgtgatcggcctgcggaagaaggtagtggccttcagtccggtcacagaactcaagaaagagactgattttgagtaagtccttgtggacctgagtggagaagggaggaccctgggaggcccagaactttccaggacagggcccctagcaggctttgaagaacaggagtcttgtccatgcgttcaatggccagcacagggtggtctggggagggtttgtgactcttgcatctgagtctacctcagaagtacttcccctcactcccagccagaggaatggggcacccagatgtaccctgtataccctggtcatgatggcgactaggtattcggggtttaagggatctcgggattcagttctgtaactaactatccaaccttgacctgcgcaggcaccgcatgccccgggagcagtggtggctgaatctgcggctgatgctgaagatgctggcacactaccgcatcagcatggcagactatgtgtctggggagctggagcacgtcacacgccgcaccttgagcatagacaagggtttctgagcttactgtcactactgttcctgcgttcccggactctcaccctcccagtgctagccacagatcccagcaccgaggggaactcaaggggaactcggagcccgtggctggctgagggatgtgggggtctactgtgctgctctggggctcttcccttagccctccccccacccccaggacagagagcctgtggggcccctaccttccagtcagacccacattgcctctccctcactggccagctggctgcctcaccacacggctgaaaagagcctcacttttttagaaataaagtcacctgtctagagcatggtcactgggacaacatgaccagaggagtccagggagagggttgtcaggactcaggtgcaaaccttacccaaggctatagtttgtttaatttatataagtacactgtagctgtcttcagacacaccattagaggtcatcagatcccattgcagaccgttgtgagccaccatgtggttgctgggatttgaactcaggacctctggaagggcagttggtgatcttaaccgctgagccatctctccagtcctgcccacagctattctacaagactggaatttagggaaccctcccgggaagagactagggagacctgagcccttagagagctactgaggctcgtgtgagccccatacctgccctggaatggctggggtatcggcctgtgggcaatgtgccccggtctggagaggagactgtcattgtcagtatagtgttcttggctgattgctgcccttcaggaggttcttgaggtcgggacgttggctcctcagagaagtttatgaagggctgagccctggccagccccacctcagatccctctctaagccccttatcagggtttcttacgtgagctgctgctgggtccatcctctacagtgcctggatttttacaatatttacaataggtggaggctgttt

SEQ ID NO: 18999 - DNA, 1208 bp, Mus musculus
gaggtagttccaggacagccagggctacacaaaaaacctgtctccaacccctccttcctcccccccaaactgtatttacatcagccacactaccatctaatttgtgactaggctaagtgttcacttaccttgctggaagccctgggttcattcccagtatcctataaactgggtgtggtgacacagcctgtaatctctgcattctggaggtagaagtgaaagaatcagaccatcctaagtgaagttgaagccatcttgagatacacgtgcctttgtgagaaagagaaagaggaaaatacgtgcatcctttagtgggcactccggagctccctggccaatgatctatttctctggattggccgatttgggcatccttggctttccgtggggattttagcctcaccatgccaagtctgcaaaaagccatctgggatttggtctacatttcatttggggcatcttgtttccccactaaatcttctggtctatgaccctgacacatccttgctgggtcttcccacatctccctcaggatcttcgggttgctttggctaagcctcctcccagctttcccctctgttctctctagacatctgcctctgctgtggaactctccaggtgtacactcggcaccccttgtttgagggagggttatgtgccccatgtaaggtaagtagggaggtactgggactgtcgtgacatggcactgtagaagggacatcacacactcagcctttgctccccgctcaggataagttcctggagtccctcttcctgtatgatgatgatggacaccagagttactgcaccatctgctgttccgggggtaccctgttcatctgtgagagccccgactgtaccaggtgaggcagggcctaactccctattgctcctcccagaagctcccaaaagaaccacacacacccccaatatgggaggcgggtgctgaaggatgcgcatctgggatgcctttcttcacaagcactgcagccaccattcagccattccctctgttcttaagcaatatggtgggtccagggaataggcagctcattcacccttagttgttaagcctccatcctgagctccatccacggtggtcccccgctctgtccatttggatatcttcctctttacagccctgacttctatctgcctcctttccagccaactgctcttgtacatcttttttatcctcagagacctta

SEQ ID NO: 19000 - DNA, 1146 bp, Mus musculus
atgggatcagatgccctcttctggcacatctgaagacagctacagtgtacttacatataataactaaatctttaaaaaagagaaggaaaaaagaaaaaagaaatctcttgaagcctatgaagacgttgtctttttgttgttcttgttgttttttcaaggcaggatttctctgtgtagccctggctgttctggaacttactctgtagaccaggctggtctcagacttagagatctgcctgcctctgccttccaagagcttagattaaaggcgtgcaccaccattggctagcaattttctgtcttttcagagttttggaaagttatgttaccctagaatatgactcatttcaatggcatttgaaaagagttgatcaaagtggtctccagattttacttatttgtagttatttaaggaaaaacctaggcctgtggatgatgttcgccccatgggaggagattgcatttgtgtcatgctgacccacggccccctcttctcccacagacagaggctgtgaccctccaggatgtccgtggcagagactaccagaatgctatgcgggtgtggagcaacattccagggctgaagaggtattcctcaggcaggggacgtggaggattcagagacaggaaactgtgctttctaatagagccatgttctacctatctgagaaaccccttgtctaccacaatactgaacacagtggtgctcagggtgtccctgtggactgagggacactcattatgatgatcactcacttcttcctgatcatgcctctgaactggtcaagagttccctcgtcctcaggagaaagtccagactcctagccatgggcctaagggctctttttcaaattgtgtaagccagttaccccccagccttctgaagcccctgccctatgcacatgcaggctcataaccattcatacatggtgattcaagtctgtaacacattcacacacccgcacacagacacccacttgcttacagacgtgcacaggtggactgagccagtttgaactatatcttctgaaaaatgctaagtcgtgtcctttcctgtcctacattgagtttctggaaacttcccacccacctcttccatcccagcattctcctggctcctagccactcttcccagtcaggtaccac

SEQ ID NO: 19001 - DNA, 1228 bp, Mus musculus
gtagggaacgatattagaggttttagtctttggaaactctgcctgcctgttcccaatccatccagagtcaggtaggaggcagggccatttattcttctgttttaagatgtggagacaccattaggtcctcctgagggtccccagagaccacaggcatcccctttaccttgtgagggcctcaagcctctgtgccccccccaaccatcacccccgctcccgagcacccaatccaatgctgcatttctaacaggtgactctttccttggtagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctctttagaaatgaatcaccataagatgaaagtctttcctagaaccagggcagatttcttcctaaggtctcttccctccacagttttctctggtttgctttcaggccttcgggtttctctcctgtttgattgccaggatgcctctgtgcagctcactttgcggggtgggaggtgcctacggctctgcacaagttcccggtgggataacctgccatgtttctctgaaactgtgtgtacctgttgtgaagtttttcaaatatatcataggattgttactggtagtgttctggtgtggtgtgtgagactgagacctttcttctgtatgtcacagtggtgacgttgccgttagaccttgaattcctgctgccctgccatgggcatatagccttcgtcacctgctattcgctttgatgattgaaccctccctgttgctacacaaaacaccccaaaccattgccagaagtgtatacctagggaacagaatgtgtgcctgctgggttgtcctaacataatgggagcttgcagaagtgggttcccaacagcccttatcagttgatcttccattgaagctaaatccattgggaagtgtggactggtcagttttgaactatatagtgaatcctgattaaccataacctctccactccccaacacatgtgcggacacacacacacacacacacacacacacacaaacacacacacacacccctcagatctagaccccagccattaaagagactcaagctgcctgggtatcacagctggggctcgggatccactggggtcatgttggctctgggct

SEQ ID NO: 19002 - DNA, 1187 bp, Mus musculus
gggagagcggaggcggagctccccgcctccaacccccgctcggaggtggccggagggatgggccgagggcgggatcccgcctgtgcccaattagccaggcgcgcagcgctagcgagcgcagttacagcgggtctcctgccgccaaagcctcaagaaccccagatttcagcgccccaagcctggaagctccccagttcttcgtggcccccaacagctccggaaccccagccgctgcaactctccgcgtccgaaatccagcaccccgcagtctgcgctcgcaccatgcagctaaagtgagtccgttcgctgttgtgtcccgtgagtggggtgggggagccggggacccacccgaactaggactgagattgcccgacgctagcgcagcggctctgtaccggcgcagatgtgcccagttccggacggctagcggccacacctggacctgccggcttggacggcagggggcggcgcagggctaacccgctgcacccgcggaccagaccccggcgcgtgggcggctgtaggcggaggaagggcaagagccggtactgaaggtgaaaactcatagcagccatgggcactggcttagccgccgccgcccttctccctgttgatttcccagaagggaggatgtgtgttacctcaaaggccagctgatacccagtgcatggggacaggacacctccttgtacacttgacttccctcacagatccagactgggcaggggaagtgggaggtgtgtaggaggggtgtgtgtgtgtgtgtgagagagagacagttttgcgctccggcgttttgcaaatatttccctcaggcacttgtaccgtagacactccatctccactggctacttgctgaggtcctcagtccacaagtgtcctaaccacagagtctccagggatagaaaaggggagaccttgcaggctaccgagtgcctgctggccagtggctggcttgagtttgtggtttgcccactaatcattcctggggacacccccccccccccgtgtgtgcgtgtgtgtgtgtgtccatccatccctccctgtggcttcccaagggtttcttttgagacaatcttctgagaatttcagggctgctgttgaaagagagggagaatttttggttggttggttggttggttggttggttggttggttggttggtgtttttttgagacagggtttct

SEQ ID NO: 19003 - DNA, 1118 bp, Mus musculus
ttttttttgagacagggtttctctgtgtagccctggctgtcctggaaccaggctagcctcgaactcagaaatctgcctgcctctgcctcccaagtgctgggattaagccaccactaccgcctggcgcagcaaatgttcttaacagctgtctcagggtttgtattcctgcacaaaacatcatgaccaagaagcaagttggggaggaaagcatttattcagcttacatttccacattgctgttcatcgccaaaggaagtcaggacaggaactcacacagggcaggaacttggaggcaggagctgatacagaggctatggaggggggctgcttactggcttgcttcccctggcttgctcatcttgctttcttttagaacccaggaccatcagctcagagatggcaccacccacaaggggccctcccacccttgatcactaattgagacaatgccttacagctggaattcatgaaggcatttcctcaagagaggctcctttctttgataactccagcttgtgtcaggttgacacacaacaccagccaggacaactgctgaacccactctccatccctaacaccaagtatcttaaatgttccctgcacacttacaccttcaactccaccttctcttaaaagcaaggctttctggggagcccctgtgggaggttggggaagatggtggacagaagggatgatgctactgggagcccaccttcccacaaagcctgaacctctctgctttgacccacaggacccaagactgtacagcttgaacttacaggtgagtctgcctgcagggagaagctggttgactgagctgtcatgacctttcacaccttcggctggtagttttccatacctgagaattcccaagatgcagaaaccctgtcctgtggtggaaacttctgggccctgtacagcagacagcttgtcataggtctctgtgcccctcctgcctctgctctgcaggaccccatagactctgtgactctggcagcccagagtcccttggtggaggtgtatactccagttgcaggtggattcggtaatctccagaggtgtggattcttatctcaattatccacagaggtatcagttgaccactgggagatatccct

SEQ ID NO: 19004 - DNA, 1687 bp, Mus musculus
agggccagcaaggagagcaggccagatgctgcactacaccgggtagagctggaactgaattaaggagggaataagttttggggacagctgcacctgatcctgctggtggcagccgagcaggatgctggtgctgacctaacgccttctgtccccagctgtgactggaaccgcttcaacatccagtacgtgctggcagtttccaagcagcggggcatgaaacgcaccctggaacctgtggacacagaagaggactcagatgcatctgatgaggacagtctgcacctactcagagctgcaggtgaagaagaggaagaggagatgctgatatagaaccatatatttcacggcctgattggctggagatgaaaccactgtgctcctgggcccaggaagtgggaggtgccagagaccccgagaccctccagcccggactcttcctgtgagactgctcatgctgccatgagacagcaagccaacctttcagggccgggaccaggatacagcgggcacacttatgctttgggcccagaatgcttgcgttgtggatggccctgcacagacttcctagggaaggtttagaagtgtggacttgcaaactttctgtcagagttatttatatttttaatacgatgctctaaggatgaatttcgggttgggaagagcttttttgtaaatgtgaggactttgcttctcaactttgagtttccggtgtttctaatgtgtcctgggtgagacattgtcttcaagtaagcagggagatcggtgactgctcgggcctgtggccctgatatctgtaagtagtgaagaaatggtgtgtgctgggctgaccccagcgggtggctgtgacagcccaaggctggccagggaagcttggactgatctttgccagtatgtacaggttatgtgggagaagggacatgcctgagtggtgctttaccgatacttcctgttcatggggttgaccaggcccagcatgtcactcgccagtgaagagacccacaggtgccaactcatgctgataactattcactggcctctgtccaggccacaggaatggatctgtgtggcacctggtgcactgagagccattagctgtcgcacccttgtcatactcaggatacactgatactatactgtcttggtcacctggaacccgctcaggcttgaacaccgttatggggagaagccagagcttagcctggtgtcgccaggtttcctgttctgcagagcatttctctgtgtagcttggggtagaaaaggaaactgcttcttatgtgcccagggacagccaggcccctggccgcccagacaaggacccgcttgttttggtgccatcttgggatccccatctgcagtacaaatacagttttatgaagctttactggttttgtctgtgtgtggtatgaatgtggaactgagggcccagggaagggcaggcaagtagtgctgaaccatgcttcagccatcaccatacatctcatacatctcatccagtttaattctcataccagaaactgggctcagtttggagtattttacaagtctgctccgtggtaaccatgcccactccacccctgtggacagccagatgcaaattgcctgacactgctccacccctccccccaactactgtcccctgaaactgaataatccctgactcgctgtaatggtgttgggccaccaaacc

SEQ ID NO: 19005 - DNA, 1171 bp, Mus musculus
gagggaagtgtggtgtggagatggcttaggctaaaagttctggatccccgactcccctaatgttgattgaataacatatgcacttggaattaaatctatatttattataattgttggatgtgggggtaaaatgttttctctcactttaaagtctgctcatgtattgtagctgtataatcgacatcttttgcaccttaagtcttggaactgaagatgctccatctggagtgaagatgagaggggcctctcttgtgctctgatcagtcgtaaaggactcagggcctggaggacctcagctgggccactgggttgcagtcataccgcaccaacgggttcatttacttttggttgtaaatttgattgtacatattgttgatttattatttttaagagtacagactaactgatgtaatgtttgtgtataagttgcaccaaaaatcaaggacaaaataaatgtgtgtttgtttttactggtgtggaagtcatagattgtaaatagatgctgtatgtattaaacgttctcagtcctccaaagtgatgtatttttgtatataggagatagagtgctctgggcttattggcgtggtgtctgtgagtgggacctgaggtagaaagctgggagaggagggagccctcttcaggagtcgctgccccctggggaccatgtttgggcccagagtcaggggcacagagagaaccaggagaaccaagccaacactttcagtattcagtgtatttgcttttttttttttttaagatttgtttatttattatatgtaagtacactgtcgctgtcttcagacactccagaagagggcatcagatcccattacggatggttgtgagccaccatgtggttgctgggatttgaactcaggaccttcagaagagtactcagtgctcttaactgctaagccatctctccagccccagggtatttgcttttaactcagccagtaaataaaggatagtacgacgcccacaacacaccaccaccaagtggttttcatttgcaggaattggaggaatgcttaaagaaaataaacactggggctggagagatggctcagtggttaagagcattggctgctctaccagaggtcctgagttcaaatcccagcaaccacatggtggctcataaccatatgtaatgggatctgatgccctcttc

SEQ ID NO: 19006 - DNA, 1486 bp, Mus musculus
aagctcttcctgatgctgtgacgctccacagtcttcagtgaagtgcagcatcctcggagagtgtttgcctgataggttcccgatcaagcacagtcctggctcactaagcacagctctgttatcacagtgcattccagcaagcactctgcagcagcctggggactcagggccactgatgcatctgcccggctgtgtagggtgcagagtccaaccatcaccctaaagctagcatcatgctcccaacagctgatgcctctgaccacactctgtcctctcctactcttcacaggccctgcagttcccaaaataggactaaatatgactgatgaaccaaatattttttatatttaaaacaacagtggggccagcaggatggcacagtgggagaaagctcctaccacgaaacacctgcttggtggcctacacttgaccctggatcccacagtggaaagagaggaccagtccccaaacatcctatgacttccacatgcagaccatggcatgcatacacctgcacacattaatactaatttaaagaggcttttttaacagaacaccagtggactaggtgtgtcggcacatgcctgtaacaccaggacttgggaagtagatacagaggaatcaggagtttaaggccagcctcagttacaaagtgaattctaggtcaggctggactacttgagattctctttcaagaacagagttggagaagtggcttggtcagtaagtgcaggcatgaggacctgagttcagtttccagaccctatgttaaaagctgagtgtagccaggcagtgctggaacaaatctttaatcccagcactcagaggcagttctctggtctacagagtgagttcgagggcaaccagaactactacacagagaaaccctatcttaaaaacaaacaaactggatgtcgtgactcctcccgtaaccctaatgctgtaaggcaaaggcaggaggatcgatccctggtgcttgcttgccagccaggctagtctgtttagcaagatctgtgcctgtgagagaccatgtctcagagcagggtaggtggtgcctgaggaatgagggccagagctgacctctgacctccacgtctgcatacatacatgcacacatgaagtaaaacagggctgcagatggctcagcaggtaaaagcaagtttgttgcataaagcctaactgccaagtccagccctgacaccctctggacggagagagctgacgtgtgcatgactcacatggtacatcattatgcatggtgtcttaggtaggatttactgctgtgaacagacactgtgaccaaggcaactcttataagacaacatttaattgggctgacttacagattcagagattcagtccagtatcatcaaggtgggaacatggcactgtccaggcaggtatggtgcaggaggagctacgagttctacattttcatctgaaggctgctagcacaacaatgacttttaggcagctaggagtaggg

SEQ ID NO: 19007 - DNA, 1142 bp, Mus musculus
cccaggatgtactgctgtgattgtggcatggggttagtgtgggattgatgtcaggtgagctaccgagtgctggaggaaagagaaagtatggctgctcagtggcccagactggagcatgaggggtggaagctggtcctgcggctaggcctgggcctcccatgtcaagctgagatagcttggcttcattctgtcagcataaggagcctgtgaggatgggggttgggagctgagggtgttgtgactcctgtatcacaaccggccctgcaggtccaccccttttcagtcccactctgattcctgtccgttctgcggcagactttactagaaacctttgcaatgcctattagctgtgaactgcctgggcccctccctgacgattttcactgattgaagacagaaaacagggcaggcagttgggggtttggaaaagaggctcagccaagcaggtgttttatgccccaagaattttccagaatgcctttcatgtctctgcaggtgtgttgtgctctctgaccctttgaaggactcttctcgaactcaggaatcctggaatgccttcctgaccaaactcaggactctgctgctcatgtctttcaccaaaaacctcggcaagtttgaggatgacatgcggactttgagggaaaagaggacagagccaggctggagcttctgcgaatacttcatggttcaggtactggcctcctgactggatgaggcagctctcaggctgggtcctactagcttttggagccaaccatgtagctgatagagtgggtgttaccatttctcagctgtatgcagaagatgatcgtgatttctgaaggtcccctgctgcctcagcactcaccactgccccaccctgttctgatcatcgggctcgtcttggttttatttggacacagtgacttctgaagtctgctgtgagttaggtagaggtgcccaggaatgggcgtgctggttcaccactgtccagacactggggttgaaggatgggtatctgggaacatcctatggctctcaggaaaggattgtgttaagctggttctttgctagaatttgccagattatttaggcttttgaaattgttatttacaatcagcctttggtttttgaaaggaaaacttttgagtgtacagaaggcg

SEQ ID NO: 19008 - DNA, 1164 bp, Mus musculus
tcctgggagagagaagtggagctgttttgagttgagcagcttcctgtcagctcctgtgagctgggacagcgtgagggagctgggtgatcttctctctggctcttatgtggagaattcaaggggcattgaagttggatcaggattccagggcttcctgagagctgagggttactgtgtgtgtggacagctggcaagaagctagggtcctggctgactaatgacaatgacagccttacggggcttgggcacagagccctgactaaagctcttcctcggctcttgggcaatagcaccctgggtgacctcctcagctcttcagcccttggtgctgtatcttatgtctttgggtgccagaatatgccagtgctgagacacccactcggtttaccctctggctaccacagtgtgttaaaatgctgtgactagtggctctttgttactgacaccctccctgttcctagagacaaaggggcattgggaagctcgccttcacagtgacttatttatttttaggatactgaagtgtacaaagctacggtaaaagacgacctcaccaagtggcagaatgttctgaaagctcatagctctgtggactggctaatagtggtagttgaaaatgatgccaagaaaaaaaacaaaaccaacatccttccccgaacttctattgtggacaaaataagaaatgacttttgtaataaacagagtgacaggtaagtatgtcttgcattttatccactttgatgttagtgatagccgttgactcaggcagtctagaaaactacagaggggtgcaggatcccttccctaaacccctcctctgtaattcctggcctagcagttcatctccaggtggacagcctagggggagaggcttctgggccagtggccctggggaagatcagtccttgaatagggtagaattccccaagtagtttcttaaccgtgagacacgcatttctgtttatagtccactttttaaaagttcctggaaggaagttgcaaagcagcagcttcatcccttccttgtagtgtcttactgctcctctgcgcctgctgggacttcctctccttagcactgcagacacagttgaccaggtggctgtgtgctgactcgtctcggagatgccctggtgagacatgctctcattcccatggtcattgcca

SEQ ID NO: 19009 - DNA, 4796 bp, Mus musculus
acagaacacacaagcgcgagggaaagagacacttagagactatttttcttattaactggtgactaatattaacaaaacttgagccaagagcaaagaactcggcctgccagctgaagatggtcggccagcaccggcagggtcccatcagccctctgcggggacagaggcgggtttgggggaggtggtggggccacggcgctcccccagaactccacctccaagaggcagccttggctgctctcccttcttaaacttagaatgaggcttttgtttattatcagttatttgggggacgtaacctggccccaaccctgtgccctgtgccccagaacactggctctccctgggtgccgctgcctactgggggcaggtcagctagccccctgtcctgcagcattcatcccgccctgcttggcaccttagcttccagccccgggagagggaggaagtcttcttagagataagcacacactgaatgtggatctggcccttttgtccttcccttgccctccctccccgcccccccccctggggtggggtggggctgaagaccacacctccgtcctctgcagcttctgttggcaccgccttgctgggggctgtgtctaagcaccttaagtctcttttaaaagtgaacgcccgcccgagaactctgcagaatgtggaacccttgagttcatacagcacctccatactgttccctctctctctctcttcctctgtagccagcaggctgccatcctgcacagggccagatgggaagaccgcatgcgagccccacacctcagagctgtggtgcctggggggctgcagcctatggaactcccctgggacactcttcagagggccgtgtcaccatcaggcctcccgttctcagtcagacccctttagtgcttgttagcattagaatctctttttacaggcattggtctgtggctggctcgcagcttctccctgacctcctcctattctgcctctattcaggcaggtgtcatggctgctgaccatacccaccattgccccttaccacctcagtgacatacactgtcctggcaaagaacaggggacctcagcctgcacttggtgccttgccagggtccctttgctggccctggaggcccatttccttctcgctcagcacaggaaggacctgcctggtttctgggagacctaggtcctcaggaaacaccatcataagcttttaccttctgtctggaactggctcttttaatgtcattcatgttttctaacaagaaaaaaactgggtaatttttcccccctgtggcatactgcaaccagaactcatagtaaaggcagagaagatttatagtgtacactggaggaaggaggcctagagaagcctgagggcagccctgggcctgactgtatggctccaagtgctggggaccgagtcacagaagatgctaatagcctcacggtccatgcacaatagtggtttctcccactcttgggtaacagcaacacacaaggctgcttgtaagggtgaaaggttgagtcaggctaactgagacaatgaatctcttcccctccagctgaagacttgagcgccctggcctctgccaactacgagccatcttgggcattcctgagggtcttctccctccttggtgggttttttctttctgtctttgtctgcttggggtctctgtctttccccacacaccgtctcctcacaaatcggaaggtaacaggccaatgggccctgccctgcatgcacctgcctcccccctcccccgctggggaaagcaacctcagagcctttaccacttcactaatgcctctggcttcccacagaagccctgagcctttggggtcagctgaccgttgagtctatgaatgacagaggattccgggctgcaggctctgccctcctaggcctgctcatcatccaatgcagcgcttctgagagcaataaaaactacactagtaatgtgggtgtgggcttatttgagggtggggtggggtcagattttgcttttcatctgcttcagaaagaaaagggggaggagagccccttcaatttttctattaaattaataaatctcagaataatgctttttctctttttccttcacaccctactactgataggcatggcagatgtcatgcccagattcgggcagaagttgtgaagcaaacttctgaagcagtttgctagtcttcagggagcccgtgctagaagcagcaggcttaggagccagaggcattctggaactggaatggttggtggcctggggggtgggggggctggcctgctaggctggctctgcttcaggctccccaggagagggacccccacaaggtcagcccagactgggatatggcctcctccccactcagggtcaagagccagataagtgaggctcccatcatctccccgagagacccttccactgtccaggtggtctcccacccctggtccctggccacacccacatacctcatgcaggcctctctgaagctgtgttgaacttcagcaatggctgccattctcctgactgcttgttgagcatctagggactgtgcttctctctctgagggctttgtggtagcatcctgattggtgaccatccttggagaagcaggagcatcacactaggaaggctgaatggtcagaatgtgggcagttcagagatcagggacactctccttttgacaagactttttaacccaaaggttaaacaaacaaaacaaatgcatgctgtttatgggtctttggtgagactgcatctatgaggcacatctctgagatgctgtaagccctgtcctggggggaggggagtgaagggggagaggcggaaccagtctgattaaagagatgagctctgaacactcaggctgcttgataacaaatggcaacaatgtaacaacactttctagtaggaacagtgcaggtgtctccacagatgccttggctgcccctccctccccttttgtgtaccttgccctgagaatcttttctacctagtccagccttcataccatccaaggaaaaaagtctgggtgagccccaatttgtgtcaggttcaggatggaagaattaagtggctcttcctgcatgttgccctgtctctgcctgagactgtataggacaagccaaaagtagcctttccagtcctgatgacctgcacctaaactgtttgtcccacacataaacccaaaccactagctagatgcatgcgacgcttaatgctagccattttggtgtggcttctagccctctacagtgtcatgaagctcagggttagaatggcgcacctgagatgcctgctgccttctttctagaaacatctctggcctatgggccagccccaaaccaaaggcaactgggcctgggttcgggcacccctgacctgcctcaggccttgtcccagagtcttgccgtggggctgtcaggtgggtactgacattcacgccccagatccctgcatacaggggccaggattttacaatgcaagttcaggctttgggcgatctgcttggctgacagggtggacacatgaatcgaatttatcacaggcttttgaaatcggttaatccaggggaaaggtggtattctcccaaatcactccagaaatcaaccaaggagagcacttcgcagaggtaccagggatggtggcatcctctcttcacagacagcgacctgtgaaactgtgaactttgtgctgacaggtcacctggaggtttctttttctccgtagcttttttgggtttctttctgttgcaaaagtgttcggacagaagcggaactgtgaatgagactctgaaatgcactaaattgtattctattaaactggagttacttgattcaatgaagagctgtagtgctctacttgtatttattgtctcagagtagaaacattgtgacaatcaaacatgacttgcctcaaggcctgtacctcctggcttctggaccgagtaccagcaagtactataactacaggaaatggctctttctggaagccgcacaaaccatggactttaatgatcaagtgctgcggtgggtggggcgcaaatatctgggttgcttttccattactgagaaattgccatatcggactgtgggcagtctccaagggatgctttgtctccagggtgcaactgtgttaatatggacgtttccttttgtactcttctttttacaagtttgctactcacaaagctttctgtagtaagaatggaggtctgtgctctaggaagatgtccagggctgggagctacagtggactccccaggcctgggtctacggcctggctgtgttgactgctatgcaaagctctctctgtccacagcacgtagaaggtcactccagcggtgtggcactcctgcttggtggtactttctaggtaaaatgcataagtatcatacttgtttattacaaacactgttgtgaaacaagggatcataaaatatccacaatatatgagaaagtgactctctgcctctttttctttctatctttctggtctgcatagaattccaagagggacagcccttcaagtgctttctgtcccttggggccaccctcctctaaccccttggtctctgcctcttctctgaggcccttcagttggcagcgctgccccagggccccggagtctccactctgagtgagcagcagagagagggaattcagctagcctatgctagggactcaagtccccatattgggttttaaaagccattgaggagactggagagatgactccacagtcaaaggctcctgatgctctcccaaaggacccagacttgatgcccagcatccacaaccatct

SEQ ID NO: 19010 - DNA, 1211 bp, Mus musculus
cagaacagtaactgtacccatgggccagagcagaaccatcacaatgctttggggggtggggtggctcattgtttagccacactggactcactgcttagagcctgggctcgcaagactgagtgctgtcagcaattggaacaaggttggggacaaagctagcaagtggctatggcctctgggagtagaggagaccaaaggacaccacgctccctctgtcctggtgctgatgaaaggcctcagatgctgaagaaggcagagggagcacctgtggacttccatgggggataagccaacctgggcatgcaggccactggagtcaggttctgtccacctgagagtgatttcatgaagtccacagagcctgaggtgtgcaggctcaggtgccagagaacaaggtaccgacgtgaagtctgctggagctggagccaggaggtggaagtaaggagttgtagactggggcttcctaagactcctggcttccctcccacctttgcacgagcggtgagagaggtgcagtgccaggtctcagaggttagaggtcagaggtctcagtatttgctcctgacgtgggaagataggattcatgtgtccggcaagatggcttcctggagaaagcagactgccagcccacagggtgagctcatctgtgggctggctgcttaggcaggaggctcacaggctgagctctgcaggccagcccctcctgtgtccttggtctgcctgctttctgtaggctgagaggacagtgagggtaggcaggagcccacagagactgaaggaccagtgtgcaccctcaagtgtgaccctttccccgtcttcagaaaacgcagtgtacaaagtcatggggaaatgttgccgccctcccctagattatcaagcacctgaagataaggggaggggccttgggagtgcacctgcacggctgcgggagtaggtggtgacgctggtcacctgctacagcatgggcctgtacagacttggttttaagcagatgagtcagggctccagagaggggttcctgctgtctactgtcctgggaaagtgggagctgccaaagcctattgcttcagagacagcgcttaatactgacagatgatgtatattacttctggggttggggacaggcctgggactgctctgattgacatgtgactcttggaaccctttatctacctgtatttgatctactcaggatgccatccatcttgggg

SEQ ID NO: 19011 - DNA, 1141 bp, Mus musculus
cgaatgttgacatttatagtaacacattcttcctacagctggcatctcttggaagcttgcaagggccagcaagtcgtgtcagtgattcttatcacttccttaggagctggacaactgagtctgaccacaggaaacatggcagaagggaagaactgacctgtgtgttgtcctttgaccaccgcatgcatgctatggcatgcaacaccccaaaataaatataaatataaaaaataataaatgaggctggagagatagcttagcagttaagagcactgagtgctcttccagaggtcctgaatttaattcccagcaaccacatggtggctcacaaccatctgtaatgggatccgatgccctcttctggtgtgtctgaagacagctgcagtggactcatatacataaataaatcttcagaaaaaaataataaatgcaaccattcaaatagctagtaaacatctggaaaggtgcatgcttcggggtcacagcacagtgtggggtgctggaagaccggacattcggagagccctgcagtaggaggaagtactgtgaagttctggaccttgctgagactctctagggtatgcaggagaccttacctaacagcataaaataattggccaaaagggatttgccagccaaattaggagtcgggagggggtgggggataggaggcagtgtgtgtgtgtgtgtgtgtgtgtgtgtgtgtgtgtgtgtggtcacccagggacacagaggactccagaagtgtggccagccctgaggggagcccatctgagtctatatcaagcagagctatttcccagcaaggcctaaatgtcaagctcaggttgttttcagccaggatgagaattcttcagaggctgggctctcaattgtgtctctcagaacaataggggacaatcctctctctggtcatgtgagtcctgtagcccaggtgtgttgtcctggtgacaaaggtcgcagacaaagtctgagattgcaggaagtaagcaggtgctgggtggatgctggaggcccagggtgacctgcaggaacagagaaggggagataggtgaaggctacagaagggttcactgtgtttcgctgtgctgggtggagattatctttgtcttctgaaggggttgtgtgaggggagagcaaa

SEQ ID NO: 19012 - DNA, 1153 bp, Mus musculus
gagtgacatcagtttaccatcaggagaggccggtcctatctattcctcctcaagtcctgttgaagttggaggcgtaccgagagaacagccagctcatagaactgtctgtccacccaggccagtcacaggtgggagggaaagatgaggtacaacagggacagccaaggacacaggctttctatctatggtgatgacactattcataaaattgtttctttgtataggccaggtgactttgggactcttgggacacatcacaaacatagatgatggggtgtcatgtgactcatgtcttgacatgaagctagttgtaaagtgaggttacattttagtaattgtagctgtctggtcaatccagggcttgtacatactctgagaacagtccatctctccctcaacctgcatccttggccaaggaatcaggctcccagcctggactcactgctctggattccaagagacacttgaggtgaccattgtctgcaaacctctcctgaatttcactcaggtcagcctagaaatgaacagaacccttccacagctgttataagccagaatatcctgctttactggatagggtagagttagggcatcagatatcaaagacacaggggagggggcacttctgagatgttccccaaattactgtgtgattgaggaaaacctgactagtttagcatgcttctccagtccctcagagaaaactgggtccatttaaatacaaggtttttgcccttatctagagagatcagctgcgaagaatgcctacccctcacagtaactgggagggagtctgacccctggccagcacacaggctgcagcagagatgggatgttgtcccagtatgaggagctttcattggctttatattcattgactttttttagtttacatcactaaaatgggggttggagagatggctcagcggttaaaagcattgactgctcttccagcagtcctgagtttaaatctcagcaaccacatggtggctcacaaccatctgtaatgagatctgacgccctcttctggtgtgtctgaagacagctacagtgtacttgtatataataaataaataaatcttttttaaaaatcactaaaatgtacccctgccttaaagttagcttcattttgagatgtaattgttgaacttcc

SEQ ID NO: 19013 - DNA, 1552 bp, Mus musculus
cgggtgagggctgtggcgtacggtgcatgtgtccggcatttaaacacacttcccatctcttggtttccccacagctcaccgcagaccagaatctgcagttcatcgaccccttctgccagatagcagcccgcactaaggagtaagtggtgggcggttccccttcctctcaggctgcagtggccactggcctccctcccatgctgtgagggtagtgtggtatctgagagcccatactaatgaggtctctggcctctgcttcaccctcagttcccaggttttgcataagatcattcagagcatctttcagacgattgtggagcaggctcccttggccatagaagacatcatgaatgaactggacacacagagtggagagggtgaagcatcagatggtgatgatggtgaagcatcagatggtgatgatggagaagcatcagacgatgatgatggtgaagcgtcagatggtggtgatggtgatgtggcagacagtgatgatagtgatggggcagacgatgatgatggtgacgtgtcagacggtgacggtggtgacaatgatgaaggtgacagtaacaagtcctcagagggtgagcaggatctgcaagacacaccacccaagaagctgcctgcaggtgagggccccagcctgtcctatcctaggctcttgctggattgttgcagctgtctctgggctgttctctggagagcaccgtgttgcatgcatgaaggacatttggtttgctctcctaagtcggtctcagcacttgattcctggctcccagcttccagctcggtccctagaatgctcctacctaaggttctagtgctccctgggtcctgtgtggtaccctgacctccctgttcacagaggagcctgcatcctggtttgcttgtggttttggtggtgttggggacggaactctggccgtaggcactaggaactgctctaaccttgcgtcacacccaagcctttccctaccccttctcctggaccctccacttccatcagtcacctttcctctgtgcccctcagccctgccctgccatgcccctgcccgccagacagtcggcatctgcccacagtgtagcaagggcaaatgaatgtgctgcacgctctccttgtaaatggcctctcactggctctgggtttgggccaggtgtctggttgcagtgggcctagcttggctttctttgtcttgatgctgtggtcatggagtctcagtgagggtcttctttcagctttggtgccagctttagtggcccccttcttgtgggtcagcaggcacactgcctggcatcctgtgtgtcttgcctgtctttctcttaacttctctttcttggtagcccagacatcctaagagtttctcagaggagaccccttgatgcctgctcatggctcatcagccactctgcacagcaaaccatcctgcagccgttgtccttgccaaagtgtcccacagcactgttgtccacaagccttcacttacaactatgctgagtggcctgtgggggcacacacctataccgtagcacttgggaggctgaggcaggagga

SEQ ID NO: 19014 - DNA, 1724 bp, Mus musculus
ttgtgcaacacctgacagtaagtgggagtcagtgtgtccccaggtcagcctgacatcccaggaagccattgtgtcgtcagcatggccagaactgacagtttgtgtttccttgctgactctggtttattcttgtggcaggcaccctagaggctgaggcagcaggagagctatggagtaagacacccacactcacaccgcccacccacccacctacccactcttgcctccttccttacatcctccctccctcccttcttccttctcttcctttcttttttaatttctagtggaataaacacaattttaagattccccactattgaagcaggcagaggatatcctcagagcaggcgtctccatctcccttggattacctccctgcttgtggctgagctcccctgggccagcatctcctcattccttcccctgtttcaccatcaggcagtttctggtctttgtgcaataggatacacattccaggtggaaaaggtctccctgatgccgtgggaaccccactctgtccccgtgggaaccccaccctgtccccgtcagctcttgaatagccagttagggctgcctctgccctgaagctacagatgggtgggaacagacatccatggctggaagctcccagaaggccttgggtataaccttggccatacctcactgcccatcctatagagccagcaggtcccatgagacgttgggtaaagccatgactgcacctcatggcctgccttgcagggctaggcagtgccccatgcaggcaggtgtaggtgacttggactgggggctctggaagcctctgagctgccagtttcatgcctgacatggaggatatgtccgggggggggggggcggtgacagaacacaatagaggacatgggcttagcatatccttctcatatcccacagagcaggaagatcccctcaaagctcaggcctgagtgagtcccaaaaaaacatcctgaaaccattttctgaatgatgggggaggggtcagtgttttgtgaatggaggatgagacacaggctcctcaaatgctcctagcttcatagctgcccattcctgacacacagcctgtcagaacttcagccgtgtgttgagaacctggaccaattggaggatgggctgcacctgtggggctggcccgaccctgctagtcctccccagagaccacccctctgtggagtcccctggccttcagagcaaagcacagttggcccctcagtccctgctgcgcaggaggggtgtgctccgggctcaggtggtctcctgcccaagtccccaagccctgtgtactgtgtcccctgtcaatgtgtttgtggacatgagcacctgtcagcactgtgtagctgtgtctgttttgtgctggtctgttgtcttctatgactatccacaaataaatattttcattgcagttgtcttagtgtggtcatttctcccctgctggtccctggtggttactgctcagaaagagcacctggattccccaaaacagtcctcaaaggaaagcgtgtgcttgtggtggccggcagctcacccttcactctcttctgtctcagggaactattgggtgctttagggccagccctaaggcttcccgaataattctctggtgggcactgagagatggagtatgcccaggtgatccacctgcaaggagctgaagaccagccattggctaacgatccaacagttcagttgctcctgagttctcgtgc

SEQ ID NO: 19015 - DNA, 2355 bp, Mus musculus
gaattcagaactatgggagagggaagggtgtcttaggttccatcctgcctgctctgatcttccctgtgctctgcagctgaagcaggagaaggacagaagcccagccccgctcagctggagctgaggatggtccagagcaaaagggacatcgaggaccccgagatcgtcgtgcaggccacagtgctgtgaggaccacacccactcgccccgacacacagccagctgaggtgtccgtctccatccctgtgaaaagctgtaacgtctgccttagagccatgactgaaactcgacatccgtgttccttcccgagagtcgggtctcagccagtctctagcgtgaaaaatgtgccattgtgctatttttttaaaaaatgacaaagccgtcgtagaaatgtgtgattcacaaccatggtcccttccccaaaggccctgggcctctgactgcctcatgttgcctcataggtatgtggaaggtaggtggaggagaccagcctgctgcctctggacctttctgttggtcactggctgccattgccccctgtgtatgtatacacagtcctgattgtgtatagactctgcctgtgtcggcgctgtctttaaaatggggttaggtcttaaccgttggcattggaagaattatgccaaatatcttctttgccattctggtctttcccttgttcctgcattagagtttctgtgtctctgctgctctttgggtggtgtcccagaatgtcagacgaatgcagctgctggtctgcgagggaaggtttcatatccccgtgcttgcacaagcatgcggtcactgtgacagggaccttttaaggaacgggaacattccaggacatctgcaagccgtctgggtgtctgcagggtctcctgtaactctggagctgagtgcagggcagcttgggaattcagggaagtttgcctcactgggcttttttttttttttggttttggttttggttttgatttttcaagacaaggtttctctgtgtagccctggctgtcctggaactcactttgtagaccaggctgaccacaaactcagaaatccgcctgcctctgcctcccgagtgctggtattaaaggcgtggaccaccatgcccggctctcactgggctcttgtgggcactcacacagcccctgcaggactgtcaggtggcagttcacctgccacatgctgctggggacagtgcattgctgcacagggggttggacagacagggaaggagagacagaggtggctcctgccccctggtggcagactgaagtgcgggttttctccactcccctcaccctcatttctggattctgtgcccacctcatgctgaggggccaggggccctgatgtgaagccagggcctctgcctccttggaaggtcttctcctctacagagcacattggcattgtgtatgcaggggcagctcttagaccccagctggggactgtgacgtgtcccattgtctactgctcgggggtgaacttcctggctctgctttccagagtttagggtccctaatcatggctgcgagccgcacccatatccctgctcctcagtccttaagatatctatcttctgagaagccacagcctaaggagaccagggagactgggagaggtgaagagtgcattatgcctacctcttccccagaagcatagggtctccatggagctctgagagcgacaccctttccccattatgatgccccagatggaggagatagatgctggtccacatggacctgaaccagcccgtattctgaggtgtccgttaataagccttttacagctttgaaggaagcagagaactgggctctctctctctctctctctctctctctctctctctctctctctctctctctctctctctctctctgtcacacacacacaatgtaattttaaaaagtactttggtcatcagtaccccaggacaagattagcaagctctctgttaaggccatgaagcctgacatgtgtccaaacctggtgccaatgtggcacctctgagccccaagaaaaaagaaagcaaagacagcaggcccctagtatccaaatcagaattggcttttacttttactttattttagtaaggaagtaatgtgcttgggaaggaagctgcattagcccagggttagccgcttcctattggggacattgattctgtctcaaagtatctccttccacctcctgaatactaggaaggaatcaccacaccacatatgaccagtgctcccttttattgctgctatctggggtgcctctcttccagacatccacgcagctacctgcactgagaggtcctggaaagccatgtctgtccatgtgacagatggatgctgaccacaaaag

SEQ ID NO: 19016 - DNA, 1188 bp, Mus musculus
ccacctgcttcctgggttcaaagagtgttcattcaaagaaagtcaccctgacccaccctgaccattgctggatggaacccactatgcaaaggtgctattgctaggggctcttagattgttaggggctcttagaaactgttttgagagataacctgacacttgtgactttgtacttccttgtgactcttaactggtatttttggtattttccaacaacgcccttcccacctccttaagttgtggtttcttcctttaaataccccctaatccagctacttggcgcgccatggtcctctacccctgcgtggtgtatgaccgtgggcccgagagcattcttgaataaaaatcctcttgcaatttgcagcaagaccatttctcgttggtgattttggggtgtcgcctctcctgagtcagaacgtgggggagtcctcacgttgtggctctttcagtagaaggttgaagtcaaagaggacctaggacctccacacaaaacaagatacactgaatctaatagaagaggaagtggggaagagcctcaaactcatgggcataggggaaattttcctgaacagaataccaatggcttatgctctaaggtcaataattcataaatgggaccttataaaactgaaaagcttctgtaaggcaaaggacatggccaataggacaaaatggcaacccacagatttggaaaagatcttaaccaaccctaaacctgtttgagggctaatatccaatatatacaaagaactcaagaagttagactccagacaaccaaataaccctattaaaaatggggtacagaactaaacaaagaattctcaactgaggaatattgaatggctgagaaacacctaaggaaatgtttaatatccttagtcatcaaggaaatggaaatcaaaatgacaatgggatttcaccttacaaaagtcagaatggctaagatcaataattcaggtgacagcagatgttggtgaggatgtggagaaagaggaacactctctgttgctggtggaattgcaagctgatacaaccattctggaaatcagtctgtcagttcctcagaaaattaggcatagtactacctgaggacccagctataccactcctgagcatatacccaaaagatgcttcaacgtataacaaggacacatgctccactatgtttttgtttttgtttttgtttgt

SEQ ID NO: 19017 - DNA, 1496 bp, Mus musculus
ctgcagggagccctggtggcctgcctcacggtgagtcctacttgcctgacccacaggctctgctttggctgactccaatgttctatgacctctgcctgctgttctgcctccaagagcttgcccctcacccccggccccacccatccacatggcaaccctcctcagcttctcccttagggttcccagatgtttttcttcttccagccctactcactgccttcccctccccaggtccgctatgtttcagatttcttcaaatcccggccaccccagccctgccaggaggatgaagtgccggagcgcaagcccagtctgtcactgacgctgacccttggtgaccgaccctagctgctatgaacaccctgtctcttcctgctttggaagctgggaagtcacctgtgggccagtcatgtgttgaccctttgcccctgatcaggcactactgacgttggagctatcccagagtcctggctggtgactgtggaccaggatcttgggtgcctgtctggccctgagtgttggcagggcccatcctcttcatttcttgctatcacatgacttcaaaagatgtggtcgtgctctgagggctgtctcccatctccagtgggttttcaaggagggccatcccagcatggccccggaagtggtttgtctgagactgttcatgaagacagcaccctccttgacggccctgaaggtgatgaacatcttgtttgcctgggtggggaagttgaccttgggcaaggatcacaagtgtgaagacagctgccaacccttggggctgcctaggagtccaggttgcccagaaagtcacacatagttttggtctgaatccttttctcaagcctgtggaagattaccactcgaggcccccaagcctctccctcaggcttgatgttctgtcctgtccccactctgtccatatggaccaaatgtgtagccaagcattggaagtaggtcccggatctgccattcccatctgtttcaaaacacttcaagttactgtttcatgggagggtgtgttataaactttgtaccaaatgtctctgccatgcatgttgatttttcaagctcttctggtgaggaagatggtcctcttgcaccttactcctcagtgcattgtgctggacctgccagtcttagcagagacttaggggacatctggcctgggtgtcttttatgttggccaagacaaaggccttatagccattgtggccttcctacatgtgtgatggatgcttatcctaggtcaccttagaacacagagaccctgcatggtcagtgctagataggtgtgtgaccatgctcccaggatgccttcatggtcagtgctagatcggtgcgtgaccatgctcccaggatgcctggccagtctcccaggggcagcaggaggggtgacaggtcttgttgtatctcaggacaaggtgtgtgtctttctgggaatgggcaggctccttatattctcgtcaggtctttgggtctgggagcatggggga

SEQ ID NO: 19018 - DNA, 1222 bp, Mus musculus
tctttactggttagtgggaaaactgaaccctggagcaaggccaaggcttaaagggaaactgaggcctggaagtgaagcaagtgcccaggacaccgcgggtggcgctgcgtctggagaagtctaaaggtgaccatgggtcgcttctgctggctcctggcctgtttcctaggctgtaagcaaaggacatccatcggttctttgggttcatattggaacccgagggtcagaactctcaggcctgccaacagccccagcccaggctcaagagacctcggagacaccgattcagaccccaaggggattccttctgtgagggaaggggttgtcatcatcaccctgcctctgtcccccgccctttccaggacagtactgccgggaaacaaagagaagagtgctgggcggggcagggtgcggaggaggggcaaggccggccagatcgatgcgagagaaactagatcactgcctgtggagggggcggaggcgcgcgcgcctggctctcagccacttccacacaggcactctcaggagcccagccaggtcgcctttggtgttgtctgctggaagaggagcgccactgggctgaagtctgaaaaatggctgtagaatctagctgattaagtgtggaccaaggcgttcccggtctgggtgcacaaacatcactgaatggggaggttatagggctggctctactctttaatctgcggcaacaaatgacgtaaataatactctaataaactcctacacatccctcaaagcccagcttcacagtaccccttcccaagaacctaactggtcccatgatccaaacccaggctctgtctctggtctcctgctgccaggggcccccatttgccccatctgaaccgaatgaggtttgcaaagttgtttagtgctttctttgcggcgtggttagaagtgctaaataaaccaatgtgcacaatgctaaccgctgttgacggaggaatgatttattggcaagcaactctaaagggtggggtgagaagggcagagactgcagggccacctccaggagagttctccggcctcatctgcagaaacccaagcggcctggacactgaattctaggacacacggctccatgtccagccagggaaagggacacttctccctggcctggtctgacctgggaaggaggctcaacctcaccctctatggagacttgggtcacaggccccagggacagaaagatcaggtggcctca

SEQ ID NO: 19019 - DNA, 1328 bp, Mus musculus
gtctggtgactattcttggcctgggcccctgagcttggatagtgttagttttaggcctgaggctgtccaggagatctgctgactcattcctctagctagcccacaccaagtgatacttactgcctggcctttcctaacctgcatgtcaggtcacagaggtgctttgtgtgtcccagtgtacagagactggggttggcttcaggacctgaacaccaggggcagccactgctttttgtccccgttgggcataacccctaattccagtgctcaaggggctgccattgagccaccccattttctaccatctgtaggctcgcctcaagttccccatcgactacccgtattccccaccagccttccggttcctcaccaagatgtggcacccaaacatctatgaggtaagacactaaatacctgcctcaggcacactccaccacacacacctcctgcctcccttgcacgtgcccgcccctcgtctaaccctcgtcactcttacagacaggggacgtgtgcatctccattctccatcccccagttgacgacccacagagtggggagctgccctcagagcggtggaaccccacacagaatgtcaggtgagaactgccatggtgttgtaccatgggcaccccccggcaccctgtatcctaaggtcccttcttcctcgctccagtctggagcccccagaatctatggggagctgagcttgcacccacggccccacagaaccatcctcctgagtgtaatttcgctgctgaatgagcccaacaccttctcgcctgccaacgtggacgcctcggtgatgtacagaaaatggaaggagagcaaggggaaggaccgcgagtacacggacatcatccggtgagcgctgctctcagcctgaacagtgcagctgggtctctacaatagatgctgcctgctctgaagagtgacctgtgtctcctgggtggggtggggactgttgtgtttctgttcttgcatccccagctggatgtgtggagggctctgtagcccccagagcaccgagttgaccacctagtatggccaagatcctctttgccttgtgtttggcttaactccatgagtgactgggcactctaggccacatcctcaccatctgacatcactcgaatttgtgcttctgaaacttagagcagttttgcaaagtggggaggtcgctgagcccactgtgagcctgtcctgagacagggacccaggctgcagcctgtgcagtccgtgagtggtaatgtctgtcatcacttctcagcgcctgtctgcggtcaggcagtctctgcactccccaagctaggtatgacgtttcacttgag

SEQ ID NO: 19020 - DNA, 1521 bp, Mus musculus
tctgggactgcccttcatcagagtgcccctcaggtcaggctgcagtttgggggagtttgatgttggtgtggaatgtgggtaggtgtgtgctctttaacctggaactagtgtcgtggcccccacagtactgggattacagcatggatcctggtgtgcccagctgtttctgtggtgctgggagctggccttgggtccttgtgcttacacaacaaacactctgactgcatcacctccacttttttttttttttttaatgactgttgtcataagacagatcctattacagctgaagccaccctgagactcagcaggcctcctgcctcagcctccaagtactaagtgacaaacctgtttcccacagccagctgtggttaccttcctgctgggaactggccactccttgtccccacgccctttattccctcccacctgctccctgccctccattcagtgtctattcttggaatcccattgtcctgggccttggcctcacctgccctgtctccccaggaagcaggtcctggggaccaaggtggacgcggagcgcgatggtgtgaaggtgcccactacgctggccgagtactgcgtgaagaccaaggcgccggcgcccgacgagggctcggacctcttctacgacgactactatgaggacggcgaagtggaggaggccgacagctgctttggggatgaagaggatgactctggcaccgaagagtcctgacccacgtccctgaaataaacttacaaattttacctcagcaggacccgtgtgggcctcaggcgacagactacctcaccgaggttccatgtgggctcccatcccatgatccttaggtcctcttaccccgtattccccatgggttttcctcggctttggagaagagctgtggtgcagggcaaacaccccactcagctttcagatgatgacaagcctgggaggctggggaccgactgcctggtggggagccagagactccagcccagcccaaggaaggccagcaccacagtctcctctctgcttttggtgtgtgtgaaataaaataaaatagctttctgagaagctgagagaatcacctaggacgccggtggcactcggtactgagggccacctgggtagcccggccaaggccgtgggatgggcaggaagagatagtgactgttaaggctcaggattgtacaggggccccaggcccagaagcaacttgctgcctgcagatcccaccttcctgcatctggcactgtggctgtctgtgtccgcctccatcctgcagtcagaaggcctgggtcctgaggcgtgcagaggactagtatcccagcagtccttgtgtcctgggcacttcttcagccctgggaactccagtgcctgcctgaggagtccctgtggcaggcagcctggtgactccccacaggaaggacaggctgagtgatgctctgaccacatcatgctgtgcagggtggctacagtgacccagtgctgaaatagcattgggtgccatgtaaagaaaggaaaagaaagtgtca

SEQ ID NO: 19021 - DNA, 3382 bp, Mus musculus
ggcacacgggtgagctgaacactcatcagtgtccttgctgggtgcaggttggccctgccctcttccaggtggctcctcggttcgcaccccaggcctttggtctgctgtgcaccgccctgacctcccgtcctgctctgctccatgcacctgctctcctgcctcccctgcctcccctgtgattgtctggcaggggtggggtctgctgcccaagtgttcgctctgactgtctactgcaaacctgaaaattccagccagactttgcagagccctctgggggtttagtgtccagttctgagtgacggtcagataacagtgaggggaccacatggctgtgggagcagcaggcggggcttgggcagctgcgtctcttatcttgaagtggtttgtagtgcagcatcagcttgctttagccgtctggggctgtagactgtcagccgctgtgattccaacagcagacctcacagagtggggctgactactatgctgagcttatactctttctccctgtggcttcagcgggcaccatccaaacctctgtccaggaagtcaactccaaaacacagcttacctgctctttgaacagcagtggcgttgacatcgttggccaccgctggatgagaggtggcaaggtactgcaggaggacactctgcccgacctgcatacgaagtacatgtgagtccacagtgctcaaaggaccctgtcctgatgctgtccatggggacctgcctccatcctgacgtgtagcagtgccaggctccacacagctctggattggctgggtggccttacctgtatagcgtgagagagcccaaggccctatgatctgcacagagagccctggtggggaggtggccaccatgccttgggagttccttacctcaccgaggctctgtcccctgcagagtggacgcagatgaccgctctggggaatattcctgcatcttccttcctgagcctgtgggcagaagcgagatcaatgtggaaggtaatctgtgggagtggtgggggcgggccaggaggtggctggcgtgaaggccagggactggtgttggggctgagagcagtctacaacgtgcttgggcatcagggttctcatcctcacagggccacccaggatcaaggtcggaaagaaatcagagcattccagtgagggagagcttgcgaaactggtctgcaagtccgatgcatcctaccctcctattacagattggttctggtttaagacctctgacactggggaagaagaggtaagggctgtgaggctaaggacatggagcttgagtggtgccaaggaccaggctgcagtgggagcatgaggttctggacatgggggtaggggaggcggcagaaggggcaccgggtgctaggaatgggagtggggataagagcatcagaggggacacaggagaggacgctttggtgtggggatctgggacagtgtaggacagactctagcatgacatgacaagcccttctccctaggcaatcaccaatagcactgaagccaatggcaagtatgtggtggtatccacgcctgagaagtcacagctgaccatcagcaaccttgacgtaaatgttgaccctggcacctacgtgtgtaatgccaccaacgcccagggcactactcgggaaaccatctcactgcgtgtgcggagccgcatggcagccctctggcccttcctaggcatcgtggctgaggtcctggtgttggttaccatcatctttatctatgagaagaggcggaagccagaccagaccctggacggtgagcagtcctgggtctgggtgagtgggtgggatgccctcagtgtgtccacctggaggagagtggggtctgcttgtagctcaccctcctccttcctccatcacttggccacaagctgctgtcctctggggagctcgctgtgaggacttggggctgtgggtgcctctagctgtacactgcatggcgagctggggtaggatgtgttggcctcaccatgtgttgatcatctgatgtacgacacttctgcagcaccatgagggtggcagtgtggggccaagttcacacgagccctgacacatgtcctttctctttcatgtggctgctcctggctgcagaggatgaccctggcgccgccccactgtaagtccagccactgtgggctctggggagctagctgtgtgtcctatagaaatgggggatgctctgggactcaatgtgtgtgtccatctttcataggcctcagtaagttcagggaaggtggatggctgctgttgaaataatggccagatttcagtggggttgaggccagccctgtgcctgttaagagtaatgagccctgttttgtatccccaggaagggcagtggaactcacatgaatgacaaggacaagaatgtacgccagaggaacgccacctgagtggtggggcaggcgggggaggggaggtgcccagggtgcctgaccccaggccagcgtctacctccactccagtatcccatcctgtcccgatttgaacctacccaacccaacctatcccaacccaagtgaagacagagccttaccttacagaaaacccacctggaagaagcaagccacttgcagcccctgtttctaatttaaactaaatgaggtttctatgcagacaatccattccttaggggtttatgtttttatttttccttcccttctgaagtgttgtcactacagccctgtggagtgggggaatggggccttgtccttggtcaggagggaaggccagtgcatgctctgacttactgttggagggggctgggcctgctggaacccccccaaataaagacctaccccaccatgtgtgtgtcactacttgaaacttcaggaccccatcttaaagggagaatgagtgttgaggtcatatacaggaggggttgttgatcagcacggcctggggcacaggtaagtgcatggtccctagaccagtggttctcaaccttcctaatgttctgaacctttaatataggatatctggtgtgacccctttgaaaaggttcttcaacagcaccccctaggggtccttagaagttgaacctgcaggtacagccttagtcctcatgggtgtccaagaaaagctgtcttcataagaacactgctgaccaccactgatgtcctgtacaagcctagtactgatctggctggtgggcaccagtgggaaatgggcagtcaagggacttgctggctggttttaactcttaaattttgggcaggggtcaggacaggtgtatgtggtggtatagtctgactccagagagacagctttgatcccagcagagtacatcccagagtggtggtggttaagggagagaagtcggggggggggggggggggggaggcggggcgatagcagacctttctgaagact

SEQ ID NO: 19022 - DNA, 2316 bp, Mus musculus
atgaccaactaggccatcctctgctacatatgcagctagatccatgagtcccaccatatgttttctttgatggcttagtctcagggagctctggggatactggttagtgagtgcatattgtcctcctatgggctgcaaaccccttcagccccttgggtcctttctctagctccttcattggggaccctgtgctctgtccagtggataactgtgggcatccgcttctgtgtttgccaggcactggcagagcctctcaggagacagctatatcaggctcctgtcagcaagctcttgttggcatctgcaatagtgtctggggttggtggtttatggggtggatccccaggtggggcagtctctggatggtcattccttcagtctttgctccaaactttgtctctgtagctccttccatgggtattttgtgtccctccctcctttttttaagatttgtttattttatgtatatgggtacactgtagctgtacagatggtggtgagcttatatgtggttgttgggaattgaatttaggacctctgcttgttctcccatctaaaacaatcagaaactctttcttttctttcctttttttcttttttcttttttggttttttttttttttttttttttttttttttttttttttttttttttgggggggacagggtttctctctgtagccctggctgtcctggaactcaatctgtagactaggctggcctcgaattcagaaatctgcctgcctctgcctcccaagtgctgggactaaaggcgtacgccaccattgcctgcaatcagaaactcttaactgaaaacctaacactagccacagctcttttaactggacgttcttccccttagctctgagcctacctttaccatgcctgtctccagctatggcctctgacgtacacctgaacctccttcactgtggccctccctggcttttctctgaccttgcccttgctgatgtgcctgtctgcaccttgagccgcagccatacagccatcttacttggatcctcaacctggacccagactgccccaactctaagaaaccataatcatggctgagccagactgcctgtgaccttgattttagtctagaccctgacccttgcttgaaccattaccccgactccaaacctaattgtatccttggccctgctctctgcctccccctaactcctcctctctcctctccagcatgacagctgcccggtctgccgtaagagcctcactggacagaacacagccaccaatcccccaggcttgaccggtgtaggtttctcctcgtcctcgtcctcatcctcctccagctcgcccagcaatgagaacgccacaagcaactcctgagtcccacctggccatcccccccggggtttggtcatcccacccaccccaggtgccccagcaccgcccgcctgcccgcccgccatggctgtggactagaggtgctgcccgtggcggccggcagtacctggcgggccccaggctgcgggcaggcttggacttggccatggccgctcctgtttggaggtgtgcacgtgggtcccatgtccccagcaggcaggcaccttcagtccgtcttaacctcaccctccaaatgttcaacggcagaagggtttttatgattttaaattattactgctttgaaataaatggacgtttgagccacgtgcggccatgcatggtctgtggagagtcagcagaactgtcgccaggcccagcccgccacacgccctgggaggccgggcccagcacccaaccagcgccggcctcgggaccacaagggtgaccagcagacccaggaacaaactgctccagcagacaattttttttttttaagggaaatgtgtgttatctggaaagctatttaaaatacacctactcaaaaaagcagagcccatggcttggcgtcttccttcagccagggtgtccatgactgcatggtggggcagtgcacagggtgggttggagcttctggcaaaggcctgatggaacccagccctctgcagtggttggtaggaggcaagaccggaagacttcatccagagctgctggggtgggaagctgcctggtgcagccctgcagcgggtgaccaggcagtgggcctgtagtctcatcccacacacttgtctttggttcaagtgatggacttgcagcatgtatgacggcaggcctacatacgccacgccagtattaccatggctgagcaagtccctagccctcctgttcccaagcttcatggagaagacccagaacacccctacggcctaaagtggtcactgctttcagcaatgctatgacctgccc

SEQ ID NO: 19023 - DNA, 1181 bp, Mus musculus
gtagacagctgttcccgtcggtgaggagacattgtccttatttagatcctcataactcagaaagtgacagccaggcctgatagtgcatacctgttgtcccagcacccaggaagctggggcaggagagcgtggtaatcctcctacctcagtctccttgagcgctggaatgacagatgtttaccaccagagctggctgtcaaggctggtatttgcctcagcctccgggctctgccccagcgccggcctgctaacactctctctgtgtccccacgcagtggtccatgccgtggacggcatcgctgagaacgggatccagcctctaagttcctccgaggtggacgaactcattcacaaggccgatgaggtcacactgagcgaggcagggtccacagctgggccagcggagcctcggggactcgcagaggatgtcaccaggaccacgccgtccagaagggagatcacaggagttgaggctcaaccaggagaggccacatcaggcccaccaggcatccagcccggtcaggagcccccggtcaccatggtcttcatgggttatcagaacgtggaagatgaagcagaaaccaagaaggtactgggcctgcaggacaccatcaaggctgaactggtggtgattgaagacgcggccacgcccagggagcccgcacctctcaatggcagcgctgctgagctcccggccaccaaggaggagaaccagacggggcccacgaccacgcccagcgacacccaggatcttgacatgaagaagcctcgctgtagatgttgttctgtcatgtgagccgtcggggcaccctagtccccggtccccgtcctatgctccacactcaaacccagcagcccggccctccccggcgcctgcccaccctcaccctccgcctcacaggccccagacacgtgtgtgatccctatgcacctcgagtctcgggtggggggtgctctgcccgtcaccacactccacactcaccccgaacctctgagccgtgggtcaccccttggtgagagacaggccagcccatatcagcccctctaagaatggggacccctcagtccaggtcacagcaggtttacacaggcggcttatgcccaccgtggtcccagcctggtgtccccttgccgccccaggccagcctgtctgtgccttatcgttacttttggggagtctt

SEQ ID NO: 19024 - DNA, 1149 bp, Mus musculus
taattttgggagctttggggtcacctctgccctcttctctagttggtttggaccagggtcctgggtttcccacatacccccataccctagaagtcagtgggtatgtctgccagcgccacaaaacctagcatatccaggcaggtttaggctgctccacacacactttgggtgggagtaagggacccccccccatctgccacctggcctgacgggagcctggcagagggtcaccaaccttcgggcaggcagcagtagccactttggtccccagaggcacaaccctgcacacaggagctgactcaacttcaaaggaccacgcctggtctaggtccctttccttgggaccccagcctggtgtgcagcagggtgcagggcctcctgcgggccccgtcactacccgcagctacagtaggggctcaagcagaggccacggggtctgtgtcctgtccttcccgtggcctggaggagaggcgcactttcctgagggtgagctatggccgtggtcatggcacccccgtcttcctcctcctttgagtctgcctgagttcctcaagccctgagcctcggctgaagtgcccttgctgcccccttctgcttttgacgtgtggcaaggccccgcccttcacccccatgttcttgactttcccagagaaacaaattaaaaaaaaaaaaaaaaaaagtgtgtagagccaggttgctgaagttcttgggtttcacctgggcgggaaggggtgcggcctcctagtggtggagccataaaaaggctgggtcctgtagagcacaggagaaacttctcccctgcggctgctgcagccctcactgggcattttcgccaggactctgcggcacctggtcaggtaagcgacagctgtggccagccacccccacgggcctcggtctccacatcttccacacccatgtccttgggctgtgatgttgagagtagagaggtcctcacagatagcccacaagttctgagccaggttctgcatagtagaggagtaccccccttttttttcatgttttttttttttggagaattttttttcctttggcctcagttgccctatctgtataaaatagatgtctaggagtcctgtgttcccaacacactgggtattccagacttgagtaaaaggcctataacca

SEQ ID NO: 19025 - DNA, 1149 bp, Mus musculus; identical to SEQ ID NO: 19024

SEQ ID NO: 19026 - DNA, 1154 bp, Mus musculus
ttcctccacagcgtgcccaggcagccctgcaggctgtaaactccgtccagtctggaaacctggccttggcagcgtccgctgctgccgtggatgcaggaatggcaatggcagggcagagcccagtgctcaggatcattgtggaaaaccttttctacccagtgaccctggacgtgctgcaccaggtgagtgcgtgccctgcacctggtgcctggattcccacttggtcggccccagctagagttcacacatcctctcttgcagatcttctctaagtttggcaccgtcctgaagatcatcacgttcaccaagaacaaccagttccaggcgctgctgcagtatgctgaccctgtgagcgcccagcatgccaagctggtgagtaggacttgcttgggtgggcaatcctatgactggcccacgcactcacctatggctccccacagtccctggatggccagaacatctacaacgcctgctgcacgctgcgcatcgacttctccaagctcaccagtctcaatgtcaagtacaacaatgataagagcagagactacactcgacctgacctgccctctggagacagccagccttcactagaccagaccatggcagcagcctttggtaagatgctgtactgagacacaccaaatgaacaggggtgggacaggccacctagctgtcagggcaccctggcactgcacagcccagccactcagcagtcctgcccgtgcctggcccagccgtgaggtgaggtgcagtgattagtgtctgtttgtttctaggtgcgcccggcataatgtcagcctctccgtatgcaggagccgggttccctcccacctttgccatccctcaggccgcaggtattcacgctcatcctgaccccagcgcctgcatgcccacacagccccataactgtccatagaccgggatgccactggccccaagtgttaggccccaggcccccttccttctggggagaggggaaggggcctccagaagcatccacaggcagctagggcagggtagtctcaggcagggctgggccaggtgccctgtgctggcattaccaacaagcctctaatcactcagtctttggtctggttcccttcaagcacctctggcgaggacgaggacgcagtgtccctagtagattgaattta

SEQ ID NO: 19027 - DNA, 2785 bp, Mus musculus
tgtcccctgctgccttcctctgctgtctctaaagagagtcacaccccaaagcctctttattctcttcggtatgttattctcccttttattaccttggtttcgttttaattggttattttacaccctgctatgtactattgagtttgtgtttggccttctgcctcggtccgtggtttgcttccggtttgcggattgtactgagtagacacgcatggttaccaccctgcatgcttccagagctaagcgtgtcagtagcatgtgatcgtggctgttctgacagctgtctggagtctgagactgccggagcgcagcgtgtgttagcaggccttgggctgtgagacacaggctcccagtgcccactaaacagacctggcccactgggagctggggactcgacgggtgggtaatgagtgggtgggagaggttaggagaccagacagcttaaagactcttaccctgggtttccaaggcgtctacggtgatgtgcagcgggtgaagatcctgttcaataagaaggagaacgcacttgtgcagatggcagacggcagccaggcccagctgggtaaggaccaccacagggcacaggcttgtgcttgaagctttggttgcacctgggggtagggcaccagtgggcagagtgtcctgctgctcatggtttccaccctttgtccagccatgagccacctgaacgggcacaagctgcacgggaagtcagtgcgcattacactgtccaagcatcagagtgtgcagctgcctcgggagggtcaggaggaccagggcctgaccaaggactatggcagctccccgctgcaccgcttcaagaaaccaggctccaagaacttccagaacatctttccaccctcagctaccctgcacctctccaacatcccgtaagtcagccagaggtcttgtttgtgggtgggccacgaagggctcctgatctcccccaccccatccccgtgtgagcccaggccgatggctcccgtctgtctctgcaggccctctgtgtcagaggacgacctcaagagcctcttctccagcaacggtggtgtggtcaaaggcttcaagttcttccagtgagtaaagccctgcctttcgtcctccacccttaaccctaccccaaacctgcaggtttagctgactaccccccactccacccctgcaggaaggaccgcaagatggcactgatccagatgggctctgtggaggaggctgtgcaggcgctgattgaactgcacaaccatgacctgggcgagaaccaccacctgcgagtgtccttttccaagtccaccatctaggtgcctgtgggcctgcatcagcttccaccattccagaaaagccactttaaaaagcagctgaagtgaccttacagaccagagattttatttttttaaagagagatcagtttacctgtttttaaaaaaattaaatctagcccactctgcagtggcaggaaatggcttggaccacagaggcccagtcaatcccagcaccatgccttgaggggctcaggcgtgaggccacagcggtgccccaaacatagccgctttctgtgccttacaaaccagcgtgcctcatggccgtacacccaccctctaaggccaccagttgtctctagacctgcaggtgagccaggtggcctatacataggctccccaatgctgtgcaagagctggggccactcccctacacccttataatcaagtgacatgattctcccatgtccctggccagcccggagggtccaggccatcctcagctgccgagcctcattgtgacctttgtattctattccgtgtggtcacagacacctgtgcctagcaatatttccacttgaccaaatacccgaatcttttccatttatatgcaagagatatagttttaagtaactttttatagcaatgatacaattgtatgtgtgtattctgagcttctatgtcccctgagctccttccagtgaccaacttgcaggtgggcccaggccagggctggagaaaaagctctgagacttgtgggtttctaccttcaaaattttggaccaaagtttagctttctgcccgcctctgactgtgcccagttgaggggctgacctctaggccttaatgtcctcctgcacagccacctctatcctagcctgttcctgtgggaggggttccctgcaccctggttctgtggaaggcgtggaagagtgtaaatatttatgattttatacctgtggggctgaggcggtgcagcagttttttatggtgacagatgtatattttggtaacgactacaggctcagtattgtcctggggccagccctggccacatctaccccatcccagatggtgtattggggaagggggggggggctttccattaaagcagttttataacctctgtcttccctgagcccttcattctgagctgtaggccaggctgggcctggattcaataaacacctgtgtcttacactcctgcctgtcattgggcggtggggggggggggggggtggtaccacggagcacaaaggatgacaagggtgagatggctcagagggtagtaccgactgctcttccaaaggtcttgagttcaagtccaaaccacatggtggctcacagccaaccataataagatctgatgccctcttctgatgtgtctgaggtcagctacagtgtacttatgtatagtaagtctttgtgcctgagtgagcagaggtcctaaattccattcccaacaaccacaggcaggctcacaaccatctatcagtacagctatggtgtactcacattaaatcttaaaa

SEQ ID NO: 19028 - DNA, 1215 bp, Mus musculus
gagacctctccattttactacaataaaagcagcctttgttttgtacactgggtctgatgtctgctgcttcaggatgtagaacacagccaatgcctcgtatacggttcacctcctggagacgctgcagccaagctggggcaaaggtgtggcaggagtcacgtcccccactttgtacaaaagaatgtccgtcagacaggtcttttggtttctgttcctaaatcccatgttcagctaggtctcagcatttaggaggttgaaaaaggaggattaccaagagtctgaggacagcttggcctacagagtgagaaaaatagagggttggagagatgcttagcagttaggagtgtctgctgctctcataggggacctggactcccatatggtggctcactattgcctataggcccagttccaggggactggatgccctcctttggactctgtgggcaccaggcacatatatacaccttctacacataattaagaaaagtgagcttttctgcgctctcgctggaccagtgagcagggacggcctcaggatgcagaacgacgccggcgagtttgtggacctgtccgtgcctcggaaatgctccgcatgcaacctcatcattgctgccaaggaccacgcgtccatccagatgaacgtggccgaggttgataggaccacaggccggtttaatggccagtttaaaacttacggcatctgcggggggtcatttgcaggatgggcgagtcagatgattctattctctgattggctaaggctgatagaattgtctcaaagaacttttgagcagaagaaatcgggaatttgttacaaataaaagttttaagtacctgtgggggggggggaagaaaagtgaagataacctgataaataagctaggactggtgaagtggcttaccaggtgagcatgctagccatgaaggtgaaggagacaatggatttcagcgagccctctgcacacttacccacacagtacataaataaaataaatacagcatatagataaataataaaaataataaataataaaatagccaagcagtggtgatgcacacctttaatcccagcacttgggaggcagaggcaggcagatctctgagttcgaggccagcctggcctacaaagtgagttccatgacagccagggctacacagagaaaccctgtctcaaacaaacgtgatgatgatgatggtgatgatatccacttt

SEQ ID NO: 19029 - DNA, 1873 bp, Mus musculus
atggcaacccttggacttgattcttctgttccctctgtgggaggatgcagcctccactgtattctcacacacctgagaattgggagaggatgtgtgggggaggtttctctctgaattcagctctggtctgaatcgagtgggaagcctctagacagactcacagctcatggctagccagaccaccctcatctggtttctttaattgtttaggcagggtcactggtgtagtccaggctggcctccattgcattatatgtatagtcaaggtcggtcttgaattcctgatccctccaacctccagggctcttgcatgctagggagccctccacacactggacctctggcccagctcctccagtccgcgatggtttgtccgcaggtgctgacctggagggccggaggcagatgaaagtcagcaaccgccacctggatttcctgcctccagagcttctgttgtctgcctacctggaccagcaatgatggcagaacccctgccagctgcctcgcccggcccagacctctgtctgctaataagatcttccacgctttcagaatttgaatgccaccccttcccttcaggaatccccttgcccttgccccttcatgtcccagatcacacagggaggccttgtagctccccaccctggtacttgtatttgggtagggagacctaatggggccctatagctgtccaccctggtacttgtatttgggtggggagacctgcccggggcgtttccctgtgttttgtctgtttagctttctttgagacagaagctcaggcaaggagtagcagactgttaccttttttcctctcctaatcagttttaatgaacttggcatgttttggggtagatttcttttaatttctcttttgaagtggggaggcacaaccaaaacacctagcgccagccggtagtgggctctgttgtgacccctgcctgaccctccatgtttcagctctgatgagggtggctggtcctctctctaggactctgcagacctccccaggacactttcttgtgtgtgtgtgtgtgtgtgtgtgtgtgtctgtctgtctgtctgtctgtctgtctgtgtgtgtgtgtgtggcgcacatgtatgcacgccatgtgccatgaacctggacaagcattgtctcaagggctcattttatgcttttttttttttttttttttggtgatgtgtgtatcttgtccccagctccctaggccctgcctgcctttcagactgtcctctcctcctccttctcccctctccttatgccaggggtccaggacttccagccagaagcctctgaccttgtgttccctgtcccctcccctgtcccctctgctgctcagcatagctgtggtcactgcagaggtcttatatgttcagcaggcctggccctccttcccttccccttctgtgtgattctttgagcttgggggaaagggacgattttaataaagccttggtgctcgagtcctgtccccgtgtttgtctttaggtttggtgggggtgggtgagactgggagatcactgagggcacgagctagcaagctggacacgggggaacctcaaagtctctataacattagttcattttacaacatgtaaaatgcttaaagatgaggtgccaggttggggttcgatggggaaagcaattggttagcatgctcaaagccctgggttccatccccagcaccatttaaaccacatggtgaccagtgacaagtgattttgaggccagcctgggccatgtggtagacaggtctcattgttggacacctctgaatcctagcactcaggagccagaggctgatggatctctgtgagttcaaggccagctagtctacatagccagggccatacagtgagaccctgcctc

SEQ ID NO: 19030 - DNA, 1277 bp, Mus musculus
ttagctgccctccccccacccacgttagctgcctgtggtgccaggcaggtgcactgggctgtcatcctgaggcccaatggttcttcaggtttaacacacgcgtggggcagagggtctgcttcccgggtttggcgtccaatccctggagtgcatagaggtcggaccttggtgtcttagggcttaaatctggaagattgagggtgaccagagaagttaccattcttctgtgtgactggttcccgtgccttcctttctccgagcctcagtttacccttcttgcatcaaaacttgtatcctggggtggggctgggtgggggggatgaagccccttgttgccagggaaaccaagcagacccctcacctctgatggcctcctcacctggtacacaggtccctccctggctgtctccccccactcagcggctcacaggtgaagagggtctcagcgtccagacgcaagcagcattttatcaaccaggctgtgaggaattcggacctggtgcccagagctaagggacggaagagtctgcagcgtttggagaatagtaagcagggagtagggtgtgtttcccttgctgtgaaacaccccgtactggccaggcgttagaatagggcttcagagggtgcataggagttcagcaatgcagggagagatagatggggctctagagactgggtgggtgaaaaaaaaaaaaagaaaaaaaattggggacagtaggaacccagggctgcatgaccccaatctttccttccagcccagtacctgctaacactgctggagaccgctgggggccctccaggggtggaagatggggacctgactcctgctgcacctggcatcttcgcagaggcctgcagcaatgccacctatgtggaggtgagaccctaaggcctgctgcaacccctgagaggtgccccacccctcccctatatgctgccagatcctgggctcatctgcacttcgtgttaaaggacccatttgagccaggtgtggtgacacacgcctttaatcccagcacttgggaggcagaggcaggcggatttctgagttcgaggccagcctggtctacagagtgagttctaggacagccagggctatacagagaaaccctgtctcgaaaaaccaaaaaaaaaaggacccatttggagactactttatacacatgatagcatatcactggggcttccatggcgtgggagtgggtcgtgcctgctgagctcctatgcaccctttgaaaccccagctccagcatccagctcgtgctgcacacatgtga

SEQ ID NO: 19031 - DNA, 1150 bp, Mus musculus
ggaggccgaggggttttctcctagggagatggcgccaacgcacgcgtgctcagatgaagatcgatggcgaatccgcttttgcacgcttgtagtgttagggacgccaattttgatgcagaagggaaaatggggtccgttagaggtcatgcttttggacagcatggcagatcagagatcttgaggagccgcaggaagacagagaccgacggcccgtccttttgttaccctcgtaaagagtcgcagatcttcatagtcaggactgactgaggcctggggttactggttctgatgtttctggaacacagagcttccttcttgtccgctgggatccctactgctgagccctgaccctgcccttcactgggaggttctaggcagtggttctaaccctgagccgcaccgacaacccctcacttgagcagtctgtctccccaacccccttactcttgctctctgtactaaaaactttaaccttccattgcctccgttctgatactcacatagtttgtcttgtatcctgtgtccctaggatcagctccaacagaaaatcatgtgtcctgggcctgtcacctgtctgaccacagcacctaatggcttgtatgtcctggcaggaattgcagagagcatctacctgtgggaggtgagaacagcttgtcacacgtatgtgtcacttgggaatgctagagagtaaaactggttggtgtccagttttacctgaggtaggcaggtggtcttggagatcttacccatgacttctgaaaacaaaaatgtggccatgtctatagggtcctcatttgtgactgagatacaggacagtgttcaacctgctggtggctctagtgctgtcgtgagcaaccaggaaagaaacttagaaaagggcagtgaccagaattagtacagaggaggaggaggcaggaaccagaagcagtgcagaggaggaggaaagcatttatttacacttgtggtttatatgagggaagtcagcgcaggaagcagaaagtcagttaacatccatagtcagcagcaaagagaaatgctcccgtgattgactacacttgttgctcttgcagaggacctgggttcaattcccagcacccacagaatggctcacagccatccataacttcagttctagagaacttgacacctc

SEQ ID NO: 19032 - DNA, 1335 bp, Mus musculus
tgggtccccacctgctgtggctggactgagagaccatctgcctgtacttcccccatccaagccagaacctcactagcccaggctggcttggaaggcagggtccccctgcagatctgcttcatctgtcccagcctccttactaagccttgctgtattccctcatttgtctgcctcagcttccccgcactgactggagaattcagcctttgtaaatactaggctgggtgaatgccaagcaagatctaagtccccagtctcctgagcagtggggcagcctgcaccaagcccccataaacttcctcgggcaacaggagtggggcagtgtagaccagtacagccccattccccatgggagggaagtggacgctgtgtggtccagccatcaagtacggaggaaccttgaggacaaaggccactgaagggttccatggcaggaaatgtctggaacagtattcggggggataattcacatttgtgagatgtgctttcccactccccaaaaaggccttgcatgaatttcctgtcattcagctggagtggaaggtcccacttggcccttctgttaggagtgatagtgaatcctgacaggcctgcagtccagctgtctcatgttcagtgagtggaatagagccggcacccaggactgtgtggtgacctactgaaagagtgccaggtgacagtatagacaaaaaggagatgtcagaggaaggggagctaaggctggcaacatctcagcttcaggaagagcaccctgaggatctctgaagtggttggtgacaatggcaactaggacagactagccccagactggaaccctaaaggaccccaagcctgatgtcctttggatccctggccaggtgcctagacagcctgccatcttgagccaagccatctcattaaaaaccagctcaaagtgcagtcatcttgctggcttttttatttgcttgatggatgtttttttggtttggttttttgctttgcagggagagtgaggttttggggggggagggggagctgaccaagtgtagattcattcatcagggctgagtgttccctgcaggcagctgcagtgcaggattttgggggaatgccacatcttccagagcgtctgtgaggacagacctcagaattcccagcaggagcctcctggctggggcagcctctgttccctgatcctacaggccacgtttgggataacaagtgaaccgggttctgagtcagttgagttgggggacctggacaactgggagctgtagaaggttccagaacaattatagagtgcctattgtaatgcaagtcctgagacccaggagggcagcgtctgcccttgtgctc

SEQ ID NO: 19033 - DNA, 1390 bp, Mus musculus
ggatagggaggggcctgtctggcagggtagcttctcccgcccccacaggttcttctacctctaccacttcgccttctatgcctaccactaccgctttaacgggcagtacagcagcctggccctggtcacctcctggctcttcatccaggtgaggcccgtgcccctttagaggacagcccctaccgtgctgtcccccggtgtctggtcagcctttctgctggtgggcgggtgctcatcctgacacctgacctccacagcattccatgatctacttcttccaccactatgagttgcccgccatcctgcagcagatccgaatccaggagatgctgcttcagacgccaccgctgggccccgggacccccacggcgctgcctgacgacctcaacaacaactctggctcccctgccactccggatcccagccctcccctcgcgctgggccccagctccagccccgcgcccactggcggggcatctgggcctggctcactgggcgctggggcctcagtatccggcagtgacctaggttgggtggccgagaccgccgccatcatctctgacgcatccttcctgtcggggctgagcgcctctctcctggagcggcggccaacagcccctagtaccccggacagctcacgacctgaccctggggtccctctggaggacgcacccgcccctgccgggtcctgagaccggtgtcgtgcccggctcccagtggagccgcggcccgagcccaagagagctgtggtctgcagggagaggggctggtggcgaaggttctggaagcggccgggacagggcggcgatgggcacgaggccatcggccgcctggtgctccccagtgccttccacacggcgcccgcacggggccgagcgcccgggcccggactagcaggtggtggctcacgatgcggggcacacgttccacgctatttaattgcagtgtacagagtcgtgtttgtatatagaataaactgtcgtggacagtgtggccgtgtagttcctcagctctcggcgggcgccgcatgcagcaggcgcagtggcctgagccgggtgccatccccaagctgggcccgcagttcccctcgccgcagcagcgcactacgcagccgctcccgtgcagcctcaatgcgcagctccagctcccgcagttctgcttgcaccccgggcccattggagcagagccacggatggtccccgccagcctccccaggttccagcaggaaacgcacgcgccgttcccgttccaccacggcccggcgcacccgcctccagcgccccgcaccgtcggctgcaggttgctcctccttggggccgctaggacggagaggaggaggcagtactgcctgtctgctcgctaagcctgggaccccgctctgccccgcccc

SEQ ID NO: 19034 - DNA, 1103 bp, Mus musculus
ggaccctcagccagctagttcccaaggaggcacaggcagccattgcttctcctgcctgggaggggtgtgtcccccgccctgctgactgctcaccccacccccctcacccctaggccctgtttgtgcttttcgtcctcgcctacatacacatcgtcttctcccggtcccccatcaactgcttagagcatgttcgagatcgatggccgcgggagggtgtcctgcgggtggaggtgcgccacaactcgagccgggcaccggtgatcctgcagttctgtgatgggggcctcggtggcctggagctggaacccgggggcctggagctggaggaggaggagctcacagtggagatgttcaccaacagctccatcaaggtgagcgcgttctgggcatgtgggcttgaggtcatccacccagtggaacatcatcaggctgcctcctgcaggctccactgacaccgtgctcccctgtgcctgcagtttgagctggacattgagcccaaggtgttcaagccacagagcggtgcagatgccctgaacgacagccaggacttcccttttcctgagacgccagcaaaaggtgtgcagcccaggcagggagggttctgaggccatgctgagcatgggaccagcccagctgaccactctgtccctgtctgcagtgtggccacaggatgagtacattgtggagtactcactggaatatggcttcctgcggctatcccaagccacacgccagcgtctgagcattcctgtcatggtggtcaccctaggtaaggcaggctgggcgctctggcaggctggggctgggccaaggatggctcagctgccgagggcttcctggcctctctgaccaatactgacccccattcactcgcagaccccacgcgggaccagtgctttggggaccgcttcagccgcctattgctggatgagttcctgggctatgatgacatcctcatgtccagtgtaaagggtctggcagagaacgaggagaacaaaggtgggcctggggagaaggggggtgaggaggggggtgggaagggcccccggctgctcacagtccccctcccctaggcttcttgaggaatgtggtctctggggagc

SEQ ID NO: 19035 - DNA, 1201 bp, Mus musculus
cagggcaaaaccctttcacagcagcagaggtcaccgggagggattggtctggtctgttacaagctggataatgcagcagggtcccagcaagggtagcgtggccacgggagggtgtcctgaagctgaaggtgaactgtgcaaggggcagtgtttgaaggagcagtgatgggactttgggcagagtgcaggggctgggtgttagttttttcaaagttgaagggtgtggcttagtagatgggttggggcaacaggcaaagtgccacgagacggtccttgtctagtgtgaactctatgggagtagagggtttgggcagcagacaggaggagggtctggtgggtgctatacaatgggtgtggtttgggatggagtgctataggggctggactgtgggagggacttgatgtgggcgtggctgtgggcgtggtctagcccttgacgagcacatctcctccaggccaccatctcctactaccagctgatgcacatgcagacagcaccgctgcccgtgaacttccagatgctgtgcgagagcagcaaactatatgacccgggccaacagtacgcatctcacgtgcgtcagctgcagagaggcgaggagccggacgtgcgctacgactttgagccttatgtctctaacaactcctggtaccttcaccctgtgcagccacatgcatctagtgggagtgtgggtggtagacctggggaggcctcttactgacccccaccactaggtccccaatcatgcgtacacggaagggcagcttcaaccctggtgatgcttcaggacccgaagctgctggtagtccccccgaggaaggtggcacctctgaggcagcacccaacaaggaccacaggggtgagcatatgcaagcacacagagtggatgctgcattctgatggccgttgctgttggggggcgggggcacactttcttcatctctctctcaccctgcagggggacgaggtcaccaggttcataagtcctggcccatctccatctcagacaccgaagttggtctggacaccagctcaggtgaagtggcacctgggtgcgtgtcacacaggggagccccaggcagggccagcctggctccagtgtttcacaactgttttctatttaggggacttgaagaagttcgatcgaacatcttccagtgggacgatgtcatccagtgaggagctgggggatcaggaagctgg

SEQ ID NO: 19036 - DNA, 1347 bp, Mus musculus
ggttgttcccctcctaggccctttgggaattattggatctccctggttcctccatctcctccctgtctctgaggccaagaccaccattgccataggccagtggtcccaaggccctgccaccaccactccctcgcctgcctgctcccacaggtcgtgaagatcatccgccccagtgagacggctggccgctacatcacctaccgcctggtgcagtagccgcaggtgagcccagcactgcccagatgagcctgctacttgtccttgacccggtagagggtcagagctgcacccacaaaaataaaatgtaacgggagggtaggcttgaatcctaatgcccaggggcaaaggcaggcagatgtctgtgagttccagaccagccagggctacatagtaagcctcagaaagcaagcaaacaaacaaacccaaaacaacccatactcttgccaggggaaacctagtgctcagagactgaagcaggaggattgctgcacatctgtggactccttctcggtgtgagtgtctccaggaaaacaatgaagaggaacccacagctgcaccgcatgcagggaaacccagagcccactgctctgcacagcaccctgacagctgtgggccacagcctgtgggtcataactggattgccttttgactgacgggttccgtcctggccattgtcgcaggatgagtgactccagagctgcagccacacccccactccttactccagggtcactgttctgttcagagttctccattctcgaaggactctcctgagaattaaaggatactttgataagttactgtggtgcaatcctagagagccttggctcagggtgcgttctgtccctcctggagctcccagttgctcctgcctgagcggccagggccttgccactcttgctctgtggagtggtttccgaagacacacttgagttaccacacagcagactccctgttgtggaactgtggagggacttgtaccatgcaattgccaggctcctgggccacacccagcccttcctatccactttgaggtttgagagagggcagtacaggggcttcctgagtgactggggtgacccttcagtccatgctctcctgcccatctctgtgctgaggtggtagagtcccatcctgtgctcagattggcctagaagctgagcctcctgcctccggctcacctatgctctaccccaaggtaccagctaacggcccaagtcccctcccttccttacacagctcagtagtgctggctatgttcatgaggtcctgcagcaatcaggacagcaattccaggacagtatgtcagccatgttagtgccgtcagccagccagccaaccctgcct

SEQ ID NO: 19037 - DNA, 1174 bp, Mus musculus
cagcagtaaaatcagtccagttctgccctatgcctcggctgcctgtcactcgagctccagcgaaccagaggccctctgctgcatgcatatgtgcagatgacactgcagagatacacatacgggtttagaaatgtagttttaaaaagacagactggggctggtgagatggctcagcagttaagagaagtggctgctcttctagaggttctgagttcaagtcccagcaaccacattgtagctcataactatcttaatgggatctaatgccctcttctagtgtgcagatagatcactcatacataaaataaataaataaatctttaaaaaacaaatccacaatccctgggtagctatgcacagcaggacacaaagtaccccagaccagagggttacctgacatccacccacaggacatctgacctccaggcttttggttcctctgctcagtgatagggtagtcacctcgtatggggtgtatcagagaagagactccctctgtgtagcccctgacctcctcctctgtcctcagacctggcccctggcatcaacgagatacatgaagaaagccagcaggtgttcctggcacctgggcacccacaggatgggcaagtggtcttctacaaggtgagcagggattcaccgagcaccagccctagctccagcccccaaacctgctaatacccccacttgccacagcagattagcgtggaccgcggtatgaagtgggaagaggcattaactaggtcgctggagctcaaaggtccctatgatggcttctacctctcctacaaggtgagttgtcccactcctggtggcggttccctgccagccacctaccgggagatcccgatggcccttgacctcaccactctggctcctaggtacgaggcagcaaaatgagctgcctcctggcagaacagaatcgcggcgagtatttcaccgtgtacaagccaaacatcggcagacagagccagctggagaccctggacagcctgtgccggaagtttcaccgggtagggaaggccccaccctctcatggcgtctggggatgcacagggagcttctgagcctcttccctgctaacttactgtgtccccaggtcactgtggaagaggcccgggaaccctgggagagcagctatgccctgtccttggagcactgcagtcacaccacc

SEQ ID NO: 19038 - DNA, 1178 bp, Mus musculus
agagggtccatgtcgtgttacaaatgaatggttgggagcaaccagaatgttctgggttgggccagtgagggctctgcgtgtatcccaagtacagtgaattgtggtatctgagtccctgtgtactggtcaggggtgttcatgtctaagcctggctagaggccagctaaagaaacctgttgctgtcacctgggcacaggcatcctggagtccagggagatggccttttggattctgaagcttggccttctgagccccaggtagaggttgggtactcagggatgccactaggggtgttccggagttgacatttttactctggctctgtgggaacctggtagcactcagcattgggggctgggtgtgatgtcctgttttgctcactttagatagtcaggggctgccacccccaaaccccagtcctgggcttctcctgaaaaaccagcctgtctggatacccagagccacattcctttctcctgccccctcctgccatgcctgggcctctccaatgtgccccgcccacctgcttcctccccccccccgccccccgcccccgaagggcggggctggggaaagtgccgcagagaagctgtgggactccagacactccagcatctgacactgtgtccttggacccctgctgatcattcaagagtctcctttggggaccagtggctggcctgtagtgtcgggggtctgaggtgtggcctagagagtcattagaataattggccctgtggacatgctgacttccatggtcaagactgactgtctctctcaggttttggtaagagtcccaggtgaggggctatagctctagggacagagcacttgccaggcgtgcatgtagaaagccctgggttccattccacagccatataaaccttgtgttgtggggtggttcacactgtcaccccagcactctggagttctgctacagaatgaatgagtccagagtcaaaaccacagtgggtgtgtctgagtggccatagtgtccctgaggtcttctctctctttcacttacaggcagaccccaatttaggccacactgtctgccctgcaggctgtggaaatgggtatagcaggagtcagtcctctggagtcaaggtctatccattgacagcattgctgaggtgaggcttccaccaaccaccagcctagagcctcccctataggcc

SEQ ID NO: 19039 - DNA, 1130 bp, Mus musculus
tcgtgtccgcgacttgcgggtgtcccggtgtcccgcgtccgggtggagtctgcgccccgagaagtcgtagaactaaggggccgcgcgcggcttcggcgcgggccggacatggacggcgcggaccggcctcgacgcggccgcctgggcccctgagcgcggggcccaagtggcgaacatgacctagcggcccgcgcgccgcgacggcggaccgtcgcctccgtcggaagcagcgtccccggggacccgaattggggggacgcgagggttgggggggctcattgcttttttttttttcattcttattttcattttttttctccctgagcacctagaagaaaaggggaaaatcaaaagtgaagaattggcgcccaggaagcggacgtggacccggttgtggggaccgggagagttgtggaggtcgttcctgtttttccccgttccttttttccccttcttggaacatttggaagaagcgggtgggggggggggaattcgaacttgaaaagaattggcgctcccgaaggggacgaggacaaagagtgggccaggatggacgtggcggaccccgagccgttgggccttttctccgagggcgagctgatgtcggtgggcatggacaccttcatccaccgcatcgactccaccgaggtaatctaccagccgcgccgcaaacgcgccaagctcatcggcaagtacctgatgggggacctgctcggggagggctcgtacggcaaggtgaaggaggtgctggactccgagaccttatgccgcagggcggtcaagatcctcaagaagaaaaagctgcgcaggatccccaatggagaggccaacgtcaagaagtaggtgccaagggcctggggccgacgcgggcgctgccttgagctccttgggcagcccttcctcctactttctggctcttctctttcctctaaccgttttctcttctcatttccttcctcctttttcatctctttccttttactgccttatctaccccatctatccctgagcgtcacctcgtggggtctgtatgttagggcagcctgcaggactgtcctagcaggaggtcgtgcagccaactgcgcctccagcccccctctttgggccaggtcctggcgcaagtcgcgcct

SEQ ID NO: 19040 - DNA, 1104 bp, Mus musculus
ctgggcactgctttgagtggtacgtacaggaaaggaaggtggacagatatccaggatcagatgtgtggacccaggggtggagcagggcaggctggtggcctaggctcctctcaggacctccttggccttttttgtaggagtggtcttaggtcagtcttgcactggggaacctgggcacccagcatcaggtgttccttcagaggcctgagcttggaaattcctggcttgaaatcattgtctcaaggtggaggtgccagaggttgctcacctccaggtggtgtctgctggtctccaaggcaagtggcttcctttggcttcagggtaatggttcttggaagcccaccatgtctgggaggctgcccaggcctgcatcctggcttgggtcagctgcagtccttgtaacacatggcaagcctgtgtgctctctctgcctgtgacagagggccccagagctctgtctgcgacttcctagccctcacctgctgctttaggcttcctgccatctcaacacccaggttggggtgtggcttgcagagccaggcaggttcagctgagagagattggtccctagatcctgaagtaaacccccccccccatgaattagtgatgctggacacagtcaacactggaggtcatcaggactggggagctcctacacactagggtgatataaggagcctgcacggttcctcaagacaggagttggtctgggcaagtagacacatgcctctcattgcagtgctggagagactgaggaaggaggattgcttctgtttctagaccagctaggagtgcatgggaaaacctggttttataagggaaactggttggtagggtgaaggccccaggacccacaaggtgaaagcagactcagttctcacaagtttgctctgacttccatgtgtatgctgtggcacatgtatatacacacacaagataaaaaccaggaggagaaactgaggcaaaagctgcagactgacacactgccctgcagtaaggtgcttgactggcaggatacaaagccaggtatctccatgggagtgctggtgttccccacttcctgagtggctcctgcagggcaaagcctagggctgctgcacctgc

SEQ ID NO: 19041 - DNA, 1599 bp, Mus musculus
ggagctcttgatattggggtgctgggccattgcctgggtatcagacctgagctaagggaagcttctgggataggccactggccccatcaacttgtcacacagtggctctcgtgtgggaccagcgccttcctcgatggtatcgtggtggctgttgccagtctcagggctgaccttcagctcatcggggcagtccagggttgtgaggtggggcagtgcttgggagaagccccgtggccctcttagcctagcccgaggcacgttaggtgctggacttgtgccgcctcccatggggctttgcttgtcctggtggtccttctccactatggcctgaaaccaccacagcccagatgactgtccactccctgggattgagccaggtgtcacaggcaaacaggaggctccaccagagatgagcatgtgtgccatgactagatgtaggcttctcacagcaggcagggtcagctaagcaatgtcctctgttgcagggagatccagctgctgcggcggctgcggcatcggaatgtgatccagcttgtggacgtgctgtacaatgaggagaagcagaagatatatcctgtgggtggagtgggctggggtggcccctgtgttaggggctggaagccttctgcaaggcctctggcagcaatagtgctacatgtcatcctgtggtgcctgtcagctcatcaggcaggggagcaaggcatggggcttccacctggtgccagcctgttctgagcagtgtggctgggactgggcatggcctcacagggacttggggcctatgtacattgacagggccccggctggttctagaggtttccatgctgccccttcccagaggtagaggttgcacagcctacgttgcatctgggcagtcctgggagcattctgagaacccagtgccctgcagccccaactcctggtacccatctctccctgtggctagtacaccagctgatttcagtcctgttgtaatctatgctgactccatgtggtccaagtcactgtggtggtcttgtggaccctgtgagtactgatagggagcgcagaatggcgggagagcagagtggtggtggtctgttggcccagcggggccctccagaccactgttgctaggagcagggctcctgggcttggtgtgctgctttccttagcgccctacgtatatggtgatggagtactgcgtatgtggcatgcaggagatgctggacagtgtgccggagaagcgcttccctgtgtgccaagctcatgggtgagtgccctgctgggtgcaggaggagcagccattgtcaggaaacccaggtgtttctgggcccccagtttttaacccagccaatgtgcttagggttaccctcttgttaggccctgtggtcccgctgccctgcagagccatagtgggtctgagtcctgttcagtgctcccaggttcagcagaatcacatcccctggttagcagagaacaaagggaagggaagggaaggaagcaagccagaggggaaacctggctccctgggcctgggcagcagtgactgccagttgccctgtgtaattttagtggcccagccttctgactctcaggtctgtttgcctgagccctaaa

SEQ ID NO: 19042 - DNA, 1200 bp, Mus musculus
tccaggagcgtgggcagtgggctgtgtgctgggttccacagccgcattgccaagcactggactgtggagttacatgtagacactgacctctggagcctgggaagcttcaggagaggccatcttttgtcccactgcgagggcaggccaacagagcaagctggtctgcagccctcagctggatgatctccttcccggtgctcatcgcagctagtagctcccaggccgaatgcttcatctccttgtgcctgtactgagggtctagagcctctcccttggagagctctgtgagctggtgctgggctgcccaggctagacaggcaggtgagcgtgggcatgctgcaggagggccagggcatagcactgtgaaggcagtgggcctgcttgcctttggagctactgaggggtgggtggcaccagaggctagagcacctccgaccagcctctgtcacagttggggctggctgggccctggggctttgagctacctgccccttggctcaagctatgcttgccatcttcccgtaggacaggtcctggaagaggaagtgggtcagaatggacagagccacagtttgcccaaggctgtttgtgtgaatggcacagagccccagctcagcagcaaggtgaagccagaaggccgacctggcaccgccaaccctgcgcgcaaggtgtgctccagcaacaagatccgccggctctcggcctgcaagcagcagtgactgaggcctacaggtgggcatgggcctgggtccagccatccctggtgttcacagtgggtgtctgctgggctcctagctccttcccgtagggcagtgctgcaagggggaaggtctggtggttgaggtggtactaagtgaccacccattctaccaacagtgtgtcatcaggatctctgggcaggtgtccctgcaaggctgggttttccaggcctgcctgtccactcacttcgggacgttggagccgagggcggacctgctgccccagaagcactttatgtcgagaccactggccggccttgcctgcatgccgccctgcgagcctcgctgtctttgggttggtttctttttttttaataaaacaggtggatttgagctatggctatgagggtgtttggaaatatggagcaggcggggcacagggtggcctgcagagaaaacccagagcaaacaaatatgcagagacatttatgattaaccagac

SEQ ID NO: 19043 - DNA, 1173 bp, Mus musculus
agcatcgaggggcgcggagcaggcgacgaagtttcagaacttcctgctccagcccgcagtcctccccgcagcccgcgagcctggccacgcaggccgcgccgcgattacagcatcgacgagaagacggacgctcttttccatgagttcctgcgccatgaccctcattttgacgatgcaccgcgtcaccgcacacgtgcacatcctcacactcatgcgcggaagcaatggcaacagagaggacggcagcacagcgaccccggtggtgcacgtgcagccacgccccctggagtggcccgccctacacgtgcgccattacgccgtggggacagcgttgattgtcctcctgaaggccgtgcgctgcccatcacgggtgatgacccatccattcctgtcatcgaggaggagcctggcggtggaggcggtggttgcccaggctctgggttgtgcgttgagcccgccggggccctgctagacaagctagcagccagcctcgacgagagactcttctctccccgtcttgctgagccagttgcctcatcccaggtgctgattgtcgctgctgctgcccctacatcccctgaccacagcccggcctaagctctgtactggacctgcctctctgctgcttctccggcagcacatggggctgctgtgggaatggtggcaacagcgggagcaacctgaggtggccgtgcatgggtacacggcccccaaatcccaagtgtgcacatatagtgtcccctgggcacttagcgcagtggcctccggaagcaagaggctccaggacccaggctcaactgcagggaggatgacgagactggactctccggtccatatatggttgaccccagcacccagcctctggccacagatgctggtggagcaggttctgaggtgcatgtgcagcctccctccaggatcagctgaccctccactcgtgagcactggcaggcagtaacactgcctgccactgtgtgagcgaacctactggaggtgaagtgactgtggggcactgaggatcagagaggagctcgccgccccatattctgagttgatttaccctgtccatggtatgcgctctacctttcctctctgagcaataaccgaccgcgcctgctctctgcatgtgcacaggctccccgtctcattcctccccgagagccttgggctttg

SEQ ID NO: 19044 - DNA, 1636 bp, Mus musculus
ccttttcggtttgctttctgattttaaagcagtgtttccttagccatgctgactttgaatttctgatcctccacctcctgggtgataggggtgacaggtttatgttggcatacccagtttctgccttgctgagggttgaacccaggatcttgcacatgccaggcaaacacagtacccaccgagcctcagtcctggctcctcttttacacttagtttgagggaagacctctctgtgttgtcttgagtggctttgaactggcagtcccctacctcagcctccccagggggctaggcgacaggtgtgcaccgggcctggccatcctttgccaccatccacatgcttggcctgtgccccagtcttgcagggtcactctgcaagtggcctagagtgggcattggcctggggaggcagagggctggtggccctgagcacacatgggcggtgaggctgcccaaggaggctgctcagaccctctcctccacagtgagcagcggctccgtcactgtgaatgccgactcctctgtgcagttactagctgaagaagctgtgacactggacatgctggacctgggggtgagcagtggatgggaaactaaggcagggcagggcagggcaagtgctgctcacaggagtgtgctttcctgcttccggccctgcctgtccctcacactggcccactcctctgcaggcagcccgggccaacctggagaaggcgcagtcagaactgtcaggtgcggcggacgaggcagcacgggctgagatccagatccgtattgaggccaatgaagccctagtgaaggccctggagtaggtggtacctactgtctgacacccacggggaaactgagccaggtccaggccgatgagaagttcccagtgggctgaagtggccaccaggggtcagcagtgctccagttgctgggcttaaagcttcctggtgcctgtctgccaggtcatggaggattccccaatctggcatccccacgatgcctctggagagatggccttgattgcccctcaaagccacctgaaccgtcgtcaacttacccagcctgtctccattaaacaccaggaaccaactgagtgttctgtttctaactgcacagcacaaagctagggctctcttcaaccctgcctggggttcctgtgtctggctgggcccccagaggcaatcggcgactctgggtaggaaacatggtggctggttgttggggtgctgcctgctggaatgggtgggatgggcaagcgttgagggcagggcatgaagtaatgggtgtgactagtgctgctggccaggcaaagcgccctgaccaccagccaggcccccctgtcccaccccacaggctctgggaagaatcgggaaccacctgctcccacagaggctccgccctaggcacacccaacctgtgggtggccctagcctggctggctgccttcccagtcccagttggcacctccttaggcacttaggcccctagctgcccctgggtggggtggggaggcctggtagggggtggccttggcaccaccccatacctttgtacaaccacccctccccttcccaccccacccccatggccaggtattatgctggcttgccctccttttatataacccacttcagcagcctgagta

SEQ ID NO: 19045 - DNA, 1117 bp, Mus musculus
cccagatcttgcgagcggcggctgcggctgttgctaagggaagggacgcgcggggtagcacgacccgagagggatccaggcaccgtgcgaaccaggatagcttgccccgtttctctaggaccctccccgtgccgtacccaggtcgctgtcatccgcccttgaaaacggatcacagaccccaccccggggcgcaacccaaggatcccacacgaccccggagcaccactcggattcttgattgccggctcaattcctaacgttgggaccttccccaaggggcgcacgcactgctcctgtccctgggcgcccgcggagcggaggaggaccttgtttcggcgggggagtcccggctaggattggaggcgacccgcaggcccccagttctccagcgcgcgccggggatggagccgcagcccggcggtgcccggagctgccggcgcggggcccccggcggcgcctgcgagctgaacacggccacggagtcggccgcacccatgagcctggcgatccacagcactacggggacccgctacgacctgtcggtgccccacgacgagaccgtggaagggctgcgcaaaaggttgtcccaacgcctcaaagtacccaaggaacgcctggcgctgcttcacaaagacacgtaggtagagcgccgcccccgcctgcgcgccccctggcaccgggccgccccctcgggcccgggccccgggcgggaacaaagagcgcgccgcgcggggaagcaggggcagccagacgggggggggggggggggatcgggggcgcgccgcgcgctctcgggcgccctctgcttggccttacttgcttgggccccttcccccgccggggtctgcacaaaggcaggagcaccctgcggggccccagggtgcacgggaaatacagggatgacaggggagttgtgggcccccgggatggcacaaggaggggtccgttcgctgtgtgcctggggaggggtgcacagccaccccctctcatgccggcggtctcgccgcttccgcatctgcttggcggccccctctgcgtctggctgtctccccatcacttgcgtctctctacccccctttgttctcggttccccacacctcctcctcacctggtattt

SEQ ID NO: 19046 - DNA, 2081 bp, Mus musculus
ctggggggcacgaggtcacctccgatgccacttaccagcctttctgattcttttttagctccccgattgtctaccccgcatccctggtcacatgcccactctattcccttaccatggtcacggcctctgcaacagggcccttccctcccacctctccagctccaaatatgtagcagtctgttcccggatggcccagacggaggaagccacccaccccagcccttccgctctgcctagctctccccacccccttccataacccaattcaggtttttaactcaatgtagattctccaagcactttacagatgagggttggggaccccaggatgagtcccacccccacccccaccccagtctgcagacttggccactgttccaggccagctggatcccctgcccctcccaccccggaaagctgatagactcacagaggatacctttgtccacgaagcccacttaactcacagccttcctcctgcctcagtctcccaagtgctacaatgacgggcctttgccactatgcttggctggccttgctcttgccacaaaagctcgttggatggaaaaagctgaagcaagtggctgttctctgatcaggcgggggatgcctcttttcctcgcgaggcggccatcctctctggacactggcctcgccgtctctttcctccctccacacacccacttatttccttaaccttctttcccaatggagcttgggggactatttatagatttcatttttctcactgagccagtgatggttgctatcctctaggaaaaaaaaagaaactggggtaggttgtaggaggggggcccagaaagacacccctgtacctcttctccaggcccagcctgccactggggatgggaagaggggttctggactgtgcctgcattaactccacgctggggagggcgcgctgctggtccacattggctccatgggggagccctccccttgagttggggctgatatagcaggagtgaatcttgtgggggagtttttttcctccacattttgagattttgtgataaatgggatgtgtgcccacccctgacatctgtccatgttgtctagactccacctgtccacggttcctttgttctaggctgtgaacccgtccttgtctcttcccccactgtgtgtttaaaccttaatggtttgggatgtgaacgtgtgttggctagctgtaaaggttttttggggtgggtgggtgggaaggggatcctgaacggtagaggccaagcgagaattcggtttggtttttttttttttcctatttttttttccaaaaagaaaagggaggggggtgtgagtgggtgcattttttaaagctgtcttgaatacctatttaaatgtgtgttttggggtgttttttttagggttttttttttaagctgcctgtgatatgtccactgggctgagattggaggcctcaggcaggagcccacccatagttctcttccctatgacgacttccccagatagcattagccaccctggggggcagggggggaagaatccggctgtggggtatccacctcgcccaagtctccttttactgaaataaaatttgaggggaagagaaaaaacttacacgagcaccgaatttcaaataaacgaaaatgagacatgacctcttgcccctggctgttcctttaggagttcccaagccccttgtctggtgagtagtgagccctagttcctgcaaatggtttcccaagcagctcccccagcttgggaccggcaggaagctgcttagggtggaggggggggggggcctggccacttcctgctaccgaggaccaggacggaagtacctttgggcgtggggccggggcttgccctgggcgacgctttcaccctcagttcctggctctgaagtgggctgaagacgggaacttgggagtcagtactggggcaaggcttcccagctcccaggagtgggaggtgttgctccagcccagaaactgggaagtgcctgtgagagtcgcacgccaggcaaagggagtcagcactgtgacttgaggttctcagggagctagacctcaccagcctcttgtgacctgcctctcctc

SEQ ID NO: 19047 - DNA, 1212 bp, Mus musculus
ggatgaggtgaagccatctctgtccttcctggaataccggagatccaggggcctccagctgctcctttcttctgtgtcctgttatttgggtcccagatggagcccaccgcggacttgccttgcattcctcaggccaggcaagcctgagccagaaagggcgcacggtgccagcccctctcggggactctgggggtgccatcccccactcttcttccagccactctcgggccccactcccacatcatctcagaaacccttcagccctcgcaactcgcccctccgggcccccccaccaggcacaaccatccccggggccagccgggacgttgtcggtttatttctgtaaatagaaaccagcaagtgtatactgtgatttattttaatgtattcttaaggacagaatggaaattctttaaaaaaaattttttttccgaccttcaattcaaggggtcatttattttggtggggggagtggggtggactttttaggatagaagcaacactttgcaataaactcatttttttttgttccgttggagccctcccccttgatcatgtgacctagtaatgtttataacaaaaaaaattaaaaaaaaaaaaagaagaaggaaaaaaaatacaggactggaaaggaaggggagctacctaccaaaaatacagcaggcaaaggactgagtgaagctggccacaccacacgtttatacggatttcggatttctacccacgtttcctcactctgttttctatatattctatataaatatatattgtggatggccgccatggcgagtggtggctggggcttttctaggggcgggggacgggtggcccggccccctcatcacaatcagctttgaagtctgtatttttttataataaaatggacaaactgttaagcgtgggcctctctgttacaggtgtgctagatttccgacagagttgggggttccggggagtcccctggctgcggacagggtccgctgcttcctgtctgctctcacggttacttactgggagggtccaccttgatggcgggcctgtcggcctgtcacccgcggctgggtggcacatggcggctgaggctattcaggccagcggtagcgagcaccggcaaacaaaagacagcgcggtgggaggtgagactgacaccgatgtcgcccctggtctttgtgcccgcgctcccacaggcgaatacacaataaataaacattg

SEQ ID NO: 19048 - DNA, 1146 bp, Mus musculus
ggccaagggtgcagagagccacctgcgggctatcttgcacagccgcaagccctcacgctggctgaagacgttcctgagctccagtcagtgcgtgacttgcatggagacatacctggaggatgaggcgcagctggatgaggtggtggagtacctgcagggcgtctgcagagacatggacggccaggtgcctgagcgcggcagtggagaccgcattcgcttcatcttggatgtgctgctgcccgaggtgggtgccccacatcctcatgctcagcaccagcagggcctggacagtctccctgctgaggcttccaggaagaagctgccagcctgtgcctgtctgtccccgtgttgctgtgggtgggacatgctcacatgaatcggaaaaggaaacagtggtacgctgtgtgctcatggtgtctcgggctggcctgaaactgggcacgctctcgtctcagactcctaaggacttgggacagttctcaccaccacacctgacccctcaagtcactgtaactactactgtgtgtaactttaaaactgggtggttttcgccgggcgtggtggcgcatgcctttaatcccaggactctggaggcagaggcaggcggatttctgagtttgaggccagcctggtctacaaagtgagttccaggacagccagggctaaacagagaaaccctgtctcgaaaaaaacaaaacaaaaacaaaacaaaaaaaaaaaaaaactgggtggttttgaccatgaccagctcctaacactggaaatggagcccaaggcctcatacatgtcaggttagctttttgttcactgagccatggcctgaccctcattcttccgcaggcaatcatctgtgccatttccgcggtggaggcggtggattacaagacagccgagcagaagtacattcgtggccccacacttagctaccggtaggtcctcacatggccgtgtgctgtgctgtgtcccctgttgtgacaggactgccaagcccctgtccacaggtagtacaagtgctgtgtgtcagtgcgcaggtgtggtagggtcagctgggccttctttccagacaagggctggacaaaggcccaggtctgtaggctgtgttctgctatgggctaggctggctgcaagccaggaggaccctagggc

SEQ ID NO: 19049 - DNA, 1208 bp, Mus musculus
tcaatgcgtgctcatgtctaggacacagttgctgggcagctgtgcctggttcccgtgcctggatgtgacaacccctgtctgacaattgtccattgacaggcatgcccctggacctgccttagtctcctgggcagtgcctaaggctctggtgggtaccctactggagcctgaagctgctaggacaaggtgcccactgcggagaccagacataggtgcatccatgaggagcgtaagcacccgtggacagagaacattgagggaggcaagtcagtcccaggagattcctgagggacagttgagccaatccaaggacatcaagaggggttattcatgatggccagagcagcagctaggcctgggtgctacctagagtcctaggcctagggcaacctctggcatcaggtgcctgccaagcactcagtgtcactgtgcccacgaggtggagagacaatgcctgcacagggctgactgtctgtgttctgccagagctccctgtggcctatgaccttcggcctggcgtgctgtgccgtggagatgatgcacatggctgcgccgcgctatgacatggaccgcttcggtgtggtgttccgtgccagtccgcgccaggctgatgtgatgattgtagctggcacgcttaccaacaagatggcccccgcgctccgaaaggtacatctgggccccttggccccttctactgccttgccacctgcagttatctgacctgtgtgtcttgtaggtgtacgaccagatgcccgaaccccgctatgtggtgtccatggggaggtgagtgtgtgctcagacgcctaggggtgcagggcccacccccagctggcaccttcctcccagctctgctctgtagacaggaaaagctccaggcagcccaaggctcctcctccgtgctctcctctccctctcctcagtctttctcttcagctgcagtaacttgttcatcctatagtaaatgcatgcatggagcctgagtccctgggttcctgtgcctgccaggcgaatgcgcacatcctcgacccaacagcttgggtcttttcttgcagtggaggctgtaggggagacccctttaaatcctggtacccacacaggggcccacaactgcctgtgacactagctccagacaatccaatctttaaaaaacaaaacaaaactgggtgtggtgaccaactctgaggccaaggcagtctgatctcggagtt

SEQ ID NO: 19050 - DNA, 2088 bp, Mus musculus
atggcagagggcaacttagagttggttccgctgctgggatgtgtactgcagagccagtacctgtagccactgagccgtccttccagcccaggagtgcaggctttctgttggcttgagactggctggctcttagtgacctctgcagcagtcctgagtggtaagcacaggcccacaggtaccgccctgaccacagaccttccattcctgtggtccaaggcaacgtgcagtgcccgaggaaggctgcaggcccggcctcctggagtccccagagcagccatgcagtttcaggacatggtctggtttcagctgactcagaagccttatgagctggagtagcagtgggtggggatggggggtgggggcaggtggatctggagttgaaggtcagcctgggctacatggtgagaccatctcagaaagcagtacaaagccacagaaaagggttgtgtggtagccagcctgtggggggtgatccctcagaagtcactgacccctttccttcttgacagcagaaaggacccaggagcgacagcagcaaatccaacaagatctttgtcgggggcattccccacaactgcggggagacggagctcagggagtacttcaagaagtttggagtggtgagctctgcgggctgtcatggccgccctgtctcctgcttctccacatcagtgttgcctggggttttaaggagggggggtcagtggacagtgaggcgcttcccatgcctaggaggcatgcacgctacgctgccttatggtggccagggcctctgagccctgtgccacctggacacctgggtttatgcccacagaggattccgctataggagagcagctggcctggtgctgaggtgtgtgcactgtctcacctggtgccttccagagcgtggaaccctttgctccatgtggggatttgagtagctaggtggggcagacaagataagacgggcttaaactgctaggtagtgcactgggcagcatcctcatgaccctgggtagtgtgtgtccatcagacttcatcccacctggggcatgcagcccccacagttgctggtctgccttagcaaagttctcccttagctggtccctggggaccttatggagtgggctgagtgggtctgtggcatctacccccacaaagcctgcctcaatcacactctgtccacaggtcacagaggtggttatgatctatgatgcggagaagcagcggcctcgaggtaagggctaagcctgttcatcctgacccatgtcctcccctcagatggcaaactatctcaccctagacaggccatggtcagatgctgcacagccacttccactgggccacatacttgacacagtctctgacctccactcacatcacatgctctgctcctctcccatcaggacattctgaccccttcacatgaagatgaacacagctttttgtctgtaaaggtcctccaaagcacaggtgccttgcctcatccagctgtcccagtctgccatgctgactgccccagcctcattccacccaccgccctagctgcccacgcccatgctgaccgtcccaggagcggcgggagacagctgtgctctccggcccttttcctggctgttggttaccctcatttttggttcagcatcctttttggaccacagtgctccacgccacagtccctcacctcacacaaccctcccttcacaccctgcgtccctcaacacacacaaccttcatgcacgtgtccctgtcaccgatggccactcaggtctcgtggtgcgccaccactcaggagcatagtttgccatttgagcctcctcactcgtccagggcgcactgctcactcgtgtgcttagctgttaagtcttagtcttaatttacggtagacatacatgcttaatgacgtacgtagtgtcatagaatacggtaccgttaagtaagctgtcttctctcttctgtgattgtctgtgattaacgatgtctctctagatctctctccaggtgctaagttaagtcacacaggtacaggcccgcccgcagtcagaggacggagcggctttgctcccgtggggtgtaaacgaagtttcagtgtgtttgtcccgctgc

SEQ ID NO: 19051 - DNA, 2183 bp, Mus musculus
tgcttgagaccttgtacatgagagaggcagaaacacagagacagagaagacaaagaaaaccagggacagagagacagacacactaacaaaaaccccaaagggagccacgcccctccggagggtagcggcgcttttgctctggcctccggacagcggggggcaatggcgagtatccgcagagcggaagctgttgagcggtggaggcgggccctcccggcagagctcgcgataactgcgcaagcgcagcccgtacttccttttccgagtaaccgccaagatggtgagtattcgtgcacggcggtctgtgctcccgggtatccgtcgccatcctcccggggccctttcgcaagactctggactcgctgcctggggatgtagcgatgtgctcgggtgcccggagactgcggatggcgggtgcggaagggcccggatggctgcgggcggccgcggggctgtgtgtcccctcgcccgtccgccgtagcttagaggagcgcggctcgcgcagctcaggtccctgggctcccgggtaaggttgccgagcccctgctaaccccgactcgcgctcacgcaggccgaagtggagcagaagaagaagcgcaccttccgcaagttcacctaccgtggcgtagacctcgaccaactgctcgacatgtcctagtaagaggccccgtcaccttagtcccgccgggtcgctggcccgtttgtacattttccttttctgtgggtggtgctggaaatagagccagaacctttgcacatgtcacatgggagaggcaaggaagggtctcgagtgccgggcaatggtggcgcacgacttaatcccagcacttgggaggcagaggcaggggaattctgagttcgaggccagcctggtctgcagagcgagttccaggacagccagggctacacagagaaactcttgagtcggaaaaaaaaaaagggacccgtgtagcccaggctctcctcgaactcctgatcctctcaacctccctaatgtttgggtcaccatcacggtgcagagcatcaaactcggggcgtcctagcctcctaggcaagcgctctagattgtgacctcaactcggcccctgctacagttgtgcagtgttcgacagtcttatgtagacagaactaccttgcctcagtctcccgctgactgggctcacaggcctccctgtgaccttggggaaaatcaaccacggataggtaatttgtctgggtgggctgtcaaaggaaaaggtttgatctcggcttacgtcactgcctgtggaagctggtggattcattttagagggttgtgccctgaaggttgacggcagtgctatggaggacttgtctttagtgagctcccggcatgttcctttctgggtgtgaaagaaatggagcagtgctggcgcagcatgctgtccccgggtctccaaaccacccccttctcccacagtgagcaactgatgcagctgtacagcgcccgccagaggaggcgcctgaaccgtggtcttcggcggaagcaacactcactgctcaagcgcttgagaaaggccaaaaaggaggcaccacccatggagaagcctgaggtggtgaagacgcacctgagggacatgatcatcctgccggagatggtgggtagcatggtgggcgtgtacaacggcaagaccttcaaccaggtggagatcaaagtgagttgtggtccgggagtggctgggtgggtggcttttctctgtgccaaagctgctcacaccactctgcttcctcctctcaacctgcagccagagatgatcggccactacctgggcgagttctccatcacctacaaacccgtgaagcacggccggcccgggatcggtgccacccactcctcccgattcatccccctcaagtagccgaggccaataaagactggttttggtccctggattctgggtttttgttttttttctggggattgggttggtccctgtgtgtggaacctggagccttttgggtggctgtcacagtccaccagaatgaaggtgaacagttacatgtaaggggctcacgtccatgtccacgtcatctctgctgcagtctccgctttcaagctgcccagcatgcacggcagagctgagcatcaggaagggcaaggggctgctccctgggtttgggtcttgggggggggaactgcagtgacagtggacacacaaggggac

SEQ ID NO: 19052 - DNA, 1255 bp, Mus musculus
ggtcacccaaggtgacagagaagctgtgtggagtttctgaaaggggctgtggtgatgcgcttgtggactggtccctgtgtgccctgtcagagtgtgttctcctaggaagcaggaggagctggtacagcaggtacggaagcgcctggaggaggcactgatggccgacatgctagctcatgtggaggagcttgcccgagacggggaggcaccactggacaaggcctgtgcagaggaggaagaggaggaggaagaggaggaggaagagccggagccagagcgagtgtagcacaggtgctgcaggccagggtgggatgtcagcccatcccctagccgggctgctaacagcttcccttcctgcctattgcaggtgccctgcccaagtctgggctgcagactgccttcagccttgcctggaccaggtaggggccagacctgtaggaggcagccgtccacctcctttccaaagcctcctgcttccaggtctcagtgcagggagcccctgtggaccttgaactcacttgtccctgcgctgcctggcaggaagccccacactgaaagcagatgagcagtgacccaactgagaggccacctggacacagtcacctccctgcctccttatcataggacaaggccttgcttggcaccgaggagctgggagccgtgttgggtgctggaggaagtttctggaaacacacctggctatgcccaccttatgtccctaaggctattacaggccagggtctggactgctccggcccacagggctgcccagcctccccacactgagggtcagcagcccaccaggaagtcactttccttcaataaactgatggtaggaacttgtgaactctgacttgtcactgtgtgccacacctctgagggtgtctgctgcccgggcccatggaaacctgctttgggccttagtgtccctgtgtggcagggacacaggctccaactttgagagagcagttggcagcctctctgtgcttggtgcctagatcttggacacctgaactgtgcccctgcagtcggagcctccaagaaactgacgggtgagctggggtgtgtagcccagtgagcgagtcagtctgtggatacaccccagtgactgagctcggccaccctaaatcagatcagggtcttgttccccagcctagacagcactcagggctggagtggtgccttttgtcctcatcccaaaaggaccacccagctaccctgtcacatggacttatatggggcagcctcctgcagt

SEQ ID NO: 19053 - DNA, 1205 bp, Mus musculus
cggccttgtccctaaagtgctgggactataagtatatatagccatgcttagctttgatgtactactggagatttgaactcagttcctggtcctttcacagcaggctcttactggccatctctctagcttgtccactttgtgttttaaggttcatgtttgtgtgtgtgtttgggggctgtacctgcagtgctcacagaggccacaagggggcatctgacctgaagtctggtggttatgagctgctgtgtgtggttgctgggaactggacccaggtcacctctccagatccatccatacaggtctcttgttgaactggagctcctggattaggtagactggccagtgagcctcctgactttttgcatgtctgctggggggtggatggaactcatttcctacctacttattgctcctccaaccctctcactccatcttatagacaagggccttgtagtgtgacactgctggcatcactcccagagctcagaggccctgggctgcccgagctggttcagtgtgcttagcttactcaccctttgtcccctcccccaggtaccatgtgccgaggcctcagacacagcgtagtcctgtggaagacactgaggaagctggacactggagaggtctgcaccgctcagggagcttccatgttgacagacactagggctgccttgatgggtgcagcattaaaccttattcttatgccttggacgcctggctccttcctcatcatcttcctcaaggctttccgtgctcaagggaaattcgtctcagcccccagcacttgcacgtctgggagagtctttaacaagcagaaacccttacactacattcaagtgttttctgggtggaaactgcacattgttttctctcagctggtctgataaatcactcccagctttaatgcttttaaagtagtattcacggcccctattggccaccatacccagctagagcagggctccttccttcctggttttgtttgtttctaagacaagttcttatatagcccaggctggcctcacactcactatatagctaagtctgaccttagacttctcaacctcctgcccctgtctctcaagtgctcatgcagctgtccactgccatgcctggtgttcatggagccgaggatggcccctgggccttcttgcatgctaagtaagagctgtgccagatcagccacagccttttggtaaaactgc

SEQ ID NO: 19054 - DNA, 1679 bp, Mus musculus
acagtgaggcctttgtccttcccagagtaaccacctggcctcccggagacatggtctaaggacacacatacaggcagatgcccataggggtgtgtcacctgcacaaggcacagttgtccacactgcagagctgctatcactgtgcacattggctgccacccacgacacccattacagcaccacaccactgccaccaagtcacccatgacaccctttctaccctcacacattacatacacatagcacgcagtggcccggcccccgctgacggaggctcggtgctgtgacccagcagtacagatgaggtgctgtccctggaggagaaggacctgagggaccgggagaggcgtatggccaataacgctcgggagcgggtgcgcgtgcgggacattaacgaggccttccgggagctgggccgcatgtgccagctgcacctcaagtcggataaggcgcagaccaagctgctcatcctgcagcaggcggtgcaggtcatcctgggcctggagcagcaggtgcgaggtaggctgcgcccgccccgtctgttccatcctgctggccagggcagcctcggcacagccccgcccctctctgaccccacctgaggaccgtctcccactgctctctccttccccactcccccagaacgcaacctgaaccccaaagcagcctgcttgaagcggagggaggaggagaaggtgtctggcgtggtcggggacccacagctggccctgtcagccgcccacccgggcctgggtgaggcccacaacccagccgggcacctgtgagccgtcacagcttcttcgttggaccagggaccaccatatctctgcccggggtgcatcaggacggttctggatgagacaggtctccatcgaagcatgagcagagagagggctctggggacacttcagggcctggggagggtggcactgaacagctccctgcttggccccagtgaccaagcagaaaagttccttcctctcggttaaccagaactggaaacaaagcagcatgctcccttttcaaaaaggaaagaaagatgccttaactatgtaagacggaagagtcggaccgtgccctggcagggcggcctgggactggcttctacttcagagccaccagcacatcgtgcctaagcatttttcgtttttttaaaggagaataaaggaacattagttttcagattttttttttaaatgtagacaaaagttagcaagaacgaggccttccgtgtcttttttttttcccttagcttttttttccgtatgttttgtaagcaacaaatttttgtataaaagtctcatgtctgtttctgtttctagaatttatcgtcatatttcatggtctacaaggttattaaagtagcattcaaaagacccagtgttgatctaagggtcacccctaccctgaggcctggcacaagatctagatgcttgccccttcctcttcccatgaacatgaacccaaggcctgtctgtgccaggcatgtgctccttggctaaaccatgccctcctcatgtgaagtgggccgtcctcatggtcctcaatacttgggtgtcatgcattaggggacctctaaagaaaagttgctagaataaggtgtgtgtgtgtgtgtgtgtgtaaggatattagaatggcttacaggccatgacctgggtattctcaacagcgacaaagcg

SEQ ID NO: 19055 - DNA, 2336 bp, Mus musculus
aacccctttacctcagcctcccagtgctggggtgacaggtgtgttcttgtaccagtccacagactctccccctgccccatggttatagcagggattgctcctcccactgctttggttttctgagtcagggtttctctgtgtagccctggctgtcctggaactcactctgtagaccaggctggcctcaaactcagaaatctacctgcctctgcctcccaagtgctgggattaaaggtgtgtgctaccagtggacagctgttcccctagttttaaaacttgtgagtttgccattttcaaacagagcaggttctgcagttgctggtttgccattttcaaacagagcaggtctgcagttgctggttctgtgaagggtctagtgtgacttcagtgtcaggcagggagccagctcccagttgagggcagccatccagcctgcctctctcagtttgtttggagctgcgtcctggcaaggggcccctcatccctggcttgtttcaggactcgggagggcaggcacaacagcgggtgccagcgagatcaagcgggaggagaaagaggatgaggaaatcgcatcagtagccgacgccgaagaggacaagaaggacctgaaggtcccacgcacgcgcaccaggtgccaaaccccaccccttgggccatacacgcacacatcacatgttacacacatcacacgtgcacacagaccccgggaggccctgcaggccaccacatcacctcactgtctccctctggcccccggctcccctcccccatagcccagacgaggacgaggacgaccttctccccccagagcagaaggcggagcgggagaaggagcgccgggtggccaataatgcccgagagcgcctgcgggtccgcgacatcaatgaggcctttaaggagctcggccgcatgtgccagctgcacctcagcagcgagaagccgcagaccaaactgctcatcctgcaccaggccgtggccgtcatcctcagcctggagcagcaggtgcgaggtcagtgggcggcccgcgccccgcgcctccgcgatgctccttccctgctgcccaagccagagcagtgacagtccctcaccgaccagtccttgcacccctcctccagacaggaggttccctgcactcgctgctctctgaactgactgtccctgcccagtttgctacactgtggcactaatgaccagtcctgcctcatactgctgtccccactctgactgtccccatccactcttgactgtccctatccactctgtccccatccacattgactgtccccatctactctgtcaccatccacactgtctgtcaccatccacactgactgtccctatccacactgactgtccccatccacactgactgtccccatccacactgtctgtccccatctacactgactgtccctatccacactgactgtcctcactctgtccccatccatactgactgttcccatccatactgactgtccccaaccattctgactgtccccatctactctgtcaccatccacactgactgtcctcatcctcattacctaacatcacatccaccctcttccacaccagctgttcccaatgtcagctgtcccttgtacctactctgtctctgcactgtcccacaggttgtctttctgccggtcacactctaggtcgactgtccccgtccccccccacccccctgatctccttcatacctgctggccccagttctgactgactgacctccttcctgccttgctgatcctgggcctgcctctgacaggcctggagtctgccacactggcctcactggcctgaggacttcaaccctgacttttcccatccccaggctcttgctagcccagccccagccccagcccaaaggtgctagctggtgtctaagccaccattgttgttcaacttagaaggctccctaccccacagtagcttctccctgactcagtttccccatctaatggtgttaatccacctgacccggggctgatgagggaggacaacagctcggaccccactgcttccttaacctgcacttgccctggcctgcctgcctgcctttaaccctttctctcctgcagcatggtgtgatctgcacagccacccactctccccttgactccaaggtctctatggtggctgagtgcgcagcccaccctgtgactcccaagcccgtctatctgctgtctgtgtttcatgctgtcccctttaccctggctgtcccctggcttcgcttgccaccaccgcccctcacctcgcacctgctgccctttggacagggctgatcgcaccgtgacctaggggccttttgtcccataggccatgcagtt

SEQ ID NO: 19056 - DNA, 1174 bp, Mus musculus
tagctttcttgaatgaggttgggttttgggggtgagagggagaagttgtgggtcccagggataacacctcttccacccactagagccttgaggttcacagtttgttttgctttggatttggggtgaccagggtcttgggtattctgtgacagctgctgcatgggaaggttccaccaagtttatttggaggaggcagagcctgggccacccctttcttcctggacagggcccatagacagtcccccccccacccctttaaaatgcaatttgacactctggtgggcctctgggaattgggagatttcatatgtgtaccccttctctccattgttcaagctactcatttgctcatgagaaggatctacagaggatccccccagaacccaggctcctgcctcttccttcaggacccccattgaccccagggcctcacttctaatgcccacttgtccacgctctcagtccctctgtttctccccttctgtcccctggtgtcaccacagggctgtctctagatctgggggacgcaccccagttccaacacctgctgtcctgggtggatgatgaaccagtctcagagaatggcacccgtgggctctgacaaggaactgagtgacctcctggacttcagcatggtgagctagcgccccccccccccccccgcccctcagtgcctacccaccccaccactcctggcctggaaggtagggttgaagtgggagtgtctgccagtaggagtggagcccccagcttgcaagagtgggggaaatctcagaggaaatggagccccctaccgtaggcctggtgacatccaccaaagaagtgctcccacctggcacctcaccagtgaggagaagaacggagcccagagagagggaagggctgttcagagctgtggttgttccccagtgttcactgcagaagtgcctgtgggggctggtggccttgagttagaaaagtgaccatcgaagttacaggctgtgagaatgaagtcccaagctgttctgacacgtgctggggccttagagaaggaagccaccaaccccctgtaccgctggtgacttaccctcctcagtctgggtgctctgctagtgagggagactctggcctgggaaggctgttagcagccctgccgcattagcatacagcctgcagtggctgttcccaccctctg

SEQ ID NO: 19057 - DNA, 2320 bp, Mus musculus
tctgtctgtccgtccccttctggcagcactgacacacagtgcccctgcagggactgccctgtacagccgcctcagggagtacctgctcactcaggagcagctgaaggagaatggctaccccttcccccacccagagcgcccagggggtgccatcatcttcacagccgaggagaagaaacccaaggaccgtgagtatcctcccagcattgccttaggcaggagaccggggtgttagctgtctgctgttaaggaacacagctcagggaaaggcacttcatcatgctcagggggtactaggctgctggcccctcacccacttggcctctctgcctgtccatctgtcttcacatacagcctcctgcagaatttgctgtcgctgtggcacagagtaccttgtgtcctcctcgggccgctgcgtgcgcagtgaggagtgttactaccactgggggcggctgcggcggaatcgaggtgaggcttgtgcccacacgtgcatgcctgctggctgcgaggactcctacccatctcaccccgcccccttctgaagctctggccctgtgtaatctacgtgttccttctgagcacaggctctgcttgtctcacccctgcagtgtccccaagggtggggaccgtccccaggcctacatcagcttatgacactgtggcccagatcctttccctgagtccttgtccctgactgggtgggcaagatccctgccaggtgccctgaacatcattgctctctcttgccagtggctgggggctgggagacccagtatatgtgctgctcagctgccgtcggctctgtaggctgtcaggttgccaaggtaagtcctgctgtgtgccactccctgctcttggtcactggactggcattgagggatgcagttgagtcctatgctcagtccccatgtggccccagccagcccttcctgactgtctacacactaggcctgacacaagtacctgctcttaggccttaatccaggacacaggactcctcgagagtcatgcacagccatgctggcccttctgctgactgctgacccccttgttccccagcaacacgtgcaggacggccggaaggagaacctggagggctttgtgcgcaccttccagaaggagctgcctgaagatgcccatgcaggggtctttgccctcgactgtgagatggtgagtctgggatcgcaggaacctgcatcctccctgggatggtgagggagtgaagccaactaagaactggcaagggagcaccacacctcaggctagtgtcctgagagaggggtcagcctgtttgggaagggttctctgagttcctagcctgtggctccctctgcgttggtggttcccgtggtgtccctgacaaggtctctgcagcagccatggctagccacagaggggaggtgcacttgggaagtcggctgcatctggtgcccatctctgttctcagtcctacactacatatggcctggagctgacccgagtcacagttgtggacacagacatgcaggtcgtgtatgacacctttgtcaagcctgacaatgaagttgttgactacaacaccaggtgtgtcccggcctaccgcgggaccccatcctcgttcccatcctgcccggcccgacgcccctcttgcatccggccctctgcaggttctcaggggtgacagaggctgaccttgtggacacgagcatcacgctgcgggacgtgcaggctgtcttgctgagcatgttcagcgccgacaccatcctcatcggacacagcctggagagcgacctgctggctctcaaggtcatccacggcacagtggtggacacgtctgtgcttttcccacatcgcctgggcctgccctataagcgctccctgcggaacctcatggctgactacctcagacagatcatccaagacaatggtgaggagccagggcccccgaagtgggggaaggggaggggaggtatgggagtaaggactgtgctgagcatgtctgccctgtagtggacgggcacagctccagtgaggatgccagtgcctgcatgcaccttgtcatctggaagatccgagaagatgccaagaccaagcgatgactcccacccaacattaccatgtcaccccccttcttccatccctggctgccctcagccccaatccctcagccccgatgccctcggcctcttttcaaactctgtaataaaacatgacagctgaccacgcgtctcccaagctccagctgcaggtctgcagtgagcagcccagagtcggggctgagaccaaccctcagcccaaccccacacctgcccaacgtgacatcacctcctttcccagtcct

SEQ ID NO: 19058 - DNA, 1809 bp, Mus musculus
tggcgccttgcagccctgccacaagcatagatgacgatgacaccttctcattggccctaacttacacgccgggtggcctgctgagcccggatgctgcctaccagcccaccccactggctgtccctgccgagccagggcacaagtactcactggccccttcagacaggagtcagggcagagctgcaggaggtgctggtgccctggagtatgtccccaaggctgtgggccagccgcgccgctgtggccgccctgtgtctggtggcaagtatgtggtggatagttcaaaaccttcaacagatctagagtatgacccactgtccaactactcagcccggcaccttggcagggccagtgctagggatgagagggccaccaagagaccgcggggctccaggggtgctgagccatacactcctgccctcaagaagccctgtgaccccttcggtggctgtgaggccaggttctcagactcagaagatgatgtgaccagccccccaaaggctgatgttagcagccccaaggctggagctgaccctgaaagcaaggcacctgggaagcctgtctccaaggagggcagagagcatgaggacggtggcctgcggggcaccaaggagatggctgtgcagtatgacgtggaagaccttgggcagccccccaaagcaccagacacagtgtctgtggtcaagcctggctccccagccagggcctctcaagatgctagggtccccaaggaaggtaaagccaaaaagaagaaaagtgggacatcagccagcctcagccacaaggacaaggttcgcaagaaagacaaaaagaaagagaaagacccagccaggccccgagggaaggaaaaggtgtgtacggacaagaagaagctgccagccagtaaccccagggggaaggcccaggggcctgaagggaccaagaaaaagccatcctctgcgaccacagtggccagctcagggaaaggggggtcaggccgcccctccagcacgggacctcaggactctgggcctggtccccatgcaccactggcctggaaggctggtagtgcaaagaagatgtcatcgggaaagttggtggaacgcaaggcccgctccctggatgaaggagccccccaggacacccctaagctcaagaaacgggccctgagccatgctgaactatttggggatgagagtgaggaggaggactcaagcctgggagcgggagcaccccgggtctggcccccgaccctgcccagccttagctcagactcagaatcagactccgactccagcctgggcctggacgagacaaaggtgcccaagcgtctcaaggccgcgccgcccgcatcccccgtgccgccctccccattgtcctcctcctcctcgtcctcgggagccagccagtgtgcagaggaggatgtggactactcggctctggagaaggaggtggacttcgatgtggaccctatggaggagtgcctgcggatcttcaacgagtccaccagcgtgaagacagaggacaagggccggctggcccggcaggtgagggcactggccttggcaggctagggcccttggaggggacactcagtcccacggtcatctccagccgattccagcctctgtgacccaagcagaagccgctccttcagcgccggcctcttataactccattcaaaattcaggaaccctcggtggccgcctgctgcccccctgcaccctgcccagaatgaggatgctggctttctacccacccagccggcttcccgtggcagcgtccgactgactgttcagactgaccggcaaaggggtaccgggccctccc

SEQ ID NO: 19059 - DNA, 1698 bp, Mus musculus
ggcctccttactgggcctcagcagggatttctatcaagggacacatctgtcctctggagagcctgtgtcctggagttccagcccacctcaagaaagcagcaaggggactgagaatggacttgggtcacctggggggcctgggaggtggcctcaggttctgtctgtaaatagccatggttaactgtcctgtcccctctgcagggaccccaaatgggcagttggcaggcccccccatcccttcctgccaccctctgctttccctcctgggtggcgttgggcatgaagcctaccccactccttgtcttcagccccctagtcacccctccaggttgggacacaggtacacagagccataggtgactggggcttcccatgggcccctacctgtccccactccactgaaagccattggcggaagttcagggaaatggggggggtgcagcctggctgacccccttccatgggtactcaaatctcaggtgtccataggttctgccctcaataagggccccccactcccagccccaggggtacaggagacccacagttttcagagaacttagggctgtggggtacaggtggggcacgtggaggtgcatcccccacatccccgctcaccttgggtgtggtgctgggcagatgggaaagaaattatttattgtcctctctgactgctggtgtgggggggcctggctccccctatctgggtgtgcatatgtgtgagagagacagtgggtgtctggtgcctggggcttagcctccttactcccactgggttagggtccctgagtttggcctttgtggcattgcgtctcagacaatctataggacccctgcggccatcgggctatggatacagggctctggtctgccgtcatgtgctccacactctcgggtgtctgcagagggtggccttggactccaggattgggaacagggcgttcagctcctggaccttctggggtagctcgggttttttttttttttgcacaggatagatttatttttttcaggctctgagttccatgttccagtgggggtccccttgtgtggccgtcatcctcaggggtgagtggggaaggtctcaggagagtctacagtaggatcctctactactgcagactggatttcttttctagaaaggcaattagggattgccacacacacaccaagaaattggggacacagagaaagttgagctgccctgtgttggctgtggggggtttactggcattcccatttgttccagaatcttccatcatgaaatgagggaggctttgggtaatgctacctttacctgagcctacatgagggaggtcacccttctggagctgggctgagggccctgggccagctcctctcctgggtacttccatttgccccttctctttggccacagaaatgagatgccttagtttgcagggtgggtggggggctggggccaattctttttgtcttttggatgtatcttgcttcatcccagctcctgctggtctcctgtccttcctgtaaacagggggaaaggactgaggttcttaggagttaactccataagcaatcagagcttttccgtgatgtcctcccccagccccccaacttcaggttctgattgataactgggacttgggtctaaccattgaagggtgatgaacgcagggcaggcaggacaagggtcctaagggatttatttgttctttc

SEQ ID NO: 19060 - DNA, 1210 bp, Mus musculus
agagacccacactggtggggaggcagcactgggaagagacagccctctgctcgtgggtcagaagggaacaggaacttttggtctggaatcttaggtccaaagtcttccacagtcaggcactgtcaccctgacccccaccctgtgggagggactgaggaaaaagccatggagctactgcttggcagggctttgggagttgctcatctccaggcctgctgaccctgctcctgttgtcgctcaggtatggcatcagcccagacagtatcatcctgtatggccagagcattggcactgtgcccacagtggatctggcgtcacgctacgagtgtgctgcagtggttctgcactcgcctctcacctcgggcatgcgggtggccttccctgacaccaagaagacctactgcttcgatgctttccctaagtgagcatgggggcggagcctgggaaagggcggggcatgagaaagggtggggctccagcctgtgcatcttttccctcagcatcgagaaggtgtcgaagatcacgtcaccggtgctcatcatccacggcacagaggacgaggtgatcgacttctctcacgggctggcactgtatgagcgctgcccaaaggctgtggagccgctgtgggtggagggcgctgggcacaatgacattgagctgtacagtcaatacctggagcgcctacgccgcttcatttcccaggagctgcccagccaacgcgcctagccaagctgcagggacctcagcagtacatgggcctcctgccgggactgcatgtgacccggagcccaggaccctgcctggcaccccaggggccatgagccatgttcaggcgtcagaggtccctcttctctcctcatggaagcaaagagaaggaaagagggaaactaattaaaggattaagattttagggttgcttggctcctttgtggctctagtgcgccttcctagggctgggagatcgctgagaccagctggctatggggaatgtgaaggaaaacctcgggttgtcccacccagggcctgcccccaggactgcagggcagtccctacagcgcacaaggctcccactctggatgcgaagattcctggtccaaagccaggaccaggccttgcactgtgtcacctgggagctgaaggggtccccccagacctgctggctctatctaggctcgtgtgctctgtggagttgagccatgtgttgtttcct

SEQ ID NO: 19061 - DNA, 1137 bp, Mus musculus
gaccctgcgggagacccccccacccctggccccaagcacggggacaaactattgtcccagtcagtggggccctgtgtctggcatgcatcctgtccttgttcccggtctttgtgtctgtttcctcctttggactctgtctctgtgttccaaggccccttggcttatcctccacatcctcctgcgtgggagccaatgagcctttggatccctttggcttaaaacttggagctgcctttgttacctgttctggaggataactccttcaaggactgagggagaaactggtggggcagacagaagggtctgggcataggcctaggggtgctggaatggcagaagctgggggccatacatagaatgagttctgccacagaggcctgggagagctagggttgtgggcaggccaagaggatcaagatagaccgtggatgtggggacacgccttcctccctgcctggcacaggctggcacctggttctaccctagattcctggagggaacctacatgttggtgtcccctgcagggtatcccactgtatggcatggagacctgtggctgtgaggctcccgggggctcgccttggaccgcgatggggcccggctgcggcctcctaacgggactgaggtgtgcagcccgcgagctgccgctgcccgcatctcggagcacccccgcccctcccctggcccggcgcgggcccggtgcccgccatgaacggcctgtcggtgagcgagctctgctgcctgttctgctgcccaccctgcccgggccgcatcgctgccaagctcgccttcctgcctcccgatcccacctactctctggtacctgaacctgagccggggcccggtggggctggcgctgccccctcgggtcccctgcggacctcagcggccacacccgggcgctggaagatccacctgacggagcgtgctgacttccagtacggccagcgcgagctggataccatcgaggtcttcgtgaccaagagcgcgcgcgccaaccgcatcgcctgcatgtatgtgcgctgtgtaccgggtgccaggtgagctgccccctcccagggctcacagcaggggtgcctgggttctgtactaccctgtctttcagcccacctgacccctcttgtaaagcacaggaga

SEQ ID NO: 19062 - DNA, 1144 bp, Mus musculus
actaggaggaggaaggacaactctagaagggaggtcactcaataggtgtgtgctgcagaaagtgtcaaagtagcgagggccaagcctttgacacggaatgatagcggcggctgagatggaccttcgtaaggttagagtgcagttggggaaaggttcaggtggtggttgatggaaccagcaggcttaaagatgatgggagtgacccggaggggagtgtgagggacagcactccctttcctggccttggttcactttgtctccagcttggtcaggtgttctttctcactggaccacaggtccttccaagccctctgtgtctaaggggtgttaaatgaggaggccttgattataaagccagtgtctctaaacattgaccttgtggatatttggagcggggtcattcactgatagcctgttctgggctattcagggtcttggacagagtctctggtccccacctgctctgtaggtgtgctcccagttacagatgtggcctggtgttgtcttggttcccacctgctctgtgctagaagtgctcccaactccattctaggagtgctgtagattccaggtgtggcctggtgtctcttggagacacctggtgtcatctgcatctttgagaattgctacctgggagctggggacttgttggtactatctttgtccttgctctggctgtcatagctgtcctctcagtgtgtccctgaattgttagggactgggatatccctctcaccagtggtcttacacctcagattctcagggatccaaaaatgtgtgtgtgtggacccacagctgcctgagtgtcatgtgtctccctttgcctgttatccatgtctctctgtccctgtggatttatatgctgtgacctaaaacccaggtgtaggttgatatcctgttaaaattgcaccatgagccaggtgtgctggtgcacgcttttaatcccagcacttgggaggcagaggcaggcggatttctgagttccaggacagccagggctatacaaaggaaccctgtctcaaaaaacaaaacaaaaacaaaacaaaattgcactatgaagtcttctgccttcctctcaggttatgagagatggttgtgggcttttctggaaatgtctctgtatctatccattggcagctctgca

SEQ ID NO: 19063 - DNA, 1099 bp, Mus musculus
gaccctgggcctttatactgactggcttccttctctctactccccaaaacacatgcaatgctggtgtgtgactctggctgcagcccagagaaggcatggccgatcctgcagggctgtgtgctctatagcctgaagtacagggagggtgctcaggcaggcatctggctgtagcaggctacctgagggtctccttcctgcaggaaaggagaacaacttccccccactgcctcccttcctgccactgaagccctgcttctaccaggacttctctgatgagatccccgtggagcaccaggtgctggtgaagaggatctaccggctgtggatgtgtgagcctctccgggtgggcgggcccaactcagagtgcagggtccccactgagcacaggagcattgtggtccaggggatgtgcaaggctcatccctaatgtgctggtagggtgggtccctgggccctatccgaggtccctggtgacttacctcctactctcccatctatgtccctcttccagtttactgtgccactctgggtgtgaacctggtggcctgcctggcctggtggattgcgggcggagctggtgccaattttggcctggccttgctctggctggttctcttcactccctgcagttatgtgtgctggttccggcctgcatacaaggccttccggtaagcctggtctaggggccctcaggccacagaatcttagacccactccatggggtgaacatgcttagaattgtatccaggataggtttcggccacattaccaatagttgtcctccacttattcagtgtgggtggccatttatgtcatggtcagcaatcaatgaccataggctgcagctaactgctgtcttggggttgctgggatggatcccagggtataagatactaggcaagcagcttgtgagccatgtgcccctgtgccctcccttggtgctgtggagtgttcctgcaggaaggtatggttacagttccccttcctgcagcaccctctggattgtaggcctacactcggagacacgagtgtgtatgtgccatgacacagcgtagcagtcacaggatagttctttttctaccatgtaagttgtggggat

SEQ ID NO: 19064 - DNA, 1731 bp, Mus musculus
agagttgcctcacactgctggtctactgtgtctcagcacacctgcctaccctgcaccaccactactgtctccctcgggggctgtaaaaacacagtcacaggtcacacaaacacatgtgcatgcataaatgcgtgataatgagatggcacagtggggtggcacatgcctgcttgttgaattgggtgtcctgtgggctatggaggcgggtggcagtgtggagatttggcaccaggtcctgcactaccctgcattgtcactcagttcacagtgggtccctgtccctgccagtacactgacttcctcttctatatccttgcccctgccaggtgcacaggatctaccgtggggctggtggaagcctccagaaggcacagacagagtggagcgctggtacctggaggaacccaccatcgagggaggcccagtttaacagtttctctgggaacagcctgcctgagtaccccactgtccccagctactcgtccagcggaggccactggccttaggcggctgcctggccccagcaccatggctctgtctcctgttaccaccctcggtcctgaggtctgagcatctctcaagggtcccaggaggtccttggcccatgttcatctcttgcccaagccctcagcaagcactgcccaacaaccattgtccactgccatcctaccagagcctggctggatttgccctgctcccacctgttaagagggtagaaaccctcagcctgtgcaaggagaggcctcaacctccaagcgcctgtcctttgtgttgctgagatgtataaagccaaactctgagcgcttgtgtagatgggtgtgagtggacagtcaggagcatggtggctgtgcctgaatcctctgttctgccatccactatacctgtgctcctctggaccctgctacttccttgtcccatcccttgtgacagtgacaacctgctgtcccctccaccacccaggatcctgaataggcctttgcccacttgcagaccctgatccacttggttgagggtgctctggctgccgggagaccccctccctctctgtgggcaactggtgggagaggaacaggctctgctacctggcaggccatacccccagccacaggactgctgggacagatctgtgccttagagagacctgtacttctccccacaccctctgccttcccggggtagctgtggccttgccagaagagccaatctgagttttggagtgtccacagcacctctgatgacattggactcaatattcttccttgtgacccgatgttaccagccaagtcaccaggcctccccacaggcctgtgtgccagtatcatgccaaactgttggggcacctgccctctaccccatcgtgtcatggagatggagtcaagtgcccgccatgggtaacaccctacagccacctgcggctcttccctgttcacccctgggtatgtgcacccacacgccatagttggttttgttatgtgagaatattctggaaataaattctctttctgcagcagggcctttatctgtggatgggaaagcatgcacagggcggagcctagaggtcaacatcactgctgctctctgttgccacacaccttgctcctttgagaccatctcccactgacctgaaattgaaaggggccggtgagctccaaggatcctcctgcctctgtctgcccagggctggggttgtaggcaaaccccaccatgttctgctgtttacctgcatgcaaa

SEQ ID NO: 19065 - DNA, 1192 bp, Mus musculus
cctgtctcgaaaaaccaaaaaaaaaaaaaagggggggggtgtttacaacttctgtagccaaggctggtcctaaactcaccatatagaccaggctggcccctaaactcatgcctccttcagcgtcctgaatgctggggcataggtttgtggcacaacacccagggaaactgtccttgactctactgtaggttattgatgtggtgtcccaggtagcctgggctgacctccatgtatctgaggatggcattgaacatcttggttcctgggatttgatctgtgcatgttctcctggggttaccgtgggaaaaattgaaggtactcctggggcagctaaagtaacccgtagcttaggcttaggccttgtagggtcttcaggtgtgtatacaggttaggggaggggcatgggaagcaggaacacagggcaggccttgccaggagccccagagtctgcagctgccccaggcactgaagagctggcctctgggtggctgagacccacagggctggcaggtggtgtgcatctccaggctctagcctgtcctctcccactcactgtgtctgtagcctgtgcttcctgtcagggcacgcccctgtgggctcctgggagatctccatgctgcccttggctgtccagttgggccccctgagaggaggcgtggcttaggcagagcagactctgctcctctgggtgggcagctgtgtgcagtcagcctgtgcttcacttggtgctggcctgaccctacccagtggaggccagggctgtgtgctgggccctccatatgctgactatggcaggacttaggggaggtgcctcctggacagctgtcccctcagttaaggtttgtggtcaccttcacctatataagaatagccagttctgggctcccctcctcacccctcagtttaaaatgttaaaactaaggatggtgggttcaaggccagcttgggtataagtgttgggggaggcagtgggcaaatgattgcctaagctcaggtctctagtgctcacttagatgccggcccgggcactctcacctcctgtggacccatttcaaactgagctggctgtggtagctaaagtgagttcagcagggagacacggcttcagtataaggtggagagtccttgacaccagcctctggcatatgagccccccgccccatacacacacatacaaatacaaacacagaag

SEQ ID NO: 19066 - DNA, 1469 bp, Mus musculus
agccagggcattggggctgagctcactgcctggggcctccagagcccctccctgttcacccagtgatgcatgctgtgcccctcacccagcatagttggagtcactttgcctgctcctgtccctatgtgggcactctttatctgccactttcctcatcttggctggtcgtgtggttagactgtgggtcaccttttacctggatcccccttgttggctttagccttccagtgtcctttgctctgccacttggtagcaaattggggcacacagccactccatccaagccatctaccccagtctcttaactgctctcagcttccatttggtcataccatgggagccgttgctgtggtctctggcctatcccagggtgacagggcatggacatttcccacagggagaggtgcaccctccaggcagggatcttaccaatcctgttgagacctgcaaagacctttttgtaccagtccatgtactctgccctctaacctgtgcctctgtttcttcacagctgggcaccacaagatttaaggcagtgggacctgttggcagaatgtcttctctctctgcaagcaaccctgaagccaccaagatgagcaccccagtccggcctgtgagcgtacccgggtgtcaatagccgggagccgaggggccaccgggagcaatggtgtactaggccgggcgcgagctcaggtttcgcactcggatctcacggcagagtcaccgtggagaggccagggtaccacaaacttatggattttgacaagaaaggagggaagggggagttggaggagggcaggagaatgtccaaaaccggcacgagtcggagcaaccacggcgtccgcagttcggggaccagctcaggggtcctgatggtgggcccaaacttccgagtcggcaagaagataggctgtgggaacttcggggagcttcgcctaggtgagtcctgtgtatctcgtcccctgtccatcactaggcccctcaggaggaaggaggagaccggctctgggtacccatcaggcacctcagatcccagaccttgctcagagtggtcctgtgagggaagtgctcccagggcccacactgccctccctcccccagcctgaggcttggctgtatggtaaaccagatcatgggccagtgaggaccacagagtctgtggaggacagaatctggtcacactgaggggacagcagaccagcacaggccctgtcctggtacagagcctctgcagccctgtgacagggctgcactttctgtggccttgggcctctgagccctcttcctgcagcccatggcttcagtgtctcctaaggcccagctcaaagatggttcctacacagtaagacatcaaactgcaaccttgaagccagccattatggccacgcttttaattcctccaacaatcagaagcagagataggacagatggatctctgagtttgagaccagcctggtctacagagtgag

SEQ ID NO: 19067 - DNA, 1289 bp, Mus musculus
ttccgcatcaccacccttgtcacccgtgcaggtgctgctgcttcttcaagaggagaaagagaaaatcgctgcagcgacataagtgagggtgggtgcagccgctcaagatccccaggcgggtgtctaggaaactggcagtgtccttggtggtgtggggctccttggcccacctgcaggcaccatctttcgggacttggggtcccttccttcacacaggactttggcggaaatctctacacccgtgtctcatcatccccttcgagagcattaactatttaaacccaggagagaagcgctgtgccgtccctgctgcgcccctgttagctcataaagtccagcttgtcccctcaatccaaaggccattttctcgaggggggcaggcccggggcatgggtgtcacatggggaggcctcagccaccaaaggggaggcgcgtgcacttccacaatgctgcaccaaagccggggcggagcgcgggacggtcaccgcatagggactggtatgggccccacagtaccagggcggccgtgatccgtgtccctgcgtgcagggcccacgggacagaatcgccttaacgccaggcctggggcagcagagaggcggtcccacaggagggccaggccttggtcgtgggaactgagttcttgctttacgacgtgtacagaaatgaacttatgtttctctggcgcttccttgaagccgtagagtttaggggctttttttaaaaaaaaaaataaaagaaaagaaaaacatcccagaatgttggcctgggctttaccatccataggacaattcaagtctaggatcgcgaactgacaaggacccagctggatcatgggaatccctagggagctgggcactgtctgccccaggaaaacggaggagactggtaatgcggtgggacaggaaggctgctgcttccaaacctgagggacccagtagtacccaagcagatagacgggtcgggtctgagcacagccccactaagggggacaccttgagggcagggggctgcatagtgcggctgcagactgaaagctgcctcagaagccaagccctgagcactgggagactagcggagctgggaggaggttgcccaagtggaaaggaaatgggggtgggggtggactccagggcttcatgcttatacaggtaccaccaaggaaacaacatttctaaaaggggctggagagatggctcagatgttaggagcactgactgctcttccagaggtcctgaattcagttctagcaaccatcatggtgtctcagaaccattctgtaatgggat

SEQ ID NO: 19068 - DNA, 1769 bp, Mus musculus
ccgatgcaccctggtcccacacgtgtcccatcaggcttttttgccatgcccccgccatacccatcttgagagcatgcccaagtacccaggccacgtcctcatcagtccctgtagcctctgcttgcccagcacagaccctggcatctgagcagcctctgtccccagatcatccacacggacagcaacacagtccttggccagaacgacacaggtttcagctgcgacggttctgccagcaccttccgtgttatgttcaaggagcccgtggaggtcctgcccaatgtgaactacaccgcctgtgccacgctgaaggtggggggggggggcgctgcactgcaacccagggcttgttcctggtccctgcgggctcgggctgtgggtgcctctctgttagtagtaacagtcctgggcatcctgacctcactctgcctcccacccacctccagggcccagactctcactatggcaccaaaggtctacgcaaggtgacccacgagtctcccaccacgggggctaagacctgcttcaccttctgttacgcggctgggaacaacaacggcacatctgtggaggatgggcagatccctgaagtcatcttctacacctaggccatccacccaggtcaccctggccagccataggcctgcctccctccccaccacctcccacatcatcatggaaggggctgcctgtgtccacagtgacaagtgtgaccgcctgtcccaaggcactgaggaggtggttaggccatgggctgggccccgttgagacaatccttcagtcttgggggacagagtgggactagccttggatggacagagcgtggtgggtcgcagtccctgaagctcagggcagcaggccagctccgagccctggtgctgccctgctcctccgttctcttcaactgcacactgcaatgcatacaagcccacactcagctggagcccgcgccgggcctctcctccagccagtggtctgggtttcatgttccttttcttctccgctgctccctgggaggtcccaggtcctgacctgcgtgcactgctgccccctgaagccctggcctgctgggcatgtacacagagccactgggagctctgccccagggtaggtgacatgtggccgtggttcctacttctcacagcagcgcaagtgcccagtcagcactgtccacccaaggcggacagactcctcacaggtgtgctcagcagagctcagccttgagcctgcagacccatcaaaatgcactgggcacccagctggcctgatgtggctctccgggggtaccacagaacacccctgtacataccacagccctggccctctaggccaccacatcaccccatccagtgatgtcccagaaggcgcagtctccagtttggggttccacttcctcatatttctgtaccagtgacctcctgcccagaacccatcccaaagccatgggaggtgtgccctccacactgtgtccccaaatgattttttttttaaataaaggaaaacatctgccttgaatcatcgagtgctatgttgtctgagtgttacatggtggctgagaggcgggcgtctcagccacccacactgttccctgaggacaccttcgcagtaccaagaaagcaaataggcagccaggctggctaccagccagatgtggtctgccatcttaggccccaagaagcagatagcctagggtacatgacacctggctgggcagtggtggctcacgcctttaatcccagcacttgagaggcagaggcaggcagatctct

SEQ ID NO: 19069 - DNA, 1186 bp, Mus musculus
tcagggcagaggggtgccaggcccctactttgtctgggtacctggactgacactgaagaaaagctctgtgacacctgaggccactcagaagcagtgagacaagctgattggtgtgtgcctgtcacccagcctgtgggagggaggctgaggcaaaaggagcaaagatttatctttggctacatagtgagttagaggccagcctgggctacatgagtctctgtctacaaaacaaagcaggaattgagaagacagataactagataaagtttgcactgacagaaaagctggacagacaactaagaagataaggggtccttggaacaacctaggggttcaatgaaagaccctgtctcagtagacaaagtagagagcactcgtggtggaccccagtactgacctggcccgcaaattcattgaaaggaccagacattaagagctttcagctagggttggatgtagctcagtggtggagtactcctgggttcgagccccagtcttaaagaaaatgttttgagcagctatatagtctccttagctactgttggactcggctgtagccataggcaggaggaccttcaatacgaagttttgttcaagtgaaatagtagcaaaaacctgtgtgtgttgtgtgtgtgtgcatccccagtacatgttctaatggttttgctgttgtttttgagacatgctggcctggaactctccaggagctcaggctgtatggaaactcttgcaggacccagcctggtcctcctgcgtactggagtgacaggcctgccctccgtgccctgcccttccgatagcttctgaggagccgcccacccaccagcattttccaagatggctacagctcccacactgcctgctacatggcttctgaagccacctgggtccacttgggagcagtgggccttggggtgcggagtgcgtggctcctcagagtgcccttcagggtccccctctgaagccaccgctctgcacgcctccttgtgggcagatccacagttttgcaggctgtccttttttgggacacatggcttccctagttgtctgtcctgtctaactgagctgaggctggagcccagggcctgtgtctgctaagcactcaccccacctaccacactacccactaccttggtatgcttttgtttggttttgagactgggtcttgctacaaagcccaagctgg

SEQ ID NO: 19070 - DNA, 2358 bp, Mus musculus
gctacctcacgctgcctgcagctgtccccaccctcccagtccaagctggcccagcggcgccagagggctagcctgtcggccacccctgtggtccttgtgggggatcgcgcatgacccccactagctccttgtacatatgcccctgccccgcggggcctgaaggctagggacctggacaccccaccccttgccattccaggtgccagctcagctgggtcctctgggggtgtaggggtctgttagggggtgtctccttttctccctgtccttcccctgccctgcccacttggctttgttttgtttgtttttctttgccgctattgaaagcaagtgcccggaggagggcggagggctcaggccgcccagcctgcaccccacgatgctcacctgccaactgtgaaggtcctgccacctgcgcccccacctccactccagccactctgctgtcttccagggttggggatcccgcagggtcagcaccccacacctctcccagccctcagtgttgtcagggacaggccctcctggtgagcacagtggtggttgcatctcctcaccagagcacccttgggtctggggtagggcagggctccctgtcttggatagagacctctggggagcaggtggatggggacagtgcacttgattgaccccgagtccccatcatccacctgcagtgtcccttggagggttgacaatcagaaacccctcccaggctgcttagctccttgccctgggacagacctactgctcccaaccccacttcccaggggcagagctggaaggggaccctgcacccagctagctccaccacagcaggagaggtgctggaccaggctttcatcagcaaacatggggctcccacatgtctccccacccagggcacctgagtgccccttctcagggctcagcctgaccacggccacgtcctgcccctggggttcctaagctctcctagctgcttctgttagccagagctgaggccatacccagggctctcaccttcctgttgcccccagagggcagcagctcaggcgtgcctgctttcaggaaagggaggctgggaagggatgtggtggccctgcggtgcccagacctaactgcccgaggcctgtagactgttctagccgaactactatgcaatacgagttcccattttctccatggccctgctggtcgggggcggctgccaggggccaggccaccctgccctgcaactgctcaggtgtctacagggcagcccctggcctcaaaaatccttggtcaggattgtttgtcgagtttagtttaggctttttttttttttttaaagaaataatttgacttgcttccctgttcttgaagagtacttgaatgtcggggtctggtgggtgggggcctgggacacccactgcccagcatcctccaccctcctccctagtctcataggatcgtcacagtggaggtgacatgccttctccagtcctgccccacctgcctctgtggacacatttccaaagaacccctgggggtgggacctcctccatcagtatgactcagctgttggccacctgaggactcggcccccctgcaggttcctgaagcaacctgactgggcagtgagcagcattgacccccactcacccccaaaacagggctgtgatttccttagtccttccaagcccgacctggaggatgggtcagaccccttaactgtgaatgagacatgatcctgggctggcttcgccacaaaccatgcagaaatctaaaaggcctgttgtagagtgggggacatgcaagcacttttaactccatcgtaccaggtgaactgacctccggactcctttcccaccaactgtcaacgccaggattttgtattctgttttgtaaggatttaataaaagtcatttaaaaatttctgtgcagtgacagcagcagaggtcagctgcccgcaggtcctgagtccttggttctttggactcctgcacacccctctggatgtgtcccagggaggtgacatcaccagagcggaaacacaagcctaaaagaaaaacaagcatggggcaaggcggggacccagaggggcgtggcttcgttcggagggggggggttgggggagtgggtctgggggcgtgacacttagggtgtggctggattccgactcttccgaagctcagcctggcctaaaacttgtgtaaatgatgagaaccttaaatttctatttcccttctacttccaaagtgctggggtgaacaaggtccaagatgaccagccttgccccagcatgcagctctggacctacttgtcactagacccaggtggcaactctactgctccgccagaggcctgtggccctgagcaccactcccggattctcca

SEQ ID NO: 19071 - DNA, 1168 bp, Mus musculus
gtgtccacctgggaagggagagccaggggtcctggaactcctctgagagcaaaggttctacaggaacagtgctttctgggccttctatgtactgggtgcagtggagctgcttcctgaagtttgagaccactggtctaagccaaacctaggcccatggtgccaggtgcccagtctggactggaaaagagaaggcagatcatgatgtggtatgggctgggccagcatccaggtggcagagtgccaccttgttgcatgggtcatgtgagagctgagactgcttggccctgccttgctggggtaaaggcagcagctacctagcagaggggactcctgggtcagggtggagaactggctgcttcctctctcttcgcctgagctaccctgaccgtgctaacactgcagtctgacttctagcaatttccaggcccagggctgcagtgttcacacagggtccaggtggcatgtggggggcttgctgacaccttgcaggtggcatctgggcagcttctgcaggtgccgtgtccctccctacattgtagatcattgagaagcagctgggccacatccgcagcagggtgttccgggaggtggagatgctgtaccagtgccagggacataggtaaggtggcctgcctaggctctctggccagagcccatcacttcagcaggccacggactgcgttctgccaggacaacaggctttctattggcctcatggctccatgagggagggtgtcacctcccaggctgggcagcaggtgctgagggcctcagggtgactcagtttattttcccccttctcccaactcaggaatgttctagaactgattgagttctttgaggaggaggaccgtttctacctggtgtttgagaagatgcgtggcggtaggtactggtcagggaggacttggggtgggagctgcagaccaacaggaagtgccatccaagggccccagctttgatgcgggcactggggctgtgtaccttcctgtcccaatggccacggcccagtattggacccaaggaagccctggggcatccctgatggactgaggcagggctaggagctggctggtctgtggaggtgacctagctctccctggcctgcacaggatccatcctaagccacatccatagaaggcgccactttaacgagctggaggccagc

SEQ ID NO: 19072 - DNA, 1208 bp, Mus musculus
ccacagttctgtgccactgaggctctgagacactcctgtgatgcctccgtgctgggtgaggagcagccgtagcctgctgcagcctgtgtgcctgtagggcggccagctgctcttggtctcagcactgtgacggggtgatcatttatacaggttgctgcacatttggggcattctggcagaaccaccctgaacatgttccccttcaacaggggcagaatcctttcgagttggccttctccttagacctcgcccagcacagggactctgacttcagcccacagtgtgaagcccgacctggtgagcccccaggaggtggacaggacatggggtctctggggaagtaggctaaggcagactacataccatctgggtctctcttctctacagacatgccttccagccagcccattgacatcccagatgccaagaagagaggccggaaaaagaagcgctgtcgggctactgacagcttctcaggcaggttcgaaggtgagctgcagagagctgccagctcctctggggaagggacgctgggctatagtcccttacctctccactcgcattccagatgtctatcagctgcaggaggatgtgctgggggaaggtgctcacgctcgtgtgcagacctgtgtcaatctcatcaccaaccaggaatatgctgtcaaggtaagctggggtctgcccccagaggccagtggcctttgagtcctcagatgacagcctcagaaaaccagtgtctaaaaatggccctaagacttgtgactggccaccttgggaatccaggtcagacctagagtcatagaaaggcacaatgacagctggcccttgatcactccatgttctggaggctagcaagccctagcgtggctatcaagaactggaaacttatgtcagagaccatgctggcccacctgtccctaaggctgggcctctgcctctaagggtgactggcctaactaaggcttacaaaccgatgcaggtccccaagagaatcctgtgtgcctttgccactcctgtatatacctagagccttgccaggccctgatgtagcctcctgaccctgtagggccaaccagtcaccctcatgaccagggaagcctggtgcctgtcagggtgaggctgccgctctggatagtggcttccgcgtctgagggtaacagggagaagcaaaaggaagagtcatttggaagttagggtgtcggagcagt

SEQ ID NO: 19073 - DNA, 1175 bp, Mus musculus
gtctattcagaaatatttttggttttgtttgtttgtttgtctttgtttttgttttgagacaggctcttactatgtagccctggctgtcctggaacttattctgtaggccagactggcctccaactcacagatccacctgcctctgcccccaagtgtcagccagctcatctggagatttttgggattactgataactggtttctagtggccaccctcctgggaacagtatctgggctaacctgggatccagtaatgaattcacttgtggctcccacccttagatctgcagttcctggaaggtggtgacaggaacctctctcttcagtggcagcctattgtgtagcaaaactatgtgtgttgtgtggcccctgtgggccacaggaccaaactccagcaggtccctgtctgtcatgccatggagggtgtagcagaatatgactgttcccagctccaacttttgagcctcatggccattccctgagacctctgcactctcaagaccctgaggaattctggttacttttccagaggctgccactaaactaaatgtgtacagtttaagcttggttgcctgagcccagggctgagagacacccctgggtacttcccgaagtcactgtgcccaatacccagctctggaagaatcagggaccagccctcaaggcttgactgagtgtatttctcacctgtaagacttggccaccttgccaaatcccagcagcccagggaggggtccacctgcctcattcactcccacctctgtgccagcctaagaataaagtggtcctctccatactgcgggctgctccttgttgtttctgcccagctcccttcttgaaagatggcctggtgacaagctttgataacagcctgttcgaccacgaagggcccaggtactacaagataacatgaaacgacatagaaagcagactcagtatagctgacaactttctttccttttgagatggggttttccttttgttgcatgaatgtgagttatgtgtgttgtgtggccactgtgagtgtgaaggtcagaggacaactctctgccttttacccctaaccacgcccccaggccccttactggggaattctaggcagggccttcatgccagtcctccagcccctctgatttaagtgaaaagcatacagtttgtttgtttgtttgtttttgt

SEQ ID NO: 19074 - DNA, 1447 bp, Mus musculus
tccagatgcatctggtttgggaacacaaggcaagaggaagggaagagtgggctcagaactgtctccggcgccctgaagggctgtatgctatttacctgccatcttagcactcaggagacagaggcagggttactgcattccaggcaagttggggctacatagcttcaaaaaaataaagtgaggtctaggctccagggagggtaggagaggtgacatttgcgccccccacacacacacacacacacaaacataggcaatttgtgcatgtgccatcccctagggcgagagctccgtgtcagtagatgggaagtgcagcgatgccacgttgctcagcagcctgctggaggaaatgaagaccacgttggctcagtgctgagttgcagtccaggatgtgcaacagaccacagaaagatgtgatgcgtcttacctctcctgttgtgtgtactgtctcacacccagcattaatttaacaccaccggcctccactgtgtgaccctgaggtcctatgttgcatcaacttcttttattatcctttattccgacctgcactcctttagcaaggaaggccatcctgaccctagccagaaaggggctgctccacttcccattctcaaaggcggctgtggactgcagggttacagcaaacacactgatgtggccccactcctgaccccatgctgcctctggaggaacccttccagatgctgctgtccacaaatattccaactggtagcctctatggagaggtgataaggccagctgttaatgcttttccccacagcctgcaaggtcagatggatgaagtgtccttgtgggtggctccgcagctcagctgcagacaacagggatggccctttgattttcttctgttcaacagaactgtggtctgtcttggggttctgttgtgggggtcagtggaagagtgcaatgtatgcctcagtttgtcactacacatcatgggcttgtccctgcagctgtggagggcttagtgccttgcagtggagagtgtgcatcctgggagcagtcagtgcttccccagctgttcctgggtaaggtgaagagacatctaactgggtagctgggcacaagctgagccttcctcagaggtgacagtggtctacagacattctggcttcctttgaggacaactgtcactttagcatgtagagtactcttaccgaccccatgtgaccttccagctctatgatgttccatgattgatttgctgttgacattcccatgtgaagagagatatatcacgctgctgacgatcggtgtcacaatgacccattaaagagtcaaaaaacatttgtgtgttgtgtccccatggtaccccagggcagtccccagtgtgccatttaggctcctgaagctcaggtggtacagaccagtgagtttctccaacctccaccagtaggtgccttgtgtgtggggattacaagtttgg

SEQ ID NO: 19075 - DNA, 1178 bp, Mus musculus
gccagagggctcatcggtacacgacggtgtgcccgtgcctttccaactgcctcccggtgagcctacccttcggccctagccttcgtcacgccaccttggctcttcacaatggacttaactagagctcccagggacagctgaagcgaaaggccccaagctcttgatgaccctcccgtgtctcggtgctactcttgggccacatgctggcttccacctgggccattgggctgagctgcagcagtgcccattgtttctgtcactctagcatcccacccagctaggacagacaccccagggtcagtgctggcccactgagtgccatgtctcccagcaggcgtctccaatgaggcccagtttgtgttcaccattcagagcatcgtcatggcccagaagctcaaaggcacactgtccttcattgccaaggtatgcactctatgctgaggtccaggtccctcccgctccccaggggatgtcaggcatcccaggaaagaaagtgcctgattggaaagtccaccctacagcctttctccttgcaggatgatgaaggagccacccatgagaagttggacttccggctgcatttcagctgtagctcgtacctgatcaccacaccctgctacaggtgtgtctccaccccaccacacagctcgtgggaggaaaggaggggtagagtttgctgatgtgggctgtgaggtaggagtaacatgagagtgctcagccttcatcacaggcgtcgcctccacctgaggccacctcttctggcaggtgacactgcagatggttgcctctctgtcccggaggactaccctgtgtgcctgtcactttctgatgctcacatgtaggtagcccaggctgccttggagtttgaagctgccctcatgccgcgacattcctaatgccaggtgactgctgacacccaggccctgccatcacacactctctgtcctcccacagcgatgcctttgcaaagttgctagagtcaggagacctgagcatgaactccatcaaagtcgatggcattagtatgtctttccagaatcttctggcaaagatctgcttctaccaccatttttccggtaagcaatgttacagtgataacactcttggtggctttgtaccaaaaatgacagaagctactttcccacccctaattagacccttgctgcatcaggcctggg

SEQ ID NO: 19076 - DNA, 1165 bp, Mus musculus
tcagccaggtgcgacttctggaacctaggggcaggcttaggccaggaaacttaaaaggtccagtcagaaatagacctttatggtgagttgtcagagccaagtgccaggagtgatatgtagggaactggctctgtgcattgctgtgagtcgttttctgtttgtggtctttgggataaactcagtaagcatgctcttcatcactgaggcacaccttttgtgtgtgtttgtttggtttttcgagacattgtttttcggtgtagccctggctatcctggaactcaagctatagacaggctggcttcaattcagagatccatctgcctctgcctcccaaatgctgaattaaaggtgtgtgacactagtgcctggcaaccttttgggtttttaattcagaatcttagcatggagttcaggctggccttgaactgacagtgttcctcctgccccagcctccccagttttggatgccagacaggtgtgctgttagctgctgttgagtataatgggttatgtctactcttgtccccagtggaagggcactacacagcccatgaagctgaatactcggccgtccaatggacttctgcggcacatcctgcagcaggtatataaccactctgtcactgacccggagaagcttaacaactacgagcccttctcccctgaggtgtatggggagacctcctttgacctggtggcccagatgattgatgagatcaagatgacagaggatgacctgtttgtcgacctgggcagtggtgagtgtcttgcagcatggtctttgagccgaccttgagtcccaaaaaaagtcaaggctgcccatgagtcccaaaagggtcttttcacagaggacactggctgagcgaggctcctgctgccacctccctgctcagccttctcccagagccctctgccctgggcctcctttcacccttgctccagcttttgacctagtggctcttgggttgtggctgcttaaccagaatcgtattcctgaggtgtctggtcatggctctgtgctactatacacttggttcagacactgacacatgcacacagacagacagtcacatatacagacagcagtgttgctggactgcctgcatggttgtggttcactcgactgacacttttcttggggcatgtcttagggtttattgcttcc

SEQ ID NO: 19077 - DNA, 2932 bp, Mus musculus
ttcctaatgatgaggttgcattctcagcctccaccctggagtcgtgtgtggaggaaatcggggtagtcaggtgggtgaggttctaggctggccataggcagaaagctgcctggggtagcatggtatcctggagcagagagttgggcccacctacctctcccagaacagaggttgtgaaaccctgcctggctgtcagccctgtaagtgaagaagagccaggtggcagccctctggccttctccattgggtctggctatgtggtggcagtagcctgggcagcgagggcagcctggccattgccatctggaggtcctagagctagcacctctccagctgacctactctggatgttcagcaaggcagacctggagggggctgggcccactggcacctgccaggaatgcccccccccatacccttgtgccctgctgggcagctcagctgagacaggcatattgaatgcacctaacctgtgctcctcttccctgcaggtaattaggacttctactacctcagccacgacctatgcaaggacggtgtggaccaagactgctgcctgccaggccggcggagccggacatggagccactgtgaatcggcggcaccgcaggaggtgctggactggtccagtttgtactgtcaatagttttagataaagtatttatctttttttttttttaaagtataagcaattctgacttactttattccatcaaagtcgtccaaggcaacctcttgagacgtctaagtgtctgtgagagagaataatataaagacttggcctgctgggctggccacaaggactcctgactccgtcccggtgctatctcaccagcaagcccatgcctgcccatctccacctctgtcctgggtgctgccccaaacatggactgtggccaaacagttctcagatgcgcccccaacatcttgctctgacaccaaaggcatgcctggcatgcccaatgggggctgacctttgttccccctccttggaacttgcctgctgtcactgtgaacaccccactgttaaccctgtggctttgggcgtgcctttgcagtgggtgcagactgggctggggcaggaatgggggttcccagctgggctgagtggtgctgacaggtgagggccactactgcagggcttggtggctcctgtgacaagtgcatttactttgtatttctttgcttttctggctcggggcatgctggtcaggtgacatggggctggcccaatgtgggtcccctggcatctgtgtataagagagtcacatgatcagtgacagtattttatagagatttgatggagatttataaatttcatagacttgactgcatttatttttagattgtataatgcacagtgaactttaaagaaaaggaaagaaaagtgaggaggaaaaatacttttatttattcaaatgcacaaaaacgaaaaaaaaaaaaatggcactggccagggaccctgcaggagtgtggcccagatgtgctgggctgcccagggcctctggtcactatgggcatcgcctgcctatgtctaggagttgcttcctggtcctggggataggtgcactgggagtgaccacagaggtcagggctgacttgatttttctgagatggtcctgactgccctcaatgttgctcacttccagtcgtgggttggtgggctgaggggagaggccatgttgccccacccccacccccacctacttcccaaagtagttgtgaagacggtgctggtgtctcccactcccttcccaccccgcgatggtgctcatgttcggcaggcctgttcctgtgcaccacagctaactaaggtgctgcagagcaggatagccgaaacaaaagctagcaaatcccaggcctggaacaaaaccccgagtgaacactgtacacaccgcccgcacgccatcctggcagctgctgctccagcagccattgcctccaccttacttgagtgttaggggacagacacagcatgttcatggcccagtgggccacaggtgctctgggtacaactgcaagtcctttcctgagcccataagaaacaggaacccacagtaaactgaccatggtgcatagtggccccaggtaccctgtgactgatgggcctagtacagggtaaggctgcctcagtcatccttgccactccaatccaaggttgctgcagggctttgagctcaggaactgatagaaagccctacagactgggaccaccactcccacactagcccagacgggacacacctcccagttcccaccctcaacctacacagcttttttgacagcctggcctgtttgtttgtaacttgatgcagcatcgctctgtcttgtgatgacctctgtacttaaagggtgcattgttctcttcccttggttcccccaaggcatctcacacattgttgctgcctttagacacagtataataaataaagccgttttcacttgagccagttctcagtgccagtttttctttgcctgtttattgctgtccaacctggactggaagagcagagtgcctatctgtctcttgtgaggctgacagtgactctgaaggattcccgctttgggaggacccagtctcacttaagaatccaatcctgactgagtcaaagccccttgacacaaagctgtgtcaaagcttgcctgttttgttctctgtcccagatgctctggaactgcctgtgtcctaccctcctcttcccgctgcctcccaagtgcacacagcctgtttagaaagccaggatttaggtgtcccttacaacttgggcagaacacacctttccccatcagggttacctacaactcccacttatatgagtaccactccccaaaacccaaggatggatccacatctccacagtgagggtgtccaaccagggttcaggcacactgcgagccagaggcttgtccccccaagtcctgcctacaccta

SEQ ID NO: 19078 - DNA, 1099 bp, Mus musculus
ccccgggtgagtccccgctgagacctcgcgtgtgtccacagagaatgacggacaagtgtttccggaagtgcatcgggaagcccgggggctccttggataactcggagcaggtgagacatctcgggaacccggggtggtgaggggcgcggggtcaggagcgtctaggaggttgagagatgtgcgcgtgcgcggcctctagccttagctactgaggaagttgtgcgcgtgcgcggggtgaggacccggcttctgtgcctagatcggtgcagccttcatgggtgatcctcgggtcgtgtgaccgtcagtcagggatccccctccacgctttgcagaaatgcatcgccatgtgcatggaccgctacatggacgcctggaataccgtgtcccgcgcctacaactctcgactgcagcgggaacgagccaacatgtgaccgggacctgtgcctcgggacaccgtgcttatggtctgaactgttttccctgccagttagggtgtctcctcctagccgccctgaagtctggcagcatggagggcttggggatcgaggcctctcccctgggttgctgcgtccagctcaatctcagaagagagtgaggacccgacagagcacagggatctggctggccccactgacctgtgacctcaggagagcaggccaataaatcgctgctggggcagtaaagcaggcgtgtcacctcactgcttcaggtcccttcccctgagtaggcccagacctcccagggtatctttccccttggggtcagtgggctgctggctctcagggaattcggagcatgatctcaggtgtttggtcatcccggggagaccagccgaggttaagaagcaaggcttcatgtagccttcacctatcatgcatgaggcccagggtgctgaccttaactctgaataaaccaagtgtggtgcacacctgtctgcccagcacttgagggtgggttaagtgtggaggcaagaggattggtacatgagatttggtcaatttggtcagtcccaccaaaacataagcaccaaaggagccaagttggagacatgccctgctcctggagactcgtggctttgacagaggttctgagccagtag

SEQ ID NO: 19079 - DNA, 2047 bp, Mus musculus
tacaggttccacagtcttgcctcagatgcagacttacccactcactgtgtgggctctgtgacaccacagacctcagaggccacactcctaacccttcagccaggattccctctgcctagagcttggggtggggagacagggactccagcccccaagtctgggctggggacaaatggaaggctctggaatagggcctttcacttgcttgggagcaggctgcctaattgcatcctccctcattccttgcagggggacccaaggactacctcaaggggctgccgactgatgtgaaacctgccccacggtcaccatggtccccagagcccctaaaactacttttttatggtctgctctcactagtccttggtctgtttctcgatgactgttaagcaaccatgagaatgtgggtgggctctgctgggtttccgagatggaggtgccctctgcccaccggcctgacctggccccatgccgtcaagatggtatagaggcctggggctaggaacccgcaggctgagggacttgggcctggatctggggcaggagaatggctgctagctcagggtggactttgtatgaaactggtgattcagttgttttctttgaagcctttcaaatcaaatcaaattcagaatccaagagtgctgtggggcccactagcctgtcaggatgtggtggctcttaggacacagggcagaccctcctctcctggagttgatggcacctgaaaccagggatggcccagctttgtgctctgaatctgaagggtttataacagtccccagctccagggcattcacaggcttctctggtcccagattctgaattgttctagtcccttctaaagcggaggaccaaggaggagcgagttcacacatgggacgacgcctcccatcctaagactgaaggggacaggcaaaccgtgggcgttgtgccttcaggagcaaaggctgcaggttcccagccagtgactgctcacatgagtgtggccacactagctatgctcctggcctctcctgtatgaatactgtgtggcccctctgtgccccacctcgatggcaaggcctggaaacttgcttccctgcaacttagtgccaggagccagccagtttcacctgtcacctccccaccactgacacatggtatttttttaaagaatatttatttttttacatcggtcagtaacgcagctcactgggatgatgctctgggggttcaggcctggagctgccacaactggcagcttcctttactgagctagggcgagttctttctctctcctggcacagctgatggtaggaagagtccaggcctagtcttcccccaaggcaagagctcttggccacaggatgccaccactgccaccaacctccagaacccaccagccacctcctgcttctagatacctccgttttctttgtgaccggcgttggatcctggatagttatggctggctgcagtcactgcgcagctctgctgccttgcccacagggcaggtgtactctgcactggagctagcttccttgtatttgaggagcaggtctagagtaatctgcaggtcctcaggggtctgtttctggccctggctaggtgagatggttaccggagtggcactgctgctggggagccgccggcactgcgcacatcgctcagctctacagattgtttcttttataagatgcatgccaaacgtgtgttccaccttttcttttacgcctatgatttgtaatatacattttacaactggaaacttttgtatactcaaataaacattgactttaactgcagcctcagagtagatcttcagattaagataggagcagcaggctggtaagatggctcagtgggtaagagcaccggactgctcttccgaaggtccgaagttcaaataccagcaaccacatggtggctcacaaccatccgtataactttaaaaaaaaaacatattaaaaaaaaaaaaaaaaagcagcgaggattttatattgtacgcatgcgcagcggggaggtccaggacaaaatgaccctggtccagcccttgccagggcgt

SEQ ID NO: 19080 - DNA, 1207 bp, Mus musculus
gctgatttaaaagaaaaaagtccaaacttctgcaaacactaaagcaaggaaggacacagtgggaaatcctcagagcagctcggggtcagacaggagttgtgactttttaaagtgacacagaggtcaagttggctaccccagtggtcctcagagatgctgaagcttcctgtacccgggcaggtccccaatcctgcatcctgccgtgcagcaggatgggggaaggttggtttttatcctccctttgccttggcattgagtgcagaggtgagctacactttgagaagcttcctgtctgttctcaggacctgtgtggttgctaggtgaccgaaggcgtcagagttccttgtgatctcactcagctcagaaaaagtagagatcgatgtccagaaacaataagaatcagtgctccacaaatgggtcgcctctgttcatgtgtgcaagtgtggatggaagaacggatatgtggatggatggatgggtgggtggatggatggatgatgggtgggtggatgggtgatgggtgggtggatggataaatggatgaatagatatgtgggtaggtggatggatggatggatgggtggatgcactggtagatgcacagacacacagatggatggcaagacaggtggatgggtggatgtatagttggattcatgagtgcatgtccaggtcagaggacacttggcataggtttcaggaatcaactttaggtcttcagattcctttgtagccaagagttcccaaagcacagcctggatcagcagtctcaaagctgagataagatgatccgagctcatgaggacgagtgattggaaaggcctggatgggtgcgtcttgtttatatggacaggttctttctgtgtggctgtcaccactgtcaccactgtactgtactggtgctcgctctgtggaatccatggagctccgcctgcgctgcctccaagtgctgggattgacggctgtgccaccaagtgcactgccagcagcttccctaagataagatgttatacgttcttacgttcacacaatcattcttgctgtctgtttcaagaatttaaaccagaccaaagttctctctttgtcccctggccacttctgttcctgtcctggagtccacacagtgtggcccttgtgtttgggtgccactgatgcagatgtcctcaagacacactgtgggaggaactgggtgacactctaagtgact

SEQ ID NO: 19081 - DNA, 1198 bp, Mus musculus
taatgccagcatcttgggacagcctgagtgaggactctctggggacataagcctgccacagctcaccaccttccctaacctggggtctgtgtagcaggcttcacctcagcactgccttccctccgttagctgaatgtcagactcctccctagtgccctgtcgccatggccaggtgaccaaaatgacttgtcgagtgtgcccctacccagcgacactcagatgatacaaggcacaaagagacatggccttggggacagctggggcttgggcattgtcctcagagccccaatgcctgggctcccttagtgctgtaatacacccaggttcacacgccgcttggcacacattcagaaccccgggctcccagtgaagggcccactctgccagtggttgaagcctctgctagcagtttctggggttctttcccgaggagccccatcatgtagatgtggtgatgtacccacagtgccacctgggcttactgtccttctatcctctacttaactatgggtgggtggggggcatccaaatggttctccagcttcccttggccccaggtgggccccacggggccaccatgcccctgcaggtatgggctcaggtgacaaagactaggccagggtaggaaggtccttagtctggccatcccaacagggagtctgcacctcccacatgggtgcatacaatggcattctctcctttccagcaccaactgctctgcccctggggacagcagcagcagtggatctggaccctccccattagatctcttgagtctctgagagtcatcccaagtgccagctcactggcaactgggggcctctgtgtctcttactgaaagttccagtttagctgacagcccttgccccagctgcaggagaccctgggccatgctaggacctgtgcagctgtcaggaggaatgggcatggaggagaaatggacatgccgggatgctgcaggggccaggccacccccaccccactgcctcctgtgggggacacagcaggaacacagctagacaggaggaaagagggcggtgcgggtggcccagcttcactgctgatctgtgtgtgtaataacagcatgtcagcttctcctatggcttgtttgtgttcctgtaatagaagttattagtgcaggcgggatccggcacagccagctcctggcatcctgccctcattgcactgcaggggcctg

SEQ ID NO: 19082 - DNA, 1218 bp, Mus musculus
cctggaggagtctacagaagacgacacaccagcaccagttcctccagccacctaggagctgcagggaggggtggggtgagtgtgagtcactgagtgacagcctgggccctcaggtctcaggccccaccctgccgggttcctcctaaagggacttgagtagctgactctcatccccactgccagccccagctgggcaccagcgtcccacaccctcgcctggttgcaggtcccagcaggtgcccccgcctgccttattccagtggcctgtgccacataggactgaggcctgtgacttctgcccagcgtgtggaccatccgtgtctctttccagcttcccctccatctttacagccatcagccaatcctaactttgtgtccagtccagcaccatcctcagcctgggcagcagacatagacattgacccatctgtgtcatcctatccttgatctcatgggaattcaatgtctggggttggcagggagtttcggggtatcggccctgaagcagccaccagaaccatctttgttggggtcagtctgagtgagggtgtggatgttcccacacacattcttggccctaggagcaggtgatgagatcacaggacagctgaacccttggggggtcatgatggcatcaggctttggcagatagtgtcagagctgtgtgtgtggtaggtagccagtaggaagatgggcccccgagggcagcagcgccaccttgggcacagagtgcctggagaataaagacagtgatgacgctctgcctctctgcttcctgtgtcagcctcttgagcccctctgagccccactgctctgagagctaacataccacagcgggagaggcggtctgtctggcctgcaggatgcagttgctgtgggctccagtgagtgtggcctgtgcaccgcatgggaaaggaggttcccaccctccctgagggccaggccatgcagccagcaagccgcccccctgctagttccctgctgagggccagacagcaggggacatttaggattcagtgagtacatcttgtccggtttccatagatgacaggaagatcatgtgggctgcaggtctgtggctgtgagggctcaggctcactggggcaggcaatgagagggcacccagcttctggaaccagtctctcaatttctgtgtggccagagagaaaggccttgacctgggtgtgtagtctaaagagtggatatccctgggtgtaa

SEQ ID NO: 19083 - DNA, 2037 bp, Mus musculus
agaccctgccagagatatttgaagcagccacttccagcaaggtgagcctgggcttcccttgactgtgcccacgatggcagtgtgccgttctgtgctgaggcttgacagcgctctgagctgtgtggcatcctgcaagggcaggtgtggcagggtacagtgagattgtttcacccccagcaggagatgccacaggacccgcgggcccctgacaggacaccaccctctgaagaggactcagctgaggcagagcgcctcaaaacggaaggtgagggagacagatgtccccatggggtctgtgcaaagtgctgtagggatgcagcccagatcagccaggtcccattggcgggggcggggctggggagctgaagagatggtgtggcagttagaggcttcctgcactctcaggcagctagctcagggctggttctaagcccaggtttggggcatctagtgccctcttttggtgtctgtgggcactgcacctacacacatacacacacatatcccccactcagaataatatatatttatgctttaaagtggcagacttaggcaaatctctgtgagttcaagacaagcccagtccacatggtacatttaggccacccagaactacatcataaaactttgtccccaaaacaaaacaaaaaatatttttaaaaattaaaagatcctggtttggtggctcaaacctttaatcccagcacttgggaggcataggcagatgggtctttgtgagattgaggccagcctagtctgcagagcaagttccaggacaggaaagactacatagtgagaccctgtctcaaaacaccgaagccgaggaaaataaagcttcatggcctgtgtggatgacgcagctcaggaaacacccaacccacgcgctcaggcagactcctggtcttgattgcaggccacgtgtggctcccagaaggcaggtggtcttggcatttaacccaggctgaccctccctgtccatggctctgcatgggatgtgtttggctggaaaacaagcttgtgtaagctggattcttgttattgtcaccagatgcagcattggaccaccatggaccctgctctgccactgtgcacctggcacacacaaagctggcatctgtccccaataccacattcaccaggcttatgtcacatctgttgtccccacatgggagaggcagggagggtcaagagctggttacatcataagttggaggacagcctaggattcatgacccctcacctgaagaaaaaaagtcccagtgtgacctaaggatcagatcttcctttgggaatcttagaccagaggagataggtgttatatgggcagcatgggccagcctgggctcctctgcctctctctctctctctctccccccctgcaggtaatgagcagatgaagctggagaacttcgaggcggctgtgcacctctacggcaaggccattgagctcaaccctgccaatgctgtctacttctgtaacaggtgtgggtggtgtggagggcactggtgagcgatggggtggggtgtggactgtgcatggtgagctgcgtgcgtgtggctctgcctgaagaacggaggtcaggtgtggcatggtgctcacataggaccctgagctgtttagtcagccctgcccagcagacaaatggacagtgcagatgcactgtcctcgtggctctggttggcatgcaggctgctcttcagctgccatcatgtccttcagcttgctttggtgtaggaggcagggtttcacggagccctacacacctgccaagtcccgtgtgggctgtgagcttctgaggtccctgtgtggtgggctacagtatccaccttctgccacagaccagctcctggagaggcctcctgtggagggcccgggagtccccgactgacagtttcctctccccagagctgcggcctacagcaagctggggaactacgtgggggccgtgcaggactgcgagcgcgccattggcatcgaccctgggtatagcaaggcctatggccgcatggggtgagtgcagcgatctattgtgggcc

SEQ ID NO: 19084 - DNA, 2070 bp, Mus musculus
atgttcgcacagctcccaaggacactgcagacagagctgggctctgctgacccagatccctgagctggggcagccgtgttgtccttgccgttttctgtgagcaagtgtctggggccacaggcacccagccacactgtggggtttagtttaggagtaggggtggtgagtctcagcccggagtcgggaccttggagcatcagcacggctgtgtgctgtgtgggccttcgctctatggctgtggtaccttcactctctggtctgaggccccagcatctctggcgaggcccattccctgctcagcactcatcctcacttgctgactggggatatcctgccaaggtcacctacagccctgggaggttcccttcaggttccaagctcagagctgctggcctgacttcaaggctccgggctgagcagcgtccgctgcatccacaggtgggctcccggaggactttctgagctctctggagaaggcagaggacggcaagctgaaggtcaccctcaagtaccctcactacttcccgctgttgaagaagtgccatgtgccggagacacgacgcctgttggaggaggccttcaactgtcgctgcaaggaggtggggctgtagacactgctcgctgtccccaacgcgtgctgtcttcccctgggacatcctgctgcagttgcagactgtcttgctgcagctgcccgctgtggccctgtgctcaggctgtcacagggacccctgttggccttggaacgggcagtgcccacttagctcttgagcaggagagacactgtggctcattccctggtggtaccatgttctggccttgtgtcagccaagggattgcaggtaagtggcccgagctgcagcagggcagagcagggaatgggtcctgtttttacttcctttggctttagagtacctggagcctgggtcccccactttcctgaccctgccccaaacagaacgggctgggacttaacacgctgactgagctgtggcctcggatccagggccatgggctctacctcccagaggcacgggaggaataattactgtcagttaaccgacccaactgctcaagactcctcaccctatagtctcccctgacctcccaagctccccatttgtggctggtgctgcctctgtgaggtctcctgcccacctgggtgcatgagttcctgtgtggtgctgggcatgctgtcctggccagtcctcatccatcctctggccacctcttccccagcccaggcttccattgcttgctcttgcggtgctcaaatggagcctgggcttgtctctactctctgctgtgccactctgtgtgtgatcaagttgctgcagcctacaaccagccccaggacagccaacctctgcacctgcagctctggttggggtagtgcagagctagagccgccatgcctgtgtccctgcaggagaactgtgccattctgaaggagctagtgtccctgcgagcacagaagtccagcctgttggggttccacacacacgcggactacgtcctggagatgaacatggccaagaccagtcaaacagtagccaccttcctaggtagccactctactctggccatggactcccatctttgcctcacccactcagcctggaaggccattgtcatgaccgtgtcaggggcagagcctgcagcccaagtccagctgcttccttccacacgcccttgccctggcagtgaggggcccccctggctctctctcctggggttctggatggtgatgtagctaggtctcctgttgcatgtgggtgtgtgttgtcctctttcctgggcagcaggcaggggtggcggagggtgacggtggtgtctctgcagatgagctggcacagaagctgaagcccctgggtgagcaggagcgcgcggtcatcctggagctgaaggaggcagagtgcgccaagcggggactgccattcgacgggcgcatccacgcatgggacatgcgctactacatgaaccaggtggaggagactcgctatcgtgtggaccagaacctgctgaaggagtacttccccatgcaggtggtcacacgtgggctgctggccatct

SEQ ID NO: 19085 - DNA, 1181 bp, Mus musculus
ggagacctacttccacgagttcgggcacgtcatgcaccagctgtgctcgcaggtgagctgggcccgcgagatcactcctcgccagccctgggccttctgccctgcagaaattgtttttattatatttgctaacttggtgtgagggcatgtgtgtgtgtgccttacgtgtgcagaccccaccagcatcaggcttgtcagcattgacccactgacctgacctgcctcttccctcctatgctgtgtctgacagtgacctaccatctgtcacagtgccatctcacccacacttgcatgccaggatgactttggggacagtttgtccaggagggaggctggagcagagccttattgagtgtgagactggagaaaaggagccagggaggtggcacagcctctggcctcagcagctgctggcatccagtgtgcagaagccagggagctgacatctgccgtgcctggtctaggcggagtttgccatgttcagtgggacccacgtggagcgggactttgtggaggcgccgtcccagatgctggagaactgggtgtgggagaaggagcccctgatgcgcatgtctcagcactaccgcacgggcagcgaggcccctcaggacctcctggagaagctcatcaagtctcgccaggccaatgcaggtgagccgtgctgctgcagccacgttgctcagccaggtgagaacctttgcagtgctttcccagcctgaggctgacctctgacctccccccaaggtctcttcaacctgcggcagattgtgcttgccaaggtggatcaggtcctgcacacacagacagacgcagacccggctgaggaatatgcccggctctgccaagagatcctcggggtgccagccacaccaggtaatgttcacactgcagggccaccaccatcccagctcccagagagctgagaattccccaccctggggggcggggggctgcaggagattcaggccttacccgtggaggctgtgcaccctcaaagtatctccatgggcccctcattgcgccctgtgtctgcccaggtaccaacatgccagccactttcggccacctagctggcggctatgatgctcagtactatggctacttatggagcgaagtgtactcgatggacatgttccacacacgcttcaagcaagagggtgtgcttagccccaaggtgagct

SEQ ID NO: 19086 - DNA, 1144 bp, Mus musculus
acatagcaagacactatgtcaaaacaaaactgagccaggcaacggtacatggccaccatcctcatacgaggacgagaaggtcatatatagccctatctcaatgacaagaaaaaatggccactctgccctgctggctgatgcagtctggttttaagtcataggttacatggtataaaggaaagcctacctttagggattgggggatgttgggtggccttttggctggtcctgggcctagtccactttcaatttcctgtaggggtgacacagaaacagtgttcagctccagagactgaagtcagggagtgactatgccaccagtgtggctcccagacctggggtgcaggcagcagtgggctctcctcacttgctattattggcttgtgttaggcagccccacccctacccctcagcccccgccgagagagaacttgtcactcaagagtaggaaaatgcagttgttgtcagtggtacagctctttgggtaccacactacagtggtctacattcaacaagacttagaaagggcaagatgacaccaggccatagctttgtctatgcctgtggcctaccctgggctaattggaactgtggtctctgtctgaaagcttgggtgcacagggccttgtcactgatctggaatgttccagccccagcttgaaaaaaggctcggggagcgggggagtggtggtggtggtggcagaactgctcaacctatatctggaagccaaggaaaagaggagagagaagctggggtcctgctgtcatcatccaaggccagacttccttctaggccaccctctcaagaggccctgccctcttcctactgccacacttacgcccagttagcacagaagggaagctcttctgggtgtccttaagtggggacacctgctaggagcctgctggagagctcacactgtcatttgcagtgtgcccatggcagggagagcaggaagttctgggggctcagcctgggctgtgtcggatctccttaagaaaatgtgttgaggggctggtgagatggctcagtgggtaagagcacccgactgctcttccaaaggtccgaagttcaaatcccagcaaccacatggtggctcacaaccatccgtaatgagatctgactccctcttctggagggtct

SEQ ID NO: 19087 - DNA, 1220 bp, Mus musculus
ggcatgggtggtagcttggtttcctctgctgctcactagagggggctatctggcctggaggcatggcaggaagggggtatccctagtgtacatgtaccaggcaggcccgggtccaggagctgggctacaccctgtcctgcctgaggaacccaccctggaagcagggcctgtggtagtgccagttcagacctggcccatggctcccgtttgggcttccttgtgccatccctggagagactgaagctgggggcctacctcaggaccccacgcctggtccacaggcacggggaggccctagccagtcgatggaactcttcctctgtcacgtcgggtcttggtgtgtcttgtgactgtgttcccctggggaaactgaggccaggctccacccagagattatcccctacgctgactgctgcctctttctgcaggtgtcgcggaagatggctggcggcgtggacggccccatcgggatcccgttcccggaccacagcagcgacatcctgagcggcctgaacgagcagcggactcaggggctgctttgcgacgtggtgattcttgtggaaggacgtgagttccccacgcaccgctcggtgctggccgcctgcagccagtacttcaagaagctgttcacgtcgggagctgtagtggaccagcagaacgtgtacgagatcgacttcgtgagtgccgaggcactgacggcgctcatggacttcgcctacaccgccacgctcacggtcagcacggccaatgtgggcgacatcctgagtgcagcacggctgctggagatcccggccgtgagccacgtgtgcgccgacctgctggagcgtcagattctggcggctgatgatgtgggcgacgcgagccagcccgacggggcgggccccactgaccagcgcaacctgctgcgtgccaaggagtacctggagttcttccgcagtaaccccatgaatagcctgccccccactgccttcccatggtctggcttcggtgcccccgacgacgacctggacgccaccaaggaggctgtggccgccgctgtggccgctgtggccgcaggcgactgcaatggcttggacttctatggcccagggcccccggctgatcggcccccagccggcgatggagatgagggtgacagtaccccagggctgtggcctgagagagatgaagatgccccgcccggagggctcttcccacctcctactgccccaccggccacc

SEQ ID NO: 19088 - DNA, 1213 bp, Mus musculus
ttggggggattaaaaaaagtaaaatgacaaaaaaaaaaaagtacaaaaacaagagaaaataaacacttaaacaggccggcagcctgcacgccacctcctggagcagcccgcagggcgccgggatttcggacactggacagcggccggcagctgtccccgcttccctgcgttgaagccgagccctgaccccggagcgctgacccagtcgcgagcagtttagttgagaagccatggtggggcggcgggccggggacggcggccacaatgtgcaataacgtggtgtcgcggggccggacttgggcacggacctgggtggcatgggggggtgtcgttttctagccagctacctcggtaactccaattcattcaggttaacttccccatggggcagccggccgcgggcttgggctctgtcgccctgctcttgtgtggcccgcggcgtgtgaggctccccggctgcctccttaccttcgggagcctcgctcttccaacgccccgctgccaggcagaccctggggcatcctgctgccctccccacccgactctgtcaggaagcaatacccggtccagtctggagctgggctgcctggcggtgtcaccgcatgaactcgccgggaggccggggccctggccagccacacggcactcttttctaatatttgtattctaatttaattgttttttaaaaatgcaaataaaaaaaatgaacgaagagtagtcagtccggcatctgaacatctgtggtttctctgtagcccaggctagcctgcccgtccttcctaggagctgggggtttgggggggggggggggcatgaattaaccaagtggacttgttgggcagccagacactgatgagcctcaacgttatcaggacataggggcaaggatggtcaaacaaaaggattagcccctggtctgagtacctaccaaccagcaacttgagtgggccccagtgtgagtactctcccacacagacatttgaactcagactaacaagaatttgtgtagaaaatacgctggaatattactcgaccttgatcagaatcgaggctcagacatacgcacagagtggagggatctggaggacgttgtgcgcagtgagaaacccatgcgctggtacagtggccactcacatggatggagctcaagtacaagtcgagaggactgcacagtgtctgaaacctcagcatgggagagggtaagcagacccag

SEQ ID NO: 19089 - DNA, 1240 bp, Mus musculus
gctcatggctgccatggccctgctgggctcaccccacctccttcagggtgcctactccgggtaggcatatctgagtgtgcccaggtggccctgagctccagctctgccctcgggtcctgcagcattgctgcatgcagcctactctcacccagggacccatgggctctttgtatacatgatgctgggctggctgcaggggtgataactcctcaacccagccactccactcccctagttcaaagtctgcctatactcattgtgtggcacaggcaccacagcctgtgggtcagaaggttccaggccagttgcacctagtcttagctgctattgtgaatggggtcttgtggctggacagacagtgttccctgacagggatggtggttggttttgcagagctgggtggagctatcagcctgttccccactgctgtgtcctcaggctgcagactcacccaggagtccaggctggtttttgaacccaagatccttctgcttgagcctcctgcacactggggtggcaggtgcctgcaccaccgccgcctcctctccctcagagggctgctgaggctgcatcgcaaggcattgctgttaaacatgcacatgacataagagccctccctgggctcctgcatagtaggccagcattctcttttggagactggacctgggtgcagacgagacggtggcctgcagatacaggtggctacccctctacctttgggatacctggctccagagggacccagaatgggtgaggccagtacatgtcactgaaatctcaggtgaagagggttggcctctgttcagccaggctacctgacccacgtgtgttcagtcccacagagtgcagagaagctgcaagagagcccatgcatcttcgcgctaacacctcggcaggtggagatgatccgcaactccaggtggggcccagcaggctcaagaactccccaggcacacatgtcatcagatggaacccagggtcccttgggttcggtggatgtgggtgaaccttctgtgatcctgagctgtccctgccccatttgtcaaggcagaggtcaggctagggtggttgggttctgtgaccacttagctggtgaccgtgcaaagggctcctgggtggtctgtgctgcaactgactcctgctcttgccctgcccacagggagctgcagcctggagtgaaagctgtgcaggtggtgctgaggtacgagcagccctggccccgcctgcccctgctctcatt

SEQ ID NO: 19090 - DNA, 6954 bp, Mus musculus
acagtcttttagtccgagcactgacgcagtagattaaggcagatcttcatgatttggtgcggtcctgggctgcatccaaagaccttgtttccaaaacaaacaaacgaaaaagtgtaataaaaatacaagcaaggttttgcagaaataaatctgtggcctcaagggtccctttctccagcttttcccagaggtgtcaaattacataacagtctcaaacccaggaaattgaactttggcacaacccactgaccggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcggtctcttccgccgcagccgccgccatcgtcggcgcgcttccctgttcacctctgactctgagaatccgtcgccatccgccaccatggtgagtctcctcggctccgctagactcggggaccgagacgaatctctggggcagcgggacgtggctgtagcgggacgctgagagggacgggaggaagagacatggctgccctggcccgggcggcaggacgtggtcgggccgcggcgccatatctgcgcgtccctgagggccttgggagtgtcaactgccgaggtcggggtgttttcttgaagtccttcaactccccgcggccgccggggtgactgcgggaggggttgtgcttggtgatgtggcagcgggcaaagcgccgtccccgcgcccctggtgacgggcggagggtgtcctcgggaggtgacagcctgtagggctggcttccttggacacctccagtgggctgaacgccttccgggccctttccggtagcccccgtctctgttttctatctgagttcacacgtgagcaccggtccccataatctaagaaagtggctcactgggcctagtggcgcattgtggcctttgatccgggctttgaccttggcgcacagcacccagtggtttggggaagaggtgtgtgtagcagaggaggttttttcgtgctttggtcccaatcaatccggcatctttgcagtgccgaggtggccgtgcaccttggctttgaattcttgtgctgaggttatgtgacttgagcctcaagatagggtcttctagcacaggcttgctcttaagtgtcgcagttgtcggtttcggcgtttgtttagagctgtggacacatctgtgaacttttgatgcttatttcagaggtcctgggttgtacgtttgagtcacactgtgagctcagctccaatcttgggccgacatctggttcctgcccctgctgtggggtgctattgacccaccgatgcctgccaagttgggttcccagaatcagcctggctgcccatccccccaccacaggtgaacttcacagtagatcagatccgtgccatcatggacaagaaagccaacatccggaacatgtcagtcatcgcccatgtggaccacggcaagtccacgctgaccgactcccttgtgtgcaaggctggcatcattgcctctgcccgagctggggagacgcgcttcactgacactcgcaaggatgagcaggagcgctgcatcacaatcaaatccacgtgagtgaggggacagccccgaggggttgtgctctgggtgtcactcgggtgtgtttgctgccagtggacaaatagtggcgtgtttagggtcctctctgtgacatgcttgtgtgtgctgcctagcctgccttggtcagatgctgaatggactgttgacctcttcctctccgtagcgccatctccctcttctacgagctctctgagaacgacctgaacttcattaagcagagcaaggatggctcgggcttcctcatcaacctcatcgactctccaggccatgtggacttctcttcagaggtgacagctgccttgcgtgtcaccgatggagctctggtggtggtggactgtgtgtctggtaagccttgggtgggagctgtaacagacagttgctggtgttttcatggcccagtaccacatttttgggggtgtaaattgaaatcatattcattttaaggcaaggatgaattctgctctaatttgaaattgtatgtgccagtccccatgtcagggcagggagattgtgaagtccacctaagtgtggggccagtttcctataatttcagtgctctgaggcagaggtgcatgggtctctggaggtgggaggggctgagtggcatagggcctggtacactggacacacttggagatttagcgcctgggcatccataccgtgtaccttggagagtgcttgtgtacatttcacagacaaaacatacgtggtcttcaggccttgaactgtcagtggtttagagtacttgagagttaagggtaaacacttagtccttttcaccctgtcctcaggcgtgtgtgtgcagacagaaactgtgctgcgccaggccatcgctgaacgcatcaagcccgtcctgatgatgaacaagatggaccgggccctgctggagctgcagctggagcccgaggagctctaccagaccttccagcgcatcgtggagaacgtcaacgtcatcatctctacctacggcgagggcgagagtgggcccatgggcaatatcatggtgcgaagctcttctatggggggcggtcagggccacgctccctgggaatctctgacccaccatgatgacggaaattcttcactttgacctgatgtctgttgaagaaactcagtgtctgagactgtgggcttgtggctgggctggctgctgaccatcttgccgggctaactgctgctctcctccctcagattgaccccgtcctgggcaccgtaggctttggttctggcctgcatggctgggccttcaccctgaagcagtttgcggagatgtatgtggccaagtttgcagccaagggtgagggccagctgagcgcagccgagcgtgccaagaaagtagaggacatgatgaagaagctgtggggagaccggtgagtacatggctgtgtgactgtctctacccctgctacttgtggacaatgcctgcctgccgatactatgtgactgctctctacaggtactttgatccggccaatggcaagttcagtaagtcagccaatagcccagatgggaaaaaacttccccgcaccttctgccagctcatcctggaccccatcttcaaggtgggtaagctgtggtcctggcctgtgttcccagccttgggaagtcgctcccatgacctggccttgctcatctgcttcccttgtgcaaacaggtgttcgacgccatcatgaacttcaggaaggaggagacagccaagctgatcgagaagctggacatcaagctggacagcgaggacaaagacaaggagggcaagccattgctcaaggctgtgatgcgccgctggctgcctgcaggggacgccctcctgcagatgatcaccatccacttaccatcccccgtcactgcacagaagtaccgttgtgagctgctatacgaggggcctcccgacgatgaggccgccatgggtatgtactgtaggggctcctgggcttagctcttgggtcctccagccttggcaaccaggtgactcgatttcccaactttccataggtattaagagctgcgaccccaaaggcccacttatgatgtacatttccaagatggtgccaacctctgacaaaggccgcttctatgcctttggtagagtgttctctggggtggtgtccacgggcctgaaggtccggatcatgggccccaactacacgcctgggaagaaagaggacctatacctgaagcctatccagaggtgggcactggccttattttcctgagtcctggctgcttcccaggagcaccctgttgacagttgccctccctctagaaccattctgatgatgggccgctacgtggagccgattgaggacgtgccatgtggaaacattgtggggctggtcggagtggaccagttccttgtgaagacggggaccatcactacctttgagcacgctcacaacatgcgcgtgatgaagttcagcgtcagccctgtcgtccgtgtggcagtggaggccaagaacccagctgacctgcccaagctggtggaggggctgaagcggctggctaagtctgaccctatggtgcaggtgtgccactaggtcttggcttattgtggttggagagggggaacacctggcaaaagcaggggagggctgaggctaggcctgtattggctgttgtcatagggctgagccctatgcctggggaggacggcagggtgctgaccattgttcccacagtgcatcattgaggagtctggagaacatattattgctggcgccggtgagctgcacctggagatctgccttaaggacctggaggaggaccatgcctgcatccccatcaaggtgggcaccagaatgggcgtctcatccttctgcctatgtgcctgaggtgctgcaccatgtgctgagggttctatgcaggccccctggaagccctgtagtgttgacagttgtggtctgtttccctttcacagaaatctgaccctgttgtgtcatatcgggagacagtcagtgaggaatccaacgtgctgtgtctgtccaagtcccccaataagcacaaccggctgtacatgaaggccaggcccttccctgatggcctggcagaggacatcgataagggtgaggtgtctgcccgccaggagctcaaggcacgtgcccgctacctggccgaaaagtatgagtgggacgttgctgaagcccgcaagatctggtgctttggccctgatggcactggccccaacattctcaccgacatcaccaagggtgtgcagtacctgaatgagatcaaggacagtgtggtggctggcttccagtgggctactaaggaggtaagtgactcagcattggtgaccctgtgttctgaggggctgctggtgtctaacttccagctcttcacagggcgctctctgtgaggaaaacatgcgtggtgtgcggtttgatgttcatgatgtgaccctgcatgctgatgccattcaccggggaggtggccagatcatccccacagcacgccgctgcctgtatgccagtgtgctgaccgcacagccccgcctcatggagcctatctatctggtggagatccaggtaacttgtgtatcttaggtggtgtctgtctatcctcctgcctctgcccactgctcaccatgttctctctttttcctcgaagtgtcctgagcaagtggtgggtggcatctacggtgtcctgaacaggaagcgtggccatgtgtttgaggagtcccaggtggctggtacccccatgtttgtggtcaaggcatacctgcctgtcaatgagtcctttggtgagtgtctggtccctggggtttgcagataacctgcaaggcctgtgtaatatagctgcggggtgcagaacagaagcagatttctgtcatcacggccagcttgcttaagggtgccaggaaagacagagctacaaactacacagagaaaccaaaacaaaggacccaggaatccctcctgggaggggtggcaagacagctaagcatgtcccccccccaccccacccccccagggaagtcacctgagtctcctgtcttctgtctaggcttcaccgctgatctgcgatccaacaccggcggccaggccttcccccagtgcgtgtttgaccactggcagatcctgcctggggatccttttgacaacagcagccgccccagccaagtggtagctgagacgcgcaagcgcaagggcctgaaagagggcatcccagcgctggacaacttcctggacaaactgtaggcagcctgatactgccacatgctgcacagtgcccacccatcagaagacaccttgagactgtcccacagtgctcctctagaggctgctggggccaccctgacatcactcagcactcacttgctaccaattctatttatttcggaattacaagatagcgggaatctctctgcaggctggactggcaggctgtggggtgggcgggacacggctcttaacattttcagagggaaacgcgcagatgtccaaaagtctaaataaatgcattcagaggtttttggggtccatggccaagtggagttcccccagagggggaggtggggtaagtgcctccaggaaggcaggcagcctgccttagacttgcagcccggctgtgggaatgaatcattggagtaataaactacagtggttgatccacatgtgctcgcaactctgttttgtacagcgcacgctttcctggttttcagggtatctggctacccttaggtggcctgcggtgattcacacataacacacacactgcaccccgtgcgacagaatgggttttattgtgagttcacagtactgcctcagtccattccacaaacttgaatcactccatagacctgcacatcaggggtttggtctgcgcatacccggctccaggttattggctttcagcctctcgcgttagccaatcatcagccaggagcccaataatgatgtgctccacaagggcggtgtcgagccttcctgtgaatctgtcaggctggccaatgagcactggactctcgcctagccttgggtgatgacgtcactagtcaacgtccgcttccgctgagaggtcagatgctaaccaatgagcgtgtgcattcaatttccggttaaagtcgtagtccaatgagcgctggttttcgggttttgcggaggtgtgcccctgcgctgtcagcgcatgcgtagat

SEQ ID NO: 19091 - DNA, 6954 bp, Mus musculus; identical to SEQ ID NO: 19090

SEQ ID NO: 19092 - DNA, 6954 bp, Mus musculus; identical to SEQ ID NO: 19090

SEQ ID NO: 19093 - DNA, 1805 bp, Mus musculus
caacagagcccctctgtcacctcaggtttgggacccgagcaaaccaggactaggcatgccctgtggtctttctgcatctgtttactgccactggaaggacatccccacgcatgactgtcacctaatgctggactgggagggtccatgttgtctgcctctcatccccttgaagccctgagctggtgccgtgggtcccctcaactaccaggggattctctgccctaagaagggcacagtcaggctgcaggctgagggctgggtcctaagacaccgtggctgaagaaaataagggagaaagtgacatcacctcagcaaagccaactatgtccaccgaacaccagggagattgcggccagtctcctcccctgggcacaccccagtgtgttgggtacagtccaatcgtgtcatgcccctgcttcatggatgttccacccacggtgtgctggtaggaggaatcaggctgaaatgttctgaaagccagcagcctgaagccactgcttttgggccagccgcgtaggcctcttgggttgcaccttcagggacagaggtcaggacctggctggcttccaaggactgcagcagccatggaggcagtgaggagcatgacacaatcatcatggccagaaaaggcatggccagggacaggacccgtgcgggggtggggcaaccgaaggagagatggacagatgtctgtccctggacctcagtccccttcctgttttgggatgcacagtgaacacactggtaagctgctgcaggagttaattcaggggctgcaaaggcaacttgggttgggccttgcacagaccaggcaggtataatatcacacctgtcatcccagcacttggaaagttaaagcaagagggttgtggcaaattccaggctagcctgggctacagagcgaaatgagaccaaaagataaaactcccagggctggccctaccactcagtgggcagagctcacccagctgcgtaagccctgagttccatcccagcaccgcagaaaccagatggggtggcacacagctgccgtccctgacttgggaagtagaggcagaaagcaggcatgcaaggtcatccttggctgtaaccagttggaggccagcctgggctacatgagaccctctcaaaagagaatctgtaaatatctttgtgactccccatcgtgtccccatcctgttctctccaacggccactattgccccaccgtggacggtgtgtgaactgtactgtaaggcctgggggctcctccaaggctgaagaggtgccctctccggcccacttctgttctcctcaagccatcccagcaagtcccctgtccagccccacatcaacctcagtgcaatatgccctccccgtggggtcccttggcacggtactgtctgcagccccttgtctctcacccctagctccactctccggtggttaaaaatcgcatcgcacatcctccccccaatcctgtttttattgttgaatccattctgtaaactacaaacctcgtgtgtcttactcatcaggacttgggatccctcgtcctcagcctatgtggtctggtgtttgacaatccaagcacagtgtcctcttggcaccaaccagaggggcctgtccctccagcgcagccggcaaatgtatgcagtccaggtccccgccccacctgtcacagcccctctttttgagatctgtaataaatctctaataagaaacagctcctctccggtgacttatgcgtgcgtgcgatgggagagcaggcgaagggtgggcaccacgtgttttgtctcccccgctctaaaccctccctggatccc

SEQ ID NO: 19094 - DNA, 2336 bp, Mus musculus
gctgtaggggacacatgcccgggctgcacgtgggagagatcacctggcttacggggacacggacacacgggtcggtagcacggctttatcagagcgcgggtgtgaaagccggaggaggctggccgatggccgggcagggccgctgcaggccccgctgtctgaagtcctgcgcggtgaagcgcggccgctgtggcagcgacaggagcggcacatagtcggaccgccagggcagctttgccccgaactggttcctggtgaccactgcggacaggaccggacgagctctgcagctgcggggccgggggtggggggggggctcccaaatccttatgctgaccgagcccaccaggccacgcccatcctgcgctcccgcacctctgcccattgctggcctagccctccttattttttcgtttttttttttttttaatattgttttcttttgacactagctagcccaggctgcctccgggaccaaaaatccccctatctctgcctccgagagtggagtgacccacgtgcagtactacccccggccccctcctgtccgcatcccctcagctcaccgaactccttgccacggatttgcctgtccctccactgcatgcacccccagcgcgggcctgagttgagatactgcgcggttatcgcggggtcccagaaggccatctcccgcaagtgctgtgtgtaggctgcggggaggcacggaagggagggtgtcagtttgagacccacgggtgtgcacgaccggaggtgggatactcaccgggcggcaggccacgctggcgactctgaaagcagccgtgccaacgcgtgtgggcctcgcggtacggagtgtcaagagcacggggcagcttgtaccaggcatcaccaggttctgagttggtcaggccggtgaaccacacctggccggccgcatcccgtcccatgggcgtgaatttccagcgcacggcttgtttgatggccggcgcccaacggggcccctccagggacacgtagtcattgctgagggagggtggggactgagccagggcgtcctgctggtcccagccagctttcctgtcccaactctttgccaaggtgctgggtgagagtcatccccttctacccatctcctctgtgcactttcccacctgcagtctatatcttgtagccgagaatggccctgtttgaggcagttgtcagtgttgacctggcagcaatcctgcctcagccttgagccacttatggctgttgggggaaggagggaccaagggtgtgcctagcctgtaactccccacagatggtgcatgcatgggaggccatgcaggctgcaggagtggggcttgcaagggacccacgtgaggtggcctgtcatcagcaccatggaaggcccaagtgtgagcagacctatgaaatgggacttttctgctaggtgtgggtggcgacactaagtgtgccaaggcaggaggatctctgtgggcttatgaacagctcgggatacacacaagaatctaaaaagggagggcattcaggcacatggctgccactgcagcacctgtagacaggagaatcaatagacccctctgcttgggagtatgagtggcagcacctgtctgcttgggagtgggtgtgtgcaaatgcctaacttacaacccttgcatacctccatcccagccacctgagctgctggtaggggtaggggatctggggtctgggtgaagaaagggaccaagggcaggaacccaccggtagagatggtcggggaagtagagttcaagggtgcctgagggaacagagggccgagtagcctcccgcctcacgttttccatgtctggccctgcctgcccagaggctctagtcaccaaggccctggggccattgttgacagggacaaaggtatcccagcaacagggaagcgggcagccacagtctaagacctcagcttacttcctggtgcggggctgggacccaaagtgttccctcccccctccctgccccacagcgggaggtcatgccctctagagcgtgggtctccaccccatctctgtcctcaagacacatccaagtaagggcacagtgacaaaggccacaaagtatgggccatgatctagagatccacagaaggaagtggatacctaagtcttgggttggggagaatgctctgggatcactggtggcatcgctgaacatgcagagcccagggcctgctcattctgctagtgcatcctgtgtatctcatgacaataaacagcaacaaccaatctcatagctcagtcaaccctttacagtctgtataggcggcgctccacttgggttcctgttttctcaccagacatcacctccccctctctggt

SEQ ID NO: 19095 - DNA, 1280 bp, Mus musculus
ctacaaaggtaacatggcagggtggtgggcaagcctgctgttgtgtccctgggctctcacagccctggcacacagtcacctgcatcccctgttcccaggaatctgtgtctgtgctcaacctcttcacccggatccgatagaccccgcaggcgggatgtgaagcccacaggcagagatggagcagccagcatgcataggccttgctgtgcccgccttccccagaagcatctggcgggcgggagccggagaccccagagtctcattaaatgcctcattgtgagctgtggagccagtgtctgggacggggacatggggaccctcagccagatggacacttgccacctgttaccactgcccaagccatattggacacagctgagcaggaggctgagatcccatgaaatccccaaacccagtgtcacctggggacctgagccgttgtgcccctctctgctgccactccaaaccagaagaccctgggaggcactggcagggacctgggcctctcaccctgtgacactcttaactgcgttgactctgattgcattgccaccctttgtctgtgtgtgcgccttctgtaacccctccccgtgggtgtcagctcaccctgtccctagccagctgccttgtctgcctcttcctggctgcctctaagcttcctgggcctccctgtcttcataccccatctccactgccccttgcctggggattcccagtgtggtggctgtggcctatggtgtgtgcacgtgtgtatatatgtatttgtgacaccttggggtcggtctcctgtgttttgttgccttgccccaaaactgctgatggctggagaagcccctgggacacagtcactatggggttggctgcctgcaggcctgtgggagtcatagccttgtgagctaagtgggttctgcacttaacaggagtttaaggttcagggccacctgctgctgttgacatctgtacccaaaagcaaaatgcctttagatgtgcactagtgtcacaggcccttgtgacctcctgttggtggaaatcctgctgggcgtgttccatatgcaggggtaggtgcagcctgccttctgattcctggctgaccttcttggtgtgtgtggttcagaaggcacctgccctggacagagcagccagctgtgactgtgaaggccatgaatgggaagggctggtatacaggtcagggtgcaggtgagtcagagagtaaggaccaaagcctacagagccagaactgcaagcagggagggcctgtggcttgggctcccaccccacag

SEQ ID NO: 19096 - DNA, 1173 bp, Mus musculus
gggggagggagtcgggttgccactgagttccgccatattagctaccgcggaggccgggggattcccgtgagcagcggcggcggggcctgtcgcaacggcggggcctcgaacaggcgcggcgtgttcctgggaccggcgggaaccggcgggtgccggctggcgaccggagcgaggcaggtgaggacacgggtgactcggggacccgcccccccagccgaccccttccttctctggggctccagtgcggcctgatcctgaaccccacatcccagcgacctccagtaccggccccgaccccgccagctctctgagtctgtcagagtcctccatccccagagctctgctctgatagttgctcccctcgaatccagggcaccacccgtcttgttcccccgaaccccagaatgcaaaccagcttcccagatgaggccctgagtcaccccaaccctgagtcccctcacccggcaacctcgccttgacctcgctctgtccatcacagcaatcatcgcccagagccttgttcagagcacggctaatgtccaaatccaggcattccacatgttgcagctcagaaccctaggtcaggctccttgcgcccccaaattcaggtcaccctttactacttccaccaaaaccacccaattcaggtgaggtcctgagtcagatctcagacggtctgtccccaatgacctcgccctgtcaccaacactctgtattcttttgagctatgttcccttaaatttagagcattctgtctcatgctgatcactcaagactcaactgcaaaccattcatctgcaccctgttgacttccaaatgtaaatccccctgcctcagatgctccctacatccaaactgggatctgagtcaacctccagagtccaggagtctcaaatctggcattccccaggtgggaaggattgtgaactaaatttgccgtaaacacccagtggttcagccaacaaccaggtgtctcatctcaggggagacatggccagaaaccacagacattctgtgtccccaaatccaccacgtaccctctcagatctgaacctccactctgtgtcttcaaatgcaagtccaggtccttccatcctctatccctgatccaaagccattgtcccctacaaagcccttaaatcaccccaccaacttcacttgtctccagctgta

SEQ ID NO: 19097 - DNA, 1334 bp, Mus musculus
gtgcaaaggcaggagcagggagaagtccggagggaggaggggacggataaagtgtatcccacagggctacatgagaacctccagtaaggtggtgtgggaggcaggggtgagatccattttgcaactgacagtttctagatccctcatctaagctatcctgaaaaagtctggccaggtggtggtggcgcatgcctttaatcccagcacttggatggatgtggagaaagttctgtggcctggagctcaggggtcctcctgcctcagcatcccggggctggaatggcagatatgcaggtgtgtgccctagcttgagatttccccttctcctttttctaccgtaggtttctactgcctagaatccggccttgcagatcacgtgctggggaggccgttgccatggtaacggagcaagagatagaggccatagggaagaccttggtggaccccaagcagcccctgcaggcccgcttccgggccctgtttacacttcgggggcttggtggccctgatgctatctcgtggatcagccggggctttgaggacagctctgctcttctgaagcacgagctggcctactgcctgggccagatgagggacgcacgggccatccctgtgctggcggatgtgctgcaggacacgagccaggagcccatggtgcgtcatgaggcaggtgaggaagggcagcccagtgctgtgttcagctctgtccctggggcacagatgggtgccgcacagggctatggacagcgcacgggggtggtctccccagcagagattttgcttctgagttgggacctatgccaacctgttcttcagggacttggaatgctgtccctctgcccaaagtctagtgatgacttgtcactccacccaggggcactggctggggtgggtggctttagacccggcgggccaacttcttgagttaaggattcggattgaccagctcagaggctgttggcccagctgtgacctgggagaccagtcaggtgttgggcatcaagcaagctcctctctactgatttgtctcctcaggggaagccctgggggcgattggtaacccggaagttctaggcctcctgaagcagtattctacggacccagtggttgaggtgaggagactctgactggcccatctctgccaggacaagctctataggccacatctggttactagggcaacctcctggaaaaggaaactctcgagatggggggaggggcacctgtagggtctcccacagctctgggtccccagctttgagaattctacccttgtctgttcactgtcgaaacctatgacctatatggtccttccccttgctcatactgtaccc

SEQ ID NO: 19098 - DNA, 1459 bp, Mus musculus
tgcagcagagcaggatgtggggaggctgcgggaggccctgctggatgaggcacggccactctttgagcgataccgtgccatgtttgccctgcgcaacgtgggtggcaaggaggctgccttggccctggctgaaggtgaggctggagcatatccctggacctgggtgatctcttgtgcagcctgaggggcagctgtcccagggccaccttctccccatccaggtgccccacacaaaccctggggactttacctggctgcctaaccatagtggtcttggtgtgtcccttccttgggaccctatgtgcccactgtttcctgcccagctctccttaccctgtttcctcggcccttaccttgcaggcctgcagtgtggcagtgcgctcttccgccacgaggtgggctatgtgctgggtcagctgcagcacgaggcagccgtgcccgggctggcagccacattggcgcggaccactgagagtcccatggtgcggcacgagtgcgcagaggccctgggtgccatcgccagacctgcctgcctggctgcattgcgagagcacattgaggaccctgagcaggtggtgcgggagagctgcgaggtggccctggacatgtatgagtatgagagcagccaggatttccagtatgcagacgggctggagcgcctgcggccaccaccctaacctagcgcctggctgcctgccctggggctgcctcctctgctgctgccctggccccggccatgtgtgctgtgcctcacatccagatttagggagcagagcagctgaggggccctgtgtcccactcgcctcacctccttgctgggtgctgtctgctctgtggttctgtgtctcccatgccctccaccagcagaggtggcagtgcagacgcttgcagggttgggaaagttgtgggggcaagggtgtgtggggtacacctcccatctgggtcaagcagggagtacaagccagccccagcgtgctgcatgaataaaataagttatttttcacaagtgctggctcctgctgtgtggggacagtcatgtggcctttggggggtcacagaagaaggtgtttagtggtacagctacaagtccatactgtgggttcccatcaggctcccataattccatgctggctggggcacccacttccctggacgccattcacctctgtaaatgttgacacagaacgtagcagcccacagccatctgttccagcttccaagacctggaactcaggtgtcatacccatgcacatgtcacctggcaggtgacccctgccctcccctgccttgtgtgctcttccccaggaagggggtgtgggctctggattgttccaaagtaagtgtgatttgtgtccttgctgccatgtttgctgagccgagaggccagaggctggcgtgggcaactcccaggttttgtttacttatttgaagcatcaactctcgctgagcctggagcttg

SEQ ID NO: 19099 - DNA, 1616 bp, Mus musculus
ttgccagggcagacaggagtccaggctccaagctatccccttgcctctttctgcccccagccccaccccccaaccagtctgcctgttgccccactcagccctgagtgttaggcactggcagagaggcaatggcaggctcaccttgatggagggactggggtgggtgggactaccgccccgcccacctgtctgcactcctgtcacttgtaggcctggctgacttacagatttttccttccccagcttgtgtccacccctgtgccaggagaggtagcaccatctcctgggaccatcaaagagtgggctggagtggggacagtggacagagcatacctggtggcaggttgggaggggccactcagcgtcccccccatttctcagaaaatctccagtcccacccagggaccccaccctggcccagtcctcaggtggatgactgacgcacggcaggagatttttgtttttgttttcctgtatatgaaatgtttttcaaaccatcctctcctcaggccaccaccccttaccctaacccatcacgccctggtgaagcccccaaggcctgctgctttggggtgtggcctgtgactgtgtttcccaggtggggaccagaagatgtctgaggtcctcctgagccctgaaatcttgataatcaggaatacccagggtggtgggactgacatcaggggagtggcgtctgcccaccccccaccctgtccctccgggggtgaaccagccaggctgcactacaatgtccacaggcaagaggcccccaggccaccagcaaatgtcccgcccctggggacagtgcgcccgctcgcccttggttgtgctgggcagcatttgtacatacatgcgcgcatttagtttgcagttaattcctgctgcgctgcccacagtggcttcctcccttcagtttgtccctgagacccctgagtggcctttgcttctccagggtactgggttgaagatccagccacttaatttcccctctgattgttttgatatctgagagacagaaaggtctccccaggctggtctccaactcctggcaatcctcctgcctctgtttctcagttgctctgacaacaggtgtgtaccaccactcctgacttccctgcccaaacttcatatcctacttgttaatagccgtcttctccctctgtcatctacccagagcattcagcttgggactgtcgtccagtgcagggcccaggtgagaggagactgccagcgagtccctagatcttgtagccatgataccacacagtcatttcccaatcagtgcctcacacatctatctgatggtgcagttttggggtctgtccccactcccctcagtccctacccctgctcccctcagacatggggcaggaaacagcaggtgcgctgggcaggaggaaggcatgtgcttcctccccagccaccacccctcccacagcacccagcctcactaccccagcatggggtacccagctggatactcccaaaatgtcacatcccatccaacctcagatctgatgcagtcatctgtgtcccccaaccaaagcccatttgggtctgagggttccagcgtaaatgcctgccctgcagcgcctggcaactggcaagcatcgggt

SEQ ID NO: 19100 - DNA, 1176 bp, Mus musculus
ttatgtgggcaacaggcctgagtttacagggccttagtttgcccatatgggcaacgggtctctgctgatctaggcctcagtttccctgcctgagcagtaggtcttgctggcctaagcctcagtttgcctgcttctccgcaggatgagttccacccgttcatcgaggcgctgctgccgcatgtgcgcgccttcgcctacacctggttcaacctgcaggcgcgcaagcgcaagtacttcaagaagcacgagaagcgcatgtccaaggacgaggagcgcgcggtgaaggatgagctgctgggtgaaaaggccgaagtgaagcagaagtgggcgtcgcggctgctggccaagctgcgcaaggacatccggcccgagtgccgtgaagacttcgtactggctgtgactggcaagaaggcgccaggctgtgtgctgtccaacccggaccagaagggcaagatgcggcgcatcgactgcctgcgccaggccgacaaagtgtggcgtctggacctggtcatggtcatcctgttcaagggcatcccactggagagcacagatggtgagcggctggtgaaggcggctgcctgtgcgcacccggtgctgtgtgtgcagccgcaccatattggcgtggccgtcaaggagctggacctgtacctggcctactttgtgcgggagcgcggtgagtgtggggtgggtggggcatggagaggccagggccatggtcagaggccagaccctgtacaaggagggggtgtggccaggggagggacatggacaggggtaggagcctggatagggtcatcgtcaggagctgggtcatggtcaggggtgagaccatggacaggggagggaccgtggtcaaaaggcaacactgtggtcatgggcaggctgtggtcagagtcatgggcaggggcagggccacggacaggggcaggactatggactggagaggggtcgcagacagggtcatagtcagacacaggatattgtcggcggcaaggtaatagttagggtcatagtcaagacctatgcgatgtctgtggttggggagggatcagtgttgggccatggtcagggtcaagggtgggatcatgttcagagccatggtggggttcaggatcgtcgtcaggggcatcataatggtggtcatggatacagtcagaggctaagctgcggtcaact

SEQ ID NO: 19101 - DNA, 1120 bp, Mus musculus
ggctccgcccacaggggaccggaagctgttcgtgggtatgctcaacaagcagcagtcagaggaagacgtgctcaggctcttccagccctttggcgtcatagacgagtgcacagtgcttcgaggaccagatggcagcagcaaaggtgactggcaggcgatgggggcggagcctggtggcggggcttagggagtggcagcggggggtggtggtcagggttgagcctggcacaggtacagagcagtagattgcaggaatagtggaatgggataggactggaggtgggcatagccaatgggaaggggtggaacaggtggggtgagtgtttgtggttggaaagggtgggtgggtgggatttgggtgtgggaaggggagggagagggaaaggaggagaagacctagttgctgaggagcggtcaggtctatgggagggcagggtcagccctggctcctgagtgtccactcaatggggctgttgtgtcccctgcagattggcccttgggattatggcccgagttctttctatccccaagcctcagcttttctccctgtgtctcaagttctgtgtcttcatgtgtctgtctgtctatctgtatgactaaaaggctggctggtcctggctccatgttgtatgaactctggaggtgcacctgccttggtggacaccacatcgatgtgtttgtctgtccatttgaccagcttccatgattccatagggcccagtacaccgtctgtgccctggaggtcagggctggggccattcaaaccttttcctacttgttctgatgggaccttcttgggacccaggctgcctctgaaagtgtgtgtggctactggggtctcaacatagttcctggatgctgagctgacttcctgttggctgaccacatgaatggacagatggattgatggatgaatggatggatggatgaactggtgggtggatggatagatagatggatgggtgggtggatggatggatggatgggtggatggatgggtggacagatggatggatagatggatgactgacttcctatttagctgaattaatggctgacatctaagtctctgggcctagaagatgttggtgtatcctatctgttcgggccatcttggtca

SEQ ID NO: 19102 - DNA, 1905 bp, Mus musculus
ttgtcttctatgaccagttgaagcaagtgatgaatgcttacaggtgagtgatgggccagagcccagggtgccacagtctgtggggatgaccgttctcctatccctgaccccatggactgtctgtccctcagggtcaagccagccatctttgacctgctgctggcattgtgcattggggcataccttggcatggcgtacacagccgtccaggtaagcagctgtgcaagcgttttgggttgggggctggctctctggtgtccctcataccttgttcttcccaccagcacttccacgtgctatacaagacggtgcagagactgctgctcaaggccaaggcacagtagcagtggccatgtacaggtggcccaggaggtactattcacacacccacagcggccagaccgaacgaaccacagagggttttgatgggtcactaggatgcaaggacacctctccctgtccatttcgttgaatgaccctggaggagagccccgcacacctgcagatgagcccactgggatggaatgatggcccgggccacgtgcactgaagggccacacactagtgttggcctccccagtggctgggtcccagaagccggtctctgcggttgtgcagaggcatccgctgtcagcctgcctccccctagcgctggccagcacctgacagtgtctccctgcttttcctcctcataccccgccctgcctgttgtcacatcctccaccactggacatacctggtcccccagctgatctgagccccctgaggttctgtcccctcctgcaagtgtcccttcgctcagtcctgacgctggtgactgggcaggagttggtcctgttctggagtgtgcagtcctgaggtctccccaccttccaccccccagcctcagtttccctacctgtgatacattctggggagtccacccctctgtcatagtgtctgatggaacagccaggcccagcacagccctggatgtccccaacaggatggccttgggagggggacactagtgctgacggttgacctcagggaccccacggtgaatcaattcaatagcaatatgacccaagaggtgtcaggctggggaccagctgaagaccagctgcttctgtccctcacgcctgctgaggcctggcccacccccacccgctgtgggctgcctctgctcagcagtgatggctgccaccctcgtggcatgcgtgtcgtagagcgagagggctcagcctgctgccctggccctgggcactcttgttctttctactcttaccctggcagctggttatgggtctgaggccagtgccacctgtcactgggaaaggacacagggcacgcccccttcctctgtcctcacagggcatggggatggatggcccctggggtggccgtgggtctgcagttggtgggttacaaaataaaagccatattgaaggaccgagcctccaggtgtcctgaggaacatccactattgtgctgctgtccttggtctctggcggtgtcacatcaggcccggccatctaccctggactgttcaatgaacactgcttccttagcactgggcatgttctcagtggaagagaagttggggacatgccacacggggcaggggtcatcacagtatattaaaggccgtccctgccaagcttagaccagaaccctgctcctcctggattctgggtgggtatgggattaggctcctcaccaccggctctgcccattgatagagtccctgtcttgtaaagtcagtcaacaaaagttcagttgctgctgtaaggccggggcctgtccactcagctcatgacagtattgctaacctcccacacacaggccacaggcattcagagcagggtctctcctgtcttcatcatcacagagcctggcaagtgggggttctaggttcaaacagag

SEQ ID NO: 19103 - DNA, 1191 bp, Mus musculus
taagtggggcccaggggactgcagttcttgaagggatcatcctgctgtatcgattcacctctggcccatgcagttcagacccctaagggtcagcttggcctgccatggttctgtgccggatataccgtgcctgtcctgtaagagccccactctcgctgtgtgctgtgtggaggatggcagctgtgatgatgccatgaccccgtgtcccccataggcacgcggaatgcagtgctcaacacagaggcccgcacggtggacgcagatgtgctgagccgccgctgcgtgcttatgcggctcctggacttttcctatgagcactatcagaaggctctgcgacagtcagcaggtgctgtggttatcatcctgccccgggccatggctgccgtgccccaggatgtcgtccgggtaagcctgtgtctcagtccccatgcctgcccctcaggttgcatctgctgggtgtccttgtcctcccccttcaggaaggaggctgagatggggaggcactgcgggtggctgcagttccctgaacgcatgcgatcctcacagcaattcatggagattgagcctgagatgctggccatggagactgtggtccctgtgtactttgctgtggaggacgaggcactgctgtccatctatgagcagacccaggctgcctctgcctcccagggctctgcctctgccgctgaaggtaagccaggccactggagggtatggggtggccctggtccctgcatctatggggctttcctgggcttctatgtttgcagtacccaccccagctgtggccctggccataagcccaagtgacccctccccttctgcccccagtactgctgcacacggccacagccaatggtttccagatggtgaccagtggagcccagagccaggcagtgagcgattggctcatcaccagcgtggaggtgagctcccaccttcttagcctgcctcagggcctttgcacaggctgcaccatgatctcagacgtccagtcacccctctgccacacacgggaggtggtggcgacaaaggaacttgactgcaggctgaggctgtggctcagtgggcagcacttgccagctcacagagtcctgggctcagtccccaggatcacagcaaccaggtgtgctaacacacacccggaggctgaagcagagagatggggggtgcagggctatccttggctac

SEQ ID NO: 19104 - DNA, 1752 bp, Mus musculus
tgccctcagggctcgcaccatccccctagactcccaagaagtgggggtgggcggcccctgtgcctaccctgggaagtgcctaatcgttttttgttttgtttttgtttttgaagaaaagagaaatattctccactctgacttggcagccaggtgacacactacagggtctagtgaccataacccctgtgttcccctgctgcaggcagggcctgctgttggtgaagtggggggtggggagattaagtccccaagacccgctgctcactgacatggctaggaaaggccctggggaccctgagggactacgtggagttgggcagctggaaggactgtccaagtctatgtggttcagcaagactcgccctccccaaacccagtcaagagcggggtgcacaggggcctcttccaaatattctcaggtccgtacccagacatgggcagtggccccaccccacgcactggtccctggccatagtcactgcaccttgcctgttgcctcctaaactagaggaccagcgtataggaggtgatggccatgaccagagaggacataggcaggcccctgctgctcatatacactacagtgtctatctgtctgtctgtcagatttctttactttttgcacgtgcgttctgggcttggatagccagccacgcctttgtcctgcctgccaagctggactccaggccccagagtgcccatgcactcagacacacgccaatctgggcagtggccacattgccatcccaggcagaaggaaacaagggaccatgggcatgacagagccctagagtatgatgggtggccatgatgatcacccacattcctggcctccagcccgtggattcccccaccttcccacactaggctcctctcctgtctccagttgagggtccgatctgtgccatcccatacactacagagctacatggatggcagggtcatcctatgagagacccaggtcctcatagtaggcatctgtgttgcacaataggaagagaagttgggactgtacaggtgtctgaggctggaccaccccaagccggcaaagtgttagcctctcttgagcagtatgtgccaagtgtgctgggccacagtggccacagccaaaccccggggcagcaaccagctcacccaagtggtgagtggcaggttctgctcaggggaaatgtgtcagggccccttggggctgtgtgccacacaggtcaggatggggaccccagactccctacttctgtcctggtcctcaccaaggaatggcctgattgcaggggacacactggtttctttgtgtccaccttggtgcactgggagtgccaaccaccatccagcacctggtccagggagccaagcctggcctgtggtggctgccagcggctgctgtgacccttgtatattacagtcctaatttcaaacttcagcctatttaagagaacactcaaaacactatttttaatcctcgtcctttgtgaagcatgttcccgtgtgagggggaggctcaggcacacagctcagtgccaggctcctacaggccctcggccatggacgccagggtgcaagcagcaggtcggggccctgaccccttaacccagagggtcttgctgaagccaccttttcatatctttctcttgaattctgttttaaatcggaataaattttgttcctaaactctggctcctttgtgattattagtaaaagtatgttgggggcggagtcagagcaagcacatcccgaggcaccgctgactgtcgc

SEQ ID NO: 19105 - DNA, 1719 bp, Mus musculus
tagcaaaggtgagacgtggagcagctgcactcagacccctgtggcaaggcagaaagagctccctgggtgggcgggcacaggcgatgggagcccccccccagctctaaggaaattcctgtgaagttggattcctagtctcccaccccagcagcccctgagcccctaggacaggacttctcttgcgcttttgcactggttgcctactgcacaggagtcgccattcccccgcccccgcccctcagtccctttccagctttgcctgagagaactctgtcccctcccttgcctattccagcatcagcagcaggtcctgggagccatcgagagagccaagcaggtcacggctcctgagctgaactccatcatccgagtaagtcggagcctctggtggactggggactgacttgacctgggtggccagggtcaggtgacaagaccctgggctgactctgtcacccccacccccaccccacagcagcagctccaggctcaccagctgtcccagctgcaggcgctggccctgcccctgacaccgctgcctgtcgggctccagccaccgtccctccctgcagtcagtgcaggcacaggcctgctgtcactctctgctctgggttctcagacccacctctccaaggaggacaagaacggacacgatggggacacccaccaggaggatgacggagagaagtcggattagctcttggggaagggggaggggggagaccaggggagacaggcacagagagcgcagtgttctaagggccacacagcacacagctctgtcactacccaagcttacacctccagtcctggttctggctgtgcaccctgggcctaggggacgccagagggacaccccaggctaagggttcttccccaccttcaacatttccctgggccacagccaccaatctcggcccagaatgtacacaacgctagctgcccctttccaccctgtgcaccccgaatctgcccctatccccttctctgcttcctgcactgcacacctgctagtcccagacccctccccccagctcccccagctccggttccctcaaccacaaaagaaggggacagagagaaagcattggctcgggactgcagtgggggtgggcaccccacaaacttccctcccctcttccccaaataaacgtgagggttaaaagttggtttgtttatgatttctttcttgtgccagtattctatagctatcatctcagaaaggaaaagaaggaagccccaggagtgtctgtcatagggttagctttgttggtcgccttggtctctgtccagaggtcaaaggccaagccgctgtactgaggatggggtctagctgtgccttcaaaataaaaacatgaaaaggttggccactgtgtccctgcttctgtcttgtgggtggggacccctttcctcagggcaccccgtgtcctgcaataagacatccctggagcaaccaaagacccagagagggtgagctggggacctgggcccagacagtgcaactcagtgctcagatttcacactgttttggcagggtggctgtggtacccacatgggtcccttggttaccttctgggagatggcctggatgctccctgtacccctcccaagctaggctgtcccctgggcatgcgcctcggtttggggaccttttcctttcttgtttttctgaaacagggttttctctgtatagccctgaatgccctggactcattcctc

SEQ ID NO: 19106 - DNA, 1140 bp, Mus musculus
atagaaatatatcctgaagtctatggtcctttgccttccaggacgtagggaatgatcttgggaatatgcagattgacttctcaaggattcattgtctatccagaaattaaagacgaagacttcaaaagagaaattaaaattatagcctatgtaaaaccagagatggaatttaaggcaggtgataggaattgttcatcttctacagtttccctacatcaaagtcaaaataggtcaagtagaaagaacaggagggtttggaagtactggaaaacatgttctggcaaacaatttttaatgatcgtaggccaaaattaaaattgcaagtaaatgtattgaaatagtaagtttggtgggtataggagcagatgtaactattacttatcaaaactctcgaaattcagaacggccacttccaaaagtttacaaacagtttctaggaactggaaagttttctcagacaaaatgtaactgtggatcaaatgtgtgagaccaggatgtcaaaaaggaaagtttaagccttgtgtgggtgtcatacccatgtttatagggaagggctcttttacaacagtgggctcagattgatattcccacaattatgaattcccacaatgatgaaattagggctgaattggttggtacatgctcctgggaaaggtattgctattcatcatcaaaaaatgactcaagtctgtgccaattgtccaaacacaagacatcacaggaattgagtttccagatttataagggaggccaccactgaagtaccaatggccctacccttaaaatggttgactggcatgcctgtgtgggtaatggcccttaacaaaggaaaaattataggcatttgagcagcttgtacaagagcagctgtagggacaacaaacagaattaattcctcctttttttttttttttttttccgagacagggtttctctgtgtaaccctggctgtcctggaactcactttgtagaccaggctggccttgaactcagaaatcagcctgcctctgcctcccgagtgctgggattaaaggcgtgcgccaccacgcccagccaaatagtctgactttaagttaatattttgtccaacaaccacaagaaataatttgtaggtaatttcctcaaaccattgtttattac

SEQ ID NO: 19107 - DNA, 1159 bp, Mus musculus
cctggctgtcctggaactcactttgtagaccaggctggcctcgaactcagagatccacctgcctctgcctcctgagtgctgggattaaaagcgtgtgcaccacacccagctggaaatttttatttcagttgtttttgtttctcttttttcttactttttaaaaaatgatatttattttatgtatatgagtatactgtagctgtacagatggttgtgagtcttcatgtggttgttgggtattgaatttttagaacctctgctcactctggtcaaccttgcttgttctggcccaaagatttatttattattttacataagtacattgtagctgtctttagatgcaccagaaggagggcgtcagatctcattatgggtagttgtaagtcaccacgtggttgctgggatttgaactcaggacctttggaagaacagtcagtgctcttaccagctgagccatctcaccagctccttgtttctcttttttcaagacaggatttcttggtgtagccttggatggcactctgtagaccaggagggccttgaactcacagagatctgcttgcctctgcctcacaagtgctgggattcaaggtattccctaccactgctcaaaatcaaggaactatccaaagggaatattggaagtttatccctcaagggagccaacaccctccctaattcacagccatcaactctactgctctctctggcatatgtgttttaatatttatattaaagaagtttggctatatggcattcaggcacagacagactaaaatcagagagagaaacagaaacagagagatagagagaaatataagaatttagtgagttcacaggtattccagagtcacatcttgaagggtggaaaaactgaggatgctcttatcttcttgctccctagtgaaaacgaggagagtatccatccacacatcaataaaatggatcatctaataaatttatttgtctatgttcctttgcctcatgacagtaagaaaaaaaaaaacagtaacaggaaatgctagaagggtttaaatatgtaaagggcctcagtaatgaaaggatacataaagatggctgggtatctccagagtaaataagactagaaagcttttgcaagttatgacggtctgaagcagtcatttaaggaacataaagg

SEQ ID NO: 19108 - DNA, 1201 bp, Mus musculus
attaactacagttagattttgttttccttcttttccaatgttatcagaatagttagcatcaccttatcagtaatcaaatacactagattccaatgtttctgtctacagctagaatgttcaggtgatcaggaactcttactggatttcctttgagttcttgattatatctccaaatcctaaacggctgagaggctcctgctgaccccacaaagaaattaacagcgaacaaactccaattttttggtataattataagtgagtatcttgaccaaataaaccctgtagccatcagcacagtggaatgagctgcactgagtttctctgtaggtctgaccatgtcatgtcagctaatccaacacataccaatccccatttcattattggagcccaggaaaaaaactgttctggggcctgccaggtgataaagcagcctcaatttctttggcagcaacaagtccactttatccatgagttggtggtaggtggtccacaggcctcgggcaccagcagctgccatctcggcagcctaggagctgggtgggagaactgctgtgtccatattcctggctgacaatgatgtccacctctgccctagggctcccttccctggctctgccagcctgaggtgaagcacctagagactgagtccggcaaaggctatggggcagaggctcagcaaaagcctgccctggcctgctttctgcaagcagatcagggaaacagagaagaataaaatttttcattggttcttgaccacataattgttttgtctgaaatctgcccagaattattggtccagaaaccacagactaatatagagtgaaaacttttttgaactaatagaaaaatgtatccattctattgccctgttatcacaaagcaattccatagtgatactgtgagaaagtatagctaataatgcaggaacagtatagagatatgagatatgctgaacctgagtattcctaagtgcattttcatcctgttataatactatacatgcaggttcagtgcattctttagacgatgacggattaaaattccccttaacatcaaataaaggttgtagttgtgctgtgggaatttttagcatagttctaactcaagtcaaatccactagctgttttttggaaatcatttgagattttcagctgtcttttctaaactctactcatttaggaatgataactgaagacattat

SEQ ID NO: 19109 - DNA, 1200 bp, Mus musculus
gagtaatgactatgatctggctataaacaatttagattctgaagagtctttgtcatttaactcacccttgggtatcttttattgtggtaacataaattgtacctaattgttctttcagctattctctggagcaagttcaagctttgtattcatttccatttcaacaaatgatggcagaagttcctaacatggcagtcacgactggacagcaggtgccagcagtagctcctaacatggcaaccgtgacagaacagcaggtgcccgaagacgctcctgtccaggaacctgcaccaggtagttcttacatggtctcccttgaatgtctccgcctccagcagagcaatcagtgaacacatgctgcgctcctgcacactgggcgctgcagcaggcacaggatgagtgaccagagacctcacagcattggcattaacttggtccaggtgctgaggcagcagagcagtaacataggagctccaaacgtcaccctgtgaacaacagggggtgggggcagtgccagctgagtaggagttgaggccccaaacccctgagtatcatggagcagaggagacggtgagatgggagcagatgaggcagtgaggcttatgtggaccctgaggagtgcacactgctattcccagagcagtagggagctgttgagagagtgggagccaaggagtgactcacatggatgggcgtttaaaagtaggtctggagggtctaagtgggaagatatgaggaaggctagagggtgtggagaaagagttgggaagtactctaaaggtgcacttccttgcctacagtacatggatttcttttcttttttaagatttatttatttattttatttatatgagtatattgcagctgtcttcagacacaccagaagagggcatcagatcccgttattggtggttgtgagccaccatgtggttgctgggaagaacaagccagtgttcttaactgctaagccatctctccagctcgatgtatttcacgtagatgctgagagagaaagagaaagcgaaaagtaccagttgtagtcccttccattattataatgacggacttgatgctgagtaacatttttcttttggagtaagattttttttaaaaaaggtgtatgtgtgtttgtttattctgttaatttttatgtgtgtgggtgttttatttgcaagtctgtgaaccacttccatgtctggt

SEQ ID NO: 19110 - DNA, 1200 bp, Mus musculus; identical to SEQ ID NO: 19109

SEQ ID NO: 19111 - DNA, 2014 bp, Mus musculus
gttcattattaagattttctcaaaatgtgcattacttccagaattccttaccgattaagacatttcacaagtgtttgctacatctgcgtaaggagaactaaagtagctctgaccagggtggcctggccggctggggtgggggcagttccctgctgtggcctgtttggtgttgtctgacataaaaaaaaaaatcttaatttatattttccaatcttagatttctggtgtccagcaaattcagttttcatgatcggaaggacggacggaaccgggcttgtgtggagagagtctgatggagtctgaagcagaggcatgggcggaagtgagggtgaagctgcctccttgtaccataagtagctgtaatgtagcttcctgatgcttgactaattgaggtgttaattctgacttgagaatctttttcatgaatgattttaaaagaaaaaaaaattggattttaaaggtattaaaatatttttgttttgtacgagagtttgttgctctgtatgacgcctgtatgcattgtatattgcaatttattactgtcagagatttgtagacagtttcttattttcatattgaatcatgttattttgtaattcaagtaagcagctgggttaattcataatgtttaccctttaataaaatataagggtagagttcattttgaatgaaagttgcctttattataaatttgagtttgtcttggctatatactatcttgcatggtaacttagctagatgttttagcatttatttattgaaaactttttttgttttgttttggtaaaacagtcatagcataagcaacttcgttttttaaaaaattttaattgaaaattaagttggatgcagaagcaagtcttgtctggcctattaaacttggtgcccttcactgtctgtggctgttcaggcagcttcagttactatcacgcctgttagcattcatttccctttgtggaaatggtccctctcttcaagtgttacagtctccttcacgaagagggacttttcagtccattgatagtcattttaccttcacaaaaaggtcgggttcctgttagaccgtgggaactgagcagtgggcatggttctgtgcagatgctgcaggagagagtggacaagcaggggagcagtgaccactaggaatcacgtggcacgggagccttctggtttgctgtcacgctatctgcagtaaactaacattaggtgatgtagcttggtacagcttagtggtgtgtacttgggttccttttttaaagtgaagatttctattttctcatcttttttttttctttttagtaataattactttgaatttttgtgtatgtgctgtggtagttctagctctatcaaaaatggcttattgtatagtctgtccagaaggaaattttgggtactccagtggacaaaagatagcagtttcctaggtccaggctgaacagtaatggccacttggccaggagttttgtggaacacgcggctggctatttggagattaaatagcatcctcttcctccaactcccttttcagtaataacctttctgtagaaaatgcacataggaaagaacgggagatgatggtgaggcaggatccaacagtcatcctgctgtgctgaaataacaatgttaatattttgataaattcatttgtccttttactttgctaaatatgtatatttttataaaagtgggctcgtgttgtacacactgttttgtaactggtttttcacttattatattgtgaacatctccccagtcacgcatggtcttctgcatcgtttttactgggtttttattctgttgtatgattgaatcatgattatttaatcgcctattgcaaattttgacctttttcatctcttcttagttataaacagcccttcattgaatcttgtgtacatcgtaacttttcttgaaataaattcttagaactgctgggttgccagatacacagcaggaaggtttttgcgccttgcgtgtgggttcactttggaatgtgtcctacccaggtgtc

SEQ ID NO: 19112 - DNA, 1138 bp, Mus musculus
aggcgcacttgggttgaccttcctgcctgtctggctttcatctgtatgggatggtagaccaactgctcagtgtggtggctcttaaccatctgctctgtttgctgtgaagaagttccctcacttttatgtacatgcttgttctgttgattctgactctgagttggctgtgaccaacatatattaatatttaagggataaagttaatgtggctcagttggtaaagtgctcgcctaacatacacaaagccctgggctttaaaataaagacccagcacttgagaggtggaggcaggaagatcaaaagttcaggtcatccttggctacatagaggagcgcctagcctgggagagctgagaccctgacagtaatgggtgtgctctgtgtggctctttgtttttgcagctgttaagaaagtaatacttacatttcctacaaatttacttaaggcttcttttcttcagatcgcaaaagatgccaaagaatgtgttcaggaatgtgtgagtgaatttataagcttcatcacgtcggaagcaagcgaaaggtgtcatcaggagaagcggaagacaatcaatggggaggatattctgtttgccatgtccactctaggctttgacagctacgtggagcctctgaaactgtaccttcagaagttcagagaggtaggtgacacttacggtttacaatatgtcacttacaatgctttgcggcaggtaacatttccggtagtagttaatgtgttaaatgagagcatttaaataccgagcctttattgcttccttagattattacagactggagcagctgggtggtgattaaagggattctgagtttggggcctgaactccttgcccatgggcagttttaaagagtttccacttcggtgtctcccatgttaaggacacgtagagcacactgtgtgtggcttgttggaaagtctgtaagcatttgtccgtgctgctgttaacttaggagactgcttcagtgtgagacttcttagaccagaaggaggtgatgtgaccctacctgtgtgtgtgtgcgtgtgcgtgtgtgtgtgtgcgcgcgtgtatgcgtgcacttgtatacaaattacacatgactcttgtctgtctgtccacttgcaccttattttttgagacagg

SEQ ID NO: 19113 - DNA, 1191 bp, Mus musculus
caggttaaggttgactgtatggatttgagggttgcgtagttgaaagggaaaaggtatctactgtgggttccttttcttttgttcctcttgaatttatacttactacgcgtggaatatggacaggaatgctgaatagttagcaagttattgaaacatttcccaagtaaagaatgttttgagtaaggtcaactgaaaactataattgttgcatctgggccggtgagtgcagggccttgctttctgaagtgcactgaaagtctttgtctctctagatggacggcgacagctccaccacagatgcctcccagctagggatttctgcagactacatcggaggaagtcattatgtgatccagccccatgatggtaaggccacagctagagccacacccacgtcagtgccctcacgtgcctcggttcactggaatctaaatgagcctgcgctagtggagcaggcctataatcccctgctgtttggcaggctaaggcggaagggttacaagttcaggactggcttaaccaagtttgtgagaccctttatcaaaataagaagtaaaggccagatgtgttggtgcacagttttaatctcagaactcaggaggcagaggcaggcagatctctgagcgtaatgctagcctggcctacagagctagtttcagaccaggcagggcttcatagagaaaggagtggggaagagggaggaagagagatgagagaaaggagagacggatggaccagttcggaatagagcacagtgctctagactgaatgcaaggcccttggtcaatccaggtccttctgaagcaaacatgttagaagagacgctgccatctctactcactccatggagtcttcagaagactgctgagttctagaaagagctctgctatagaagtgtgctttaagaaaattcaaactgatcactgactccctgcaaaaagtaattaagaggaattcttagattaatatgctagaaataatttgcttttgtgccatttgtaaatttaaacattaatatttatttttaggagctgtgaagggatttgtgttagtagattctatattatcattatccaattgggttagtaatcaagtctatacaatttaatataaactttatatgaacaagtttatataaatgctaggagttttatactttagaaactttacatatacatgcttatatacact

SEQ ID NO: 19114 - DNA, 2398 bp, Mus musculus
cgcacatataggaagcagctcattttaatgcattcctccttttatcctctggagaactagaggactctggtggaatacttgagttctgtttattttacgtatcacctaagtcactgtaatgtatgtggcgctgtctgtgaacttgtttgctctggagtttgaaatgctctccttcctctttcctgcagatattcacaacgttgtcagtgacgaagcgctctgggggagacatcctccagtctggctgctgaggttaagccccagtgtggatgctgttgccaagactacagaccattgccttgcttccttgcccacgcccaggtgaagttcaggaaggctcttgggtcctaggcgccaattcaaggtgctgtcctaaggccaccgggtccctgggatcttgtgggtaggaggtggcaggtcgaaggaggctgcagcatcgcactggggtcaccatgacagactcagactgacatctggcagagcatcacaggcatgcgtccatgaagtcactggcctcaagcccaagtggtgggcagtgacagaagagctgccgggtctgttgagctcaaccttttcctgtagattgtcttagtctcactttcaagctgtctaatgtcaattctgtttttcttttttcctccatggggttaatgatactagagatagggaatattagcaatcagtttttgtcatggctggtccatctgcaacagtctttactgtgtggaagtgggtgagatggcttatgagagccaaaccaatttatccccagaaagacgaattaccctgtgactaaaatacactgtctgcttttactaactggtgtagcattgtctcctttaataagtcttgtgtccaaaacgagaaaaaccattggccacttttgcaagtttcctgcagtgtgcttagcaagggaggtggcgacttggctaatctacttgaactgcatcgcatggctcttgggtagcttagagcatcgcagggtagaggcagaccagcagtgagtgtctctcctggtacaattattgtctggttctcagtggaaaacgcttaatttgctttaaacttggtgtttttgtgaggtggatttagtcttaagctgtgtcccataagaactacattcacaggcaagtggctcttcctccacacagcctatacatcttctgaggtaattactttcataaggaagctgttcataacgtaagttattattattattgaacacaggtggatgtgaaggatttttcattgaaaaaccaaatggtttttctttttttctgttcagtgagcccacaggaactctgtcaggacagccagtactctgccggcatggctgctggggcgtttacggtgtagtttagctcctaggttacatgaccgtgaacatgctggctgaggactacacaaaccaggtttcccaccatacacggcctggccctgcagcttcttttcttgccctcccctttgcctgtccccacctgcagtactgagtggcgtttcacagtacccttctgggccacctcagggaagggatttgcctggtgtccagccagcagcacccaccctgccccacgaggctccctcacacctgcccccccgtccttgtgttgaagacagtgggaagaggagaaaggaccagggaaaccaagggagttgactgttcagttttatttatttattttttaagtttttttttcctttcaagtctgccagtctctgagatcagaacaacagacagtgtagggtaactaatcatgtgattctcttagtggaatgaaatgttctacccccacaagaaggagtatacgtcattgttcatattctgtaatcgcacaatgtattgtaatgcaaattccaattccatgtatttttattacaatttttctggaaaaaaatgtgaaccaataaaagatgttgatgcacacgcgtgccttctgactgagtggtgctctgggcttctttgacaccgcacagggctgagtcaggctttgtattgaaggctgaagtcttgtcgtctcatacctctggcgccatgcgattgcccgggcagcatcagctgagggtatccgtacaggctggcggttcttcagttctgactggtccttcaaccctggtcttccgggaagcaaagccatccacaccgtgaagtcaccttctgggtgtcccagcaacgtgtgcatggagagctggtgcgtctcgctccaggtggccgtgagggtgtgcggtcttcctgtccacccacctaatatttccccagaccctggaaatgtaatctctgtgatttcagccgcgcctaccacagtgttgacgtcacagactctttgcttgcgtgtacgagccgagccgcagtagcaccagtcattaagcagaagccccaccctgtcttcccaaaatgcat

SEQ ID NO: 19115 - DNA, 1140 bp, Mus musculus
agcttcggtggcagcgggcggcgtggctcccccagagggggcaatgtctaacggggtttatgtcctaccgagcgcggccaacggagaagtgaagcccgtagtgtccagcacacctctagtggacttcttgatgcagttggaggattacacacctacgatcccagatgcagtgactggttactacctgaaccgcgctggctttgaagcttcagacccacgcataattcggctcatctcactagctgcccagaaattcatctcagatattgccaatgatgccctacagcgctgcaaaatgaagggcacagcctctggcagctcccggagcaagagcaaggatcgcaagtacaccctaaccatggaggacttgacccctgccctcagcgagtatggcatcaatgtgaagaaaccgcactacttcacctgagccacgcaacccagatgtatttgtctttccctctgtccccacatgagcctgttttcataataaactttattgtgacaaaaaaaaagtatgtgaaacttaaaggaattgacggaagggcaccaccacccacagaagcgagaaagagctatcaatctgtcaatcctgtctgtgtccgggccgggtgaggtttcctgtgttgagtcaaattaagccacaggctccactcctggtggtgcccttccatcaattcctttaagtttcagttttgcaaccatactctccccggaacccaaagactttggtttcccggaagctgcccggcgggtcatgggaataacgccgccgcatcaccagtcggcttcgtttatggtcggcggtatctgatcgtctttgaacctccgactttcgttcttgtttaatgaaaacattcttggcaaatgctttcgtattttcacaataaattccctcaatatagagagacattgcataagttctgtgactctagagaaccctgactaataaatacatggtccaaatggccactttatagggatgtctgagttggctgtaggcattgactggctttgtgaagtggaagggaggaggttccagagactattcttttgcagtgcagacagacacacagacacacagatacacagacacactaggctaacttccaccaagcagggagctggatagggatttctagg

SEQ ID NO: 19116 - DNA, 1107 bp, Mus musculus
cattaatcccaccattctggaggcagaggcagggaggccagcatggtctacagagtgagtccagacagctagggctacacagagaaaccctgtcaagttctccaccttacacagccacactaattagctgtggaacatcagctttttgcagatgctgtttagactggagggatggaggggctgatggagacagggaccctaagctgttttcatctttgagatggctatcacattagatccccttggcagcagtagcctgagggctaagtttgatggggtcatgcacacaagaagttgtgactcagtccagacatgtgggttgtcatggatacacacctgtgtggttaccagctcaagggtgagggtgggatgggaggggtggggaacaagtggtcccacacagtcccacatacaatcccatgtttgatagcattatatatcacacgcatacagaggacagagtagaagtggggtgagggactggaagtgcagccgggccgtgctcactgaagactctctctgtgttgagggggctcccggagctgagacaggatgactgagtggggtttggaaagagcatagcagagggaccaaagtgggttttctttgggcactacagatgcttgccaacacttctgagatgtttaattcactagactgcccttcacaattaggaggcaaaggcagtcttaagtaagttggggggggggtctggcaatatcagtatttcttttagaccttcccacatggagctctataggaaattttagaagaaaattgcccctcagacagaggtttccaacctttcctgggtctgaatgtcttccccagaccgcgggaggtaggtagccagttggcagtgggtttcctgatctgctatggggggggggtcactgatccctgatcttattttgagacaaagactgagtgctccaaagtgcctgacagcaaagcattgacctggaggagaagtggctgccacccccgtggacattcatatctggttaaggagtgtgtgggagctgcagtaggttccctctttacccctagccccaatcttggggcgtgtatttgctgagctggtgaacctgcagtgcactggtatgc

SEQ ID NO: 19117 - DNA, 1207 bp, Mus musculus
accctagcaaatttgcgtatttctacagttcaaatttgaaagccacacatttggatcaggccacttaactagctaagtagttcattgcccaacacaagaaatgacagaaacccttttgatcatgtatatctagtgcagtgtcttcatagtagaagcctataagccacaatattctccaagcgcaaggatggaggactgctgtgattgattagtgatgtctgccttgactaaggaaagggaggaacatttctcaagggcctcctactgtgatctccagtccacatcttgtcctgcctgccacttaaaacagtgcactgcatacatttggagactggcggagttcaagtgtgaaggtcaaaggtggagtgttggtacccacaggcacatgcccaccctccatgtcctgcattggcagagcatccaggacctccctctcctccagaaggttggaaatttgctctttcctgttccttgctgatcaatgcccaaacctattcctcatttctagttgtttctgatactttgcggttgacatttgagccacattcccatgacagccagtgtccgggtacgtagcagatgctgtacatagttctgatgataagggagctggtaggctgtaaattttgctttttgtgtttttgtggggttttgtttgttttgatgcagtatagagtgaagggggtaagaatattctgaaaaacataaaattgagtaatttattcacagaaactattaaaatggtattgttaggctcacaaggaggctgggggcagcggtaactgctacactgtctcgcagaggaaattattttatttaatgtgagagaaatgtgagccagagtggctgcctgaggctatttataaaacgcaggtaccttccccaatttctctcccctcgcctttaataaatagatttatgtcatgtgtgtgaccaagaacagtgacagatcttggctgtccctggaatagagaggcagtcatggtgctcaggccctgggcgtggtgtagctgatgcatgtcccaccgagcccaggctctccaaggcatcagtttgtggtcacatatccttagaaaacaaaattaagtcaggttcctgtctgcaggagttttcagagccttgaatacatagtctgccttgtgaaactgggagaatgtagcatttctgggctgcatgacctaggtatcctgtatggcagaccatgtct

SEQ ID NO: 19118 - DNA, 1170 bp, Mus musculus
agctggtttttcacacagtagccttcagtgagggtgatctagcctgtctgaggtctgcaaagattgacagctgcttcctagatccttccacaaatcagcagaaacagtgtccatctgggaactttatgagagtgttgctttacctagttggggtgtcttcatctggatactgccccagagagtgatcccgtccctccaagcacagcggagggaagcctagggtgttatggagtggggcaggtggcttaaggacaccttaaaggccacttggtggggataatggcctcgtggggatactcctcacttccacccacagtttggaactgttcactgtgtgcttcaggagttttaaatggagattcgtgttgatttccatggtccgcatctgtttgtcttccgtctgtggtccagtgctgtgtgcagatggtacttactccctttctctctcttacagggagaaagactgtccttctggggagagtgtatcaatacgcttccagaatgagggagtctttctcctgtcttgtgttcacacttcctagtgacaattttcaaaatatgtatcggcttgactgtttattgtagagtgtagaaaggtttctgtgttcctggctaaagacatccattggtgaaatgtgcttggaaatccaagtgttttctactgaggaaaaaaaaatgttggaaaagctttctcctgcatgcctcttgtgcttagctagaaaggggagctgccagcgtcccagctctgagccactgttcaaaggtgcagctgtgttttaggactaggtacaggcagagtgataaggacatgcctgcttagtgtactcatttatcgagaaagtttagactatgagccacaggggtccctgcctgcagtccctatagcctccccctgccccagtgcctttctcagctggtctgggaatcagggcagcccattgaggggggctcagacaaccctttcttcctggttctgggagtaaggctttctctgcagccacaaggagaacatgggaaccagaaacttctctttggtcagcccttctgagcacacaggtttagcccatgctccaagaatgctcctgagcattgtataagcccctaggactcttagctcatgtgataatgattgcattactatcctgctttaactgacaaaaccacagagaa

SEQ ID NO: 19119 - DNA, 1184 bp, Mus musculus
acctaaggactgcggtgggcctcctggtcaggtgggagcacggctcgttcaggacagaaataagacctggctcttggctggctggaagtactgagtggacatttgacctgtaaaagtgagcaggtattattgtatttactgtttatcagcaagcctacagaattatggaattcatgacacttccatacatatgaatgcacatgactttctatgggacatctttgaaattaatatagagaataaaaatgaaaaccttaacatggagcaaggattgtccctttgcaaagggacagctttgtttctcttttaaactttgtcatgtctgctttgccctttctcgatctcattctctcttcttcatttttaactttgacctcttggcatcttctctgtacctgaccattctggaatcttctcttttacctctcattttaagtatacaaagagtcaagtacaggttttaagttggttttagaagtgggtttgctttgaaaaacaattgaaccctataagagttgggagtgtgtgaaaaagggtaaaatagaaaagcctaggctggtatgggttctgagtgacagtggctcctgacctgagccctggtgaatgaatggctggctcttaggttctacactgagatggctgttcagggctctatgagctggagaaatggtgaagaaatgtgattcatattaatattattatggcatcttgtcagcttatagaagcaccttatgagaactattgattctactttcagtctctttttgggcaatttcactgtgtatacaatgcagaacattttatttatttatttatttatttatttatttatttgaggcattatgtgaactggagcccaggttggtctcaaatttatggtagtcatgcttgagtgctgggattacaggtgtgagccatcatacctggctacgtgttagtttaaagaaatataggtggctacgggaagcagaggcaggcaggtggatctctcttcaagttccaggccagccagggctatgtagtgagaccgtggctcaagaaacacagacaaacaaccacaaaaatagaagtctaaatgaagaagatagaagtatggaatcagtagggttctgccggaagtttccatcctgctgaagtgaaaagcttgtcctgacattcatcaaagaaagctaaacagtccagtt

SEQ ID NO: 19120 - DNA, 3095 bp, Mus musculus
tttgttatgtatgaactgggtactagagacaagcccaggatgacagccccctgccatttaaggtgtgacggtgcctatattcagttcaggaaaacccaagctgccttttaaagatttgtaagggatagcagttgacatccttttagagcagattgatctttgctccttctgtgaagagagtttagaaacaactatgtgctatgtcactgtcttgtgtgtgagtgtgaagtcatgtaaaattgtcatttcaaattataatgctactgacagcccgaggaatgcctccagttctagtaagcttacagtgtggatgacctgtagctgtttcactgactaaccagtcttagatgatgttatcagggttagcaagtgccagcagcgggaagacgagcggtctgttcaggaggctacttgagtagaggaaccatgtccctgtgacttggaggagatggtaacacccctgtcgtttatcctggtggtttgccgtaccatgtgatacttcatctttgccacctctgagccagggtctctgattggtcctggaagctactgttccacagtcatgctgggttagggcatcaagcctggactacagttttcccaccctctagcacttctcaccctctgtaccttcctccatagtccctgagcccctagaaagaaaaaggtatcctggtcattttcctcctgagaacagagcagagtaaaatgttcaaggcacgcataactacctgactgaagagagtctgccgtgtataggtcagatcatcatgggttacaatccttgctgcccagtggaagaggttcccctcggtgactagttgatagcctcagtatgactgatccccatattcagaggataattgtcttttttatttctgtgaagagacgcttcatgaccaaggcaaatagtaagtgtttaactgcgggcttcctttcagtttgagagtctatgacattctgggggaaatgtggggatgggcagggcaccaggcagagcagagcagtgtataagactgggcctagctgggcttttgaaacctcagaagtctgtccatctctcctccctcccccgtccagtgacataccttttccaacaaggctcctaattcttcctaaactgtccgccaactaggaaccaaacattaaaatctgtaaggaccattctcatttaaacaatcacagtgattgattgggtacgtacgtgtttggacataggattgtctttagctcgaggttggagggggctagacagacagttgggagatggttaactgtgggcagattgaagcaccacagaacctgctgttcctgtgggacacacaggtagtggaggacttgggagcctcagccaagtgaggctgtaagagttggcttcccctcggggcctgaacaacagcctctgacactgaatgctaactgctcgggattggggtagtgctttcttgtgtaagcccaggttggtattctggtctcctgaagtcagcatttggcgtccttagcagtaggggtgaccatttagctctagtacacacacaagtatagtgacagtagtcacttctgggatctatctccctggccaacaactcacaggaaactagaccaccaccctgggattggagtttttacttaattaacaaccctgcagttgctggaagcactctatgcacgtgtaatgaacagctgccgtttaaatatatgtgccatttctgtagtctggatttttttttcctttttttggtggcatgttacagtcttggcaaaaagttctcttcacacattcctttttgtatatactgattttactgttggtgaagcacatctgaccaagccagttcagtcagtcagcagggtctccagggagtgaggattgaggagaaaacgttagacagcatgatcacctgactccaccctgtcctgagactgaagcagcttcatttctctccagcctgctttatatcctcctaggtgcatccaaaaaacgtggtcagctcttagagcaaagacaaagtaagcaagccaagtagtgaacaagaagatcacttagggtagtaagtaacgtagtaggcaaggagatggccgaaggtggtggtaaagtcccatggtcactgtttctaatattcttatctgagcatactttcttgttggagcccagggagaaatgccaaattctagaagcagcaccaaaagccctcaatacacatcctgctagattccacctgctttggggtttctctctgtggctaacaattgctccagtattattttgtacattgggcttacctttcttcatgacagggatatgaaacccattggaactgtctgttaagtggttttatgtcttgtcccccagccctaggacccgttacttctaaggtaaacattgggacactaagcacacagttgcttaagctgtcccactccctaacccaccccctccccaaaatctactttttgagggagagcgtcatattgaaggaagttgtaggagttgaagggggtgtcggggtgccaatgatcaagatggattgtttacatgcatgaaattgtcaaaaatgaataaattctatttaaaccgtgtttaaagtatttggtggcacattcttgtagtgctagtactggggaaggctgagacaggaggactgcagatttgaagccagcctggattgccttgcagagcaagaccttgtgtgaaaacaaaaaacagcctcttgagccagctctgtgtcctggtctcaggcctccccagcgggctatacaagaacgggcagctggagctgtgtggggtctgaggcagcacagcacccgatgcctgcccctgcaagtctgccaaggctccctgtgaaggtgtcaggtgctgtctgcctgcaaaactacagggctggccttcccttttcacctcgttaaaatgttacaacccttgtgccctatttgagtaaacatgtcctccatgtgcccctgatcacttcatgtagcctggcgcctttgctctttccttttgtcacctgtctgtcctcattatgagttactactttctcttaatctcctttctagatgttaagactttacacctgttggcatacatgtggcacatt

SEQ ID NO: 19121 - DNA, 1149 bp, Mus musculus
aatcaagataacataaatcctttgaaaggccacataaatcgtaatttcccattatggggtcacaatggaaataggcttgtatcccaattaacttgtacgatgttggaggcattgtttgaagtgaccctcacaaactcaagggggagttggagaataagactggctgatgacgttctcacaggatggggagtcccatagtaggcagcctggagatctgaggggaagcaaggcagaggtgggtgtgatatccttgggagtgtactgggcatgaagtcgagcagtcctctgagggggagtgaggatgattgtaggaaagccagaaaagaaggctcaagattagaaatcggagggctgtccagcaaatactgtggcagcctcgacttttcatcctcataggctttgtatatttacagtgagtgggaaacaaagtcagaagccagctggcacaatggctgacatatattagatagctgttcccatccagaggcctccctgttacttctccaagattaacagaacatttagcccctcgccttgagcttcaagagtatcccctcttactgttccatgcgtcagcaggcctggaactctgccagttgactctgcctgacaggctttcacagaagcaggcaaaactgcctgacacgtgggtcctttggggactctggtgaggggtgaagctctatccccagcatagagtgctgtgtggagttactatggaagtccccagtagtcatactgtatatctgcatgccaggggcccatgggggtaccttggtcggtagtaaagcaaagaatgtcatccattgaccatgtgccctctaatcatgtggcattgaccagattcatgaagggcagccccaggcttgtgttggaggagaacaaaacagggtagtctggagagttaacagccactgggaatagaatatgggggtagtgggacaggcacccataatcctcagctagctgaaactgggcaattaagcaaaaggcaagctatgtacattacctttcctgggctttctcttcctctttcccaagtccggtaactctgtggcaggtccaatgtcctttgaaggtacccacatcggcaaagtttgaactctgggggaaaaacatgcatatcctcacccctttgtcagtagtggt

SEQ ID NO: 19122 - DNA, 1175 bp, Mus musculus
tccttcgtttctttctttcctcctccatattttactgacttgtcctgcaatcctcctaatttctgtaacttccttttcccttggtcagattgatgaagacccaccattagagcctggcaatagactttcaggtgctccctactttccgtgaacccagcttccatgtcaataggcagctgagagggcctcccatccgcgcctgggacattattcctagcctctaagagaatcctgtgcctttcctctggtgaaaagaacctgcaacaattattggcaatcgtcccacgtgggctgctgttttaatgggtgtggtgcaccttaggatccaacccgcatgccagtggtctctggtgaataccactccacctgcagacacagacagaggatctgcacctcattgagcagtgcggcagggccttgcggccggctagcattggcagcacatggcacagcctagaggtgagcatgagggggatgggaacaggggtggggccacccaaggaggcatgggagcctgctgcctggggcacactgggcgacgtgccagaactccctcagctccgggtccacaggcgggacatggatgccaccttggtgatccaaggacggcagaagcgcctgaacaccaccagctgctctctggagttggagagtacggggcagggcagccatggagaatctgaaaggaggaggtcagcatcagggtctgacaggattttcaggctttttccagagggcatatataaccacaaaccggtagggaacctgtggatgggagaaaagggcgggcccagagggatgggtagtatctgtctcatgattctcaaaaacagtcatcggtcctagtcggaacacagagacacacaagacacacacagaaactgtcctccaggcgactgccacagaataaaaactaaaaactgaatcagatggctggggacaattacttcccctgcctagatggagttagaccctccaacggtctttctcccagcaggagaatagagcgttctctgaacctcctgttgctgcagtgttcagcacatctgcccactgctctggcaactatcagacaaactgaaagcaaaatagagtcagaaacagacaggaatcccactttaccttgctcgagcagtcctctgatgcacggcatctgggtcctgaggattttcctg

SEQ ID NO: 19123 - DNA, 1180 bp, Mus musculus
gaagcaaagttcaattttgcttgcgtatttgagaaatcattgcttgaaagtccctataataaaacaatactgaaagaaaggacacagatccattcgccgaataatgcagagacaagtttggaacattcgtgctatatgatgccaaggctctagaggagacttaagtttcagtgaaactttttgcctcgggactctgtccaagcttttgggcctgccacacagtttttactggagtgggtgtggcagggaaccccactaactgaaaggtgaatctagtacactggctcttccccatcccactcccctgccgaggagtgcagtgcacagggtctcccctggaaaaacagaacaagcgacagaagggtatcatctctctcaacagctgaaattggctctgttttacaagatcacgatgaccatcagacaaattaataggtgtggaaaggtcttttcccttaagcaaatcaaaaaagggcattaattcttccatttatggagatccagggcctcatccattaatctctcccaacaacttttggaactgagggagagtataagtatcttgaaccttaagttggggtttaaccagggagacggtatctaaagacagtatagagccaaggattcgaaagaggggagtctttgaaccttttccggggcgactgagaagttattctcttgtaagatggagaggcatctatccatgcattttcataacccagatacattgggatgtcccagattaatatctatgtaaatgtaaaagaggatatctgggtctatcaacatggaggaaacaatggaaagctataatattgacaaatgggagagtattatgagccatgccctgaggaagaagagtccattcatgtctcaagtctggacctccgaaattgcactgaaaaggcaaatctcacaatcatctgggtgcatggggatggggaagaaactatctttaatatctattatggtcagatgataggtattagaaatggcaggaatccaagggagtcctctttagaggtcatgaattaaaccattttttcattacttattcttatgtcttataaacaatctccataaaccattacccttatttatcctgaagctaatcaagagcttttaagtatcacaaaattttttgttgctgtataagaatatggagttgatataatttttt

SEQ ID NO: 19124 - DNA, 1171 bp, Mus musculus
attgtcaaacacattagtcacaaaccatttattagctttatttactctgaaactaagaggctgtgcactcgcccttatttcctaaaatgaacagtttttctagcaggggccctcctgccacgtgtctgatttctggctgaaacacgtggcagctctcggctttgcagaaaaagtttttttataccatctttattatccaacacaaaacatagaacattcattcatatagactggacacgaacatacatgaattgaacacgagaacagattggtgcaccggacattagacaagacaaaaaagggaacagagtactcctgctataaggcccagagagaaatttctctctgctttttgggacattttcctcccttatgatgcgttttttattaaatggggcaatccgcctgttccttttaataaaccctttcttttctcaagcctcatgtagcttcggagaaccacggcctaccgactgttacccagctcctcactgctgaacctaagtgaaccagcactcaggtttaacgctgtctcagcttagcccataccttctccggtatgaatttcctttatcctttattttatggagctccgaaccagcagtgtctctttcaaaaatcctttgccgtttctcagtcccacgttggttcgccaattgttgtgtccggccagcagaccacaacctgggttctagcctggaaaggcattttggaaacctggaagagaagaggggctaggtggcgagagaaagaaatgtagccaagacagttattctgatcaaagctcaaattttattgttgagacactagttaagaaggaagggggaggggacttgattcccgccaaataatctcaggtccagtagaaaggtgagcacgtgtgtggctccaaacagcaaagcagcaggttccagcagtgggcgtggcagaacgaatgagcaggaagctccacccctgagcaagcaggtttcaagctgggggaggggagactacagagtgagcgacaggttttcagcgcttcacctctgcctctgctgcccgcctcttgcttctgcctctgctgcccgctgcctgctctggcagcacttttgctggcagatctcttgtgtgcggggcagggcctgggttgcagtcagtcacttggcatgagctgcactctcccttgggactg

SEQ ID NO: 19125 - DNA, 1106 bp, Mus musculus
gccccgtggttatgggagagagggcacagggagagagggcacagggagagaggttcccacataggcaagagtcctgagtctggtccctggctggagcataggaaggccttccattgggagattagaaacggctcattaggagaaagcctatctagtcgtccaagcacagaccttgatgaacagagacaatctggttttagaactttattgtagaaaggcagagggaaagagaagagaaaagagaagagagagcgtgtgcacgagtgagtgagcaagcagacattaccaagaggagagaagggggaaaaggagagagaagaaaggttagaataagaggttagagtgagtgaggagaaagaataagagaggagagtgaggggtgtagcagcccctcttgcagtgggcttatattattttgttgttgctaggtaactgggagtagtctagcctgaaggtcagaagcttggaacatgtgtatgtgactaaaagccatgtctctcctttgggggctgtaggggtggtaacttcaactggagccagggttccaggagacatgagactgttccatgtaggtgaattattaccaccgggtcccaggattccacacctcagctcgactggagaccagcctgtctgtgaatagcccattgtcccacaaccctcctggccatagctgaaggaagtcttccctcaacagtggcataatgggcggggatgtttataaggacctccatgtcctcctcttgtgcctctctaagggacgaggccatagctctagtttgaaaggaagagaggtacccacatctcaggtggccaccattcaacttttcatggcagcgttatgcaatcgggttcatgccatcccagaccaatgttctagtaaacgggtcttgtagctccctgcggaatattttctgtataagctccttttaccctatcagtgaaagaggcaaggtctgcagtggccttttgattgatcccagaaataggggacttagtgggtcccctcatctagctttctccaggcagccaagcctagcacccatccttgtcttggtagggaggtgtcacatcgggggaccagcaggaaagatgcaacaccacct

SEQ ID NO: 19126 - DNA, 1140 bp, Mus musculus
aggttctacttgtatgtccttctggccaggctgctatccttgagggtgagcctgattaccatatcaaacttagatgttacttcatgttaatctgaataagcctggtgaagccacacgagggccctcttgccctgaggtactgagagtggaccttttaggactatgccttctcaaatggaggcagagaggcaggttttaatttttgaggatgggctattgaggccttctaagagggagaagaggtgtcaatctcttgatctgatatgggaagaaggggctttagctaatttatagccccacaatgttggatttctgcaagggaatagattacttctcatgtgatttagaatgccagttaatcctttcagcaatgaagaatccaagcaaaaggttaagggggcacttgtaggctaagttcccggaggctgctcagctatggagtggcggcggcctagggcctgtcagcatgtaagggacaagtaggacatcggaggacatgtttgtgtgacctcggccacagagagttgacaaatatatagtagggtctttttcatcccctgtggtaatatctgatacctcttcgtaggtttacttatgttgtgttctcacactgcaaacgcaaaatgagctctgtcttgtggagccagtggaatttggaagaagcaatctttaatgaccatgtctgtgattcattatggaggtggcgtggcaccagggtggaccagacatgcaagagtcgtccttgtgttctccatttgttcatcagcagcctccagctcctaaggtaatctgtatttgccaggctttttctttatcacgaagatgggggtattaatgtctgctggttgatggttcaagatgacagagttatagctgttccttggctaattccttaagagcaataagtttaggtttaatgatgggtttaatgatccacccagttgacagcttcgatcagccaagtcaatgatactgggtcagggatcttagcgtgtactagtttgtagtggacagtggcccttagaatttggggtgacaatcaattttatgtccaataaggtctggacattcatgttctgtgatgttatagaaggtttggtcatgtactagttgtgagaacagtacccgtgtcctacaaaa

SEQ ID NO: 19127 - DNA, 1167 bp, Mus musculus
atcaaagtatcaaggggtctgaattaaggcggttgtacctgtgccaaccccagccggcacccctagacccaggaagatcgccaaagtcatggtaatgggctctcgcttatggtggactcgatggtcgaattcatcgacaaaagagctgtcatcatggtacaggagcctagggacaagctgaactagaatacagtaatctttagaagtattaaaaacagaagtagatacacagggagtgagaccagtgttgcaagcccacactgtgtctaaggggggcactaggtactgaccactgtcggaaaactggataggttgggtctggttacagaggtgccgtctgccatgtggcacttgacccaagcaaagtccactccctgaaacagctgccagagtcagttttctgtttttcccccaagtgcattgagaatggtctgtagttttattataggtcctgacttgggcgattccctcataatagggggcactagaggcatagcacagtcagcaagactgagtaatgttgggattagtatggttgaggaccaggaatgccccctgtaccaggctgaacaggcgattctcggtttctgggggcgacggagtggttggggctagatctagggaaggagtgtaagcatcagtaggaccacctaaagtaggcccggggagggtaggtcttggagggggtctctgaggccttttaactaagacggggttaggccccactgactgggctggaggactttcttatcttcagccgaaccttaaaagtgaatccagagtccgtccctgtcacataaaatcttaggccccactgcctcctctttatccaatcttctttgcctcttttcctttccgagtaaaagtgatgtttaaagaatcatggcccttacttcctctggacactacaataagatcccagctagaggaagggtgccaataagtgttaccagtggtttcacatccccactgactacagaagaagccctctgctcccccgcaccggcgagcctcttttttactttttctatctctgggacaggcataaaagggctcctgacggcgcctcctttgtttagactcactactacagcctggtatatctgcaatgtactgcccctgggaacttaccccctggttatatgaccgcttctggtagattacctc

SEQ ID NO: 19128 - DNA, 1543 bp, Mus musculus
gggagcagggtggcagggttgaggttagcaggcggagcaaaagttatctggtcatttaacaacgagctctggtactgtgtcatccaggcgtttgtcatccagctgtcggggggctgccacacaactttccaaagcatggggagcaattacagtcacattttgacccatagtaagcttgtcagcgtctttgacaagtagggctactgcagcaatggctttcaggcaagagggccaaccactggcgaccgggtctagctttttggacaggttggccaccggctgcttccagggccccagagtctgagtcaggactctgcgggctactgtagcccgctcatcaacgtatagggtgaaaggcttagccaaatctggcaaggccaaagcagggcctgcaagcagtgcagcctttatgccgtcaaaggctttttggtgttcctctgtccaggtgaacgggacattttctttagtgagtgggtacagagaggccacccgcgttgtgaaccccggtatctagagtctgcaaaaatccgctgtcccccaaaactcacgtacttgttgcggagtggtgggggtcgggatctgcatcacagtcttctttcgagcttcagtgagccaccgctttccttttcggagggtgtatcctaggtaggtcacctcggtgcggcatagctgagctttcttagcagatacccggtaccccaactcacccagttcattcaagattttcttggtcccgtcgaagcacagttcttgagttgaggctgcaagtagtaagtcatctacatactgcaagagagaaatctgagggttctgtgccctgaagggcgcaaggtcatggtggagcgcttcatcaaaaagggtaggggaatttttgaacccttgtggcatccgtgtccaggtcagctggcctgtatgccctccctctgggtctccactcaaagtcgaatagtggctggctgttggggtgcaatcggaggcagaaaaaggcatcttttaaatctagggcagtgtaccaagtccgctctggtgggagagaacttaataggttgtaaggattgagaacattagggtgaatgttttgtacccttttattaacttctctcaagtcttgcacgggtcgatagtcattagtcccgggcttgtgcacaggcaggagaggggtattccaaggtcttacgcgggttcgcgaccggccaggaaagacgcaacaagccagaatcttctgcgtcaaagctttattgcttactcaggagcaagagaggaagagagagagagagagagacgcagagagagaggcagagagcagaggaagagagagagaggcagagagcagaggaagagagcagaggaaaagacgaagagaaagagacgaagagagggagtgccagaaccccatcccttttaaggagaattatcctccgcctaggacgtgtcactccctgattggctgcagcccatcggcccagttgtcatcacgagaaaggcagagcacatggcgggaaaactgcccttgcacatgtgcagattatttactacttagaac

SEQ ID NO: 19129 - DNA, 1888 bp, Mus musculus
aatttgcttcttggtcatgatgttttgtataggaatagaaaccctgacttagacaccgtatattaaaccattcctgcatccctgggatgaagcctatttggtcaggatggatgattgttttgatgtattctttggttcattttgcgaggattttattgagtatttttgcatcaatattcataagggaaattggcctaaagttctatttctttgttggatctttgtgtggtttaggtatcagagtaattgtggcttcatagaattaattgggtagagtaccttctgtttctattttgtggaatagattaaggagggttggaattaggtcttctttgaaggtctaatagaactctgcgctagacccatctggtcctgggctgtttttggttgggagactattaatgactgcttctatttctttaggggaaatgggactgtttcgattgttaatctgatcctgatttaactttgttacctggtatctgtctaggaagttttccatttcatccaggttttccagttttgttgagcatagccttttgcagtaggatctgatgatgttttggatttcctcaggttctgttgttaatctccttttttatttctaattttgtcaattaggatactgttcctgtgtccccttgttagtctggctaagggttgatctatcttcttgattttttttttttcttcaaagaaccagctcctggtttggttgattctttgaatagttcttcgtgtttccacttggttgatttcagccctaagtttatttcctgccgtctacgactcttaagcaaatttgcttcctttcatcctagagcttctaggtgtgctgtcaggctcatagtgtttgctctctagtttcattttggtggcactcaaagctatgagttttcctcttaggactgctttcattgtatcccgtaagtttgggtatggtgtagcttcattttcattaaactctaaaaagtctttaatttctttctttatttcttccttgaccaaggtatccttgaggagagtgttgttcagtttccacgtgaatgttggctttctattatttatgctgttattgaagatcagccttattccatggtgatctggtaggatgaatgggataatttttaatattttttttatctgttgatacctgttttgtgaccgattatatggtcagtttttgagaaggtaccatgaggtgctgagaagaaggtatatccttttattttaggataaaatgttctgtagatatctgataaatccgtttgtgtcataacttctgttagtgtccatgtgtctctgttgagtttctgtttccaggatctgtctattggtgagagtggggtgttgaagtctcccactaccattgtgtgagttgcaatgtgtgctttgagatttacttaagtttctttaatgactgtgtttgaccttccatttggagcatagatattcagaattacctttgatgtgtatgaagtgcccctccttgtcttttttgataactttgggtttgaagtaatttcattcgatattagaatggctactccagtttgtttcttcagaccatttgcttggaaaattattttccagactttcactctgaagtattgtctgtctttttccctgaggtgggtttcctgtaagcagcaaaatgttgggtcctgtttgtgtagccagtctattagtctgtctttttattggggaattgagtccattgattgtgggaagccattccgaactccctggccagcccaggccatactctaagatggcgcctgacagaaatctgtgtcaattaactgggttcccatctgtggagtcaatataactctggtggttgagcagaggtccaattctgctgaaccctcagttgctctcctcggct

SEQ ID NO: 19130 - DNA, 1178 bp, Mus musculus
taaaattcatggctgacaacacatctcttctccataaatttacaggtaaagggagcacataaggttgaaaaacctgtcctaccttctttatccttccattgtaaggattttgcacttatagttggagtagcctcatatcctaatccttgtaggctatgtgatgattgattaacaggccaagaagcaggccaccagttactggatacaatgcttttatctgctcctatatccattataccttgaaaggtttttccttctacttgttattgtaaagtgggacgattatccaaatctaaagatatgtaggccacattagttcctgtagaaccaaatcccttatcccttctgggattctggttactagagaacatgttatgcaaactaggaagaagatcaaatgatcttctcggatgagttggcattaactgtggctgggggagcattgacctgattcctcctgtgggtgctgtcacgacccacaatcatggctcttggtatattttggggaggggagacagagcctcagaaagattcttttggtcgtaactggaactagataccaacctccatccgaaccgggtgtgtgtctcagagaactcagaaatggtcaagttggaccttcccctgcagtgcttagcctcgtacccacgctggtgcccatactgaattcgtattatcacgaaccagcatgcacagttctgagtcctgtgcagttcctaaaggtgaattgtcaacctcagattcagcaaggcctcttcaagaattatgccacttgtaacaccacaatttgtggctcttaggctatattaggacctggaggtcaccctcctcatccctaatatctccacagcctgaggaaccaaggggaccttgcatttgcagcaagggtggaaaactggagaccagctaagggactaagcccgtcttatcagaataaaaacaacattcttctaatatctgaaattaccacctttctagccctcatctaaaccttaatcccaaatcagaccaaaagccacagtatgtattggaatgcttttagaatgaaaattagtagctgccacctgcaggctcttgggggcgggcaagcacgcctgctgcagtcaggctgaagggcgtttattgacctacttgaaaaacaaaatccagacagtgaaaggtaacagtacaaaagcttc

SEQ ID NO: 19131 - DNA, 1144 bp, Mus musculus
ctgacaaaggatcatgtactgaaaaccaagaactaaacccacatcttggactatcacctgaaagcaagcatacccacaatttatcattgtcccaatgttcttgtggacatcctttcagaggcatagtttcttttgatcttacaaaagtttcattataactaaaataccccaaaatcattatttaaagctcccacattaatcttctatgatgtgggggtggggagcttggggaggtgaggggagggcgcctatctggaacccatctatctggagcatcagaaagaaaagttctataactaatgggaaggcagcccatggggggggggtgttccctttaaagtaacactgattggggcagagtctgacgttccctcatacttaatgacaggggaagtcaaatgggaggaaaagtcagtgagcgcccctagcagctcagtcttattagtcctgaccctgatgacccttattagtccccagcccatgggatgaagaagaggatggggaacaaaggcccaaaaacgaggtcgcaaagacacagtatagctgttgcatggcagccacagcaagcatacatagcaagaagcgtgttctctgctgagggtggtttctcgggatcagagaccatttgttgtactctctgggtgagcttgtccccaagttggtgggtctgtccctgtggtggatgataacagtgtctgcctgactctttcccaactggaagtcctgccgtctaatcctgcctcagctgggtgaagttgacctgccagtcatctcctgactggtgtcctcagaactggtgcaaaggctgttgtgtggaaggctttcctgcacgtcagtatgggcatgcatctggcaggaataggaatccttagggtatgtgtctggagtctggcaaggtctcgtaggtctccaagaatctgtatagagcctctaggctaatatacaaggtgtggtgcatgtaagagataattgaggctcaaatgcttaatggccgcaagtgcacttataaagtcggggggggggggcattcccaccaattcatccttggagcctggaacctgcaggatagggtgtagtctctggaatagctggggggggggggttgggctctcagctggtagcagtatcttgaagaggaacagcg

SEQ ID NO: 19132 - DNA, 1113 bp, Mus musculus
caaggaagtggggagggcgttgttggaaaataccaaagataccagttaagagtcccaagtaagtgcaaagtcacaagagtcacaaggaatacctggtaattgtgcaggttatctctcaagacagtttctaagagcccctaacaatagcacatttgcatagcaggttctagcaacagtcagggtgactttctttgaatgaacactcctagaacccaggaagggggtgggtggaggaatgtcactatctgttttatgattagcataccttggtgcattgagtcacagaggtcacattcccaagcctgggcctaaaggcctagaatttttttttttttatgttatactttcagaacagcagaggcatgtaaaattttccaagactctaggttctttaaagaatagcccaagtgttccgggaaggcgtccatctcgggtaacttagctgacagtacatttccacaacctctagaggcttaccagtggaggacaagttttgctcttattaagtaatttcaagactttaaacataatgttaaccatcacaaaatgaagtgtacagatagctggaccgtgtaccctatagaaagataacataactgtaatcagttatttgtcacatcaaactctgagagaagtccttaaagtcatagtcatcttttcaaacatgtgaatttgataacagtatctggcctcctgctttgggtaaggtggctggctggagaaatactcttccagaaagagagagtgttttgtagctgggaaatacagcatttagatttggcctcagcttttaagaagataggcatgttcatctgggcctgggatcttgagtcataagagtttttaatcactgttcccacctcgtttaagttgttgatctcttcgtctgagtttgggaatttgcatgaacaaacacctggatttcttttaggttttctaacctgtaacctgacagtgtagatttttaaagcattcacttagaatattctgaaatcatgtttagtataagttttacctgtttacttgaatttgctgatttgggcataaagtccaagatttcctcctcaccctaagttccaaaaataactctgaaattcaaaatatatatttata

SEQ ID NO: 19133 - DNA, 1617 bp, Mus musculus
ttactgtgtgagttgggggaaaactacccaacttgtctgagctctggcctcctcccgtgttaaacaggagtagcagtgccttccgcggaagcctcattacaaggactctgtgcttcataattcatgtgaatattccattaaatgtgaatgttccttcccaccactactctagaagcacggccctaaattgatgagattcgtgagcagctccttagtcaaggaagctaactgatggatgaaatgaacttcctatacttctcaataatcaaggctcagattactcttccctgcccattcttcttacacagtgcataacacagcaggatgctgccaactgccgtgcagtgaaaaacgggctaggcacagtggttcatgcctgcaaccccagactcaggccagggcagggcagggtccttattgctgacctgaggtcaaccaggctatgcagaaagtgtgatgccagcctgggtcacactaagagaccttctatcaaaaccagaaaaacaaaaccaacatttaaaatatgtcagtggcaccaggaaaagggtcaccttgtccttggatgcttactttgctgtctccaggacatgttgcttctcacgactgtatctgctggctctgctgctcactggctgtgtgtggtcaggggagtcagtgacctcctgtctccaaagtctccatttgttacatggaagatgatggtaagctctgtgacttacttggtgtagtggttagaatgcgctcccagggagctgcatcgtgcctcttcaggatggccactgatcctgtgcggtgctcacaaggtttcccactgtgactcaagtttgattatcaccactgacatgcaaccagacaaaggggaattcctgagcacagaactgatgtgcagcaatccattaatttcttgtgatgactagggagatagtccccaaaataatgaagtggctgggctggaatggggtctagagagtgtcagaggcagtactcatggcataggacctaggcactcatgaccccaaggtatggtgagttaaatgttaaagtgtttatccaacaacatggaaatgtactctgccatagtacatgagtcaaagtaatgtgtggagggccacagtgatgctttgctctttcttgtgtgctcagtctctctgtgtctccctccctccttccctctctctcaactctcatacctaatcagagtattcatgacctccgagacatgctgccttgacacgcactacagtctttctgcacttctggctaggaaggctcatcactcaccccttcctaaactacaagtggacaagaatggtggtaagtccacaggttagaatttgctagaaacacattctgttttcttcagaaccacggatcaggaatcaactgatacttaagcccaagaactttactgacacaaagctgagaggaaagagtttattgacgctatatattccatcccaagtaaggccatgtgccaggcactgagggcctcacacagagcagcagatacacagcaatgtactgcaatacacaagctggttataatcaccagagctcgatacaactaaacacacaaatagaaacatgaaaactttgcatataagatatttaaaccct

SEQ ID NO: 19134 - DNA, 1190 bp, Mus musculus
ccctaaagcatgctgcataattaataatttatattttcattattataaatgtttatattaatgatactggatttgattatatcaaattagtcaccattttatagtaccaatatttctgtctttttcttaaaaatgttctttaattattcctgaacatgagagttcacatattccttggacacttaaaatgggaagtgacaggtaactgttttaactttagttaaaaataatgtcactggggctggtgagatggctcagtgggtaagagcacccgactgctcttccgaaggtccagagttcaaatcccagcaaccacatggtggctcacaaccatctgtaacaagatctgacgccctcttctggagtgtctgaagacagctacagtgtacttacatataataaataaataaatctttaaaaaaaaaaaaaataatgtcactgtagtctggataaattataataagttcatgtatttgaaataaagtctctgatgagagaaatatttaaatggtattaaactgctgagcaacagggcttcagtatgttcacacctgggttactgtatacgttggatgatggttttcttttgctaacaatattttttcagaaatattgtaatttaaatattaacatgagtgttttgttgtaaattcacagaaaacttaatgatgttcaaattctcaggaattaagaactaaccataacattgtcagttctgattaaattttgtaaaagacagcaagtttgttatctcacttgagtggggttctcctttcccttggctcaaatagaatacaatacgtataataaagcattaataaatataatttcaaaactgtccttccattggatgcttaaggtcagaattgaatgttgtcagccagtgggttttcaatgtgcttttgctggtgtgtggaactgcggattgaactagatagttgtctgctccttgaccctgtagtacttgttaatctcttaggttcccttccatacattatgtgtgatctcttttaaagaattaaatatatcaccaggtgggtggtgtatgctttaatctcagcactagggaggcaaaggtctgagagcatctctgagagttcaaggccagcctggtctacaaagtgagttccaggacagccagggctgtgacacagaaaagccctgtctcaaaaaacgaagaaacgaaaacc

SEQ ID NO: 19135 - DNA, 1195 bp, Mus musculus
cagaagcactggctcgattaatgctgtctgtaccactaaccaatgatggaaagtatgtactgttaaacgatcaagcagatgacactggcggaagtccaagtgaaaacagaggcgcagaatctgaagcataactcatttgggcatcgggggtcagagcacgtgggaaggagagccactccttaagcagttttcaacttctctgccgtacaggcacagtgacctgaatttagaacaccgacaatcacgtgcggagtgtacccttggatgccctggcacagaaacttgggagggagacaataagaaatgggtgagagcgtgcctacactctacaaatgctattttaggtgctttgtggtaagtctttgcttcagactgttgggtacccagaacgagagctataaaaatgcattgttcactttatttggatagcagcgcttcagttcctaggatccttttataaatggtaaaaccctggatttacaatttgttaaatactaaatagttcctattaatatgatctatttttgtattttacttagttttaagtgcctgtcattctgaagattatatatttataacccaatggtctcatgcctggacctcatggcactgctatgcaatttggtctcaaacagacagcaaagcctttacaacagaacctttctgaaccagctttcattcaaaagcttcaggtcctcttagatgctttctctggctactcactgtgagcaagggacagttctactagttcctgtttcttctgagccagaccttcctcaaagggaccaattaatttaaaactcacttgaagctcagctggctgtggggctgtctttgaagttctggtttctaccttgatgtttctggttcgtggggtcctggaccaatctccaacccctaattatgaagtaaaggtcttgaaatcatgcagcataaattaattgtaaccatcttcaacaacctgtctttgtaataatttagcaataaaaactgtttcatctcaaactgcttattgtggttagtttatagaccacccttagaaggaaactaaagtcttggtatgtggaccagattggccttgcagtcttgcttctgagtgctagaggtacagctgtcatcaggcctgagtatcagtgacagtgacatagctacattttcaacactcagctgaaggatgagtccaaggccagcctgg

SEQ ID NO: 19136 - DNA, 1237 bp, Mus musculus
tcttgaagctttggaagtcagaagaccatgccaagtaacccccaggccacactcctgtggcatagatcgagtccttccttccctcttggctcctggtggcttctgcttgactcggcctgtggcaagtcacagacatctgtgacttaacatggtcttccttgccctcatctgtctgtgtcttttgttataaagacactgtcgctaagctcagggtccaccaggacattcatggttctttccttgtcctggttacatttgccgagaccccgtttccacaagctctcatgttctgggttctggatggttgtgtattttgagggggatgcaattcaacacattacaaaagattacatacacattttattatatttgtgggaaaccatggttttaggaaattgcataaatcttagttgtaaaaaccgtaagtgagctggggatgtggcccagtggtacaatatctgcctagcatgtgcaaggccctgggtttaattcagcactgtttaaaataaaaaccctcagagctccagtactgctggtaccaagagacccttctgcaatactggaagtataataaactccagcttttaaagactgagcagtgtgactgccgtaggaaacgtggagaatgcaggaaagagcgtgcagcgaccaggccctgagccagggtaagtctgggttcggcatccatatagaactgtaccagttgcaggtgctcacctccccaccgtcacctgcactgtggagagctttgtgggaggcactagagaggaatagcaaactggccatcggctctgagctttttattgtcccattgaaccgagggggaaagacacagaaactgtttctctggctgtatccacaacacctgcagagcccatagggtcccacaagctaaaggcccaatcctgcaaaactgtcctgacttttaggacagttgtaagtgccaggcttctggagcttctggccgactagctaaaattggaggttaggaatttgtgggaatggcccatagctcaggcttgctgtggttaccaactatgttaagatatcacaaagtacacaatgaccagctgaacgcaatgacacattggcaaggtgtagggagggacacagagcttccgactctctagggacacaagtgccagggttcagcagtccggaagctcctcctctcttagataaaccaatctagaagcttcttcacagacatgcctagagctttatttccacaacgatt

SEQ ID NO: 19137 - DNA, 1213 bp, Mus musculus
ccacctgcagggtgggttttgggggttttgtttgttgtttgtttgttttgtttttttctgtgcagtgctttttgtcataaatattcttgccacaactcacagagatccacaggatgtccagttagagataagaaaggtagggttcagattctaggctttgggaattcaaccgagtgcacaacccactaaagttcaataatgctgagaacctaggcgatgcctcttcccccttctctctcccaccgaaatcagagctcaggttttaactaaatgtcttaggaagcatgatagaaatgtgggtaggtgattgtgtttcctccctctggctggtgaagctggaggatgtcacagaactgtccacctaaagagaaagcaacttctgagtctctttgcttttgtcgctcatcgcagataccagccgacccaccggctttcagaccatggccaacctcgagcgcaccttcattgccatcaagccagatggcgtgcagagcggcctggtgggcgagatcatcaagcgattcgagcagaaggggttccacctggtggccatgaagttccttcgggcctctgaagaacacctgaagcagcattacatcgacctgaaagaccgtcctttcttccccgggctggtgaagtacatgaactcagggcccgtggtggccatggtctgggaggggctcaatgtggtgaaaacgggctgagtgatgttgggggagaccaatccagctgattcaaaaccaggcaccatccgtggggatttctgcattcaagttggcaggaacatcattcatggcagtgattcagtggagagtgctgagaaagagatccatctatggtttaagcccgaagaactgatcgactacaagtcttgtgcccatgactgggtgtacaagtagacatgaagaaaccagagtccttttcagcactactgatgggtttctggacagagctcttcatcccttggatcatcttttctaaaacaataaagactttggaactgaaaaaaaaagagagagaaagcaacttctgattcatctgacacaaggatcagggctttatactggcacagagaaattcttcgtgcaaatcacaagcatgtgtctcctcctctgagatgctgcaatcccaggcaaggatgccgctaagtcagagaccagcgaagccctgtctgtgttctgggtctcattcacacccctcaggctagacacct

SEQ ID NO: 19138 - DNA, 2563 bp, Mus musculus
tgccagggaatcaggaccggaggcaacagcatacctgccctggctaagccctgggagttaggttaaagcaggctgttttaaagaaaaacagttaactctttcatggcacagcatgacatgtgttaatttgctcctggaccttgagtagaagacagggcttgcttagagagtgaatatgctgaactctgctaccgaaataagtctggtggtggtgactttctggttttctgggatctgcctcttctttctcctctctcttgccttgttcttctttagtgggatcttctgaaggtgagcaggaataaagatggcagtgtgagagcccagggctttgtgtgtaatggggcacagagctgctggggcctttgctcagtgaatggactgacggtgaagcatgccagcaaggggcgacttaacactttcttaaatatctcagtattaactggaaccccgcctcttggcttctcacctgcacaaggacaggatgctactctgagtctccaaagcatcactggctcagccataggccccattcaccccaagtgtggaatcttgactgtagaagagttgcttctagggagttagtatgtaggtgaaatatgtggccgagggaaagcccagtttgacagaaggttcttgtctcgccaggccttagtattctgcctcgtggttttgatctccctcattttgggggaataaacaagttccattcatccatccttccatccatccatccatccatccatccatccatccacagaataagatgttgagagagcagagtgtggggggaggaggcttagggacgtttcctcgggagccatccagatggctctggaggaggcagaaaggaggtgtatggggtgacaggatgcttaaaaatgttccagctagttatctaatctctgaacactaagattacaggtgatgtcatcccctcagaggggaccctggggacactgggggcgggggtgggggggattgaagtggtctttctgggctgaccacggaatccactggcttagtcaaattagaatccttcttctaaggtggctgccttgtgggagcctctcagacagggttgggggaggatgcatccgtcactgcactgaggacagttgtcagggagatgctgctctatacagcagaaggctgctttgcatcactgtgtttgggccccgcgctttcctttgggctgaagtgagcaggatgtagtgggaagctgcttcgattcttttccttcagtttcacctcctacctgaactgtggcaggggctaaaagggaggaaaatctataggtagagaagtggctctggcgcttggaggtgtatagacggcagcatgtaacctctgaatcctcccgctccctgcctcctctcgtgaacaaccccgcctgctgctacactgctggcccctgagcaggcagctggtctcgggtgtagcagccattgctggttgatggaatttttcccttttgccagctgattgtgtctgtttagtattccccaccatgcagttgactccattaggaaaaccacgcccttcggctttctccccttctcgatcaccagggtcaccagtgtgttctcttttggcgggactctcaaagacaaggggttggggaggggaaaccaaatgtttcacaccaagaacagaggctctcgggtgtggggtgtgtcctccgttccagggctgacactgagttgagtccaggtctgccttgatctggaggtctcaggcacctgcagtggctatgagggctgcttcccacgggtggaggctggagacgtggctgagtggtttcccaaggccctccccgcccccctcagttctgatacctgcttctagctgagatgctgactgtccctgcaggaaatgagttagatcagagaataaagccctaaaaaaagcagtttcccaatggagccctgttatccctgccagtcagtccccagccaaagaagggatgcctgactcatttccgcggagtccccagtgagagacacagatgaccccatgggcagagtgggaaagtcgctgcgtgagctgtcctcgtccttcctttgcttctagggcacttctattcttcgtttacacatctgccaaagggggtggagttgtacttcgttttacaggtaaatttcaaggcacagtcagtttttaagaaagtgctccaagaccctaggcaacgtgacagttctcagttccctctgaattttagtctctgctacctggtgctctttaccaaaggagctcgctgcagggtgaaattcaggcgtgttctgcccaggcctgctgtcttgagtacaaatgtgaatgatggactgactgcttgttgccaaactggaaatgttttgtagggatttactggcatggtatcattcctaggaagaagaagaaaaaaaaaaggaaaaagaaagaaagaaaaagggacaggagagggagagaaacttgactgcacattttttttttattattaaatccatgttgtgacttttatttaatttctatattttttggtaataaaaagttgactttttaatttgaatttgtctttttttat

SEQ ID NO: 19139 - DNA, 2298 bp, Mus musculus
cggagactggaggaagagctacagcagctgaaggtcggggcccatgggtcagaggaaggtgccgtcttcaaagactccaaagccttagaggaactgcagaggcagattgagggcctgggtgccaggctccagtatgtagaggacggggtctactcaatgcaggtggcttctgcacgccacaccgaaagcctggagtcgctcctgtccaagagccaggagtacgagcaacgcctggctatgctgcaggagcacgtgggaaacctgggctcctcatctgacctggccagcacagtcaggagcctgggggagacccagctggcgctgtccagcgacttgaaggagctgaagcagagcctgggtgagctgcccggtaccgtggagtcactgcaggagcaagtgctctcactgctcagccaggaccaagcccaggccgagggcttgcctcctcaggacttcctggacagactgtcctctctagacaacctgaaatcctcagtgagccaagtggagtcagacttgaaaatgctcaggactgccgtggacagtttggtggcctattccgtcaaaatcgaaacgaatgagaataacttagagtcagccaagggcttgctggatgacctgcggaacgacctggataggttgtttctgaaagttgagaagatccatgaaaagatctaagtgaactgcgtgtgtgggcacagtttcttacgaccaaaaccaaacaaacaaaaaaaacaaaacaaaaaaaatcccattgttttctcccaggtgccctctcatcaccttctcgcccctcccccaccccatggaaagtagcagataccgactggacaccgccctggttttctgtgcccagttaatttatttgcagttattaccacacacctttggtttcttaagtcctgtttctgcttttggtttggcttcctgaaggcccagccagccctgtgcagaaaaggatgtgtctcctgttagaaagatgacagtggctttaactggggattatcaggaagcagattaacctaaaaaaagatcctgtcaggcagtcaaatttatagtaaaatagaaaaacaacaaaggacaggtggggggcactttttaaaaaattttttaaggaaaattaattttattggtttgttgtttttgtttttgttttttgtttttttatactcctggccagggtttttagaagctgtctcattcttgtcttccatttagaactggtaaaaactcctagaggtcagctctgaatgggcgaaagaggaccccacatccacccccaacctgcctgagagtcactctcagaggcgtggtctctctccattccctaatccaatcaaacggtaactatgcaaattcagtaggtcctgaaggcccagtgcacttctggtcctggtgacccacctgtgtcatcaggctaggaggggtcaccatgtgcgtttggagggggtgttctttgggttctgatgtgagagctgtattttccacagaggatttgggcatcttcccgagagatgtgggccaggtctttttgttttatcacagcgtctctggagaggcctcccttcgcctcgcccggcccccatctgtcagtgaggatcacgtgggctgcgtttctgtaattgttctccatgtacccttgccctttgagatgtattgtttttgatggctgccttgcccttccactccctctcccctccccccaaaaaaaaggaaagaaaaaaaaaacagaaaaagctgaaaagaaaaccaagatttgttagtttactgtgaaatgaactgtatggcttctttacagtatttttaattcttaataaacacttgagctttgttatgaccttcagtcagtgggttctgagaacttagtgatgatgcattttatcagcataaaatgttcgggataagaaaattggtaacttttccatcttaagacttttttttttttacgatgtacaatgtttttaaaaattatttttttctcaagccgggtgcactcgggaggcagaggcaggcagatttctgagttcgaggccagcctggtctacaaagtgagttccaggacagccagggctatacagagaaaccctgtctcaaaaaacaacaacaacaaaaaagatttttttctcttgggaagggggtgggggtgggaagtgtgtgtggtggcccgtgtgcagagggatctaactcaggttttgcaggctccactcctgcaggcacaggcttttgttggtttattattggatctatttttatgttcctcgtagttgcttcagatccctgcctgactacctggtagga

SEQ ID NO: 19140 - DNA, 1219 bp, Mus musculus
aaaggttagccacaggctcttgcaaagcagaggaggcccaccctggccaattgaaggcagcacactgaaggctgattctctcacttggtcaccgtgtgggagaagaaggatgtagaaatgacctcactgaggttgagaactcgggaaagcacagcctgtaggcttctctctgcaaaccaacccctcgtcaccatggattccctctctagtccagacatgacagcttttggagttacctccacactgagtcataggtagagacaaagaagccacagcccttgcttgaaacatcctggaaaggttaaccagtccttcttttgtcgcaggctgaggactgaaggctgcccagtggtggtggtgacaaagtcagcacttccctttgttagcctttggatgctgtgacaaagccccagagacctgacttggaggagcaaggtcaaggttggctagatccgttgcttttaggtatgggatgatgctaaacatcaggacacctggaccatctggtagaggatgctgctgccgttgtggtagctaggaaacaggaagacagaaggaagacaggaggcaagagcatgctctctgtgatcgtcttctccaagcagtctgcatctctgagctcctaacacctccccctagtgctgttgaatgatgggtatatccatgcaaccactgattaggtcagggcctccatggcttgctcatctctcaacagtgtcaccagctagggtctgctccttcaatactgggacctttcagagagcatacatagtgaccatcttaataccaccaaaactttgctctcattccttcttgtctccagagtgcttgaaccaaagaggcatcaaggagtcatttcctgttacatagaagggcatcatatttcctcaggatttttctttaccctcagctagttttgtaggcaaagataatagccctctgtttcattgagtgcttcgatttctttttatatcataagtaggttgctgacacactatgtgttgactaatcatatcttttcttttgtgaattacattcatggctttagctcactttggagttttaagttagattttaatgtcttcaataaaaaatatactcatctgcattatttaagtcaagcatctgtagacagaagaattaagagagcaaaaaaaatgagggaggcgcctactttcagagtccttttctactaaagaaagatgtatttagtttcaat

SEQ ID NO: 19141 - DNA, 1189 bp, Mus musculus
tggcttattgaccaatggtaaagtagtctgaagtttgtgttttcattttgtttctggaaatgtgtggagaagtggcttattgagtaccacaaatccatgtcttctcttagtttcatattaccagggattctgacccatttgggatttcatttcaggttttgggcgttgtcttgtgtataaaaatgctaagtgcaccttgaaacgatacaccaatcagacctttgataaggtgatgggtcccatgttggatgctgctaccagaaaacccatctggcgacatgaaattttagatgcagatggcatttgttctccaggtaaaaacccttaaaaaataatggatttcagtgtatagttttttaaattgtgagaggtacttaacagtatttctgaatttttgataaacagggcagaaagtaatctgtactgtaatacccccatctacattcagccagtgtggtcattttcactgaattttcttcctatgtttttctatgcattaagtgtgttttcccatagcaaaaatgcatcctaggcataaccttaaattacacaaaagccacacttgaaaccatgttttgaatccggtcttgactctgcatctatgctggttatttctaaattcacacattttgtctatggtctgactttggacttccttttccctaaagggaaggacttcattatgattacaaacgtgtaatgagtttgtaatgagacagcccttgcctttggtcctacaggctagtgtagaaggcagacattacatcagatcacacacaagcatgtcaggttacatccagagtaagggatcagagagagaaccatgagatcattgtgtggcaagaggatttgccctggtgaagaagatctgcactgttaggaaatgcgctgatgtctgcagatgggtaagaggcgtctgctaaagaatcagaaaactccagtggaaacctgtatgagtgacagaagtttggtagctgaggtggtctgaaaggaagactgcatattagggctgtgcggaacacagggaccagctgaaaagtctggtgtcagaccaatcatcttctgtacgacccagccatagttccgctctgcatggacggtgctctagggaacatgaatctgccaagtgtgtgagtctccttcactctgtctacctttgtttctttggaaatttttgtgaagctttaac

SEQ ID NO: 19142 - DNA, 1207 bp, Mus musculus
gcagggtgggagttaactctctggagcacactgcgtggcatttgcatttaagccagcattcaagggagggcaccacaactttctaaagttcttagtgccagaatggaccttatgcctctgctctttgatgaaacacagttttaatttttcattgcaagaaaagagaagaaaccttcccaatgttgtgaagattacatatttctaaaccagagaaatgtaaaagaaaaaaaaatatatatgggggaaaagtgggtttcaaaggtcaggaacgttctttacccctgatggattcaataaaatgcagactttaaaaatcatctgtctaatttgagattcaagatcatcaaattctgtctaaatattttgttttaacttctaagctcattatggcccctttgtgttaacttgtattaaactctgtcagctatgactggtctcataagcacagtcagtggggcagaataagttaattatttacttgtgtcactagtgctcttcatttaatgaaatgcacagctgtgttggatctgcagttggatgtgtagctcccattgttcagcaagtcagcagaggggagaagccgtggtgatggagagtcctcgcctctctctgctgctctggctttctgtgtcgatttcatgggtcttttatcactcgctttctcacaaaacaaacaacacagggctgtctgctatgggaaccatcttggcatataaaaggggtttcagaggctcaagtaattttaagttagcgaagatttaatttttggcttacaggtgcccctggttcaaatataaccaaagcaattctattataagacggaatggaaaaaaaaaagctccttgtgtatgtttttgtcagcaaatgtcagaaaaaggcagaagagaaaacaaaacaaaacaaaaaaaaaaaaaaaaaaaaaaaaaacttcccaaaaggaagctgtgctgtgaagagtaatcgggcccagaggaaaatgactagattctgactgtaggaatgagcatgtatgtcatcttaatagcctggtgaggttaaatcagctcaattaaacacgtcaactaaaaccaggctaccaagtcttccgtcttcctgccatccctaagtcccagcctgcctgaaccagttcccaccttctcctggtggtgtggagggtggaccgcagcctctcccaggctgacaccagcatccctgtgggtcctgcctg

SEQ ID NO: 19143 - DNA, 1451 bp, Mus musculus
gtgttgagtgggagtctcactctatcccaggtgggatttgaactcacctcaattctcctgcctttgtctcccacaagtgctggaatcatggatatgagccaagcatatctggtttgtttatgttattatgttttaaactgtacttgttagaaaaaccttcttcctttaaatttcctctgaggtcttctagctaacagaatcctgggttctcatcagatgtggaggaggtaaagaattgtttgaattgggactgagaagttagctcagtcaagggcctgttgcataagtatgacctgagttcaccccccaacaacccatgtaagggctgggtgtggcacctagcacccctgtaaaagtcagatactgagggggtgggggtggggagcagacagactgacccctggcgctttctgaccagctggcataaccagtcagtgcaattcaggttcaatgagggacccctgtgtcaagggctagtgtgaacagtgactgaggaggaccccagtgtccctctggcctccacacacacatccaaagaatgggtagatgtgtgggcacaacttttgctgaggtgggaagaagtaaactttctctcagaggacagcaagtgacatttgtgactctgaaagaccagcagtcacagtctgctgtcacattgtgagtcagagcttgctcagacatcgatcttgatggaatgtgatctgtgaagtctaccttttaagactctcctcctacttcttttgaacctgcaggatacctaggtctaatccatgggcccctggtcactcatttcctacctttccattgctaccagaaagttagctgtccactctctcagtttgttcttaactgttgtgccctggctccagataaatgtttatatggagaagtgttcagagagagagtgtgccccagcagcattgagtgtgcggatgaggctgaggagggagtgcgaggactttgcagatctcactccaggctcatccggatgagtcacgacttaaagactcaaccctgtttgttttcttcacaataaagatgtggcagtcagaacggtactcagtctgagaggtgatgtgagtgggcagccttccgtgcatcttcagagactcatgggcattgtgagtcagaggaggcgtccacatcctccctgcagggttggtcatcccttaccagatctgccacccccgctgtccttactgacgggcctccggattactgtactgaggtgtgtgtgtgtgtccttgtgccgtgtgcctgttgggccgtcagaaggacctttttcttaggtgaccttgcctgagtctaccaaatccatcaacggttgataaccctgcagccccaggcccttcacatcattcaaggagcaaggcagtgttctgggtacaggcagcaggacatctgctcagcactctgtacgatgccctatgttggaggttccaggaacaggg

SEQ ID NO: 19144 - DNA, 1130 bp, Mus musculus
tacccagaaggcagtgactgcatctccagcttgtcctgtgtcactgatccactgccccgttcaagttcctcacccttgctggaccttaatttccatttctgtagaacaagtgagagatgtgaacaaaacagaacccgtcttctggttctgatattttatgatttatctaaaagtaaagccagatcttatagccatatctttagcctgcattggtagaaaatactctttttgaaatcatttgagcagataatgattttggcatacttgttgtttttcagaaactctgtgaaggcatatttaaggtccttgtcaaggaggtcccaacgacatgccaagtgtcctgcctggaagtactccgcattctctccagagacaaaaagatcttagttcctgtaacaactaaggaaaatatgcaaatactgctgagactagccaagctccacgagtcagacgattctttggagaaggtgtcagagttcccagttattgtggaatcattgaagtgtctgtgtaacatcgtgttcaacagtcagatggcacagcagcttagcctggaactgaatctcgctgcaaagctctgtaacctcctaaggaagtgcaaggaccgaaaatttatcaatgacataaagtgctttgacttgcgcttgctcttcgtcttgtcacttttgcacactgacatcaggtcacaattgcgctatgagctccagggactcccgctgctaacccagatcttggaaagtgcctttagcatcaagtggaccgatgagtatgagtcggccatagaccataatggacctcctctctcacctcaggagacagactgtgccattgaggccctcaaagctctgttcaatgtgacggtagacagttggaaggtgcataaagaggtaaggctgggaaaactacacacatccttctggaattacgcatctgggttgttcttacagctgcacacaaaagaggagtgctaagtttggaaatggaaactgttcccagttccctcattagtctgttctctaaattgaaaaatatttctttcttagcttgccttcgttcaagggctggagagatagcttagtagttctgagcactggctccttttccagagccagccctggattctgttccca

SEQ ID NO: 19145 - DNA, 1333 bp, Mus musculus
ttccccagcgctgagactctaggtacatagcactacgactggcttcagaggaaacagcagcatcctcactcgggaaacaatgtacacaacatggaactaacgttctagccatttagcatgtgagacccagtggccatcagtccattcactgctgcacagcctcttttacacaggtttcactggatagcctagactgatcttcaaacccacaggctggccacagccttgagggtgctgggatgcaggtgtgtctgactgtgtccagtttatctccagactgttcgtctttcccaatgcaactgttcacttccctgcaccctctcctagcttcttcctgtctgtatgtgaaatcatatatagtagtcgtcctttttactggatagcacctgatagctatggctagatcttcatattgcacttgttatttagttatgccttctgctttaactggcaccacgctgaaactttggctctgtccaaaatccttccccctttgtctagtaccagtgacagaaccatggcttcttgcacggcaagctagtgctccaccaccaagtcacaggtctgtctctctggtacggtttaaatcagcaccatctaactgaccttgttgattctgccttgggacttttcattacattctcagctcaacagttactgggatccgtgtaaaatctgagtcagacaatattagttgcttaaaactgtctagtgactgaaagccaaggttctcactgtggtttgtatgcactgtgtctctccgcccgtaccaccggcctcttcactacttgtcaaacacgtgacttcatgttgagtgtctctgtgtggagcacacctcctccagagagctgctgtgttaccctcccatccctgaccccacccccaggtcttgctcaggtctgttctctgtgcagcctgtgtagtgccgtctaaagcctgggcttctacatttccctcctaagcatccctgttccttaggtctggggttttgtccctttgtttgcaagaaggtaagtttcatgaggaaatgggatttaaaaatcaaaagtctgtctttctataaatgtttgttgactacattaatatatttttaattattttttgtttgagtctttcgcctgcatgtatgtctatgccccatgtgcatgtcagatgccgggggggtgggggtgggggtcgcagaagagcctgtcagatctcctggaactagagttacagacagttgagagcccctatgtgggaactgggaatcaaagccagtttctctgcaaaagcagctagtgttcttaactgctgacccatctctccaacccctgggttaatacatttttgg

SEQ ID NO: 19146 - DNA, 1106 bp, Mus musculus
aggagcaggctcacccagctgtgcagctcagttctagaagctacggtatcgagtcacggcagcaggactaagtgcccagacagtcttgcaaggtgagtagcaagggctcaaaccgaagctcataggccaaaggcacacactgtgtctacacacaggagacagtgggcatgacaggacaagtatcccatgcctgagattggacagtgaggagccatgtttctggcaaggactagacgtgacataaagtctgctgtgggacggactgaactggagacaggaaagacaacatggaaagccattgcctcagcatctgaagggtaagcatggcctgagatagagcacgacgggaggtgcagacaagggtgaagtcaaggaacacttgaagctgcagtcagcacaatctagtctgaaggcaagaaatctcagaaagtggaggaaagatctcaaactcggtcccatcttacagactaataagtgggctggggacaggagatggggactaaattatttccaaggagagagaacagtgtttaagaacattgaatgttctagaggatcctagttcaagtgccagtacccacagggtagctcacaagcacctgctacttcaattccatgggatccaacaatctcttctggcctccacaggtacacacatggtacagacagacatgcaggcaaaatatatgtatacaataaaaggattatttccaggatctgtcaaaatcctcaggtcactggtcacttacaaatgatcaagatacttataaagagtggagacagcacatcgtggtcgggagcatatggcacaggaaacacattcagcttctggctagcagaaaaagggggcatggggaggggaagagatagggtcccataaccctttcaggggacagtccccacctccaaacatctccattacttctcagtagtgccaggctgaggaatgaccctttcatatatggtccttcaggggactttccggcaaagatgacagtctccagcacttctgcattgcacaaacagtgccgtgtgtgtgcaagtactgcatagacatgtgctgatgggagggataggacacaagtctcctgagccttactgtattc

SEQ ID NO: 19147 - DNA, 2834 bp, Mus musculus
taattatcagtgaactctttcaaaggttgtaaaattagtttccctcttaaaaatctcaggagtattgaggtaaaggagtttcctggtgtcagtgggtaagagtgcttatcagctgttgtgagtagttaacacgaaatgtgctttagtagttggattcatgctcccatccttaatacaccccacagtatctatggaacatttcttagctcatcaaaagctatgtgggaagtttcatattgagaaggaatacatttttttttttgttttgttttgttttttcgagacagggtttctctgtgtagccctggctgtcctggaactcactttgtagatcaggctggcctcgaactcagaaattcacctgcctctgcctcccgagtgctgggattaaaggtgtgcaccaccacacccggcaaatattaatttttaagttcttataattatcctagtaacctaagataatccttcatgcttattctttctttaggatgtcttaaattattagtagtaattcctttaaaaatacaataaaatcaaccattaatatatgaggattgactcttcaaatgaatgagatgggctctatacattggctttgaatttaaaaaaaatagataaatgctttcaatgacgtatttagggttttttttttttttttttttttgttgttgttgttttctttgagatggggtcttctaaagcccaggctggtcttgaactggatatgtagctgaggatattcttgcgcttctaattctgcactcacctcccaagtgctgggcttaaggcatgagataccatgcttgctttatgtgatgttggggatggaacccagggctgcatgcatagtaggcaagtactgtaccaactgagttgcattcgtagtgaaattcgttcatagctttaaaacatgttctcttatagccctttaaagcagctgtagacataccatttctcaagccagtttcaggcagggagttgaaggtttttgatatggatggtaagtgtgttgtgtcttaatgtgttatcataacatattcattttcacagaatgtaactcagaagttcatttctttttgtcttaatgcttagtttcatggaaatttataagtgacatatatttggcatttatcttacaatctaagcctgaaaaaaattcttaattttctttatacctaaaactagaattctgtcttcattctgccccttctaactccctggagagaggaagggagtggtgccttggtgtaagtcaaaatgtagtgttcctgagaccagaagaagatcacctgaatatgtaggttcaaatgtttggaactcttaagaggattctattagtaatgtgggccaacagttgaataaaaatataaatttaaaaagcactcataaataacagcaggactgtcaagcaaatctacagatgttcttgaaactttgtttatacaaaatttaaaatcactgaattaaatttagaaggaattaaatggtcatttatttcatgcaatatcatttaagagacatttgttgatacatttggtgaaatgtgttaacaaatggtatttttaaagttccaaaattaatagacccattctcagtgatctaaataatggtattggagaaattgattcctgctatttagaagaatttattgattcatatctggtttgtatttctaacttagaggttctactatgctttgtacttgaattagtctaagtgtaggcttagtatactatatgcttgcatatttattttcaactttgcttgtctttaaaatcacttgaggaaaaatggctaattaatttctgctacagaaaagccaactggtaaattttctcaattgtcttaaatgctaaagtataatgtggttcagaggggcttttacgatagcagagaactgtacaaatatacaggtagctgtagttctaactgaaatgaacttgccatttgatgatgtgtacagctatatacctgagtcccttctagtttatgtagactagcaatttgacctgttaaacaggactagtttactttgttgtatacacctggaggtatctgttattcgactccatttttgagttttggcacagtgaagataaatttgtgtgacccacttgaatgactgatctaacaatgttgatatgaatattgtatttagtgaaatgtcagatgaaaatacctgattgaataatgcggggatttttgtattaaagggatgggaaagaacacctgaatctgataataaaggactatgatctacaaagatggaatgtttcataaagatctacagaaataaagggattttgtaaacaggatgatcttaaaagttaagattacacagttcagggtgtgctgcagtaaatttttttggtgatactttacaaacatgatatggatgtagacacaacagtaaagtgcaaacacaaaaactaaaagtctgaaaattcaaatgtctagatttcgtcatctcagtttgttcagtctctttaacaacctttgtgggttattcttgggcatactaaagtgtgaaagctgaagagctagacctagggaacacttttctattgtatgtagttaaggatcccgtggccccttcacgctggcgtttcttctgtgagttctaggagttaaacctaacttaggttctaatgtcccacgtgctgtgtcctgagcccttcaacccactctacaatgccttctcacttccctactccaacagtcactctggataagtcaaccagtgattgccctattccaaattcattagtcacttccccacatcttagttgcctctctgtgacatctcatctacagcaatgactctaaatgctaca

SEQ ID NO: 19148 - DNA, 1223 bp, Mus musculus
gttaaaggatttgttttctatcacttgtatctcttagtacctaattaacaggtttattaatacattatttagttatattttctttggatcagagaatgtgaaatgtaaactataatgctactgcatgtatggtaccttatagcagcatgatccctttgtccctatgcagcacatccaagtttctgtatttctccttgtgatttagttggtgatatttttgctttcttaaaagtgggatactacccttttttattctatgaatatcttacagctctttaaaactcaatgatttgagtaattttttactcttccactagtagcacttccaaggatattgtcttagttatttttctattgtcatgaccaaacaccatgaccaaggaaacttataaacaagaacatttaattagggtcatggtttcagagtttgagagtctgtggccatcttggtgggagcacagcagcagggaggctggcatgaatgtggaccaggagtcaggcaggagcttacttctgagccacaagtatgaagcagagggagggagagagattgcacacccaggaaatgacataggcttttgaaaccctaagcccactgccagagactgtctccaaagaggctacacttcctaatctttcccaaacaatccaactacagaacaggtgtgtgtgtgtgtgtgtgtgtgtgtgtgtgtgtgtgtcctttctctccgtctcccttaccctgtccctgtccctgtctctatcacacacacacacacacacacacacacacacacacacacacacacacacgcgcgcgcgcgcgacacacacacacacacacacacacacacacacgcgcgcgtgcgcgcgcgtgcgctctcatgtgtgtgtgtacgcctgtggggcctcttctcattcaaacctccacaattatagaagtaaattctatccagaaagctgtatttcctgtgtattctttcccagaaatttcttattagaatacaatgtatattttagaatgtttaattttcagttctatctagattttcttgtcttgagttttgctctacagtgacctgagagatgctctttgggtaaatgtatatgtacattgcttgtttactgtttcttcccaaggtctttgaagagttactgcttgatgcagattggagcataaatgctggaagttggatgtggctgtcctgcagttccttttttcagcaattttttcactgcta

SEQ ID NO: 19149 - DNA, 1200 bp, Mus musculus
ctaggtcctatcgacactgtggccggctctcggaggcttctgcatccgtctggtcccagggaggagaggaccagacacttttattttggatgaaaggcgcgggtcctggcgggagcttccttcccggcctggctcgcggctcagtgcgccctcgctctggccccgactccagaagatgacttcaggttccgccgtgtatcttcccgtggtgacggctcggggagacaggcgaaagtagtgacacttgctggcaacgccaggtgggaaagtgagcctaggcgacgtggagccccgctgtccccgaggaccccggtgcccacagatccttgcctttccttcccctcggctccacggcggctgcagcatgaagtggcgcagcgatggccaggagaggtaagaagcctgtggtgcgaacgctggaagatctgacgctggactcgggttatggtggcgcggcggactctgtgcgctcctccaacttgtctctgtgctgttctgactctcacccggcgtccccgtatggcgggagctgctggccgcctttagctgactccatgcacagccggcacaacagctttgacaccgtcaacactgccctggtggaagactccgaggggctggactgcgccggtcagcactgctcgcggttgctgccggacctcgacgaggtcccctggaccctccaggaactggagttgctgctgctgcgctcgcgggatccccgggcaggcccagcggtccccggcagcctgcccaaggacgcgctggccaagctctcgatgctggtaagccgggctctagtgcgcatcgctaaagaggcgcagcgcctgagcctgcgcttcgccaagtgcaccaagtacgagatccagagtgccatggagatcgtactgtcctggggcctggcggctcactgcaccgctgccgcgctggccgcgctgtccctctataacatgagcagcgctggcggcgaccgcttgggccgtggcaagtcggcgcgctgcggcctcaccttctccgtgggccgcgtgtaccgctggatggtggacagccgcgtggcgctgcgcatccacgagcatgccgccatctacctgaccgcctgtatggagagtctcttccgggacatctactcgcgggtgttggcctccgggctacctcgtagctgtagcggtcctggccctggctccagctccggttctggcc

SEQ ID NO: 19150 - DNA, 1174 bp, Mus musculus
cacagggccttcaaaagccgggtttggattttatggtttactctgtgtctttcctgctctccgttcacagaggatgcctcccgatcaatattctgccacttagaacacagactcgttctcaattaaagcactctccagaggtgaatgtgtcacgcttgaccaacagtgatacttgatttaaatgcattggagagcctagtgccagatgatatttactagacatcaaaccaaaacaaggtggcttcacaaggtagggacttgatcttttgtcttacagtaatccaaggtagtccatgagttgaatggcattctaggttccttctgtgtttctttcctgccatccttagtacgtggtttccattttcgaggaagcttcatagtcctaagatgaccatttcagctccaaaaatcccatatgcatcttatgcaagatgaagaacaaggaagggaaacggagcactgcctgcagggggattccactctttgaatgtgactcgtcccctcccaaactcttgtctgattgcaggtgggcacactcatgcagctgggactggcatcagctgttccagaatcagtgagtagaagaggcactgagctcgccaaaggaaagcagagaaacctagggatacaacgagagcagttataacaagagatcatctcgtgatgtattcccccagatttgaactgaccctcagcaggtgttggagtgggccttggggtaggagtaggaagggacaaaacatgagctacgagctaagagggaacaggaaatagaaaaatgaagggtgagttagagaggagatggcccccgttcctggactctggtctccatcaggggttctgatcatttcagactgactctgtacctggagtgtcacaagacagtagctcatttgatcttcagagtaacctagccccattaggtacaacctgccagcggtcccacatactgatggggttaagtgccgtgtctgagacccctgcatccgtaagcagcaggaattcgcgtggggctgctgaggatggagcctgggctggctcccttttagctaccgacacccccggagaggtccaagtggtgattctgttatggactaaataagatgtttctgagctccttttccaacagagttaaggaaaggcagacattctggattagggcaaaggctaaact

SEQ ID NO: 19151 - DNA, 1152 bp, Mus musculus
ggctggagtgatttgagcaagcagacaataatggatagagtttatgggatgtagtggatctcagaaaggacttagaatctatacccacttactgattccctaagtctggtgcctaaaacacctcagactcacttaataagaaactgtggctgtgaagtccacagtccattttaagattgtgaaggcccctagaatgttagatgtattgctgtgagactctaggccaggtctgcttgctttcccctcccgtgttctgcagactatgagtagccactggtgtggtccaagatggaaggacctggaatgggccatcattgttgacctgacctcctgattccaagaaacccagtgtctggaaattgacattcagactaataaagaagccaaatgttgcctgtgctcacactaggtcagatgacagcagaggtagaaagtggactaagtaggtataggcttacacgatggagtcattggcgggcagtcagtgtgaagaggcctttggggcatgtgagccaggctgctcatttgaggttgggaagacttagatctgtaaatgggacaagaggctaattagatcctgtggatggccacaggtcttcctgtttctggatgcctgcttacatgcagactgcctgcaggctcagggcctctgatttttagagaacccactgtcctccagaagtcatgataactatccagatgtgtgactaggttctctaccagtctatgggatggcactttgagagcagagactacctcttatcactggcttctcatgacccgataaatctgaaaatcctggatacctccatggttcatattaattgtcagcttgacaaacatagaatcaccaggcctctgagcatgtgtttgagggattatcctgattaggttgtgtgaaatggaaaagcctgcccactgtgggtggcgacattctctagaacctggactgagtgatggtactggtgatggacaagcttcaatgtagtagaaccctagtggcaggggcggcagcgtctttatgatgtcccattaaaataaaaggttggggatggtgggcaccacagcctgctaccagattgacctgtatgtcacttaacgacttttgtctctgcaaacctcctaagtcactctatgctacctgcgtgtcaa

SEQ ID NO: 19152 - DNA, 1176 bp, Mus musculus
ttcgataaacaatgaataaagctttggtataaagatgccccacgcacctttgatctagcatttatatttgcctaatctggcaatgcttgacaagttcaaagcccacgcgtactggaccgagaagctgtaaggcacagctccattcagtgtttaggatgtcaatgtcatgtttgaagccaggccctggggtccctccatcctctcccaccacacaggcagctgtgtagctgaagggtctctgtggtcttgcccctcctctctcagcaactggcacagattgcccagaggttaatgccctagaaacactgggctctgtggatagcctcaaataccctgccatgtctcacctggacccttgctcctgctggctctgcacagagtgctcttgtcttctgccattcctctccccatacctacaaccacagctcaagggccaccttccgaggaagcctaggctcccctaggctgtgtgtggtgcaaaggggcttatagtttcataacattttttatttagagagagaaccaccgaaccctaaatacttgtatgagatacatgagaatatggcctatgcttgtcttctccggactgtcttcatgcttgtcttctaccagactgtgggcttccagcgcagggctgctgacatgaccctaacaggcactcaatcaacacattgttgcttgattattgttgagtgattattgaccagttcatggggactgggagaaggtactaacattctttcaacatgaagcctgtatcaccctctctcattggtttcctccctcgtttcctggcctagcctcttgctccctgaagtggcttgctgaagcaccttgccatctctcatttcatctagcaagttctccagcttgttctattttgaaaggagagagtccatcctgagctctgtccactctcctgtcttaatgccccctgtctcctctgtcactggaatggacccaggcaaatgcctgctcagaagtccacagccaagtatgagggctcagtcaagtgaacaggaaagcagtaggttctgcactcgggagctagagtggcacagaagatccgaagacgggttctccacacatgcttctctggttcaaatccaagctatcacttatagatggggtagcctcagaaagattcctcattcctgttttttggacagtcccccc

SEQ ID NO: 19153 - DNA, 1807 bp, Mus musculus
ctgctccaaggcagattagagaacagtagaacaagcccgagagaagtacaaaaagaggactaaggaaagctaaactcagtgcattaactcatcaggcttccaggttggctactttctcagtattaaatatgtttcatctcacagcagacccttgttttatactgtagtctgtctgtgctcttacctccttgtctcacggtttctttcagtaaatgaagcatttggaagacgggagcgactcgttataggcggcacgaaaggtttatctgttagcggcccctgtgggagcaggagtccacagcagacaccaatggagtcctgacaaagatcagtttcctgctgtgcttaccttaactccgtttcaaaagactggcctaaaaatgtccacgtatatctacaaccatagatggaaattcaggtcctgttgccatcctttctgcagccttggtggcagtccacagcctttgggctgccttctactgggtactgtacagagttcttgcctttcttgaaaatataaagttttttaaaaatgattccttaacaggccatctgacctttggaactctaggcataaaatacatggtaactggagagtttttgatacgggtcttgctgtgttagcaaagcactggtgtggtggctcgtgcttgtcccagtcctggggaggagagagagacaggcagattcctaggaccaggctgcccagcgaatctcacctatctccatcttcccaggctaggattacctatatgcatggtaggttctagaattgaattcaggccctcgtgttggcaaatcaaacatttcactaactgagcagtgtccctaacccattgataaatgtgatccctaaaggtattttcaccttttgaatgttaatcatattttgacaacttttggttttaaacttccatgttttcagggatattttgtttaaaatgtcaattattttttaaatggggattttgttcatacaattttctatgatcaaaatattttactaaatagacaacaaactgtcaaagtaatacataaccttgtaagttttggtcccagtacattctcccatctatttccttcaaataaacttgaacttgtcaagcccataaagccttctggacttaagaggtcctaaattagcaatctcacaccacctcacagaaaggctgtccactccctcctcccagactccaccattactaagctgatttcccaagtttcaggatgttggtactttttgaagtaatagaataaactgttctatttgtcattgaaattcacctcactttgacttcactcttattttcagaataccagggcatttctcaagtctgatcagaacttatttagtccttgtaagcttccaaattaggaacagaaccacctgagtggtttaatttgtttcccacacaatgactgttgtgtggcagataactgggaaaacacagaatgcagagctttgtctgactgacatttatctaattctgtatcttaaaaactaccctcactcctgtcgtgctttctataagctgccactgtgaagataaaattaacacgtaatgtgctttcccttcttggtaaagactgaggatggctttgaccttgaaattaaagcacctgttctgccctgtatttcagaccgaggacctggttttccagaccaggtctattcatcctcggcgtccagttgtccttacagagctaggattacggtgggctttatgccttccctggtctcagacaggacctttgactcctgttcctctacttttaacacattgtacatacggtagcatgcagcaaa

SEQ ID NO: 19154 - DNA, 1845 bp, Mus musculus
agacctgcaaagagcccagctccagctcctctgcacaggaggaagaggatgatgagtcggaggaagaagatctcgcagactccatgaggacagaggactgcaggatgggcagtgctgtttactcaacagacgagtctctctccgcacataaataggaggagagagcaactgctttggacggaacacacattggtaaaacaaaaccaacccacggttagaagtggacggagtggggacagctaaagcacttacagaggaatgtccagtggattctttaagatggactggcagatgaggcatgcatctgtcctacttttcagtaatgggtggcaatgagagggccaacttttactatctgttctttatttacatgtaatttgggagatgtatttatgcttgagtcaaagtgcccttttgtccacacaaatcagatttctctcatattgctccattttcccccagccagcgtgacttgagccatcccactgcatcccacacattaagcactgatgtaaggtaaccgccgtgcaagtgttaggaggcctgtaattagttaaaaaggaacacctgcctaccttctggctcctgctgcctcagtctcagcaggggttgagagggcaggtaaagcagcaggcgtggatcagaggacagtgactgatagaggaaaaggtccagaagcccacctctgatagaagccaaggttagccacgtggttatgtgtatgcacatctttgtgatctagccttgtctctttaggaaagccttcagtctttcagagaggacctagaacattaacagtgttgagataatacatgctgggtagtctctagtcagcaagtgcacatgggctcgcctgacgagatcacgagatcggttcttctgcccacaggaggaaggatcggaatgatggtttgttttctttctttcttttttgaaatgtaggtttactttatgaaaaccattaaaatgttgctagctgaaagcaacaagtagttccaaatgcattgtgggtttcagttaggccttcccagttgtcttccttgttgctgaaggtcctcaccagctgagtgtagaggataccaaaggaattggaagatgagaaggcttattagtcactccctgtgagcaggcacacccagcttttctccagaagcggacaccctgaacttgacaggattgatggaacacgtcttcctgctcaaaggcttgagtagaggactctgctggcaaggttttgctgctaatgtatttatagaatgaatgtatttcattcaaacctgtattcctctaggaagaattaaaatcatttttaatgaaaatatggaatttgtcatgatcttttgtggaagaaggacttgaaggttaaaagaaagcatttcttagttttggctttgagatcataccctgattgtttctgtgcagtgctcggactgcacctgggtttgtagcctctcccccccaccctcttaaggtggggctttactgtctccttggaaactagcagcttgaaggccagagctgggggtggctgctaatactacggtagcaccattagtgttccaagtggtttctccctttactcggggtgaattcttttagtgctctgcacagagatgctcctcaaaataattaagctaaataccccaaaccacaagacaaaaggaaaggcaaaaatccttgctataaggatatagcttctatcttttaacctcttgggtttaagtggctcattttaaattattattattttgttttgttgagacagggtttctctgtatagccctggctgtcctggaagagcagtcagtgctcctacccactgagccattttgccagtcccacttt

SEQ ID NO: 19155 - DNA, 1282 bp, Mus musculus
cttataaatatacaataatacatatatttttgagaaattagaaaatgcagatgaaaatgtaagaccaagtatttatctcatatccctttccagcactgagtttactcatgtttttaacctttgcttttttttttttttttttttcttcttttcaagacagggtttctctgtgtatccctggctgtcctggaactcaggctggcctcaaactcagagatccgcctgcctctgcctcccaagtgctgggattaaaggtgtaagccactacaccgggctaacttgctaatttaatgggcacctgagtatttatttcaaataaaacttaatagtttgaaagatttccttttggtggattttacagtgttcaattccttctctgtaggcaccagagtcctataagaatgtgacagacgtcgtgaacacctgccatgatgctgggatcagcaagaaggccattaaactgagaccaattgctgttattaaagggtagatccaagactatcagagcgtctgaggtgcccatggactgaaattcctaagacatgagactcaaggcctgacaagatccgaattgcagagctgttgctgtgcgtgccaccatggctggtggagaggctgctgtcacagggttggaaaatagccttccaggagatgtgtctctgatgggagcagggcaaatgagcctcttcttcctttgtcccacaggggtttgtgactgtcaattggggtgtgggaaggggcccagaaatgccctgtttggtcatacaagtctgtaatcaccagagtgggcttctttatcccaggccctgtttgtagcccagaaggtatcatggagaacatgctattaaataggtttttgaatgtttcctttcttctcttcctgtgtcagttttgtctgctcatctgtggagctcctctacaacaagcaaacctagattcccttctcacggagagcaccaagtacccaaagtgttttaatcaagacagtagacaaggcacagtggggtacgttgaggaggctatatggtatgccaaggaatagggcaaaggagaaaataactctccacagccttcctgtctttcttacccaagaaccaggcagagaacctgcagcgcggggccggctgtgactcactggtgaggctgcctggccagctttgaataatgctttacagtgacaccattaaaaaatggttttcagttttatttaacaattctaaaaacactaagtgaccacagctggtgatattaacagttgcttgatgtggatatcttgtcatct

SEQ ID NO: 19156 - DNA, 1149 bp, Mus musculus
ctcctgttccctgtgacagcagtggttcctatactctgcatcagtgacaccccatctctagtgagtgctgtcttagtgctacactaggcatgctttactcccctgagctatatggcctgggggttattgtaaggccgacaaaggttcaactgcagtgtttctttcccttaactctcggggttttgcagatgaggaaacagaagtccagagagggcaggtgccttgcatggatgaaaatgctaaccatccatccctccagtttgagtgttttctgtactacattctgtctgttcttgacccttatagtttccttctctttcttttcccagggagctagaaaatcccaagtagtgctttattatagccacaagagcactgagtcacaagagcactgagtcacaagagcactgagattagaggtttaggtttcttgtacagttctgcaacacaagaaatttcaggcataaaaagcatgtgcctttctaaaatttaatgttggttttgtgtaccctcagctcacaggacaaccagtgcttattggtggcaccatggggacctgtagttacgttctgactggcactgaacaaggcatgactgagacctttggaacaacctgtcatggagcggtaagaagaatgaaaacttgctaagaaatgctgtcagtttagctatttgctcttgctgcaagcctggtgatcctagttccagcccagcacgctcgcatctgtaatcccagcactcctgcaacaagacgggaagactagagagtcaccggaagctcacatagcaggtgtcctggagttcttcacagcagcagaaactagagaccctgcctccaccaggtggaaggagagagtccacttctgacctccacacacacgccatggcttttgtacatacatgtgctcatgtccatacacactaacataaaaggggaaagaataagcacatagtagaatgtgataatggtgagaatttcattatcaaggaaaaggcatagaattccaagggcttaaacactactggagtcaagtggactttagttcgaaatgcataaactggtttattcctgtccttgctcctttctcattctagggccgtgctttgtccagagcaaaatcacgtcgtaacttagatttccaagatgtc

SEQ ID NO: 19157 - DNA, 1100 bp, Mus musculus
tagcttttatttggatatttaattgttctcaggaacttcagaatcagaggcacaaatataatttaaaaaaatataattaaaaagtgtatcacagacactggtgatatagtagagtgtttacttagtgtgcacaaaaactaagcacagtggtgtacgtggtggagagaggcagaaatttctgaagttaggatcattcttgactacagtgagtttaaggccagcctgaactacatgagaacctgttctggcttatctgtttttcagtacaacaaaccatgaaaataagtggaactataatcattgtaatgacactgtcacaattttaaatagtaaccatgtgactgctttcctcaaaaaaaaaaaaaaaaaaaaggaaagaaaagaaaactagagggcttaaactctagaacaaaaccaggtacacaggaaggtagtaattgtcgcatagtcctgtgcgctttgagatgtgtttcttcctgagttttgctgtcctttactaagaaatgacttggatttccttactcaccccagagacttggaggaggcattggagatgggggtggactggtccctgagggaaggctatgcctgggctgaagacaaggagcactgtgaggagtatggaaggatgctgcaagccgaccccaataaggtctcacccagggcaaagaaaaggggccttcctcaggtaactcactccgcagggcagtgtgccactttagcttttgtagagggaggaagtctgaaccttctgtttaacaaaacaaacaaaagttatccttggagagtttttttatagtacatcaaaaagaacataaaggtgtttgcttgtgaatcatttttctgaaaggttatgcagagctttcaaatattcatgaagaactctgagttacaagtgaatcggagaaaagtgggatatgattatgaggtttataaaccatgtcataatttagatttttaaaaatcgttagaaaagaatggaggtagtgagatgctcagtgggtgggaacacaagcctcactcagagctgagctcagtctccggaacactcgtaacggtggaaagagaactgactccaaaaatgtgagccctggcctctc

SEQ ID NO: 19158 - DNA, 1163 bp, Mus musculus
ccattctattatgtgtctgccatgtttgcatagagtgtgagaaagagaaatgcagatgactttatgcagtgacgtagcttagagcttgggatgatctccaccgctcaccatatcttttgtctctcccctcccgccacccccccaccctggtttttttctacagttgtatagaaagaagcacatacaaagaaaagaggctcagaggatgcggcatgcaatgttcctaccatcagcccaccctatcccattttgtcccattcccgtctaccccagggcctaccttcccacctcgctgcttcctccaggaatcattggtggtgaatatgatgagaggccgatactgcctagtgttggggacccagtcacctcacttatcccaaggcccggggagcttcctggtcagttccgtccactcagaccacgttttgaccctgttgacccacttccaggacctcactccctcttgccaggaagagctatccccaacaacagatttcccttcagacccggcaggggtaggtcagctgacagccggctgccattcctgtgaccaatttggagactttatggaaactggatgctgtttccttggatgctgatctctgctgtcggtttctggttctgtgggcaccaaggacaaggttgctcaaagaggggtcagcttgggaataggtgactgctggtctctcccctctggttcacctctgggatggagattgtggtattgataatgttttgtgttatattagtaaaagtaaaaattgtatggcagacttgactttttttaaggatgtatttagtaggaaaacattaatcacaccgtgaatttgtgtatttgaaaattatcaggatgcttctcagtgtgaagggtggttgattataggaagtgtgtttttatcgttggtgctcagtcgggtgaaagctcaacttacagcatgatacaagtggaactagtgcgctcgaactcagtgagcccaaccctttccttagcagctttctgggttctgtgaggaacttcaagggttccgaagaccactgggttggtacagacacattaccacctaagcttcccccttgtgttttggtatcagagacagtcttaacagcagcgtcctttatgtgctgtcaggtgaggcacttgttcaggacagccccctcttgct

SEQ ID NO: 19159 - DNA, 1228 bp, Mus musculus
actgtaatgggagcaggacagcctagaagcccatggcaagcgcttgagaatggtgcagccccggcgcattgacttgtagtagcctcacatctttctcggcccctaagttctccagtagtcacttttagtaataggatctgagtctccttcccttagcactgtaagtggaaaatgcccatttgtcatggctggtaataattcagtcttgggaagagccctttccaacttgtggctccctgtgtaaaaatcctgaattctgtagctcttttttcctagttcctctcagttgctgaggccatacatatctctgtaattcttacctggcagagtcggatagtccttctccttcttctgttcagagttgttccaaggtctgttttcttcctatctgcctatttgagccttggagaagagctagacaggtcctctgctgtgctctagtgctggtggtgttttgtaaactcttgcatggataagggtattgcagtatgctaggcaagtctctatctctctttatgttaccagggttgaggttctaagtgctcactgccctgcccggcttttcagcatggctcctgagaatcaaatgcaggtccttgtgcttgtactgcaaacaccgaccgatctatcgagaccctaaagatttgatttgatatgacttctttttttctctattggaaatcccatgtgagttgttaactcttatttttctgatattccaaagtaaaatgaagtgttgggtatgaaaagtgtttaacttctcaagacttgatgaccacctctgggtgtttttgctttcttctctagatctaccagttagatctgcatatgaagcctgggtgtgcatgtttatcaatctgggctcatgctttgtgggaacacaaaagaggttctgtgtcttttatgctcctaaatagaccagtttggcttgcttgccacccagccttcccatttgtcttcaatcaagcccaaagtgcctcctcctattaaagtctaaacattaaacagtttaatcagctactgtggtttaggacagcatctgccaccaggttaattctatcagctgacttggctctgggataagaagcctagagatacatgtgcaagctctcttgaagggaatggactggtcctggtgatagttatgttaccccttgtccatacttgcaaggctggcttaaccagtgcctgcgactaacctgcagtcgttcaccacttctgaagacac

SEQ ID NO: 19160 - DNA, 1154 bp, Mus musculus
agaagggctgtctacctgcctgcctgcctgcctgcctgcctcccaactctctgctttggactgtttgggagtttttgaatcatggttgtctaggcttgttttggggcctatgttagcacagttcgccatggcagagagggtagagagggtttggtgaattaaaacggttcatgccgtggcagctgagaagtgagagaaaggagaaattgatagagtacataacaagcccctcccctggaaagcaatgctatgaatccatcgatgagatctgagccctcctgatccaatcaccgccgccacccccaagcctctgcttctaaattgctacaatggggaccaaaccttcatcgctggagtaggggaagatatttggtacctaaaccatagtaagtgcagactccttagaacacacacaggataaagataaaaaaacttttacctttttttccccttactatattccagggcctggggtgggccctgatgaacagatagggggattcctctctagaaacctattccctctttctccactcccttctctgtatcacaatctggctgtaacttccccctcttctcctcctcctctccctcctcctcctcctcttcctcctcctccccctcctccttctcctcttcttcttcatccttctctttctcttcctctcccatctcctcctcctcctccttttcctcctcctcctcctcttcctcttcatccttctctttctcttcctctcccatctcctcctccttttcctcttctttcccctcctctttctctgcgctgaaagtggtctccctgtggttcccaatggccttcatgctaattcagtgggcattcttctgaccagaactggtgtctctgtatcacttaagctttctgggaattccttctaccctagaatttttctctagtggcctagaggaaaattctgattcacgttcttctcccagctttcttcttcagtttcactggttatacattccgtctctttcaaggataaattctcctgtgccatccctgactctggccactccataagcacaccgctgtctctcgctaactccctcggcttcagctgccaccctcatctcaacagcctcctgagtcatatttcctacatacgcagtcacgttcctatctccaatta

SEQ ID NO: 19161 - DNA, 1199 bp, Mus musculus
ctaagagaagaagaaaagaaaaaaaaaagaaagaaacccacatgccattttttttttctgattcaaattctacagtagaatggagggcagaattactgggacacaatcaccactcagctagaatggagattcaaggaaatggaaggtactagaaacagactcctccagcctcctccccatagaatcctaagggtgggaagaagaagaagaaaaaaagcaaaagcaaaacaaaacagaaatcaaaagtacactcaagttcttgtcctgtatcaaatatccctaggtcatctgccacccactttccaagacctttctcctactcaaccaggaagtcatggtttctgcagtccagagccatggcaactgagattctaagctctctttgtctcatccaggcaacttttctgtctcccaaccaaggaattcctctgctcaggctcctgttgcccaggatagctctcttctatagccaggatgtggagcttaaggagactccaatgtttactttctccagtcctagctctgccatataaacactgtctcatgttgtgcttcttaaacgacaaagaacatagtgacttttggggatagatctgtctgggagataatgtgagtccaggaggcattactcttccctgcctcacatcaaggtgccattcaggtagttggctcccagctacttaacgataaaaatatcactttcgtatttgtatcagagaaacttaaaaaaaaaataaagtctgatggtagaaatccaatgaaatgggagaaggcaggagagagaggtctcagtagatctaagtcggctgtttgggttgaggaggagagaacccgaggaaatgaccatgctctggggacaggggtaccttagattctctgtctatttttcctctagcaagccagctgtgctgaagcccagtagagatgaagagacaccagccagagaaaaccccctctagaaggaatgtatttgttgctaaattttgtagcactgtttacagttttcctccatgttatttatgaattttatattccgtgaatgtatattgtcttgtaatgttgcatagtgttcactttttatagctgtcctttattctaaacagtaaagtggttttatttctatcacatacctgctgtctcttgccttcttgtgtcctggcttgggaggttataattgatatcagagaggatcttgcaag

SEQ ID NO: 19162 - DNA, 1173 bp, Mus musculus
tgctaatgagcatgggtgtgtatagaacgtacaggaaatttaattggaattaatttaaaaataagtgaatttttagggacccatactggtaaaggcatattggagattatatatttacacggcatccacaactatgtggctcattggtatagttaaattattaaggggatgaacaagacattaaaccagcataacttcattcacccagcagaacttgattactttgactcatcattaagtagtcccttcttcattttttcacctaaccatggctatgtccacatcaaaggaggcttttttttccttctgtaattaaagctagaatacagtaggcatgtagaccctaaaattggtgtcttaacctaatgctcattttgtccgtaaacagttactatgccagtcaaaagaaaacgttcgaaatcaatcctagacacccactgatcagagacatgttgcggcggattaaggtgagcagtgaggggctgctctcttgtggccttaaaaggaatgctttgtaagccttaccaccgatgctaaccaagcgtaccttctatcaggaagatgaagatgacaagacagtcatggatcttgctgtagttttgtttgaaacggcaacacttcggtcaggatatcttctaccagacaccaaggcgtatggagatagaatagaaagaatgcttcgcctcagtttaaacattgaccctgaagcacaggtttgtgtgcccttaactctagcatggctgaccccccagggtagcaccacctgcgaaattaacaagaaatctcctgtgtcttctttctttcccatccgctacccctgacacagggtctctgtgtagccctggctatcctggaactcacttttagaccaggctggccttgaactcgaggatctgcctgcctctgcctacagagtgctgggatgaactcgagcgccaccgccactcagcttggcttcttccttttgcctctcttgctagtttccctgttaaggcagatcagattgactgcagtacttgctaaatcacccattttgatcttaaacacttagatcaaaatagaggtagatggaggccatttacaggttgtggatgtcacctttaggtggaggaagaaccagaagaagagcctgaagacacctcagaagacgcagaagactcagagcaggatgag

SEQ ID NO: 19163 - DNA, 1109 bp, Mus musculus
attctgagattattgggtctcagagctgatacattcccccaacatagtaaggaataccgttttgaacagagctgaagccagggaacacacctaccagttgtctggtccacagtcacccacatactaggcctttcaataagccccctttttgccagtattgtagtgattagaagactaggtggggttttgtttttaaacatttgaaaatattagtcattctgtcaacatatctgagttctagcattggaatatattagaaacagttgtcgttaattctaacacagtctgatgtgggagtgccctggtgcttcctgtcccttgctgagtggtgtggcagttgtgctgtctcagttgctgctatcctggtctcagaagcaaaggtttgagataaaccttcctaaccagattccattttctttaggtgattaggaagaagcttgtccgaaaaactctggacatgatcaagaagattgctgatgagaagtataacgacactttctggaaggagttcggcacgaatatcaagcttggtgtgattgaagaccactcaaatcgaacacggcttgctaaacttcttaggttccagtcttctcaccattcaactgacattactagtttagaccagtatgtggaaagaatgaaggaaaaacaggacaaaatctacttcatggctgggtcaagcagaaaggaggtaagatgaagtgcagctgctagggtccctgggagctggaggcatacagccaatgtgggagaggaaataagttaattgtgtagctgggatagttaggcagacaccagaggacactacctttagtctttgtctcacacagctaatgtgccaaggcagaacttgaaaacacatacttcttttaatcttgtaggcggaatcttctccatttgttgagagacttctgaagaagggctatgaagtcatttatctcacagagcctgtggatgaatactgcattcaggctcttcccgagtttgatgggaagaggtttcagaatgttgccaaagaaggggtgaagtttgatgagagtgagaaaactaaagaaagtcgggaagcaacagagaaggagtttgaacctctgctcaactggatgaaagat

SEQ ID NO: 19164 - DNA, 2445 bp, Mus musculus
ttgccatggtgcaaagggtcgcacaccaattaaaggctcagcctgaaagtcacactcaacttccacttgcaccttcactgggcagaaataatcatgtggcctgtaaatggatgcacagtcctaccaggttcttgaagacagctaggactatttagtgaagaacattaataatcacagatcccaaaatcccttttaatttctgtgaaataagaggtttcctaaggtttatcttcaaaagtatgttatttgggttagtgtctgttctttgacatttataccaggttttgttttgtttttttttttttttttttttttttacttatgctggatttatataaaaatacaaaaaacatgctttttaggtatggttttgaaaaatgccataacatagactgtagggtagtgcatcactatctaaagttgatgtggtccaagctggtttctatatttctttatatggaacctggcttttggcatcatgtgaatgtgaagaagatctaactgtctggttcttgtcttgcttttagtgtgacaaagagaaaaacctgctgcatgtcacagacacgggtgtaggaatgactagagaggagttggttaaaaatctcggcaccatagccaaatctggaacaagcgagtttttaaacaaaatgacagaagctcaagaagatggtcagtcaacctctgaactgattggccagtttggtgtcggtttttattctgccttccttgtagcagataaggtcattgtcacatcgaaacacaacaatgatacccagcacatctgggaatcagactccaatgaattctctgtaattgctgacccaagaggaaacacactaggtcgtggaacaacaattacgtgagtattactgattctaacaaaaattaatactgtgaggatcaagggagaagctgatgggagaccacaaaagaggtagctctgtgggtttttaggtctgagaaggaggctaaggtatgcagagaactgtggaataggcaggaaggcctggcatggtcacagtttaagggactctgcacagttggctgcagttgctgatagttctgcttttctgttattagctctgaaggtgatgcaggagtggctggaagaagacgtgacagaaatagtcaggatttgtaatgagtagtaacaggttggggtaggggtaggtcgaagagaacaagcaaatggaaaacccagcaggtgatctgggtaatagctctgctatcctcagagcctcacatttgactggcagatgtatcaggacagtttcatagcttaggtgcttgggtaagatttccttctttcaagtcctgcatcacgagtcacccatactcatttgaattctacatgtgggttggggttacagtggagaacaggatcggtataggccctgctctcacatggggctcaaggtctttagagtttgaaaaatcatttcagagtgatgtgcaggaaagactgctaagagatgcctgcattttcaggggaagttatcaaaagactgacttaccgttcctgcttcaacacctccccacccccttaaccccaccctatcatttagcttctgttgattgattttatcacttcagagactaagaataaatttttccttggcttttaaagtcagatttgcccacacacatcacattttcaacatgaaaaggttcagtgtgcaagtgtttgttggggagaggagaaagacaggtaataaataatgtgaaggcccttttccactgcctgggtcccatgctcccctccctgcagtgaagcatctttaagtacagagtcactctctgtgtccagtccacagttgaagaattgcttgtataacatgcactgtatttccataaaacctatgctccccccatgttctaagtcatatcttaggtacttatagtattatattatttaaggagcagtgtgacaagttatctacatgatgagcatagagacaaccataaataacctacaggcccgacagtaggccaggtcagcagtgctatgaagtttcatcccgtgcttggtactctctactggtgcaggacccacagtatgaaaggctagtctatcttttgctttgcttcccttctgttggtgtcttgggtcatctgctgtctttgtattgtgtaagtcaccagacggcctgttgccaaagtccaggtgatttagagagatttgattactactgctcctagtagcatgttttttattgtcttcatgattccccaaacttggctctcctgctgctctcaagctttctcagtgcctctcctatgtggggtgcctgtctttacaatttttctttacctatttcctcggtggtgataatctcatctgaaaagttctgactctcagtatctgttccccacactgttcctgctgtggcgtcatgtccatctctgtttctcatatattcttagcctagatcacaagtcagaaaa

SEQ ID NO: 19165 - DNA, 1099 bp, Mus musculus
gatgtagcccactcagcttgtgcttccaactttctaagacctgacaggacacttgattggttttgtctgtgtgaagttagtactatgaaaaatagaacttttatgcctttaacttttaagaaaagggcttttcaatcggtgaggtatattttcaattttggccttctaggaattagtgacggtactaaagtgttcactgtgcaagcgtacacaagtcatgacttgcttttcagtagagggaagccagatgtatttttctgggaattttaggaactatttccagccgagcattaagcacagcccattctgtgatgagagtgagctggtatgtgagtgctcttttaacaagaaggtctgcagaggccagtctgtgtcctgactagagactgagaaaaatgaagctgagtatttgcttatctaatttgatttccttagagaggaagaagctattcagttggatgggttaaacgcatcacagataagagaacttagagaaaaatctgaaaagttcgccttccaagctgaagtgaacaggatgatgaaacttatcatcaattctttgtataaaaataaagaggtaagtgttacatggttgggacagcagtttggatccttccattagaaattaggaattaaattcggaatgagaattcttattggtccatattggggcaggaagggagtggacattgtcctggtctttcgtgtcagctcagaataaggtcatgacctaccgacggatgaagtcacacaactgtacccctgagggagggtgggagaggtattcctgttcccaccacttcagatatcccttgtagttgtcacatagtgttatagagccacacctccttttttatgaagagagtaaagccatctcttgcaccataaaaggcttggttccttgaagagtgtcttcacgattccgaggagaactgagaggagtggataagaaccaacatcttaccatgcttaggggtcaatcgcaactcattaaatctggcttctttttagattttcctgagagaactgatttcaaatgcttctgatgctttagacaagataaggctcatctccctaactgatgaaaatgcactcgctg

SEQ ID NO: 19166 - DNA, 1330 bp, Mus musculus
cattcatgagattagtgcgttgcatgccggaaactgtagtttctcaccaccatccaaacgcattccggatattcaacccctcacaaatttctcttttgcgaaaagaaacgcccaaaagaaaggtgacggcgaacgtagcgctgaaaggactcgtaacgtgacccgcgtcgtagacgagaaaagggtaaaggacgcattgtcttggctaccgtttcccctagtcacggactaaacgttcgctagaagccggaagtggttccccgggacctctaggaatggacagacgtgctatgcgcctacgttcattggacggttttcctcagggaccaaggcttcccaggccaaagggtggcccggtgtgtgagggcccgcggagccatctgattggaggaaagccgctggacaagcccaatcgcaaggagccacgcttcgggcatcgggcaccgcacctggacagttccgattggcgggctgcggtccccccccatgcgtctccattgggtgcagagagtgcgtggtgaggcacgattggtgagttcgtgtttcccgtcccccgcccgcaagcagtggggtgaaaagcggcccgacctgcgcgcggcttagtgggcggaccgcgctgctggaggtgtgaggagcttagactcgggattgggggggtggaggcggctcctgagaccgaaaaggacttgcgactcgccggccacgcaccatgagggtcctgtgggtgttgggcctctgctgtgtcctgctgaccttcggtgagtgaccgggcggcagtgggcgccctccccttcctgtgtggccgcttctcgaacgttcttggggcgttgaacctgggttggggacgccgggtggcctacaggggtttcagggaccatctcgttccctcgaaggagacttgggtgatgatgctttccctgaggcctctgggaaaaggcgacttggagaccgggcatttaaataaataccctgcggatggtgctagagcgctccccgaagtctcgctgacggggcgcggtctctcggactctactcccgggggaagccttcctggaacccctccctaaggacttttgtgatcaggtccgacctttggccaccagagcctgaggacccccagcccctgccctctactcccggagcgcgtttctgttttctaacgcccgactcgcgagcgtgggccctcgggccagcgtcgtggcggtggcccaatatctgattccgatgtgcttcaagagctgtccttgacatgtcttcccctttgggccggatttcagttcccctcaacagaagttgcacaaaccctgtttgcattctgacctgtgataac

SEQ ID NO: 19167 - DNA, 1186 bp, Mus musculus
tgtgatggtaggatattttggaagggatttttgaaaggagaatgagaccagaaattgtcatcttacaggagataaacacacacacacacacacacacacacacacacacacacatatatacacgaaggacaagaaaaaaaggagagagctctcacctgattgatattttcagagctataccacggtttttgtctcaaactaaggagaaggttacaatcaatcaggttctggtccagtaagagcaggttagctgtcaccactgtgcctgatggtgccagcgaaatccaacaaacttcccacaactatcagacccattttccaagtgagaagacagtgtccccactgggaagagactaaggtaggctacacaatggctaaggtggggcttgaatccccagccagcctcgacagctggcacccaaaatcatccacgcatgtttgcacccaggcttcctgcacaaagctaatctggcccaggcattcctggctcctccctaggtggctatacgcacctgcacctgcgtggccagcatgagatatcaggctgattttatgcattctcttccacagctgtgtctgcaatgacggctatgaaggagatggaactctctgttctaagaaggacccttgcctgggatcgacctccagaggaggatgtagtcctaacgtgagtgttgtttctcagagccaggtgccccaggttttgtttcacttaccttttgtaagtaggcacaacaggagttactctgtggaagtgaaaagcagttcgttaaggtaaaaaaataaccttccacgctgataacctgccatgctgcttcagaatagtggaagacagtgacagctttgagcttgctttttgtacatgggtgtaagacagggggttgggggagggagcagagtcggggagagggaggggcggggggggacagctcgggcagggatgcagggatgctctttcagacagaggaggtgctgacagctgaagtcaggggtattcagccagccgtgaagggcttctgaggcacactttaggcttctgtttcctggccaaaccaacccaggtaggaccagagccatcaccctacacagccaccagctctgctgttgttttgtggcctaacacttttaaaagaaatcctgagggagagacatcccagaaagcagtgcctgattcacacgcacaaag

SEQ ID NO: 19168 - DNA, 1218 bp, Mus musculus
tataccaaaagtcccccatacccacccacccccactcccctacccgcccactccccctttttggccctggcgttcccctgtactggggcatatggattctgaagtcagaatgcctttgggagagtcatttttgctaagcattttggttatccattgctatgtgataagtggtccctctaaaagaattgcttaaagcacagcaggcattattttgatcattggcctgtaatgttaccagggtacaatgggggagagttcatctcttctctatacggtgtcagctaggatgggtcttctaagattggaacattcacttcctgctttctcacatggccggtgatttcaacagggacctccttgggtttcctcataggatggtggctcaaccccaagaatatatatatatatatatatatatatcccaagatagcaagacagaagcatgacacatagaaatgacctggcctctgaagtcacccagcattgtgtttggcagggcagtgttgttgtggtttgaggattgtctacttccagactcaagctaaagcttgatatcctttaactgtattaagaggtgagatcttaagaacctggatagctcagttggtagagcatcagacttttaatctgaggctccagggttcaagtccctgttcgagccctcagtttttgaatctgcatttataaacactattgttaggctgtcttgtttgccaagagcactataataagaagaggtgagatcttttacaagaggtgtttaaatcataaaagacttgcctctatgaatggttcaataacattaccataaatttcttttcaatttaattatccagcctcaactattacatcatagcaacacaaaccagggtacaatgggtgtactggattacactgcaagttcatgagcatagaatcaaaaactatggaaaacccatgcttccataatctttcttttggataactgctgctcatccttatgtgaaataaaatagccttttttcctagaccccccaggttttgtcctattatgtcattaggcatagtagtcaattgagtgtcactttcacctgtgtctagggagcaagagatctgctcttcttgcaaccagcatatgatatggtagctattgaacaccccatgtacatattttcatccaaatgggggggggagaataagaaatatacaacaattacatatggttggttgtaagtttgg

SEQ ID NO: 19169 - DNA, 1178 bp, Mus musculus
tacaggagtctgcgacatgagccgcagtgtttccggtggagttcatgagcactggataagaatgtagtgcacccacaaatgcgtactgcaccacaattgcaggggagctacagaatgcaacttgcgtgatgcaaatgcttcgagaaacacttcaaacttactatgtttgatttttaattaaatcttgtctgtcccatattcagaaagcttttactattgccaaatgttttgagacctgcctccccattccgttacacaactccatgttggttcattaccacagtttaagagactgtgctctgagagagctgggaacactgagatggagcaattgcacaaatgaccatcaaacagaagcagcctgtgctggaagcttcatttgaaagcagatgttctgagtcactgtgctgtcccatccactcttcaatcagtgccttccattaagaaagccacctgagaggaagaggcgggctggtgttggaggaaaagagcgccaggaaggtcctgggtttgactctgactacactgctgccagactgctctgttatgctggtggttggctccaagctgcatcggacgctgggcgcggaagccccggggcatggagaactccagtacctgaggcaggtggagcacattttgtgctgcggcttcaagaaggaggaccgcatgggcactggcaccctgtaggtgttcggcatgcaggcacgatccagcctgagagatgaatttcctctgctcacaaccaaagagtgttctggaagggtgttttggaggagttgttgtggtttatcaagggatccacaaatgctaaagaattgtcctccaagggagtgagaatctgggatgctaatagatcccgagactttctggacagcttgggattttctgcccgacaggaaggggacctgggcccagtttatggtttccaatggaggcattttggagcagagtacaaagacatggattcagattactcaggacaaggagtagaccagctgcaaaaagtgattgacaccatcaaaaccaaccctgatgacagaagaatcatgtgtgcctggaacccaaaagatcttcccctgatggcactgcctgcctccttgccatgccctctgtcagttctatatggtgaatggggagctatcttgccagctttaccagaggtcaggagatatggg

SEQ ID NO: 19170 - DNA, 1205 bp, Mus musculus
agcgtttggaagctgattatgggatggatccccggatatggtagtctttagatggtccatccttttgtcacagctccaaactttgtctctgtagtgtgtgtatcttaatccttgctcctgttaaatgatgtgccagtggatgctgacactgtcgatataaacaaccactggttatcctatcagtaattatcggaagagaaatacatagtagaggaacagaagtaattgggctggtgtggtggctttgaatcttcctgaggacaagactcagttaattcttgttgggtgaatgtagggactggattcttttccttacaggcatgcggtatttgctgtagttccagccgctccagattcctgcctggaaggtgctggaaaacaggcaaagattaaatgatggatgttgtgattcagttattccctgtaaaacccttttcttgaagccccaccgggttgatcttgcctacctctcataccatcacccatcattgcaaggcatggcaggaaaggaatcctagccgtcgtcagctgtcacgccaaatgatgtagtttcagtttttaagggaccttagtagcatggaaattatattgcagctaggtaggctggtgcatgtgttagagaaggagggggcggggagagagagacacacacagagacagagacagagagagggaggatagagagttccaggctggcttgtaaatgtcctgttgcacatttcaatacctaagtaaagaaatggtgctggaagctgaccatctggacagtggtttcattggtgaacagtggagtggacaagaggaaaagccaggcttaatcccctttttaatgtttttttatttggaagtttttaaaaataaagtcttagttactaaaaaaagaagttttaagagatgttctgggggctggtgagatggctcagtgggtaagaacacccgactgctcttccgaaggtcaggagttcaaatcccagcaaccacatggtggctcacaaccatccgtaacgagatctggcgccctcttctggagtgtctgaagacagcttcagtgtacttacatataataaataaatctttaaaaaaaaaaaaaaaaagagatgttctggtgtgcaataactaaatgtgcattaaatgtagctctacaaaaacctggaaaaatgtccatcctcctgtttatgttacctaagttgttctagtaagcatca

SEQ ID NO: 19171 - DNA, 2636 bp, Mus musculus
tctgttctctttagtgtttgtcttcatcgtgactgtgtttgtatctcaaatgtttgactttgtaatcctaacaatgctgcgtgcttaaaatgctgttggtatgctatgtagctaacagtggcaaaaccctttccttctctttctttaaatataatttagaagtacatttctcatgtaaacaacccactgattatcattcttggatattttttttcctgttgtgtatatcttgggtgtactggcaatggagatgggaagggaatggggatctttcgtccccaaacataatttaagattcctcatcctctactccaaaccccgagacattcttcagtggatgtttaagaaacactaatgggtgctgcatcgctgggtggcagtgaggcattgtggtgatactacagtggccacgtttcaaggtctcgattgccacgtgctggagggtgcagatgcagaacattctcatccttggagggtgcgctgctccattctggctctgcattagaacttagatgcttttctctccccatcatctcttcccttccatctctatcaagcagcccccgccagtccttttcccagacttaggacttttgcttctgttttgtggcccatttgccttagctggggccatctatgtgatggttggattggggctatccattagaacccgtcaggatcactggtgggtgcacagatgagtgcaatgactctcccctgaatctatcagtagcacaaggttcagcagtaaagagtaggtccctaagcccacctccatggctaacggttgataggttcgttcttgtgcacattgtgagcatgcatccacagatgctgagttcctgactgcaatggatgctttgcctagatgatggcaggttggagcccttctccctatcttttgtggcttacattctttccatgcccccttatgcagtgttcccttaagcctagagggaatcttccttttctccacccccgcatttatgtatctgtagacacacttgggcatttaagtggagaggccagagtagaccagagtttaatatcaggtggttttctctacctcaattcaccttactttttctccttaggttctcttgatgaaccagaaattgaccaatttgggtagaatgtttggctaggaccttgtctttgtgtgcctgaagcacatgctggctttttactgggcctctggaggatctgaattcaagtcctatgtacagcatcattttcctcacagacacctctgccagccctgttttaggtcttgcctcctcagtaggaaatgagaaatttgtgtctcatagtttccttatacctattttcactcaacaaatgtttttggtcatatattgtatgcaagtcactaaactaagtgctgagaatttggttgtggataagatagtttcaagcctttttgcatggagcatatattttaatgggaaaggcagtcattaagtagtcagataaataaccagaattatatcatgaaatgtatcatagctgctagagtgactcttgaggaattgactaatggacaccaccaatttcttagctactgacaagttggaagcacagaaagctggataggaatttatggctgaggcctacagataccatcagcattttagtgcagtcaataaattaagtgatgttcaggctgttttctgtgtttttctcgtttctgacatagaacaatgattatgtcagttgctctgtggtttaaagccacagttattctgagaggacacagttgccatcagtgagcagtgactgatccaaaagaattctggccgaggtcttgccagtgatggaaagaaacggtatgttcttgcagctgccagaagttatgctattctagctgatggcaactttttttgtcttgaaaccctttctgtattgtgacttgtgaccacatgagtgattgctgagaaagcagagagcatgctaattcattgaacagctttttatccacagataacttcaagttgtctggatacctcatagatgcttttgataatgacattccagagaatgatgtagaagataaacctggaacattggggctttactattgttcattattttagttgtctttcactctttacaccctcagtgctgttactctgggaagtcctagcagctttctttagtacaaagggggcaaaagaactgtagttcttttcttggagatattttttgttagtgtgtgtatctttttttttttaaaggtattttcctcatttacatttccaatgctatcccaaaagtcccccctacccactcccaccttttggccctggcgttcccctgtactggggcatataaagcttgcaagtccaatgggcctctctttccagtgatggccaactaggccatcttttgatacatatgcagctagagtcaagagctccggggtactggttagttcataatgttgttccacctatagggttgcagatccctttagctccttgggtactttctctagctcctccactggggccctgtgatccatccaatagctgactgtgatcatccacttctgtgtttgctaggccccggcatagtctcacaagagagagctatatctgggtcctttcagcaaaatcttgctagtgtatgaaatggtg

SEQ ID NO: 19172 - DNA, 1068 bp, Mus musculus
aatatgcaaatatttagaaattgataaaagtcatttgattttggaaattaacaataataaaaattaaagaatagtttggattaaaggtaaatatgacataatttgtggaaccagctaatgtgctttaagggaaacatatgcttgtaaaattaaaaaattaaaaatgggttcacatcttaagcttccaatcttaaggaattcaaaaaataaattcagaaaatgaaaagaactgctaaacataatacgacttaacacaatgtgagttaattatacaatagaaattgagcaaagattagtaatgcctttagtggtattgatcaagaaggaaacaagagttacttattacttacatcaggaatgaaaacaatattactatgattcttaaagttaatgaaagacagagattaaagaccaaagagatggctgtttgtaaactgcttgctgcaaatgtgaggactcgaattcatgctccagcacccctctaaatgttaggcatgatgacgttccctggtaatccccattctggggaagccaagacagcaggatctgtagggcttgctggccaaccactgtagccatatcactgcattccaagtccagtgagagactgcatcaaaaccttatttttttaattagatattttcttcatttatatttcaattgctatctggaaagtttcttataccctcccccagctttgctccccaacccacccactcctgcttcctggccctggcattcccctgtactggggcatataatcttcacaaggccaagggcctctcgtcccaatgatggccaactcggccatcctctgctacatatgcaactagagacataagctctgggagatactggttagttcatattattgttccacctatagggttgcagaccccttcagctccttgggaattttctctagctccttcattgggggccctgtgtcccatccaatagatgactgtgagcatctacttctgtatttgccaggaactggtatagcctcatgagagctatatcagggtcctgtcagcaaaatcttgctggcatatgcaatagtgtctg

SEQ ID NO: 19173 - DNA, 1097 bp, Mus musculus
gctttaaaaaaagtcttatatttaaatctatcaagttttatatttattcttgcactttataatcgtagcacagatagtttctgtctttttttcctttccgcaggagacccagccaccccattgtatcagctgaaaggtttctttcctcaggttgctttgctttgatgtctgtgtgaaaagttaaatccctaacagtaaagagttgtttgggacttcctaactcatttgtttaatgggtaatgtatttatttaaacgttattgctgtattatcttgatgcataatacatatacacttcctagggagcagactttaagggttctggaatagctttgctatatatccgtttgtatgaggaatttttatccagcaatatagctgctttggcaaggaatcacatctaaagaccttctaggtctgtgtgatatggctggaatgtcacacatttaatccctctggctagaatatagacacatccttagtagattcctttaattacagataatgaaggcaaaggttgtagaaggaagcagccatgtttgaaagttgcatctaattgaggggcagacagagtgacaaatgagagaaagacttgacagaaggagttggatacgcccaactctgacaagaccaggagttgaaagtcagttgatgggagtgcaatgctgttgagtttgtgactgttcagttcttggagttcagaggcaattttcactaggacagttttatagacaggttgcagagagaacaaggtagacacaggtgaagactgaatgacccagagaatgagaaggagccagaagagtagaaccaattgatagtgttagtttgaggccaaacagagcaatttagtcagaggctgggagaagccagtttgaattagtcagctgggaaaggagttagagccagaacagctatgttgagccagccaaccagaattcagaaagagctagggagggtgagcttattcagcagtaagcctccaagacaacaggcgaggaagagatacttttacaaactagtttttataataatattgaagttgactagacagcttgtttctttttcatgattgctatgtatgctaagctttgtttt

SEQ ID NO: 19174 - DNA, 1122 bp, Mus musculus
ctactgctgagctgtgtctctagctcttttgttcctttcggttttctcttttagatggtgtaatactcttttccaatgtggtcttgaactcaccctgtaacccacctaggccttaaattttcaatcctccttaacatttagaatagcaagaagaccaggcctggtttttgattgtcttttgataactgattataaacactccttatacactattttggacattagatatacatattggaaatattttgcttggtttggggcttgttattttaacttgtttgtggtatattttagtgacccagtctgtttaatattaatatatgaattttttgtgtttgattatttctaatatgttgtttttaaaagaattctttcctaactctgcaattattaacatttttccatttttttctttttagaacgtaaatatgctcattttcacatttattattaaatctaaaagatttagaatgttacaagcggtggtatatttaggcttttatgtttctggtgtctacaaacctcctggtccattatgcgccctctttcggctgatctgctgtattgtctggaggacgacgggcttccttgaatgtgtgggtccctttctgaattcttcaccctgctgtcagatcaattgccttatctatttatatttttatgtctagtaaatgaagcctatcagcatctcatcagccattcatttctcttaagcagttccttggcaattcttggacaattcttagttcaaaagcatgcggcttcccataggactttctctgaagacacactaacccagactcccagcaagtgttgaaatggagggagcagacatctttgcagggtaatgattttatagaggataataacactttatcctggagagcaaccttagacctcctgtctactgtctaaatggcaggagattcctatttctgccttactgatagctttaccaccatttgttggattttattgaatacttaatactatatgtattttagaaatggtgatataattttctttagtttttagtaagctaatagattgtttctagtattgaagttttcatatgcctgtaaaacaaatcttttatttatattcaacttggaaatatttcat

SEQ ID NO: 19175 - DNA, 1492 bp, Mus musculus
aacagacatttacataatgcacaagttatagcaacatcaagggcttttctccccgcttgcaatgaattgttttcttctgtaaggatgttgcggaccagcaggtatcagacttgccaacatggtcggtagactcttcccagcatacacctgagcactgaaagagaacaaacaatgactataaataccatgcagaattgagaaaaactgtggacttacaacgaatccagaataaatcaaactctattactgattttgaaaaatccccattttttgacacgggtcgcctactatttggtagaactgaattatgggtcttgattttgttatggtcagatccaactcatttaagctcagagctcttttataaaattaatatataggaattgaatgtttagaaagctactcactgtcaaaatctctccttcctatgggaaatttagctgagttttcttcatccccaatttctctcttttcctgtgtggactcagcattctgaactccattctcagctgggaaggctacggatcctttcagagcgaggtaaggttttacagccagactcagtggcagcccgtgagttacaagattctgtttggagcctgtgttctgtgaagagaagttcggtttgtatcccagctgtcttctttaaagaagaactaaaatacagttgtacaacattcttgctgatcaattctaagaagctctacactgcgttcacctcccaacatgtgagatacaagatacaaagattttggataagatggagaaatacctggtttatatgaaattttcctagttatcttaatgcacacgatgactgtttgcatgtatgcctatttataaaattaaaatacaaagtttacttctgggtggtttatacttataaaaggcagactatatatacttacctttgaattcttattgtcatcatcgttcatgaaaccgctctcgtcgtttttgtattgttccagagaaggggcgacaacggatctttctgcagtatcttccttctgaaaggctttccccattcgaaatgtattaaatactatgtcatcttccaaattccttatggacttggaagctgaaagtaaaataccttgagaaaacaaagaaaaagccagcattaacatgtaggaagagagagtcatctttgccatccttagtttgatgcttgcataaagccaaacaagagtgcattggatgaaaactttcacactctgccagtggctaaatgatccccacctttatatactttctgtctgaatagaaagcacttgaaggccttatcttttcagtttagaaatgactcaccccgtagagcctttgtaaagctgcgaatgcttgcattgttttggatttagtggcctgttgtttatttcgtgtgtaaattttctcagaatctgattaaggtctttgagagaaggctttctgtgagtagattataggctcttcaaagtgggatgttattaaggaagaccacaggataccaggc

SEQ ID NO: 19176 - DNA, 1181 bp, Mus musculus
actgcgcagacaacgccactggctggcacgtcgctgtcaccgagatgcgttcgcagagcagcagcccgaatgcccactggaactgcgacccgggggcacagaagagaccagacccacctcgtccagtgacccaggctgggtgcaagcggagggaggagcagcgcagccaggacgccggaaggcagaggtttgaatcgcctcggcgtccctttcaaatctcgcggcacgacctgggaaccaatcgccgcgctcgccctccgacccggaagcagagcgggcgcacgccctggccacctatggtcgggagagccttgcccaggtcgcctcccctgctttaggtgcgtatcgagtgcggtgaccggggatcgccagcttgtgctgcttccccaggggcgcttccctgttctccagagctcttccttgtgacctcgcgaggtgggagtgggttttctcgggcgacgcgtgggggacacaactccagggaccctgggaatattgacccagggctttaaagacctggaggtcaggggttgccatcaaatccggacctcaagtcccctgcatgccttatacctctctgctctatggtcttctcacctgccggtcccgcgtaacatgtgtccagtctctctgagatgggacttaatctgaaaaaactcagcagataactcaggattttacgtgttctttcttagcctagggtgcctccttttcattaacaacaaagtaaaaattaatttgcacgtgagaatgctatttctacagtacacactacctgtctcgagacaaattagttgaggattgtgacaggtgttaataacgttagtatcacacattactccagagcctgtattttttaatctccttattttattgcatgggtaatggttggttataactattgctacctgatattatccttcaaggctcttggactccatgtgtctttaggcaggggtgggactttccagttcatcggacccttgatagttcaggtggtctgtcaaattagaatgttaaaggtcatataattcgaacaaataatgtagcatagtcctgagataggcaggtgtgtgtatttgtgttttctctagcatgtaggcccaacacatgctaaatcttttaaatcctcaacctgttgacgaacttggcaaatttcttcataggcaaagaagggacta

SEQ ID NO: 19177 - DNA, 1200 bp, Mus musculus
taaatctaagaaacagttttcatattgtaatttttttaagattgggatttattgtataaatttatgcatttggttacgtatttcatatatttcataacaatttattaaacatctaaaattattggaatcatttcaattattggagtcttataacaaggaaatactgagttacaagggattactaatactaataatagccactcttttcttgatttaagagttcaatatttactaggtgcttgtagaacaagcctataggtatctctgatacttatgcatttggcttctgcttgtgatatatatgtgtgtatatatacatacgtgtgtgatatatgtttatttttcttttatgacattgaatctgcttctttctcaaatttagctgatgagatacatgtagaattttcttgttccaccctgtattacagctaatggttgcagagaagaatggaacaatccggttttatgatctaatggctcagcaggcaattttatctcttcagtcagagcagacacccttaatgtcagcacactggtgcttaaaaaacaccttcaaagttggtgctgtggcaggaaatgattggattatttgggatatcactcggtccaggtagttatttaatatgtctgttatgttacataaatatgttgttaaatgacccatatagtcattcttgtacatataggcctccatgtcctatggaaatgtgtgtctcctgtagaaaaaggagagaagtgctgtccctgtggggcctcagagtggttctaactcatggccattgttcactgtttccaactgagtgcttacttgggcttttgttaaatttattggggtccaaagagaaacacctttaaaaccttcgttcaagttcatctacttcactctaacacataatttgcaaaatgcaaactcttgtttttctagttatcctcaagaaacaagacctgttcacatggaccgagcacacttatttaggtaatgtcctgtttctgctggagttgtgtggatgctttggtagggttccactgccagaataagttcctggcctcctcttcggtgcagtttggggattgcttttcctcttttatctggctgctttataagggttgttttgctttccctactaagtagttgctttgtcttttgctttaggtgagcaggacatgtattttttcaaccacttagaaaatgtttataat

SEQ ID NO: 19178 - DNA, 1156 bp, Mus musculus
ccgcatacacatacactcacagtcactcacaaatgtaaacaaaaataaagtaaagctttggacaggctagatagcacatgcctttaatcccagcattctagaggcagaggcaagcaaatattggagttcgagaccagcctggtctacagaacaaattctaggatagctttccagggctacacagaaaaaaatttaaaaaggaagaagttaattaattaattaagtaattgattgattgattaatttcaacagttttgcccacagcccgatcttatgaaagcatttccccagttgaggtcccctcctctaagatggctccagcttgtgtcagctcgacctaaaacttagccccctgagagcagagcaggcaaaggatgaagacgagctggcctttagagtagctgcttcagtctttctgtgtccactgcctctcccatgtcccagtccaagcaggatgaggacgtgtctgccagccgctttgaggataatgaagagctgaggtactcgctgcgatctatcgagagacacgcgccatgggtacggaatattttcattgtcaccaacgggcagattccatcctggctgaaccttgacaaccctcgagtgaccatagtgacccaccaggtgggtgactttgcacgtacggcgaggctgcggtttcctgtctgtgctttcagtgtggtacagtgatctcacgatgtcgtggccctccccctttctacctcctttctgaattaacagtgtcctcttttccctctttctgaatgcccaaccaaatcaaagcagctcacctttgccctctgtgtgtgttttctgttaaaaggacattttccaaaatctgagccacttgcctactttcagttcccctgctattgaaagtcacattcaccgcatcgaagggctgtcccagaagtttatttatctaaatgacgatgtcatgttcggtaaggacgtctggccggacgatttttacagccactccaaaggtcaaaaggtaagaagagataggtgggcgcctagctagaaaatcagtagcagatgaggaaatccatgtgcatatttctgtatttgcgtattaacaagcaggcatttttgacttccaagtcagcagttaggcggtaagaggactacatttagagattgctttcccacggtc

SEQ ID NO: 19179 - DNA, 1844 bp, Mus musculus
gcatctgtgaacatctccctcctcgacaccacagcggagtccctgtgatgtggcacagaggcagcctcgtggggagaagggacatcgtgcagaccgggttcttctgcaatgggaagagagcccactgacctggaattattcagcacactaagaacctgtgtcaatagcttgtacagcttgtacttttaaaggatttgccgaaggacctgtcggcttgttgacaaaccctccctgacaagctgctggtttcttcccccagttactgcagactgagaaaccagtccatcttgaaagcaagtgcggaggggccccagtctttgcattccaaagctttccagcataatttctggcttgtctcctcctttgatccatttcccatttttttttaaaaaacaataagtggctactaagttagtcattctcacttctcaaaataacaaatcaggatgtcaaaacatttgtatagatcttatttaaataatatagaacgattacttctttagcctatctaaattattgatttttattaacagtcaagtggtcttgaatcgctaacaactactgaagagctcgagattgacgttgaaagtgctttgagcttgtttaactcattccccaagaatactgtgacctcgtgtgcgggcctgattgcgaagggctagtgtcacgtagcagtgctgctcaccggatgtaattatgtcgtggaaatgtacatacaaacaaaagtgcctcacttcagaaatgagtagtgctgatggcaccagcgagtgatggtgtccatttggaaacccatgataccttccaatgcccaccctgcttactttatacagagcaggggttaaccaacttctgtcaaagaacagtaaagaacttgagatacatccatctttgtcaaatagtcttccttgctaacatttattattgttggtgttttgggaggtttattttattttattgctttgttatttttcaagacggggattctctgtgtagctctggctgtttggtaattcactctaaagaccaggctggccttgaacttagagattcacctgcctctgcttcctgaatgctaggacatgtgcccacactgcctacccaccccccttttggggggggtgagcaactcaataaaaagatgaaaacctgctttagtttgcagctatacaaaagcagcaggcctcagccagacttgacccccggggccattgttggcccacgggagaatcatttttgacgtgggtaagcaaaccctgatattggtcatgctgtgttatgtcattatgtggtggttttgaattctggaagatatcttcagtcatgatctcagtagtattcctccaaaatggcacacattttcgtaataagaacttgaaatgtaaatattgtgtttgtgctgtaaattttgtgtatttcaaaaactgaagtctcataaaaaaacacacttattgaaactttgagtttattgttagtatttttatcttaattacatatgagtattttgtctgcatgcaccatacagatgcctggtgtttttggagaccagatgatagcttcagatcccatagaactggagttacaaatggttgggacccatcacctaggctctggggactgaacccatatcctctggaagaagagccagtgctcttaaccactgagacatctctccagccctgtgctttgagctttaagtctctgaagattggggttactgttgtccagactgaacagtcaatgggatggttgtctgtgtggtgtgtgcttggctctcaggctctgcactgaacactattaagtgtgaagtaatgtaaagaaaggttaaatataacatgctggagaat

SEQ ID NO: 19180 - DNA, 2057 bp, Mus musculus
atcccaccaccttaccttgaaaatgaagttctgtgcccttgtcacagaccagagacacagtgtttgctgtcttagtttatagctgttccgcagatgtattgactccagcttgttgagaatataaatcagtttttacttctgaattgtgcatatggacaacccagtagtaacagcagaatatagatacctggcactcaatttgactgtgcctgcttataatctcaacactttggaggcagaggcaagaaggaattcaaggccaccttcgggtacttggtgagttcaaagttagttcaaagtttgtctcagaaaaggcagaataaataaaaatcaatagatacttagtagatagtaatcttagtctttgtactctacctccattgcaaaatttatattattgccgttcatactttatactttagaagttagttttgttaaactgttgccctttgtttctccaggttagttgaaaccctgaaaagcagacagtgagcccattcacgtcagcgcctgtgagccaacgctacatcacatactcattggaagcagtcaggtgtgcttcctgtgactgctggagctgtgcgattctggcatagacagacctgcctgacttcaatatttgtaataaatataaaaacaagtatttggtgagagggttagcttgattgaatcacccaaatggtttatgtaatgtaaaatatttcttcctggttttcatgtgttaaggtatatattctatttgtatggaattcttactcagatacagttctattaaagaatgtatactcttagggggaaccctcctatttttaaattagtggttgcatcttgtttgtataaacactaatatttagctcagactctttcccccttaaaatgaattaaggctttccaaagattagtcttagcaaagtagattagaaatacagtgtataatcttcatttgcttaactgactagtttattttgttggctcactttactgacttatgttattttacagtacttatacttgtcaaaagaattttgtgtatgttgatctgaactttgtacaggaactctgtaaggaaggtggggttctgctatgttgctttgccaggccctatacagtgaggtagggtagggttcagagtcaggcttgtgggtcagaaacttgtgtcctaaattatactatctccggatataccaacactgggaacatagacacctaggtgtggtggcacacacttgtagtcctagtacttaggagacagaggtgggaagacccaagagttcagctttgtggtgaatctgaggccagcctgggctgcttgagactatgtctcaaaacaaaacaaaaaaacaaccaaccaatcaaaaaaattatgctcaagtagttatggatttcaaagtaatgtttatataaacttgtctatgctagtaaaatgataagggatacggtccacactatcccaaatggctgtttgatgaattcacaacacaatacaaaaccttcacatgaaaagaaataaaaagcaattttaataagcagtaacgagatgtctttagtgtcttccattcatttaccttcgttaataagatgtctttactatcttccattcatttaccttggtatgaaattggctaaaaataaaaatcttactggttctgtagcaaaaatattcctagttttaaagattaggtatactgtgtaggttttaagattgtgttctaaggaattttctgaacagtaatctaccacagtgagcagcatggtccatatgtgttactaacgctgtggctctttcagtaaattggacaactggcatttaaaaatatggcattgggactggagagatggctcaaagagcaccgactgatcttccagaggtcctgagttcaattcccagcaaccacatggtgactcacaactatctgaaaatgggatgtgaggacagcaacagcatatgcacatatataaaataagtcaatctttgaaaaaaaattaggcattgatagagacttgggctctagccttttcctgccatacatgtggtaagtgagtgggatccaagctcc

SEQ ID NO: 19181 - DNA, 1233 bp, Mus musculus
tttctgtgattagatcctgtgctgaagaatttatcccaggaaatcatagaattactcaagaagctggtcgggctggagagcttctcactagcctttgcctccgtccagaaacaggctagtgagaagagggctctccgcaaaaagaggaaggccctggaggtgagtgtgcggttgtaaatgtggcttgtctactggcttaacaagtgctccaactaggggtgtgctgtgcacacgtgtgcactgttccctgggagggggatgagggcttcagaggaggagtttcattaatgacacatgttgctctgcgtgtgatttggggggattcttttcacatgtactttaaaagtaatgaaagatttctggattctcttcaagtttgtaactaatcccgatattgctgccaagaagaagttgaagaaacataaaaataagagtgaagcaaagaagaggaagatagagttcctgcgccccggctataaagccaagagacaaaagtcccacagcctcagagacttagcaatggtggagtgaggtctctcgtgtgcattaactcagctggttccaccagggtgaaaacctgattgtcctgcgttagggtactgggctgaatgtccctatgctaagctttgggcggtgggtgtggtggcttaacacctgtaatctctggacttggagggctcagacaagaggattgccacaagcttcagagcagctggacagagaccaggtctcaaccaaaagaaattaagttaaaactttggcatagatttgtaatgtatattttatgtaaccatacttgtatttttaattaaaatgttttatatgctactcctgcctgaaagactatgatacaacatgacatgatttaaagccaaccttttcacaaaaatcttggtggggtgttgcatacctttaattccagcatgctggtgtcagaggcaatgatctctgagtttgaaaacatagatcctgcctcaaaaaacaaatatataaagaagagaccagggctggtgagatggctcagtgggttagagcacccgactgctcttccgaaggtccagagttcaaatcccagcaaccacatggtggctaacaaccatccgtaacaagatctgactccctcttctggagtgtctgaagacagctacagtgtacttacatataataaataaataaatctttaaaaaaaaaaaaaaaaaaaaaaagagaccagaaaccagtagccaggcagtg

SEQ ID NO: 19182 - DNA, 1184 bp, Mus musculus
acaaggtttcactttctgggagaatcacactgttgtgttatagaaaaaattcagcagtagaaagactcgggttttctctttttcagataggagacatgtctttaagtgacaatgccagcatatgcttgacaagtatcatcaaaaggctagctgctctgaatgtcacagagaaagagtataaggagatcattcaccggacactcctggagaaactgaggaaggggcttaagagccagacagaggtattggaaccatgacgtctcgttactactgtctacaggtgttctccctcttctgctgttgaaaagcagtcaggtttagtctaataattaaaatagttaccaactgtcacaagttttctgggggtaggtttttattttacacagtttttttcttttcttacagtggaagaaatggtttacttaaaatgtaaatggctttttcatctaccttatattatctaggaaatggataattcttttaaactactttcatttttgttttccctcaatgtgatatttgcagagtgttcaacatgactataccctgatcctttcctgtttgattcaaacttttccaaatcaactggaatttaaggacttggtgcagctcactcattgccatgacccggaaatggacttctttgagaacatgaagcacattcaggtaggtgcagctgatttcctccgccttgagaatagcagctcatacaattgggccttctgggaaagatggatcttggggtttcaagaaggcttcagggttctttccctggtcttcatgaccagcaggcaaatttgcatgtaaggtgatcgtctcccgggggtctcgttcttggtggcatcaccaaacacaaatcctgatagtgtcaacttcctttgttttttttctaagagaattcaggcccattgttaagtgctatggattatatatgtgagagcaagccaagacccagctatctgctctcgtagtggccatgctcttctagatccctgcctttaaacttctcatggaaaaagcacttggggctgaggcaggggtggctttaggagagcgtgtgcagttgccactgcatatttcctctcactgtctagatccacagacgagcaagagccctgaagaaactggctaagcagctcctggaaggccaggttgtgctgtcttctaaatctcttcagaattac

SEQ ID NO: 19183 - DNA, 1176 bp, Mus musculus
gaagtaatatagcagactaccttctactgatagtgattgacttgtcagtgagacagactgaaggaaagagaatactagtgtaggactggacaaatgactcagtggttaagagccctggctgctcttgtaaagaccgaagtacagttcccagcacctacgtggtggttgacagccatctgtaacttcagcccaggggatccaatgtccttttctgctgacctctgttggtaccaaacacgtatctggtgcacagacataacatgcaggcaaagcacccagcacatagagtaaaataagagagagagagagagagagagatagagagagtgtgtgtgtgtgtgtgtgtgtgtgtgtgtgtgtgtgtgtgtgtgtgtgtgtgttcgttcgttcgttccagtgtgccataggtacctttctgatgcacacactcctcactgttgctctcacctacgtcctcttacagcaatgagtattatccagcagatctgcaagttgctcctactcaggatctacgcaaaaaaggtcgaggagcagtggctgaggaggaggaggaggaagaacctgctgctggggaggatgaggaactggaggaagaggccgtgcccacagaggacgcgccccagaagaaaaagacgagaagggctgcagcaaagtgagttccccaccacaggctgagcatggagctgtgcttgtggggagagcagtacagtccttcctgtctgcctgggaaatggcttcatgaaagatggactcctcagataattattgatatactgtcctgagattctctggacagttttgtcagtctttggagattcttactctgaaacatgctggtgccaggcattgagaactgtctgtggtgttctgtgacatcaaagagaaaggcagacagacccagaatgatacaagtgacattgatggggatctgctggtattgatgctacccaggaacgcacttctgtcggtgtggcccagtcagttgcatgttgctatcttggatctctctgcccttttctttagtctcttggccaccgtgaagattgctgctttgttttggaacaattgctgactaactttcttgtgtcaccacagaatctgagtacatgaggaactgttgacgtggctcttttttgtcatggttcctttacagatgagagcattgcaggctagggc

SEQ ID NO: 19184 - DNA, 1240 bp, Mus musculus
aaataacctgacgactattctctgcacagacactggaccatgtatgcccccactcgttcaggcacatcatatgcatgatcgaataacgagaaataaaattcgtagtctgtgcaatgtaggcagtgtacaaacaacagatttaaccgtagttgattgttttacatttttctactgggatatttcacacttaagaccatgctgtatcgtgtattttatgatctttttctcttagttctcatgcctatggaatggaaaacaagcaattctggaatgtctgctatgaacatctagaaaaggcagcttcccatgccggtatgaacaggaatcttggagggctgggacaccgtatttatttgtttagtttgataaagttctgagatggtgctgttctctttgtgttactagaaagcacacatcctgtcttaaggccaagcagtggtctacaggcttgagagtgacacttttctattgcagagaaagaacttcacaaggatgtgagggatgaagagtctacaggagatgaaagttgggagcaaacccaggaaggagacgttggggatctttaccagcagcagttagcattgaaaaccgactgtcgggagcgactggaccacaccaacttccgattcttgctttggagagctttggccaaattcccagagcgagtagagccacggtccagggaactctcccctcttttcctgagattcatcaagtaagggctaggactctacccctggcacagtgtaaaagcgaggtatcagcctccttactggctgggcattttgaattttttgtcatgtttcaaaccattatcatgtctgcaaagcacttcctccctcaggcaaatactaaaccagttttgttcaccatttagttatatatgaatcaacatacaaataatgctaataaaaataggtcaggttaccacaaaggaggggccatgctgagtttggtcagtatacaaaggccttgctctttctttccctgttcattgttttcgtacttgcctgggagtgacataaccatgtctgctgttcgagtctcaatgctaagggatgtactcttgaagaatagtaagagctcctgaagccttgttttgttttgagtgtgtaagtctgagagtcttgagtgctttgaacggattgctttgaaaggatgtgttgtgtaaaacagaactaaataataagttctagtgtgctttgtcacatgggaaggaggtatggggttagattgagta

SEQ ID NO: 19185 - DNA, 1179 bp, Mus musculus
aaaaaggaacttaaacagaagagagaaaagttctctaaggtagaaattagactttcaatcaggatagttcagaattcaacattaggaatgactagtcctgctggctcttacctgtaattccaggacttgggaagaagagtaagaaaagaatggtgtgattttgatatcagcctgagctacagaaggagactctgtctccacatgtagctagataaagagacaaacaataatcaaatccagcaaccacctttagattgtgtctgtgttctattagattagcaagaaggaagggtgagggagatgctgctcatgtggtttctgatttagaagtgaaagagaaaaaccatctgtcccttgagaatttcttctcatagcttcctataacattggtattctactcaggaagagggagcatggtagagatagatgttaatgtggggagttgagcagattcagcatcacaaaagaaacactgaggtcacacaattaataactgtaggaattgaagccacaactgaccctaaggttcatgggacctagagagagagagagagagagagagagagagagagagagagagagagagagagagactgagagactgagttgagccccagaactccaaagggaagaagctatcctgcctgttccagcatgcaagggacacagagaagaatcctgtttgagaaatgcttgtcttagaaagctggaatctggaggggggggggggtaaagaaagctagaatctggattcaatgtctatttccaagttgaagatattattgctagggcagcatcagcaggaacaggtaggccaatgagcaggagtacctgcattattctcttataatctccatgtagtacccacactcaaaaaacaaatcacagcaaagctcgagggaagtctcagagatatcttaataaacagctcactccctaatgtccataattttgtaattgagactttcattgtttgagtgaagccatcttggttaaaataaaaatgtctattgcaaagataaaatttttaattcaattctttatgtattccccattgtaaataatttaaaataaactttaatgggaagaagagctaaggcagggatattctcaatatacctagaatagttagagactgccttgaaaatagcagaaaaggaaaagatggaaacagagtga

SEQ ID NO: 19186 - DNA, 1843 bp, Mus musculus
tcgattttaattagtctccagattatgttcatcttcattagtaaggccatgttgtgctcagttttccagtgcccagcagacagtgtaccttctgttctgtaggcagattctcgtcaggaatatccaatgatttcatgacagcataaacaccttccacccacagggatacttgtaaatgatttatgtacaggcttgtcactatttaaagtttattaatgtactttgggaacttttaagggtgttaagtaactatggtattaccagttatcctaagttgtaggaaggaaaagcaggtctaagaggtacacgcttgtaattccattacttggaaagtggaggcaggaggatcagaaattcaaggtcatgttcagctatgcactagagacacgcctcaaaaaaaattgtcactttgactcctcttttataactcagatgccctccctttaaaatctgctttccatcctcctcctcttcctttcttttctttgtgagactgaggatctatggtgtcttacattgatagataagcattgcgactgagcttcctcctcggccccttcaaatacggtttctaacacaaacaaaatagttgacccagacctgccatcattgaatgagtgagcatcgtggctggctgctggcattctctagacctacatacagcaagagaaccttgggtaaagaccactggatctttacccaagcagtatgcataaaatcaaagatctactcaggatcccttacaacagaaaaccaccaaaaacttgccaaacgttccggttctgagcatcactaatggcaatatgtacatctttgaaagcacctcttagcactcaaaagagatgccaggggcatttctgtaatcaggaatatctaacacacctttcagagaggaaggattgtagctttagagaggctattccctcatagagagggccgccgaaactatttctagatcagtaacttctgagaattaaaagaaaaatataaattacactataggcagactaaacctatgactcagtacattgtacagttttataaacattatcttttgtgctgggtaatcaagaataaagatattctcagacacctggcacaaattcccgaattaactttaggattatttatttaagataaagattgggttttttgtttttgtctgctgttcagtagcatttctccaactgtagtcatatagggtgaatttctttgtgtgtgtaccttgtctttcctaagcataggttgtatgtgaataagtaattcagttccatgggaactgagagaacactcagcaactcagaacacttggtattcttgcagagaacctgagttctatttccagcactcccggggtggctcacaagcatccagaactcttgtttcagggtatctgatgctcgcttctggcctccagaacacaggcaccaggcattcatattgcacacatacaggcaaaacattcatacatgcaatcaatcaattagtaaatatctttccctcccaaattaaaaaagttaaattctttctgatgtattttggtattttctaaaggagctgataaatctttgccacaatttaaaaaacaagtataatgcagttgtactcacttctttttactactagtgtgaaattacataaggtctttttgtgtttaatatttaataaaccaaatattaagcataaaatgctgatgtacctggaagacacatgtgtggtttcttaaaaatagaatgtttttgttttggaatgctttgctaatgtgtaattatataaagctgaacagggacgggaagggattttttttttttttttttttttaagatttatttattattttatg

SEQ ID NO: 19187 - DNA, 1135 bp, Mus musculus
tcagagtaagggtgtctgccggaatccgggacctggctcttcaaagtctcctggccgtaccccgctgtctattgtgactgttccccaatctgctaccaagacagaaactgtctcgaagtcagccaagactgccatgaagggccagtactcagctaaagggcctcccaaaagcagcaagccaccaacttccttcagggacccaccctcatctggtaagggggcagacagcggagataaaatgcccactgccaggaagaaggaagaagatgaccattattttgttatgaccggaaataagaagcttaggaaataaatacacttgtatcgtttcagcaaatcagggtgatcaatgaatggcgagccacaaggatcaccaaagatcttcctatttgtgtctgtccggagagctgcagacatgaagtcaagatgggatgaagctgggtcagggaaaggacccatgcattttgtgtatcaatggacaaatgtgtgagttttgacctgtatcatcttgctaatgatgtctgctgtttgagggaagtgtaaaagtccaagaacactactagaattttaactattggtggtatatttttgaacacaggttaactgtggaggttatctgctaatagcaactccgatactcttaaacactagttactgtgctcagccacaaagcaatggtttgcttggcgctagtgtgtgcctgtaatcccagctccgaaggctgaggcaggggtacacagtagaagccagcaaggttttgaaatgtgctgtaataggcacctaatttattggtcaggaatcctggtccagcaatcctaagtaccaatggctcctgctgtttactttgatattattctggattaaatggaattcttactatttaaatctctataatatttccgtatcagaagggactatttggttttttaattaaacttggctttttaatactgtatcattttataaccaatatttttgataaaaagaaaaaaaaactcaaccaagtaagttaacttattgaatcataagctgaaatttagtaagaattaagttttttaaaaaaaaaaaatatatatatatataatctagacactttgtatcttatatttttagatgaagtctgtgcagtgtgaca

SEQ ID NO: 19188 - DNA, 1190 bp, Mus musculus
gcttccctgccagcccgcataggaggtgtgtggatcctaataggttgaagtttttaaagcatggaggattttctccctattacgaacttctcttcaggtttttaaagatccagtccttactagtctcaaagtgcgaaaggacaactgaattatcctgaatagcagtttttaaatcagatgttttattttggcttgtaaatcttcttattaaaaatcttgagttgatgataactggaagtccacctggtacctgccttcctgttcatttgtcttcattgaaagggaagagcctcaatgctgtgctagtttgggtgcttttgtaagacagtggcgctggcacgggaaggattgggtcatttgcttttccggtcttatttttcgaagaaatgtatgcttagtaaaagcacagcaaaaatgctgcaaaattatattaatttcattggtttaaaacacattaaccattttaaatgcaaactaatcattgtaagttatgttttagcatgatctgcctcaaatagcaatgtatttttctgcctttacttgaatatatttaggctcactttcttccctgttgtatcgcagaagagctgtgtactgatctgtacagaagacagactgagcactctgacatggtattctcaactactgccttcatacttgactttcagttcaaacttatgaggttgcagcatatatgaattacattttcaaatggagatttgtaaacaaaataattacactatatttaatgaataaacttttgagatttctgccatattgtttcaagtatagtaaagtctaaaaatgagcaagccattgggtaccaacaggttcaaatgttagcttgcagtggtgtctgacctcgctcgttactactactacagtttcttttctagaagtcccagaaactttgtgttcagacattttagtatctgtaatcagtcactgttagaaaggaaaggaggaagggagggagggagggaagaaggaaggaaggaaggaagggaggaaggaaggaaggaaggaagggaggaaggagtcagttctaagaggccacacctctgatgtctgttgttaacttgctgatcctaccacagagccttatgctatagacgtcatttgtatttttaaaaagtatattccactgttatgtgataattataaaactccttaaaaaactctgtatgtat

SEQ ID NO: 19189 - DNA, 1176 bp, Mus musculus
taagtgagcttccattaggttgagcagaactttcgactgtttagttcgtaattgacatttgctctatagtcagtgtctgggttcatttgtgtgatctctgtttcagccccatcacttactcctgggaaggtgggaagttgatatctgaaaacgatgactttgaagatatggtggttacaagagaagattatgaagaaaatggacatagtgtctgtgaagagaaatttgatatttaaaagacatttctgaataatagtcttggaaagtttatttcaaagttccttttataggaggctaagacctaactatgttacttttcattgtaagataaagtttacttatgtaaatattccgagtcatggctggtatgcacaggcttcttatgtgggttattacagtaaactaatcagccgtggttcattacttagttagatactaagtaatacttatactgttcctgagaatagattctttttcatgagaaagtgaaagagcaaatgtttaattcttcatacttgaaaacacaaactgaaatatctcacccatcagttttccttgggttttcactttgtgtagttctgactgtgcttaactaaagtatttgcagactgttaagattctgtttagaactaagtattttatttaaagtttgttattcttatttgtacataataaaatttgaaatatcaatattaaatatatctgtttaatgtttatcttttatttaatgtaagtctgaaaaagtacagatgtctgtatttatggtcaccactgttttgcaaaaatgtactactttgttttcgaagttcttttatgtgaccaatagcaccatactaagataagatgcttagtgactagctgggcgtggtggcacatgccttcgggaggcagaggcaggcggatttctgagttcaaggccagcctggtctacaaagtgagttccaggacagccagggctaaacagagaaaccctgtctcgaaaaaccaaaaaaaaaaaagatacttagtaactgtactcctgtcaagcatgctcaaggccctgtgtctgagttctgcatttccaaagcaattgcttttcaatttaagaaatgagttggtaatttccttgagttaaaacatggcatcttggagggaactcaaggagaactaaaaagaggctcatttagactcaaaaac

SEQ ID NO: 19190 - DNA, 1194 bp, Mus musculus
cactagccagtacctcttactggctttattctccctatcgtgcattgtgttttgctttgccttgttttccagtgagtacggctttgctgagaaggttgttgagggaattactgtttctgtcaactctatcgtcatcagaattggagcgaaagctttcaatgcttcctttgagctttctcagctccgtatctacagtgtcaatgcacagtgggagcacggagacctgagatttactcggattcaggatccgcagagaggagaggtaagaggcttcttgtcttactaaaacccattttagtcagtgataaataaacagagacagtttcacattacatctgggacctgtgaaatggctcagtggtgagggcacttgctgtcaaatgatgacctgatacattcctggaacccacgtggtgggaggagagaactaactccccctgaggcacgtggatgcccacgcatatgtacacatatccacgcatgcacacaattagtagagcaccgggaggggtgccctgcagttggagtacatggtgctattgcagaaggcctgcatgtggttcccaggacctacactctgagcctcacagacacctggaactccagcgccagggttatctgactcttttctggcgtctacaggcacatgcacacatggtacccttacatacgcttagtcatgtgcatctatggttgccaggaatcatattctagcggattgtttttcttctggacttacaagtatcctttgatattaacctaaattattgaattttaatgttttactatataaatctttgaccttatgaaaataatgagtcctactttgtgtgtgtgtgcatgtgtgtatgtgcatgtgtttctgtgtgactgtgtacttatttgtatctgtgtgtgtgtgtctgcacatgcatgtgtgtacatgtatgtacctgtgtatgtgtctgtttctgtatatatgtgtgctcgtgtgttggtgcacgtgcaggcatgcgtgctcaccatggcatgtggaggtaggtcagagaatgacttatttgcgtgggttccaggggtcaagctgaggtcggccaatcccagagagctccgttagctcctttgcgttttactccaccactgttttagtgatgattctggtgctccttgttggtgatgctgttttctaaatgaaatttccaggactcttacagatga

SEQ ID NO: 19191 - DNA, 1912 bp, Mus musculus
gactctttgctaggaacactgattcagttccctcttgagaactatgtcataagtctgccttagtctcactgtctcagcataccctgcctgttctccagagtgctacgattacagctgtgtgctctcttgcagcctggaacaacaagtcgggtgacatctgtctgtacagttgctgtcattctttcagtctcctagaacacttgggcttaaaagtagcttaacaaaactatcgaatatcgctttttcacacttagtgcttttttgtgtgtgtactcaaacatttagtaagtaagagatggctcagtggttaagagcactgactgctcttccagaggtcctgagttcaaatcccagcaactacatggtggctcacaaccatctgtagtgggatctgatgccctcttctggggtgtctaaagacagctacagtgtactcacatataataaataaatctttaaaacaataaaaataataccaagtcttttgtatttttcatgatgtagggatttgtaaactgaactcaatttttttccccttccagtttgtcattccttctgaagtgaaggcaggttgccatcaagatcagcctcacacggtgtctattcagagctctgaaatgatagccaccaacacgaggcactgtccgaactgccgccattctgatctagaagctttgtgtcaagactttaaagagtgtgacttttttagcaaaacttatactagattccccaaatcctgtgacagttttaatcttctacatcccatcttccagagacatgcccacgaacaagataccaaaatgcatgaggtttataaagggaatattatccctaaattgaataaaaacactcttaaaacatctgctgccaccgatgtgtgggcggtgtacttttcccagttttggatagactatgaagggatgaaaagcgggaaggggcggccagtaagctttgtagatgctttccctctgtctatctggatttgccagccaacaagatacgcagagctacagaaagagttccagacttgtgatcaagtgacccttaatacctcacaaagtgagtccagtgatctggctggccgaatgaagaggaagaaactcttgaaggagtattacagtacagagtctgagcctctgacaaatggcggccaaagaccttcatcagacacatttttaaggttttcctcttcctcttcagatgcggatgttcatgtcttggtccgtgttcataaacatgtcagtatgcagatcaatcactaccaatatctgctgctgcttttcatacacgagtctctcgttctgctttcggataccttgcggagggatgtggaagctgtgattggaagccccgcttcccagacttctgtttgcgttggaattttacttcgcagtgcggagcttgccctgctgcttcatccagtgaatcccacaagtgctctgcgctctcctgcttctgaaagtgggagcccattgcttcctgacttcctgccagcagaaaatggggggtttttgtcttcaaagagaaaacaaggtggtagtggtatacaccgaattagaaatgctactctcaatcacatgtcagacaacaggtcaatgagtgttgacctcagccacgcccctttaaaggatccgttgcttttcaaatcagccagtgacacaaacctgcaaaaaggcacttcttttctagactacttatcagataaacatttagggaaaataagtgaagatgaaagtagtggactttctcacaagagtggctcaggagaaatgacctcagaagggagtcacacaaaggatgtggcttccacagactcagatagtgtcttaaactacagagatggctcaactaggctttccctggatgatgacggcaaccataacccaccttcaaaccctgtaactggtaaggg

SEQ ID NO: 19192 - DNA, 2776 bp, Mus musculus
ggtggggaggtggcaaattgaaagaactggctggtataggcaaaaagatggaggcttatgacagagaaggaaggtcagcgcatctgaagacacagaggccccagtgtagtacggtgacacagtatcactttaaatttggaactgagaagttaattagtattttcaattactgggtcaaaatgtaggaacacggttacttgcatagtaattgcttcccagttttcagctcaactggaccctcaccagcactgggtggtttaccatcccaagtgatgctacataaaatagttgcatttttgggaagtgattaaaacctcttgttttacaaatgtcatttcagctcatggaggaaaacgaatgtctcaggcagagactagctcaagctaaaatggagctcgcggaggctcactcggccagagatgagcttctccatcaaatgaagaggatgggcctgtagctgccgtggccgtgagaaccggggctagagcgctggagaaggacggctaggtttaacagaaggatgtaaccagttagtgggaagttttcctttacatgaaataaagcgagtggtgaagtggcggctgttccaaaccctgtggaggaaaccttgggcgcaagcggtacagtcatctgggtggccccgtgaaggctgcgcacactgtaacacagttacatgcctaatgagaaatgtcagttcctaacttcagtgtctcatcaaaagcattttttacaagaaaaacgaagacctgttgtgctcatgcagattgctgaatttatttctctgttaataatttactattatttacaaaaaaaaaaaaaaaaagatacttttagggctaatgtaaaagaaaagtaggcttacattttagatgttattaaaattatgtacttaatctataattatttaattgttgtaaaaagtccaatcagattaataaattatataattactgagtttacaaatggaaaactcttgaccctaccgaacttgtgaagcaacttgaaaatgtgaaaggaaagtcaccttaagtgatggggaggcttcagtgaggcactcgtgtaaaatcaaagcacaaatacagggcactgggcaagtgacttaaagcattcctgtacattccattaaatgtgtgtcattagaagtaaaaaggcaagttatcttgcgatatttggcggtatttgtaactataaaaattttaattaatactattttaataattctttatctttcctctttaaggagaatgttttcagagaatttgtttttcacacatgcagaacaatttcataccattcctgtagcatcatattacacatgtgtttgctcatatgaatatataaagccagttttgattagatttctgtgatgtatgtctgtgtgtgtatatatgtgtgtgtgcacacacatacacacacagtcttatatatgagtcattggtaaattttgaaatctattttctatgggataaggttgaaaacaccatgagagaatcttaattatgaaataaagtacatgagtattttaagaaacaggtttttgaagacagtatatttctgatagaattaaagtaagtggtgtctattttaaacttcacattcctcaatagaactatatccagataggccatgagacagctggactgttctttctttaaggtacttgggaaccctggcccttgctatgacactcatggtgctttgcatgttggccggaattacagccatccctgtatctgaggacttggcagaaatcacatccttcattacatcacacgttggagtgatttaaattttattgtgaacagtatttgccttccttctcctcacatcattcttttcgggtgacatcatttgataaaaacaggcactgtttgggagccaacatacagccaagaacaaattaaatcgttactatattacctcagagtatttacaacaccatgtgaaaactttgttactctaagctgtatgtagccttagatgaagtatggaggtctaattagagtttcagaatgcacaccttgctaacctttgatgtctggtatggattcagcaagagcagtctcacagaggaggacggatgggacatgaacttctgagctgacgctgtttctcaggactgacctgttctacataaacatacaagttttctatggaacaatgttaaactgtttaatgttactagacactgaatgttttctttattcctttaagatgtatttggccttcccatgaaatcgtataaacaacagagatgataatatgctgagcattcaatatactttgtccgattggtttttcctttttcttttttcttcataaaagtgctgttttgatagtggtttacgattaaggaaacatctcccaaaatattgccgtgtacccccacaaacacaggaggtgggtgtgattggggtgctagaaatttgagaggaaagagacctttgatgctcaaaataagttggctagagccacaattagtgatgtggctttgatttaaagtgcatgattataggttttatctcagcacggtcatccgtttgcagactttgtcaaggcagtggtaaagggacgagtcactgtcttacctgtttttctttaaagaggacttttaatttttaaagatttcatttttacttttgattgtgtatatgtgagggtgggtttgtgcatatgagtatagtgcctgtggaagccagaaggggctggagttagcaggaaattgtcagcttcctgacaagggcactgggaattgaatcttctggaagagcagtac

SEQ ID NO: 19193 - DNA, 1184 bp, Mus musculus
agcgttaatgtagttcagctccttaagtttgaattggaaaaaaaatctaaaccctctatatcaactttttataaagctgtgaattgtactgcagtattgcaaacattacaaaagtgtttacagctgggccagtgctctgtatagttgggtgaatcatagtatatctccacaaaggaacatacttttactctatttttttaaatatagtcatcattgttattaacagtttgtccttaacatgcaaatgaaatgtaaatatgtaccttgttatgctattggtaaattctttgatgcattcaaattggttggcaaaattagtgagaatcatttgaaggccttctataggttgatgctgtcattatgtaggctatgtcccaaggtaatggtggtcagttttctgaaccacacttactcccagggggtatggttttccaaataaatcatgcttatttgcactctttaaatttgctttaagatattgtgtcatggtgcaagcacagtctgcaacatttctcttgttaactcagtgagtattggttttcaacagttcttcctatgagctagtcatgtgttagagagatttctctctgtagctctgtgtttagctggactctggctgtcagtgtctgtgaattgggcaccaaccaccttgcactcttttagttgtttcgtttataaagacagggtttatgtagtcctggctctcttggcactcagcatgtacaccaggttagccttgaactcagagctcagcctgcctctctgcctcctgagttctggaattgaaggcgtgtgccaatagcacctctctctctcagttatactcgactgagcttgacctcttctaacttcttctccatgcttaggtgttagtcagccagtgacgtgtgaagcggtaacacatacttccccttttacctgtacatcacccatgctgttctctccacgactttcaagagtcgcagaaacccttccccaaaaccccctgggaaatgagacatttgcccatgtcttcctgggaaatgtgacctcattgtattatgcagtgattgtgatcctcctgcatcagactcctaagtagctaggagaggtgtcttttgatgcagaaaaagctttgcaacatcagtatctagttttgttttcaatcttcttttaggatctataattgaagcttaagtttaatc

SEQ ID NO: 19194 - DNA, 1211 bp, Mus musculus
tgggggggtgggtatgggggacctttgggatagcattgaaaatgtaaacgaggaaaatacctaattaaaaaaaaaaccctctttttttacacacttcacttcctcacagttctcctatactataaagatgcattgaactctgggaaaatgccaacatttacatattttaaatgattttttagtgtttaaaaatgacaatttcaaatggtccaacctcagcagctactgttttttgttctggatcctctcagacatacaagatgggtactggatgctgtgattcttgtcttacagatgtctactctcctaattcccacagttttcctaagtggcagagcctagtgtgcccgtgtaaacctctgaatgaattggtccacatcattgccaccctgtctctcctctagtgatggtgactcttccactcttctgagaaggtcccaggcacacaatttctttttgctttttgagggcccatttttccccccaacatacaggttaggtttctagaatcttcagttacagcaccatcttctctattatttcaattgggcaaataaacacccctcctccgcgcaggtgagagggcggactacagaagcgacacagcttttgggacaggcagaagcgacacagcttctggggcagaccctgtttcgggctccagacatccggcaccttccctgccagaggagaggtgtccgcccgggagggctctgccggagcacctgtgggagccatcttgggtcccagatccctcacagactagtctgcccagcacaaaagccaatcaagagtcagacatagtgccaatcaaggtgatacacaattgcagtctcagcatttgaagcactaaagaggaaggacttggagtatgtggatagcctagctacataggattaacatagcaaaaatggccattttatgaaaagtaatctaaagattcaatgtaatccccaccaaaatttcaactcaattcttcacaaagatagaaacatcaattctcaaatacatctggaataacaaatatcccaggataacaaaaactgctctcaacaataaaagagcctctggggaatcaccatgcctgccctcgagctgtactacagagcaatagtggtaaaaaccgcatggtattggtacagcgacaggcaggtaaatcaatgcaattgaattgaagacccagaaataaacccacacacctatgttcactt

SEQ ID NO: 19195 - DNA, 1700 bp, Mus musculus
gtttctcacaacttttctgtctcctgctcttgcagccagttggtaacataccttcctctcccaggtttttggggctctttttttttttttttttaaattcagacaaccaagttcattggaagtgtatgtaaaatagaaggtaaccttcctgcaggagaaccaaggggctctcctgtgaggtagtgccacgttatgaaaactatgaaaactgaaaagtatcctcccttttgcaaaggttctaagctgtgttacagatacttacaagaggtttaagatgtgagtgaacgtgtccctattgtgttctcatttatagccttttctatgaactggtgatgttttgaagtatgagtttatgaagtctctttgtgaacctggacttttatttctaaagtttgaactgtgtgacactagagtttactgaatacaattaatagatgcttaaaataagaacatgttgggcctgtgcctattttaaagataaaataacatagcaataaattgtgataatgacatatttacatcattattttaaagattctccaatgtatgaaactaaatttgtttcacatattaattttttaaaaagtagggctggagctaagtacggtggcgcacagctttgataccagcactccagaggtaaaggcagtcggctctctaagttcaagatcaccctggtctacatagtaagactgtgtctcaaaacaaaacaaaagaaaaacaaaaattaggacaaggagatagttcaataaatgagaggcttgctgtgtaagcacaaggaccaggatcagggtttaatacccgacactgacataaaaagctgtgtcttgccgggcgtggtggtgcacgcctttaatcccagcacttgggaggcagaggcaggcgtatttctgagttcggggccagcctggtctacaaagtgagttccaggacagccagggctacacagagaaaccctgtctcaaaaaataaaaaataaaaaataataaaaaaaaaaagctgggtctagcatcccctgcctataataccagccctggaaaacagagacatgagaaaactattgaacatgtgtgtctgtgtattcctttgctaagaaatttgatgtctcaggggttaagagcactggttgttcttgcagaggacttgggtttgattcccagtgcccacgtgatggctcacaaccatctgtaactcagctcccaggagacccagcacagccttatgactcctgcaagtaccatgcatggcgtgcacgcggtgcacagacacatacaggcaggccactcatatgcataaaataaatgtattttaacttcctgtttaacaaaatcgtcattgtagattaacgtttaacgaattttcctttgtttctttctttctttgtttcgaagggtttttttgttttgttttgttttgattttgagacagaatctcaagatgtagcccaggttagtcttaagtcaccatcttcctgctcctgcgtttcaagtaacagggaccataggtctaaatcatggcacaggacttcatattgttgtgctttatggcaaattcccagtattataatccacactttcgtatctctgtaattgataataaattttatatagcagttagcatatagagagtactgtccatttatttaaaaaatttcagcacacacaaaacagtttatacccaggcatggtggtaggtgtcta

SEQ ID NO: 19196 - DNA, 1599 bp, Mus musculus
taatattttttattattacgtattttcctcaattacatttagaatgctatcccaaaagtaccccataccctccccccctggtatgaattatttagaacacatcatgaaattatatgcaaattatatcacttccattgttggcccctttgtgaaggaaaatttccaaagatttgggagcacttttatctgcctgtttttatgttctgccagattctacatactcttaattatttccaaaaaatctttttctatagttaccattattattattcatgttactgtcatgcttgaaaatgcatctgtaactccacttccaggagatatggctcccttttctgatctttgggcatacaaggcatgcatgtggtgcacatacatgcatgcagggaagacactcatgcatatagagtgagtgaatctaaatgtaaatgttttggataataagctaaagccagtgtggtggtacatgctcgtaatcctagcactgggaggctgaggaaggagttctacttggaggtatcttgatttttttttcccttccctttcccccagctggagtcttctgtgcgatcgtctcccaccctgctgactctgtggtctctgtgctgaataaagagaaaggcagcaccgcgtctcaggtcctgcagaggctgggcttcagaggtgagtcaggctcccctgagacagcagctcactgtgcgcgtggggaggtaggtggcgctcgggcactcatgtctcctctctgaaccaggtgtgtggaaggggctcttcgcccgaatcatcatgattggcactctgactgcactacagtggttcatctacgactctgtgaaggtctacttcaggctccctcgccctcctccccctgagatgccagagtctctgaagaagaagcttgggttaactgagtagatacatcaaagtaacatggactgaatctgcttgttgatcagtgttgaaagtgcaaaggaacttttatatatttgacagtgtaggaaatgtctgttcctgatataattactgtagtacccttgcttaaagcaagagtttcaaacttaatgctaaataaacccatctattcctgatgtctatgagtttgttattttaaaaactagtattgaaaaaagatttagtcctaaaacaaaaagaataattaaggtattcaccccaggaaaaaagtgtaaactaagtaaaccattggtgctattcctaaattgtcccctcacttaagaaactcctgtgtttaggaaatagtcttgggttttcaaaaacatggtttattaaatatggataaacactgaattgtagttttatttttttgacaagctaattttagtatagcaaatttttgtctcatgttcactttttaatgctagtgggcctattggtctgtgtttgtaaaagggcacccagattaggctcattcttaaaatgatagttaaggaccaaagcaggattgctaaaaagactaaggtgacctacttttcacacaaccagactggatggaatgtcagcagtttgcagttttgtttttatttatttagttttttatgggaaaggctgctagacaactgagcgaagctggagatgcagcctcag

SEQ ID NO: 19197 - DNA, 1131 bp, Mus musculus
gcaatagcaaagacaggatgaaaagcaaagtgtatttcataagattctagcttctcaatgtactatgttatttctaagtaagtatgggtggtgtgtgtgttagtgtaagagaagagtctggggtttctcttatgtagtataggattactgtatgtgtcccatctatattcagagtatataccttgtattagttatgaggttgagagacaatataaacttaattctgacacagtgttattcatggactgtgtaataagagtagttcagacaagtcaggcagggtataatgtgcatctgtttcctagcatttgggtatattgtgatttttgtagccagattgtcccatataacaaggctagactaggatagactgatgaagttagatcttaaaccagaaagggggagaggagtaattttagagtctctgaaatcacattgtcatagaaagttagattgagatggccacgtgacagcggtttatatctgttctgtatattgtcttttaggaaaacacctacctgtggcgcacatcactgtatttagcttcttctgccagtgctgaattcttcgctgacattgccctggctcctatggaagctgctaaagttcgaattcaaacccagcctggttatgccaacaccttgagggaagctgttcccaaaatgtataaagaggaaggcttaaatgcgtaagtgcgtattctcctaaaacgagtcactggggagaacctaaaatcaagtcctgtctgtctgtctgtctgaaaatgatacttgtctaagtatctattgactcaggaggatgggcttgttaggacatttctgctatacacagtttgcatgtttcagatgccaacatgcttccttagatccacctttgtggatgggtcttggactgagttctacctgtaaacttcttgtttcttgtggttccagtccaagaaacgtccagcaactttgttggttgtatagtcgaaggtgcttgagtcattggcatgtgagactaatatacctgcatgctagtcttcaggttctgatggaagtgacatgcgtgatgctgtcatgtgttactgtcaggactcgactggtgtgcggacacgtctgtggatggtgaaagaaaatctctgctaaatca

SEQ ID NO: 19198 - DNA, 2881 bp, Mus musculus
gatctttgagtttgaggccagcctggtctacagagtgagttccaggacagccaagggtacacagaaaccctgtctcaaaaaacaaaacaaacaaagaaaagcatgtgatacgtcaatcccctgcttttatctgacgattttctgctgctgcattttgcagtgtgcttagaaatcacactaaggtttggttgttgacttgaatcatctggaattctgtttcactttgaacagtgctagctgccgcagaccaatcaaaggtgctgcaggccggccgctcgagctcagtgacttcaggatggaagagtcgttctcatctaagtacgtcccgaagtatgctcccttggcagatgtcaagtcagaaaagacaaagaagagacgctccgttcccatgtggataaaaatgttgctgtttgcccttgtggccgtgtttttgtttttggtctatcaagctatggaaaccaaccaaggaaatcccttcactaattttcttcaagatactaaaatatccaactgaagaaatcatttcggcacattcaacttgatctcctgtttttaataactgtagaaaaacatttgtgtccacttgttgactgaagaactaaattgtgatttcacctcagtaaagttagtgctgcattgaaaagcagacaggatgcttacacggatctcatttcaatattttggaccttggagatcacattgtgccatatgaataatttttttagctccagaacttttttgtaggctttatttttttaatgtggacatcttatttcacttttggggaaaatgcattgttttgtgtatttgaaaaataaggcaaaacatggtgatgtaatgtgaagctacacattaaatacttggaattcttacggaaaagatttatgacttattctctgctgagtaaaaatgttacaaatgtgaatgaggttcagtatgagaaacggccacgcagttgtgcttcctgtacgcagcgtttgttcatggaaggtacagcaataagctcttgtgtgactcctgtcatgtggtagtgctggtgcggccttaccataccactcgctagagtatctgtcatatcatggaagtcctacttcattaaaaccattaagtacgcttggctttccacagggaccttgtagagaagcagatacctgctttagctggctgtacaattgagggagctgttagctacctctaaggctcccattgggatcctgtgctttttatttacagtaaagcatttgtcccatccatccagattgttagcaaaatattctttaggtaaatgtgtgagggtgtttgtttagaagttagaaactaaacactggtcccctctgttttacttggatttcattgtcttcttttaaccaaaaaaaaaaattgtttcagccagggatttttgggttttttgttttgggttgagtctgggtgttatttttgtttgttttaggcatataattcccgatgtaatttgatttaaaagtataactgacttgcttttaaatcacatatgtagtagctaatgcttaatttgtaatttcaaataaggtgggcattatggttttgtatactcctgaaatgattaacgatatcctgatggttgtcgtcttttttttagctgaaatttacctcatgtatggcttagatgaagttgccgtcaatttaaattttagtaaaaatcaagtaaagcataaacatttttaactaaatcattaagttgcaattttacagtcattgaccataaagcacactaaaaatgtaaattatttttaataacatccaaaatgtaaagacgattttaatttttacaaaggaggaagccgaatatgaatatttagaccagcacacagttttgacttaacatttactgtatttagcttttagatatttcgtagacattttaagtacacttctgccactgagaccagaacatgtaggtctggtcttccagggcatgtggggagctgacttagatctcaagtgcttgcctctcagagtcacagtgtcttttttgagatgagccacatgggcatgttttacccaactttcccaccctaccgtgacagccatcttccttcctttgttttcagacatagcttctcatattgctttcaatcttttgtttataattaaaaattgtgagaagccccacttgatatttaaaagtgtgggggtataaatcagacttcacatatatgtaaggccggtcggtctgggatcggaaagtatggtccagtacagcaaaaggtaggaccaggtaaaacatgccattttttaaaaaaaatgtgtacttggtcttttgtctgtgtctgttttattccactagagtaaatgtgtccttgatgtaaatgcaaagcatttattaattcgtagatgtagagtttacaatataattcaataataaagtaattaacctctagttttgttgttgaatacatgattttcagatagcataaaatttaagatttctgtatagcacttatcatgtggtatttatttatagactaagctttagttctcattttaacctattctgctttctaattattgtagtagttggggcctgttagagaaaagcacccagaaccccaccccccaagcacctcttccttcctgtaataccgtgattttccaaccatacctctgtgtttgtggtcgacccccaccccacccatctttttttgaagaacttatgtagcactggctagcttcaaactcacagagacctgcctcctccgtgcctgtcacgccggctcctgcttaccatcttaagtatgtacatgtaactgtcggcagttggtcttcagtgtgactgcaatccatgtcgcagcctgtgtttgtgagatgagggtgctgtttgcgtctttgtcgttcatgtgtc

SEQ ID NO: 19199 - DNA, 2121 bp, Mus musculus
gtgaggatgtctgcctgtgccatggggtcttctaccatgggtcggcgttatctgtggttgaaggattgtaagattagtccagcttctaagaataaattgactgttgccccctttaaaggtggaacattatttggaggggaagtacacaaagttattaaaaagcgtggaaataagcagtaatgaggttaagaacaaaggcagaaactttgacttagagaatttgtgaacctttctaagactttagtctcctaatagagctaatttcaaggtgttacgctaccactcatccagttacagtataattgcatatgtagaggcctagtacagttgaagctccgtaggtcacatctgtcttacatgatcgtacagcttcctgtttcatttaacattttagatatacaaggaattcagcaactagaatatcagtggaaccctcgcttcctttagtttgccattcgagtacttcctgatgcataggtcggagttaaacattgttagtcacttgaaacactgattttttttttccccccctgctcagaggagtttaactttgagaagtctcgtgtgtagtatgtcgagtctcacagctcctgtgattccagtctgctctgccttctgctgcttgctttcattatataaataatattttgccatgagtccttttgttgtccactcattacattgcaggccatctcacaagtgacctttgtactgcaacaaacctcataataattctagatcagtgtaactcttttaagtgccagtgcacaaacttgctgcttggctcgcagacaagcgtgtgcatgtatagaagggaaagaccctgctgctctgtgtgtgggaggatgcatgcacttggcgtgcacgtgactgagttcagagccacttaagaaagtgtaataagagtttaaatctagagatactttgtaaacaaataagaggtaaattgtatacctgtatgtatgtataaacacaaacacatttatgcacatttttaataatcgaatagacaaggcagtgtacagttttatgtctgatagaggaggtagccaacaaacaattcctagttatacaagtacatggaccacacttgaggaacacagcaagggatggtaagtggagttctggtatacctcatcttcactcaacatggctattttgttagataaacaagacactacaaaggtggggcttttttattttctacatgtatttaaaggtattttatatgtcctacatagatctggatgctaaaaccaacaagatgttttctaaaaaccttaagaatttttactataccctaatgtctgtgtctgtatgaagcaatgtatcaccctgttttcatttgtatggttgtaaggtaaggaatcctagctgtcgagatgctgtggaaaacagtctcaggcacaatcaaatacggtctcggtgtccatgtctaccactaccatgttcttaggctgcacagtccatcgctacagccctgttacttgtctttaaaatgtacatgtatacatgtacctgtgaagtgctgtgtgatttttttttttaaagcaatgtatgcctgtagaatgcttctacaaattcaataaagttgttaaatttgaacagttttgtgtggtctccagaaacatgttttatgtgtgctttattcttggagtttgaacaagctgaatatatgtggatgaacatgcctttgccatttcctcatggaaacatcccagtagtgacagggaatattctacttaccacatgtcctcctcactatttaaggactatgtatttaattgtctgtaaaatctaaatttggacaagaacttaatttgtagccacatagtttgtctaatcaatcagtttctccttgctaataggtatttatttatttactttgctctatgttgtctgaggtttcttagattcttctgagttaagcaagaacaaaagtagcttttataatgcagaggagtataccaaatgcagatgacagtcatagatctggtgacagtgttggggatggagttggttgcttggtcttcattgacctgtttgaactattttagttaaaaatcactatccagagggagggagaatggcaggtatatatgattaactagggttagactg

SEQ ID NO: 19200 - DNA, 1119 bp, Mus musculus
tcccattatgacagtgaaaaaggagaatttggaggttctggttctgtaggtggaaaaactgaaatagaaatcaagatcaaccaagaaggagaagtaaacagggcccagtacacgcctaagaacccttgtatcattgcaataaagaccatccagtgatgttcttgtttttgactatacaaagcacccttctaaaccagacccttttggagaatgcaacccagatttgcatctctgttgacaccagaaggaaggttatgggctttcttggaatccaaatctcagcaggacacttacttagtgcttcagatgaccataccatctgcctgtgggacatcagtgcagttccaaaaagaaggaagagtggtgggtacaaagaccatctttacagggcatacagcagtagtagaggaagtttcctggcacctgttctccaagtctctgggtcagttgctgatgatcaaaaacttaagatttgggacactcgttcaaacaatacttccaagccaagccactcggttgatgctcacacagctgtagtgatttgcttatctttcaatccttatagtgagttcattcttgccacaggattagctgacaagactgttgccttatgggatcagagaaatctgaaactcaagttgcattcctttgaatcccataaggatgaagtattccaagttcagtggtcacctcacaatgagactgtcttagcttccagtgctactgattgtaggctgaatgtctgggatctaagtaaaattggagaagtgcagtccccagaagatacagaggatggatccccagagtttatgtttattcatggtgggcacactgccaagatatctgacatctcctggaatcccaatgaaccttgggtgacttgttctgtatcagaagacaatatcatgcaagtgtggcagatggcagagaacatttataatgatgaagacggtgaaggaaatgtgcatccagcaagacaaggatcctagacgtgtctgcacttgtgattttagactctccttgttttcctctgaaccctgagatggatttaacattcagttgaggcatagactttgttcagctactcagctacaataggtgccaccaataacgctacca

SEQ ID NO: 19201 - DNA, 1249 bp, Mus musculus
ttgatggacaaattgtattccaaatttttttaggtagccaacttttaaaacctcggtataccttctattttataaagaaataattgtaaagtggcaattggattttttcacagtttagtaattattttgttaacatgatgacatcaggtatgccttatttatttagtgtatatgtaatacatttttgaaactttgcattgtacagatacatggtacctttgttctggttacctaattttatatatatataatttttttaagggtttggaagattcaagggctatatatctgctgattgtctaatgaatttactatgtgcaaaatcattactataagattttcatcactcaacttaggatcagtgaaattttcttatactaactaaatattagaatattgttgccattttttccctcacaagtaacaggcatagattatttcttctgtgttgtgtatcattaactttctctaattacagtgtgctgtgaacagcactttctatccttagccttaccataatatttataaaggttcatcatgcagagaatgtacatgttggcggagctggccgtgttcatctgcctgctggaacctacactttgatagggctggactaggggctactcaccgtttatattcttgtcgcctcttgcccaaagatctcaactgtgtactttatatgtacatctgttccccacttttgctttccaggatcaagatgtttactaaaatgtagcttagattgataactttaagtgtttctaaagagatagaatctgtaagggtgtatttaataaatataaacctatgaataattatctccaaaagtggaacaggagtaagacttttccaagtgactcagaaagtctgtttgtgtgtcaagtttctgtggccttttcttggcagctatggccgcattatgacttgtaacaagtccccttacatgtcactcaaacaacgttaaaatgcagacgtcttttgtctatatactacattttaacctattaatattttcctatttccttttttctataggtgtatatattgtgtattaaaaagggtctgatagagcatgtatataggtaaaacacttgtcatggatttaagcactgagtacaataaattttcacattcaaaatgtagacagtctgagcttgaacctttcacctctagctgaaatggagtaacaatttaaccttccctctggaaatttgaaagcaaaagacaagattgttactaatacacagca

SEQ ID NO: 19202 - DNA, 1126 bp, Mus musculus
tgaggagccgcttacttttatagcaaatggcttgccagagctaaacagcacttttctcttctgatagcctggctcttctgaaaaaccatcaaatatgatgcccttttaaggtgatgctgctgcagatcagggaagtgtttgtgtacgtgtgtgtgcgtgtgtgtgttttggaaggagaaatcagtgacagggtttgcttggttgttacaacagaattttataatcaaactataggcctccaaccaatgaactgctgttattcaaagttttatttgtagtgtttattttcctggttctcattgggttaaaaactagttgatgttttaaattgaacaatgaacaatcaaattcagaaaatagctgcaagaggaaaagatgtcattttaattggctttaattgcttggtttttctttatagcaagacccgttccattatctgtaagactgcttttcatttgtttctgtagctgttcctgtaccaaattctccgtggtctggcatattgccatagaagaaaagtgttgcaccgggacttgaaaccacagaacctcctcattaatgagagaggagaactaaagctggctgactttggtatggagagataagatattcattattacttccaggtggctaagcgagaagaccaccgttgtcacagagtgtcgtcaattttctgtgtgttttgacgtgttctctgtagctcggagatgtgtgatggaatttaggtgaatggtttattagtgaggaacacgcacgtgtttcctagcatgctgagacctctagaacttctaagactttccatggcgtctaaagataaattcacactcagaattactgttctccttgctttttcctggttgcaccgaggactcaacaccaagtaagcagtagagtcgctggttccttggtgtatttgggggtatttagggcagggcatgtgtagtcttcactgctgacatgtttaggggacaagtgtcagttatacctgggatacttgatactgcagtaaagtttattttcctagactataagtcattacaatatttcttgtgataaaatgaagaataagcataaaacacattgagctcacacagaaacaacagtaatctaaagagaaagattacta

SEQ ID NO: 19203 - DNA, 2088 bp, Mus musculus
tctggtaacttggtctcaagcccagctccagcctttcttatcagccatggactcagagctgaaggcagtcatttcttgtgctggacttgggaactccgtgtgtcagcactgtcctcttcccagtggagtctttttatttcagacctacagattgtttttatatttgttgtcacagtgtgacaatttttttttttgtacagttggttttaaggtcttctccgccagtagagccagtaggttacagctatcaatgtaactgtagctgcagatttgtgccggactgagaaacacagtgcattatttatttgcggaatcattgctgctaaataactactgtctgtttatttaacacaacagttgaatgcctgaagaagttgcagtggctttattatatgtgaacgcatctgtttctcctcacaaattgtttgactgctgcattttgttgttgtttgtttgtttgtttgtttgtttgttttttaaaagattaaactgcagtgtttcctggaatgtatattttagctttgcttagcagtagaataagtgagccatcgtgaacactcgaagtccgtgctacatatcatttcttaggcgcattggccaatagccaggctgagagggggtcagcacagtgtgtttcgggagcatgcaatgtgagggttgatgcaagcaaatgagtagcagacattttgggttctcatgtcaaataccaataaactaaaacacggagttatttatttttacctattcctcctcttagaaatgtctgcatatgtgtatgctcctacacttggttagctctttctcactgtgcttttagttaaaatttagccacataagtcattcaaacaggaagggccttgccgctgttcatcataagcacatttctcttattagaggatacttcattttgagggaccgtttctttcatttggggactgtgtgtgtttcaataacgttcacttggaatgagctgaaagctgtgctgtgtctttaaatggagccacgatgaattagaaatgagaaagaagaacccagaggactgctttagtgttgtgggtattatctgctcatcagagacactaacagtgtaacttgaattatgcatctccttgaacatcacagacacttggtgttggtaatcgtgtcttaggcatttgcgctcattgttaaggactattggttagtgcatcttacaactataaatcttaattggttatagtttgcaatggtcatgtgtttgccttatatcatgaaaatagttataacttaatttttgtcctgccattcactgtaaacattcagggtcctctcatttctgttcaggaaatcctgtagtttattgtttgttatttaacagtattaagtgagtttttgtatatttcattttaactttatttgtgaatagtgattgtggcatgtttggggatgttattttaatatttcacaatactgaaattttaatttttttttaaaaaaaaagaaagttctggaagaaacagattcatatgtaatggtgaatattggaccactgctgctttcacagttgtcagctggttttatgttaagccctgtagcctaactgctgttatttctaactgacagacatgtattaatattgtactttgaaggttataaatattatgtgaaaattccttcatttgttttgaaatttataataactaaatctctgtgttatataaaatgtgatttttgtggagtcactgttctttattggggaagaaagctgtgcacactggggtcatcctccttctgggttatcattgtcaggtgacaagatgtcactgtgctgaaagtgacagccacgttaggtttgtgccgaccgtttggttagtctcttatgggatctcctgagatattattctttacttatgaagtatcagatttgttaatttgatttgcagattggccttagtttgtcagtaagcttgattcgtacatataaagaatatacaggcattatttaaaattctttctagggggtctagggtcttacggttaagaaatgtgcatgggttgcttttgtttgttgacgtttcagccttatcctgatcctggaaactgcagaga

SEQ ID NO: 19204 - DNA, 1202 bp, Mus musculus
caaactctcaaggggactttccaggtttgtatttaattttgagactagccctgctctcttcatttcctacaaccacaaccatctggtatctttgtcactactgggagttaaggtttctttagattcctggcatgacaattaatatttaaaacctaatgttttagggctgaggatatagctccatagaatgtgtaacctgcatgtgttgaggctgtgggtataaaccccagtaacctgtctccctgtctctccccaaaaagggcgtggtgggaaacaaactaagaatgttttggaagatgcttacagatggtgaattcaaacaaagaaatgtttatatactaccagccatgtatagagatatttcctgtgtgtagatataatttttgatggattaaatccaatgcattactaagagctggaggaactgaaggccttgcttctgaggatgagcactcaagagccaccgctttcggtagtaatgatgatgagaataaagggactctgagaaggggagacttgtcaggatctccctctgaaacggatgcagcagctcctcagatgctccgcagggaaggcttcacgtgctgagtatggcttccggctgtgacgcgagcagcctctcatctggtgagaccctgaaggcagcacacctgtgcttaaggggaagttctactgtaacactctgaaggcaaggcactttaaattcaagatcaggtgagctgaaacaccactcatctataagtattaaacaaacaaacaaacaaacaactgcaatgtgcctctacagactagatactaaatagaggattataagggggttaaaaaaacaaagctcgtgcaaaaaatttgaattttaaacaatctaaaattatgtttagatacttacacattgagacttactaccgaagttgactttctttctaaggggcatgtgtctttactaaggggagaaaaaaacctctgactgtaaagccatggagacagctccaagcccataaatagatgccctgccactccctcacggcgaagaataaatgtgtactaaaataaaaaggagctggttcaggaggctgtaattaccgaacacagtgtcagagctgggaggggctttgagagtgctggcttccagctgttctctggtcaagacaggcacacaggacaggggtggtgggggtggagaagctggcctggagctgcctggg

SEQ ID NO: 19205 - DNA, 1215 bp, Mus musculus
cctgtgagttcctctacagatgtaactgtcaacagtgatgaacagtctatgtaacgattcatagggaattgggagggttcacgggagttaaggaagtttgcacgcgtgagtgcgtgcatgggtgtgtgcgtgtgcatatgcgtgtgtgtacacatgtggggtgttgtttgcatgtgcacgggagccagaggttgacatcaggtgacttctccagtctctttccttctaatgtttggatacaaaatatctcattgaacctggatctcatcgacttggctagactgacaagctagtgaggtccagtgatccccctgcctccacctccgagcaccaggattacaggagtgtgccttaggactaagctttataaaaacaaaacagtgttaaccaaaaccaaaccaaaaaaaaaaaaccaaaaaaaccaaaaggaaacctcgagtgcatccagactcaggtcctctgcctctcccgactgatttattcagtgaaccggcttctcagccccgaaatcagattaccttaagcccacggatctatccttgctgctctaaaagatcccgagagattcgaagactctattattctttaggcagaagctatgtaaaatccgtggtgtggctttaatgatttctgtgtttcttcatctttttcccttttaggccatccactgcagggccatcctcccttgccaagacactccttccgtgaaattaacgtacaccgcagaggtaagcattacagagtgtagccgaattaaataagtaaatgtggagtgataaggggagacaagtcaaatttcagaggtggaaatactgtacttaatacgtttccactgagcctgcacatctcattttggatctctaataaaaaggtagttttaaacattctaattatgaaaaagggaaaccatcttgttctcatttcgaaaaagatattaaaattcaagatctaaagatttaagaatttaggaccattgtttttcctaagagtaccttctgcagccatgacgcctgtgtacggatgtcccgggcagcagctgttggacttgtctgtgtgtccagttcctctgtcactggtgctgctcggccctttggtgaaggttggattataattacagagtacccttccaaaggctggggctccttagaccaagcaaatgaaaggaagaccaatgtttattcatgggatttgctttcttccccagtttctctgtag

SEQ ID NO: 19206 - DNA, 1198 bp, Mus musculus
ttctgtcttgtatcacaaactaatagccatacttaaagcgactaaccctacatttcatatacttacccagtttatttgccaaatcgtttcactacacttggtatttttattctcactggatgaagctttcagaaattccttttgtaagttagaatgtttatactcttgaatgattgattagcataaacttgaaaagattatttttttaaagacaaaataatagaggtctgccctctcatgcaaggtcagtatttagccaatcaccctccacactgctctgtaaccgctgctgtcccctcactgtgcctcctctgtgtagctccctccaaattcctgtgatctgctctctctgggccagcatttgatgcagagatggtacaggaccatctggttttacatgggtgacgcttagctgttccgttgtgatctttaatttaaccttagctctgacgtgatatctctgctcctctctccatctcttcccgatgcctctcctttgccctttgctctgcagggatctcgctgccttcgacaaatcccatgatcaagctgtccacacctaccaagagcataaagccagcatgcatcccgtgactgcgatgctggtggggagagatctgaaagtggattaaggaactgattgttgctgatttcagaaaattccttttttttaaaaaaaaaaaaaattgaacctattaagaaatacaaaattttagctgtcattgtattttaaagtgtcatttttggttttttgttgttgttgtttatttgtttttaaatcatttttcatgatttcactaatattctctgccccttacaaaccaatgtggagtattcatctgccatgagatgtggatatgagagtaatatcctcccccaccctccctcacctcctgtggccgttgggataactgtccctggggtcatgagagcaaatgagctagccctgtcccttgctggctgcagcactgcacctagcctggccagtacagtggagctggccctgatggcagaggcataagtgagctagccccgagggtatgagagcagatgagctggccctgcccctcactcacctgggcagcagagtatggctggcatggttgaggggcgctcgtgagcaggccccaagggtgagagcacaggatagccggccccatcacttgtctggtatgaggtggcatgggttggaagatga

SEQ ID NO: 19207 - DNA, 1138 bp, Mus musculus
aatctcttaaatcaagggcggggatctagtgcggcttttctgggcatgcttgtaattctagcatcagcatagttgaggcaggcacatcatgactttaaaagtcacctgagccaccagtgaaattctgtcttgaaaaaaagaaattgtatctgagctacaagtgaaattctgtctttaaaaaaaaaaaaaactaggggtctggggagatggctcaacagttaagagtactatctgctcttccagagatcctgagttcaattcccagcaaccacatggtagctcacaaccatctgtaatgggatctgacacccacttctggggtgtctgaagacagctacagtgtacttacatataaataaaataaatctttaaaaaaaattgtaggctcctggtggaacatacctttagtcccagcacttgagagtcggaggcaattggctctctatggatttgaggccagcctggtctacatagtgaattccaggacagccaaggctacagaggaactgtgtctcaaaaaagaaaacaaaccagggaggatctaaatatccacacgtaaaactgcctcttccccttgacaggcttctcttttttacctgaaggtcagttctgtgtatgctaacagatttttcctccgcacacttcagcctcacagactatgatggtgttttgattatacatgacacttgttgattgtgtcatttgagggcagactcaatctaactatcatacatctattcatctgtccgtctatccatccatccatccatccatccatccatccatccattttgtactcctatcacagtccaggttacctactaacttgggggaaagcccctatttccaattgctgaacttagtttttaagtgacagaggcaagggggagggcactcttttgccttcttagtagcagaaaagtggtttgaggtttctctcacgttcttaagtttaggcagaacaaatctgggtgccagattctaatgtgtgtgtctggtgaggaagatgggagaagacgctactgtatgggctcagactaatcaagataggaaatgaatcacgtgtccaatttgttctgagtgatggggatcagtctagccacgaagccaaactaaattagtgacaaaccagaaaata

SEQ ID NO: 19208 - DNA, 2999 bp, Mus musculus
ggcgtgcgccaccactgtccggctagatttgacttttataatgggtaaattggttagttaactcttttgccaattgtcttcacttttctccccttaggcttccaagaacaaaacacttgttaaatgtcatcaacgaaaacttcggtacccttgccttctgccgaaggtggctggatcgcttgggagaaagtaaatacttgatggctctgaagaatctgtgtgacttgggcattgtagatccatacccaccactgtgtgacattaaagggtcatatacagcacagtttgaacacactatactgttgcgtccaacctgtaaagaagttgtcagcagaggagatgactattaaaacttagtccaaagccaactcaacgtctttattttctaagctttgttggaacacattataccacaagtaatttgcaacatgttgtctgttttagcagtggacctgtgtaataccgttattcatgtttaaaggagtttgatcaaaggcaaactgtctacatgtaattaaccaaggaaaaggctttcaagactttaatgttaactgtttctcccgtctaggaaatgctgtactgctcactagttaggaattactcacacgttttgttttgaagacctaagagatgctttttggatatttatattgccatattcttacttggatgctttgaatgacttcattcagttctgcacctgtgccctctggtattgctttttaacctccctggaatccattttctaaaaaataaagacattttcagatctgagagatacattttaatgtgtatggttgtaattctaagcagaaagaggcaaaagtatggataatgttctttatctgtctttatctggactgtagatacgacagataacctcagattctcttcatggtggctacaagctcttcatgtgtgtgaagcaggcagaaaggagtatagttgaggaaggttttgctttttttttttttttttttgttaaaagcatatttaaaatgatttaagcatcatggaaaaaccttgtgccaactggaaaaaccttgctgtagtaaatgtccctcaagggttcatatttacaggatatgtgttccatattagaaaaccaaatcaacagtaaagccacaagcaaaagaagtttcaatcttgtcctaattagaacaattatcttgggattgggctttttccttcctgagccaagcactgaacatcacggcctccagtaagttagagatcccagcatcaggttactcaaggagatgaggttcgagacctttcataaactgtgtgttaatttgaacataaagacacattcgactttaggctgggcccaataatcatttagctgcttaaaatctttgtatgatttgctagaaatggtccatcttagttccaaattcgtcccttgcccaggtaaagccttaatttgtgtataccttgacacagtaatgctgtattgcttccggaatgctaaatcaatttttattttgcttgacattgtctctgaaggaaaggtagacttagggccctggaccacgggctgcttgaagttttccgggaaggctacttttgactttgtgagctgtgtcttcctggtgctgaggggctccacgtgaactcacacactcacaggccctccagctgcctccttgggttctgcattcatggtcttggtttttgagcagcttgacctctaagcccaggatattgaaaactgacccctaaataaactttagggttttctaagacctttcctgcagtctccctctttgtaaggtccaaacttatctcagagtactactgttgggagcagacatccttgtgtcctgagtggccggaaggagtatggccttataaaggaaagccaaaacaacacaaagccaaaaccaacacttgttgtttgcttagtagttatgtagcccttaaagtcattgttacatttagtgatgtgtcttcctgtgatggttaacaatagtgcctttagtaaattattttacagcctaaactgttggttttttgcgtgggtgtccaccttgcagatctgaggtatttaataagaaactgaagtttctttgcatcatttgggttttgtttagtttttttttttttcagtgtaatcttagattcacaacaaaatctagtgggaagtacaacagtctgctgtgtgctagtttaatgttttgtttcttttaaatgccagtaaaaaaaaaaaaggtgctacaatgtgttggtctagaaaaaaaaaaggttcttgaaattaaaggctagatttggtaacttttatcacatgaatctttaatgaggtatatttaacagctgatgcaacaatttgtatacgctttgggtaagtgacctaatatcactccaaatattactccagctgtatttttggcacataggattctgtcttcggttgatgtgtttttgttgcggtttgttaataagctgccccaggcgacactcctttcagaagtctgtgctaaagataactcttcctggcttagatataagctgtaaattaagtcactttctttaggaagaagggggaaaaaaaaacctctcccagtggctcacaggttccttgggatctgtgggttggtggagccccatttctgagcaggttgggtggcggtggccatggccatggccatggcagcagcagagctccatccataagacctggaaagctttctttagaacacagcgaaaggaatctctcttgcttttagttaattcaagtttagaccacttctagtgtttttaaaaaggggccagggccctgagaaattcccagtggtcacataatcctagcaagagtcaggcttagggtacttcgagaaaaacaagatcttagatgtaacagcccaggtgccatgctcgaactgtcttctctctgccttaaacatctgcccctatgcatttgcccctatgcatttgtcttactcctttgaactaaaaataaaaaataaagaaataaatctcaactacttaagatatct

SEQ ID NO: 19209 - DNA, 1179 bp, Mus musculus
tttatatacaattatactcaaatacaagatattggaccagggctgggtatatatagctcaatagtctgacattcagtccccaatatcagttggtggtgggagctggaaaccaggcatggtggcttggtccctttaatcccagcacttaagaggaagaggcgggtggatgtctgtgagtcaaggcatgtctgaggtctagaactgccacggccacacaggggaaacccccacccctctctttaataaagggtacaggtttagtggtgtccactgtgagttcaaggcctatccgatctccatagcaaggtcagccagaactacatagtaaagctctgtcttttaaaaaagaaaatgcgcatgagttcagggtcaccctaggctacctagagaattgatgccaggctggaataaatgagactttaaaggacaaacacttgtatttgtagagctttgtttggtcagtatatatgtttacttttctaatttccctaaactaatgtctaaagtaccttgtgaatattatttaacaggcaagaaagtgaatttaggttgaatatttacttgagattttaagcttttgctaaaatgggtcagtgacactgctgagggctttgagacgatgggttttctctgctcacaccgctgtattttatctctgtttattggtttgtctgagagggagcagtgtatagtaactcagtacaacttttattgagtcactaaggagctgctgcttttggcctttttgagtctaaataatctctggggacttgaaatactgccttcctgtgagcccacagttctctttttaaccacggttaatagaggaacttctggaagcaaatatgtcatttaacagttaagtaaacttaaaggtggatttccttctcttgcaggtagaataatcgattgtgcttttactgttacttttaatcccaaatatgacatactattaacagctgtaaaggatgccactaatactggaataaaggtatgtgtgctataagcactatttaacaacataatttagagtactcatagattgttttaaggcctgtataggagtttaggtgatttatattgcctataaaattggctgtttttattattgttaattttttttgttgttgctattttgtttttagaccggttttatgtttgtagcagaactgagctgaa

SEQ ID NO: 19210 - DNA, 1160 bp, Mus musculus
gaatatttgtatctcacagcaaaagttcaaacagaccctccctcagttccaatatgtgacctgtatcctaatggtgtatttcccaaaggacaagagtgtgaatacccacccacacaagatgggtaagaatcataccacagcttcccgtttgactttgactactgtagcccagtgctaaagccacttgaacttctcgcagaaatttcaattttactaaaagtttttgacttgttgcaaagaaaatacagtagaagacttcttacccaaaataattgggaccaggagcaggttggtcaatcagaacagtaggttagggtgggtattaaaaacaacccgaagtcttacaaagttggcttacttgtccctcttagtcttttacattggatttgcaggagatcacactttttcttctttataaagtgttcataatgcttttatctgttcatttcatcttgggtttctgggaagatgagcaaagtgatgagtgactatgtgtgtgtttggtatgacatctcccctgaaaacatgtatagttggtgagcatgtgggggggtgggctaggtatctgtctgtctccttgaacctagagcttgctgttttggtgggtaaccattgatcctctgggcctgcctgtctgacagcaccctgcagcactgggctttagcggcacaccaccacacacaccgctttcttacttgggtgttggggatctgaactctcttttcacacctgactcagcattttagctactgcgccatctccatagctcccactgttattccttttttaaattaaaaacctatgtgtttgtgtgcatgtatgcacacgtccctatggagtcagcccccttccacctttatgtggaattacctttgttactatcctgcttgcttcccacagttctcccctgtacttaatttgataagaaaacatttttaacttttctaagatatatttattttattatgtgtgtatgagtgtcttgcctgcatgtatatgcaccacatgcatgctggtgtccgtggaagtcacaagagcgctttggatcccctgaagtgggaattacaaatggtggtgagcctcctgtgggttctgggaactgaacctaagtcctctgcaaacagcagcagcagtgctctacctgctgagccagctctcca

SEQ ID NO: 19211 - DNA, 1156 bp, Mus musculus
tttcagttggatcacataaccgttttccacgtgagcgtctgcatagcgtttgttgacataacctgtatagatcggttttccccgacggcccttgttttctgcagtaagaagcttgattccttgagtatttactgatttttttttctaaacgatgtcagacacccccactttgatttctaacacaatggaatggcactgaggaaaacaactgggaagtatgtttttgttaggcagatacatagtaggctgtggagggatggaggagccttctattcgagaacctaatgtcatcgccatatgggggtatgccttaaacgtacttccactgtgctcactgtagtcaaaaatgctggaatttccagaagtcaaccctacctcactgcacgccacgatccttaaggatagataccatatttattctctgcatttctcctggatctttgcagctttagttgaatacattgaagacaggcttcccaaaggggttttgccttaagtaagaatctcactgttttcccaggacagctcctgctgacatctccttagggtgtcaccctgcctgactcagtacaatacccagctacccctgatgtcgtctccaaagcccccctgatccactctctcctcaccgcccttcaagcccacatccagggcaagactagcacccagctttcttcccgttcaagtctgttttcttcaggacaccacctggacctctgggatcgaactctgagtctctcttgtccttaccatcttcattcttccactgttacacccccttatgggtgctacagctttccctctgagctgcagtaacactcacttgcctgctatgcagtgctatgtagaaggccctgggttcaagcccttatctaggaaaacaaccgtgttttgttttgtttttccttcccgattacaacccctctttctgtgtagtctatttcaggcattgcaaagcaatctgcattactgtagaattctgatttaatcccaatgcctgtgaacttcagtggcattcccaatggtttggcctgcttcagcctttctcacaccagtcagcccagctctgccccttgttatgtgacacttcccagtgatgggatcctgttcttctgtccttcagactgtttgtgctcttttccctggttcctgtagt

SEQ ID NO: 19212 - DNA, 1304 bp, Mus musculus
aattgaagacctgtgtagaaagcattttctccagcaggaccttcatgaatttcagtctgaggctttgtgaggcagagtaacctgcgcataagttctcacactgacttacactctttataatcgactctagagtaacatctttacatctagtcaggatccatggtatacacacactgtgttataatttcacagcagttttttctgtatttgtaacacgtaaaataatggtgtaactgaaaaaggatggtgccttaaattagagagacttagtaaggatgatgagggagagctagcaggtgctgagtacctgccttcagttagagacttagtaacagtgatggggaaaagccagcaggtgctgagtacctgccttcagttagagacttagtaacagtgatggggaaaagccagcaggtgctgagtggctatgaactctgctgcagtctgactttgaccataactcagatttctcctcttcaggcaccgctggcttcactgcatgactgacgaccctccgacgactaatccaccgactgctcgtaaattcatctggacaaaccataaattcaatgtgtctgccactccagagcaatacgttccttattccaccactagaaagaagattcatgaatgggttccaccttcgacaccttacaagtgaccgcagtgaagactgttcctgcacttccaggctagtgcaggaccatcctagcagctgaccatgaacttgattaaaattgtttgacctagcagtgtcttgtgcgttcacaccgtcattcatcccctgcaaagtagaagctcgcacatgagggagggaggtgactgacatagatctctggggcgggggatgggagtggggggtctgaagtaaagttcccagttctaggaaatagccccaggggacctgtttgtgtttcatgatcttccccgacttccatggctggttgataagggcaggctgcattccaacctgagccagacattggtaagcttcgtggagagacacaaacaccgagtggcagcctggctcagactctggtgtggctctgtatggaggaggttattggagatgtcctatttccttccccaccccactccccctttggttttttgagataggatttctttatgtggctctggatgttttggaactcactttgtagactaggctagccttgaactcaaaagatctacctgcctgtgcctcccaagtgctggtattaaaaggtgtccactaaaaccaccttgcaagatgttctatttcctgggtaattgtttgtttaatctgtgttttcttcacattt

SEQ ID NO: 19213 - DNA, 1219 bp, Mus musculus
cttttgctgaccagtattaacaggactgtggaaatacaattcctttgtgaccactagtgtgagggcgataattgtacacctgacttaatataagcattgtcctctgtcgcacttaaaggaaaaaaaaaaaggattcctaaggatattgttgactctcatgtttctattacatactcatgatgtataatagcactagaacagaagacaattatggtgtgtgtatacaatagaatactcttgacccattaaaacattcgattgcatatgtccatggaatctgggtcatatttgtccaaaagaaaaagcaaaatacagatcacagtgtacagaatatgaatgcatatatgatggcaaatatgagtacaaaatctaaaagaatatgaagctgctttttatcttttggatgttttaaccttgtttaagttttttttaatttgtgaatttattattttatgaaagtgagatcatgttatgttttttaattataagatgtgccagggaaagaagcagctgactgccggcctacaccagtgtgcaaccttgggatcttgggattttttgttgttgtattgccataaattctacaaacttgtagacctgactactgactcaccacatatcttgattctgactttttttcttgaatgccctcctgtattctctatgttcttcatgatatttttcaccgtatcttgtaattccccctacccctggattatttttgctctttctgtacatatatctttctggtatgtattacacatttcctttttcttatctatcatttgtttatgtatttgtaaactcacaaactattctagtcctagtgctaatagaactatgttgaatttaaagagatacttgggttacttatgctagtaataactaaaatgaaacagaaactgccatgaggctggagaactcacatttgccattgtgtgtgagacccagtggaaggcaaagcaggagctgacacagaaggaataaaacattcaagtaactcagtacagaacacattgaatttatgatcaaaacactgacagggaactccaggcacatacggctgtactaatgaatttcatcaataccttaggtaaagcgttccggtgctaccctgtttcagaaaaacagcagtttcatgagttcaacataatcttagtaccaaaatatgccaatagtgttttataagaaaatcacagaccaatattcttcataaaca

SEQ ID NO: 19214 - DNA, 1203 bp, Mus musculus
acaaataagcttttgaagttggctggttacagtatcttaccagaaatttaccagttaagtcgtcatgcagtagaaagtatgattgtaagaaaataataatgtaattcagtgtttggtggttgattgctaaccactcaaatacatatcttcttcctttcctctttccctgacttcccctgtttttctctaaatcataattattgagcttggcatgttgccagggctctgaagggtctgctcccagctgcacttcaggttctggcaaagtgtcaaaatgtgacatttattctctttacaaatcatgggatggctagccaactgcctgtagagtgcctagtgcagagttgtctttgggtttggagtaaatttcgaatttctgtttgtaagtgaagcaaatgcctgatgagtgttatcactagactttttaatattttgaaaaacaacaaaaacagcattcactttgggggaatgaaatatttaaagtattgttttgaaatgctcaaaggcatagagcatgtgctttttaatgaaatgtatttggaagctttccataagcatcagcagctgtgctttttgaatgtcttgaattgccacacttttgggcagacattgtactattcattgctttaaaaagttgaatgcctgtgtaggagaagatgtaatatgtaggtctgtagatatggggtcagtcaaaagtggtcataagggtgcgtgtgtgcacttatatcgttgttagagttgtaaagaagggacaaggaaatgtttggttaaaagttggtgttcgtagaactaattgcctttcagagacattctgtagacactaaattactaagatgccttatttttttcttgttatggcttaaattatatgcttattttaaaaggatcttttaaaaaattttatgtgtacgaatgttgcctgcatgtatacagtgtggtgcctgcagaggccagaagagggcattgggtttcctggagctggagttggaaatgattgttagccatcatgtgagtgctggaagctgaatctgggtcttttgtaaaaacaacttgcagtgtgttatcttaactgctggaccctctctccaacttctgaattatgtactttaaaaatttgcattatggatatatttagttggtaaactttttattatagattcctatgcatgcacgtgtgtctgttttgagtgtctaataaatgga

SEQ ID NO: 19215 - DNA, 1212 bp, Mus musculus
tccttctcagtactggggcatacagaaagctgggaaacctttgaagaacaggattatagtgactcttctcatattcatgcccgacaatttctgaattctctgagagtagcctttctggtagagtagctaatctaatgtgtgcttcgggaaaacaatgctctctcaactgttttttctgctggcttgcttttaaaatctcttctggtagagaagggaaaggctttgtaataggagactatctgccaatgttttcttcttcccaaagcacctactccccaaacctctttgcagtgctcatttggggatgaaaagaaagaaatcagtatctaagttctatatggtatgaaatactgtggttatagtgagaaatgcccccagtccttgctattcattactcacttacagggcaccctgcatgcctcactgggagagacagtttcatgaggagatactctgctcctcacatggcttgatggatatcttagtgtctttctgtttttcctttttcttttaagcaaatcagtcatttgcagatccaagtgacctcactgacacagtcggagaacgacttactgaattcaaaccacatgctgaaggacatggtggagagactaaaacaagaatgccgaaatttaaggagccaagctgagaaagcacaactagacgttgaaaagtagagtttgctctttttttgtatacaaacttttttctttctgctgtataaatattttattgatgattgaaacattgaatgtatttgtgggaagttactttctccttctatgaaatgaacttttactccttaattgcttctaaaaattttaggaatggacaaaggacctttaaaattatatctgagcacagtgttctcaaaactcttaatgagaaacctttattcatttagcaaattaaactatgattccccaaatctgtcttgaaaaccagagaacagaatgatttgggttgtgaggttgctcgctctctctgtctctgtctctgtctctgtctctctctctctctctgtgtgtgtgtgtgtgtgtgtgtgtgtgtgtgtgtgtgtgtgtgttgcaaacagacacagagttagaactcaccgtttggatttctcttgtgaaaagttatctacttacttatattctttataccttaaaatgcactgctggtaaacggtaaacggtatggagaatgctctgggtatgctcaggattttat

SEQ ID NO: 19216 - DNA, 1636 bp, Mus musculus
actgagcagtacaaaaagaccggaaatagtcgcctatctgccccgccccattctcaagtcttccctatatgaggtgcttgctttattcaatttcctgttcttttcctcctcaggtgactggatggccggaatcccctcacacatcctcagcagctcgccatcagaccagcagattaaccagctggctcagaggctaggcccggagtgggagcccgtggtcctgtctctgggactgtcccagaccgacatctaccgctgcaaggccaaccatccccacaacgtgcattcgcaggtggtggaggcctttgtccgctggcgccagcgttttgggaagcaggccaccttcctaagcttacacaagggcctccaggcagtggaggctgatccctccctgctccagcacatgctggagtgacctgacccccccccgcgccccccccccacttgctgtgggggtggtggggcgtgggttcccaagtcacactggctgaaccggacttttctcagcaggtggctttgttctgggcttttcagtgatctgtttacggaaagagatcgtccaccactcactcaaccatcgattggctttaattgcttgaagactgcgctgttgtaactatggtttggaactttgtggctggcctttaacaggaggccagaaaaaacacaacacccaccctacccaaccccccaaaaaatcatgctacagcatcgaatgcaggtgtcctgcatacaaggcagctacacttgtgttgcctggagactggattgtgcatttagctcttcataatggtgatgataataaaaaagcaaattgtgatatagaatgtgcctctttcaatgagagagtattatatcacacacacacacacacacacacacacacatacacacacacacaccactcttctgttgcatagacggagggtgtaaaaatatgggagtggagcaagattgatagcagtcatgtgacgacggagataaataactcaggcaggatgtatagattaagcatgagacaccgaagctccctgcagaggccagggagagaacggaagaccttcatcttaacaaattgtatgaggagtctctgtccatttgttaaaggcattggatcagagacaagagggctcagtgtttctcttgaggcctgaatggctgaaggcggtgagttcccgaggggcgtcatgggttgtccagcctttcattaactgcacatagtgttagccagacaggtgtacgtgtttgtcatcccatctaagagactgaagcaggaggatcacctgtacatgactgcttctttcaacattttaaaatgtgtaacttctattaaattctctcagtgcaaataaagtgcgtgtccattgtgtcctttcaaaaacctaacaatagataagatgaggagaagcaagagtctccttgtactccccgcagtcagtcagctttgctctgctctgccgtcagtttcttagttaagcccgcccgcacatcccttctgcagctggagcaggattgccctgtaaggctctttaacacttggcttccttgccttaacacatagcacttgttccaatgccaaaggcctttacaacatcctttgctcttagagcacacttgcaagagctatcgttttggc

SEQ ID NO: 19217 - DNA, 1147 bp, Mus musculus
gcgtgtaaggaggggtccaggtggaacagtggacgacttgatttcataaaatcgttgctgttgatttattggacagcagtaacatcttcattattcagattgcctcatggtcctttttaagttgcagaactgacaaatactgaaatggtcttcgacactgctctagagtcttggcagctgacggttctggagtcggagacaagggctgtgggacccacagctcttcttgcagggtcttttatcttctcgttgaatcggaaaatgaagcaggggctggtgactgtggagtacgctaagtaaactgtgatgcagctggccagcaagtgtcatacagatgctgtggcacatatgaccgcgcctcacccttagcaccgctgcggtcatcttggatgcttagagtccctctcaaacttcccttggcctctgtctctggcacactccagttcctccacctttgcatatgcggttcccttaggaggggctggaccaccctctttacccagcattctcttttcaggagctagctttagcttcttcgctccatggctcacatccagttagaggtccccctccccgccccccgtagaatgtcagtgtctgtacagtggcacagttacagccacacacacactggcactcttcagaatcctgtttagcaagtgtaaggtcaagctctccccagcacctactcctacgctgtaggcttggctgggatggtgagacagctcgaatggcttctagtctcttctcccatcacatcttgcctctatggcttgtttttttcctcagggagaggggatgctctggcttcctgcttctgtaccttctattctgggcgatgttttatattgaggctgccaggagagagaagctgtcagtttggcctcgagcccctccccacgacccttcaaggggagcagcactcacagcttggagcagcacactgctggcccccaggctggtattgaggggagtggttttcagccagagctcttgataagatttctgacaaaaagagacaggagtttaaaaaacaaaaacaaaaaaaaccttgtgacaaaatagtgtgtccgtgagcatgatacatgtttgtctgtctatatacacaaggaggcagaattaagcaactatccatggatttttcttc

SEQ ID NO: 19218 - DNA, 1243 bp, Mus musculus
catgtgcttagcagtgagctgagatatcccatcattactgggatgagatccccatcattactgtatttctcaaacagataaccctgggggtggttttagaaacttatcgattttatgggaagaaaaacaacaacaacaacaacaacaacaacaacaacaacaaaaaaccccaccacatatctccaaatcaataactaaatatttctcataggacatcaagaaatagaaattaactcatttctgttatttaaattattagtggctccttataggccactacagctttgggtaaaatgagcttgtctctgtagtcaagagtagtaaatgcagtgggtgttttcacagatggcattttgcacatgctctgatttgctgcaagcctaatttataggagtatttggccatttattttagattttctgcagcttgatctgccagttagatggactcatacgcaaagacctcaagccagcggtgccctagacagctttgatcctttttcttttttttcctgcaggaaaggaaaagcatgggaccttgggagtggatcagtcatccaaattcagataggtgctgttgtctgttgtgattctgttgggctctgttcttctgagagatcctcagaggtttccaggaactcaggggctaagaaatatcttaccgagaatttgaaaatatctcggcatttaattttgtgtgagtgtagagtgttttatgactctttaagttttgaggaccagcaaaatagagaagggtattgtgttacatagtgtgctagttacaaatgtttgcttttattgcacatgatgtaaccagagtggaaaaaaaccacagcagtaataatcgttgatataatcttggcttgaaggtagggggaacacggggggcaagggaacagcacaagagagaaaaatatctgttaccaattacagcaaagttactacatagttaaaaagaagttgtacatatgaataagaataggatgctctgctaactcaatcaaaagggaaccgctcgttttccttaggtacttgatgagggagaattcttcctgcacgatttgcttgaagagtggattattttgctttgtgaacctcttcagtccggtccttacagaataccatttggctaatttgaaacggttccagttctgggcttggttgaacactgccagccaaaagcctgcctgtcgtcttccattcgcatgccttcctgccctcggtgcccccaacccctatcctgc

SEQ ID NO: 19219 - DNA, 1213 bp, Mus musculus
atggacgtttacagtacctaaacacacacataataatacttgtgagtgcttttcatgtaaactctgatttcagccttggagaattttgaatgtactaaacataactactctagatttcaattttcagtgagaaaaccgggtctcctgacttccctgtcattaatgagcttgcagcttcttgtttgtaaggcaaatgtaaatgctttcttcatttcttagaggtctgagtgcctctcacatcttactaggcttgcttttatattttaatttactgtttataaaattggattactattgctttataaattctatttttttctttcagaaaatggtgtgtgtgtgtgtgtgtgtgtgtgtgtgtgtgtgtgtattttaggcaagcattttactgctgagtcaaaaagtaattagcttcatagtcacttgaaaacaggaaaattgggtttctcttgaacttgtcttgttttgaaagaaagacatttggttctttccttctgctgaaaaggttaactataaattgcaacaaaagtcataaaaacatagttttggcagaagcttaaatggacagtctgacagactggaggcatctgacaggatctctctctctctctctctctctctctctctctcgtggtggttctgttggaggtttctctgacgattctctgagaacaggaagcaagacttgatttttgttttgttttgttttttttgtttttttgcttttggctttctgttttgtagaatgaaaaactttagcaaggaaaaaaaaaaagaagttttctcaactgtatacttaaacaaaacaaaacaaaacaaaacaataagaacttttcagcccaagaacttatggtattccagagtttattttcaagttacatacttgatattaaggatatgtttttctcaaggaaataatgttgtctataaagtattttggattttcaataaacccaaaattcaaagaagttaaatctaaataaacacaggacttcaattttgcacccagacccttgtgggacctgtctgtgatgtgagacctgtctgtgatgtgggcaggtgatgttggctcttgggaggttaaggaaggaggattgctgagttcaaggccagcctgggctacggtggtaggttttaaaacagcaaacaaaacagattctgctgcattcagatcttttttaaaggataatatgtgtgtacagcagttgttaca

SEQ ID NO: 19220 - DNA, 1231 bp, Mus musculus
ctgacacaaagacaatctcttaaggtggcagattttctagaaagaattttattttaaggaggaaaagaaaaaaaaacaccattgaaaacagatgttgttcttctacgtcatctaaccactggcatcttccatggagcaaaatttggcaggaggttttggttctgggttccccaacccccagagcacaatttccaacagatgctatgcactggaaacaaaatttaaaacagggaaacctggcttgtcaaagttcaaatctgaggttttccaagtttgtgttccagatccagaggacatacccaaagaggaagccatttgcttgattcaggcccagggtcagttgagccactcacctttggcagcaaaacccaccaagatgtcaaaaatatttataaccaaagatgctaatttaatgctgcattaaaaaataatgttaagaataattgtgatgagcaaatgccatatctaaatttttattcttaaatttttcaaaagtgtataaagtgaaatatgatcatatcccctgctactttttcctccaatttcctcaaatcacccagcacagccagaacccaatttcatgtctttttttttttttcttttttaataacccacttattggaggagggtctcgtgccccgtggtgtatttagacgctgacttctgtccctcgtgatctggttacattcgggatgagggcattgtcatgaatattgaaaaatctcctgtatcaacgtagtgtaaagactgttccccaactacctctgattggttaataaaaggttgaacagccaatgactggccagaggagattgaaaggttggacttccggtcccagccaggggtctcagaaaagagccaggaggagccccgaggcaggtgaggaggtacaggaggcaggtagaagaagaggaagaagaagaaaggaaggagaagggggaagggagggggaggagggagaagaagaagaaagtcagcatgaggttggtgtgaggtgcagtcactaagggagttcgacttgaggactctccgagggagagccctttcccttgtctatgctggaagtttggctggcttaatcttactcacgtcttgtgttggtgactaaagtcaccctgcgttcatgagctctgctcatgtaaagaccagaagcttgcccttcacagcattcctccccttctctggctcttacgttctttctgcttatcttccacaatgctccccgagcctt

SEQ ID NO: 19221 - DNA, 1183 bp, Mus musculus
cattggttaatctccacaacagccaggagcattacagactccttttattgaaaataaaacagatgcttgaagatggaaactgtagcgcccagcaatactgccctacgactaggagtctgtacctgtatggagactatggaacacaacgcagggttatagctatgagtgacaccatgctctcctctcctcttagtctgataaagcattccttacatgagagaactggcttaggcttgtgctgtgtactgtccttctggactccctgggtggtaggacttagaggtgaagagtgagagatgtgtggcgggcaggcaggaagcaggtgcctgggagaggagtggagaggcagacaagatgttcaagtttgtcaccgggctcagatttgtcccagatttgttccagattaatttggagctctgggtctggaagctttctgtttgataccagcttccactctgggcgagctgagccaactctgccttttcaggaaagcagggagcagtggcacagtgggtgccattctgaactgggaatgggaagagactatttctagttgctttgtcttggaccaaacgccgagcttcttagaggctcagatactacatgtgtagaatgtagagcttgcagtactgatgtctacagtcagtctctttcaggaagttaccctcacctatgagcacatcaggatgggaggagacagaggggcaaactctatattttgttgggtggtctcagattgacttaagttttagcatagatttttgcctctatgctatcataggctctggcttatttggggaaagagattctctctaccctaaattgttttttcccttttcacagtcagagtcagtagactgtttttagtatggtaagaggaattttatgttgttttctgagccatgaatctttgagccctggcctgtattcagagtatagacttgggcttttagatcctggctgtgatggaggaggctctgatgctgggaaccgaactgtggccccggtcctctgcaaaagagcagcaagtgctcttagtcaccgagccatctctccagcccctaaccatcttttgtatttggtggtctactccctggctccatcaactgatactttgtttctggcctccttcccagctgggactataggtatacaccatcctataccactgatactttgtttc

SEQ ID NO: 19222 - DNA, 1231 bp, Mus musculus
ctgggtcaaaagtccaagctccataggagagaaagaaaggcttccatttccaggaggacagctgaaggagggaaagaccctggctgacccaggcttcagctccacttctagacgcctggggttcagtctgtgttagaacctgttatagtttgcatcctgatgtatctagtaggagttccgttaagctgaccatgcttgtatttatccctcgtcttatgcaactaatcaaatcaaccaaaaaaaggaaaaaaaaaaaaaaaaaagaaacgaaaaaagaaccatcaccatgagatcctgtatttgtctttttttactacacgtatgacctcccccgtgagtgagtactgtagtcctccatctcaaggcagccttacttcagacacatttcaaactggtgcaaacagaaaagacttctctcttttcttctgaggctaaagacaagaatgtcacgctatacaggtgcaactcaatccttgaaaacagaaaccaatgcagacagagacattttaccccttgatgtagctgtgagtcccaacctagtgccattgtttttatttttatttttatttttggaaatggctttagaactttccaagttatccttgaattgtctgaccacggacatcaacagctgcctcccttctaccatgtagaatcctatgacttaacttttcttccagatatagaggggtacctgcctgtttttcaaagtgtttatttactgctgttactatttgattagaatgtatcaaataaaaacaaacctgacttttacaagttgcactcattactttgagttgtaggtgtacatttccatgctaataaaaggtcgccataaaaactcattatcaagtgaaataaactaagcaatcagctcagggtagaacattaactcgcttgcctccaaataaggcccacacctgctctatgtgttttagaaagcatggttcacaggctaggaatcgtcaagacagcctgatcatgtgcaggccggatgggcacaatccttgtgcatttcaaaagcaatggtttagaagcgataaaagttacgtcagggtctaaactctaacaagttccgcagccgctttctcttggccacccagtctcacgactgctgtagcatgccatcttctctagagtctagacactatgcctcttgccgccctgtacatgtttcctggccgggccgtaggttcctgtgtgtccagggtgaaaggagaacctggggcgt

SEQ ID NO: 19223 - DNA, 1160 bp, Mus musculus
ttgtaggctgtgggcttaaagcattacattgaggctgacaagtaattgcccgatgactttgacagacaaatttgcctatcttaagcatgagcttttaaatgggagtgggaaagagagaaaagcttgttcaaaggaaatagcaattaaagatgttcccagcaagttgggaaaagctaaaggaaaaggcagaatttgtgaccacgatgtctagagagctatttgtaaagatttagtttgaattttgtgtgtgtgtgtgtgtgtgtgtgtgtgtgtgtgtgtgtgtgtgcgcgcgcagagccccaacgaagccaaaaagagagtgttgaatccccaagagctggagccccaggtaattgtgagccatcttatacaggtcctaggagccaaactctaaagagatctgtgtgttgagtgtatgtttcacaagaaacatactttcatgtttgttttagaatttttggcatatggatactcacgtacttgttgtctgggagtatattaaaacaaaacagaaaagatttgacttttcccaagaatattcctagtaatttctggggaagccaggtgttgtggcttaggcctgtattctcaacattctggacgttggcagaggttgatttagtttgtttgctttttagaattccacgactaagccaggaattgtgtttgttgtttattgatactcatttcttttgcctgcctcgattaccataccattgcagcaaccagacctacagtgtgagagcctgtctcagaaaacaaacagaaaaacaaacaaacaaacatcttttggagaggctgaagagatggctcatgggttaagagcacttgctgctcttgcagaagacctgggttcagttctgagcacctacctggtggctcacatccatctgttactccagttccagagcatctgatccctccgggcaccagggacccttagtattcatatatatgcatgcagacaaacactcatacatgtaaaataaatggctttaaagccctttgaacttgcacttataattattgaaatgacctctattaaaaagtaactttctctcccaacttctctcccatgtaaaatgctacctttgtacacactacatcactgttctaaaacaaatctgcttgcagctacagaactgcctaattaatggact

SEQ ID NO: 19224 - DNA, 1208 bp, Mus musculus
gtattaaaggcgtgtgccaccatgcccggctagccccagtttttatccccttgaatataactggtcctgggaatggccctcagcggtaccttctggagatactgaagcatgcttccccatccacgagtgctggataggctattaagactcagtagtggggctggagagatggcttagcagttaagagcaccggctgctcttccagaggttttgagttcaattcccagcaaccacatggtggttcacaaccatctgcaatgggatccgatgtcctcttctgttgtttatgaagagagcaacagtgtactcatacaaaataaaaataaaaataaaaataaaaagttcattagaagcactgggggtgcatatctttaatttcagcactcaggaggcagaggcaggcagatctctgtgagtttgaggccagcttggtctataaagtaagttccaaggcagctagggctgtacatagaaaccctgtctagaaaaacagacagacagacagacagacaactcaatagaatggcagtggacttgacagaaaccctcccctcacgatgtctgcctgagcttcttgtgcttctgttccttactgtgagaatgtcctgtgtcgctgcaggttcaaggaaaactggagaaataaacccagagtagactcaaccccgaaggggaacccagaatagagctctccctgccgacctgcagatctcagcgggggaaaaggtgataccgttgtgagccactgagccatttctcacacagcgtgctcaaaatagaaacccggtggagaaggtatccttcccaggcagaggctgagaaatgagaagagatgttagaaaaaggccaattaatgctaagtatcgatggtcggtccccatgttcaaatccagccaacagttattaaataagttcaccactaagcttcctaattagaatccaaactggaatctagtctgctgtgtctcaaagtcctttccgcaatgggcagagaactttggagcctgcgtttgttaagctatgactgtatgttagtgtctgggtaaaacactgtcttatgttttatttcaaacagtcctttccataattctgtgctttcatttcctaacagtatccccacttttcgtcataggaacggaaacccagagtgggtaagtaactgtcagaagcagtagaggctgatgacaccccaggctcacactgaaaagcca

SEQ ID NO: 19225 - DNA, 1152 bp, Mus musculus
ccactgactaaggaaacctccctagcccctgtcatctgtgttctaaaaagctctttagattcagattcgggttgacatttgacaaccactagagagaggagcaagctgtccagagctgaactgtgatgccacgtgccccacagaagcacatgtgtgtgtgtgttattaacgtgttgttaacgtgttccctccagatgaacctgcaggaagcaatcagtgagcctggggtggccatggaggggccaaagacatatacttctgcaaagaaagccaaggaaaaaaagaactttgcttcatggccgcctctcttgcctgagtgtcagctgtttgacatctttccactcctccgagcaacacagaagaacatggctctctcagaagacgaaccgggcatcctcccaaaactgtcacaaaatggcacatcctgcagtatttactgatcccctgggaaatgctaaccagaaattgggtttgcttcttgacttgtgtcttcacagttgaaaaccttctaaaatggacctgtcgctttgccacacacagaccaggaaaaccctaaggggcaagaacttggaaagatttcggatctttatgaagcactctgactcaaattccgacttgatttctggagagacgaaggctgggagtcactgagttctcactgacctctgagctttgtgtgtgatctcagggggacatcgtttgtggcacatcccagtgtgtacatctacggctcatttcccatttatagctgacatgtgaacgtcagctactgggctggcagttgccggaagtgtggcacattttaaaaaacacggagacacagctgctaaagtcactgttgtgtccctaaaaactgaaatggagtgctcaatgcactggaaggaagaaaacatcatcctaacagccatggcctctccaggagcccccagatctctggttcttgttttgagcattagctctttccattagccagtgtaggcagccctgactctatgattgggagaagcaacacaaagtgaaaatagagatcttctgtgtgaaagttcctttgaggtgggaacattgaagcaagtgagaggtctttttgagtgtggagccccgtgcttctgaaggagtctgacccacgaagatagctcggtgtgtaggagctgg

SEQ ID NO: 19226 - DNA, 3988 bp, Mus musculus
atactagaaaacttggaaactgttctttttttatggtccacttaaaggatatagccatttatagaatcaacaaacttcttcctgctataaacatatcatctattcaaaaatgaaagaacgttttctatctgttgaattttatgaaaggtttgaagctagtctagtctatatagtgagattcttagaaaacaaaacccctaattagttgcactgttttggtagtaaggtattcagaaaactggtctgatccagtttataggagatggtatctatcttgtttggaaagaaactaacagctgcatatttgttttttgtctacagcgagagcatggactaggctatatgccatgaacaatatttaagtcgatcagatcatcgagtgtacaccacttctcctgttctgccaagacttcttcctttttttgtttgcatttaatggacacagtcttagaaacattacagaataaaagcccaggcatcttcatctttggtgattacatgcacattagcaaatctgtcttgtcctgattcactgttgtaaagcatgagcagaggctagaagtaccatccgggttgctgagagatgctgagaagcaggactctctgctttgactccttccccatcatggttaaagtacaaggcactgtgaatgaaggtagttgtcagggttagctgccaggggtatgggtgttattttatttttagggggaaagtagttttattttaattttatggcccccttccccctcccccctcttaaaggatctaattgcagtggttaaatgcagctaaccagtttttttagaatatgctctctagccaagtctaactttagacgctgtagatggacaagcttgattgtctgaaccaaaatgggaacattaaataaacatcacagccctcactaataacattgtgactttgctgtcaagtgtagattctccacccccacccccaccccgaaaagacgaagaaaaagcttgtgaccattttgtatggcttgtctggaaacttctgtaaatcttatgttttagtaaaatattttttgttattctactttgcctttgtacagtttattttactgtgtttatttcgctttcccgatgtgacaatcgtatttaaaattaaaatggatgggacattctgttttagtcctctccatctgacaaattggcaagaggagaattttaccagtttgtttcattgatgcagatctgtgttaggattctactgagtgagtatttataaactggctctgagcatgcatgaagcatcaatatctcttttttttcttaagcctcctagaaatttgaaataaatattacctgattcaattaggtgatccttggtgtccttgccatgtttgaaagttgaccatactcagcagtcacagtgaagagggcagttgcatgtcacatatggcatttgagcttcaggtgtaggttatgacttctcttggttcttgtctgaacactatatgaccattggtttgtgctattaggaaaactctagttatttgattttgctgaggcagttttgagtcctcctgcagacctaatgaacccggcaagtggtgtcattggctcttcagttcctgtgcatttgctatgtagccctggctgtcctggaactcactattacagaccaggctggccttcaacccagagatctggctgcctcttctaggatcaaaggccactgtgcccagctattccttttatcctttaatttgctcttagtagttgttttttttcctgtgtaaaacaatccctttccacattttctacatggaatttctgattcttgctattttaaagtcgtatacatgtaaatgctaaccttatggtcagaaatcttcatctccataatcttcatgcaaggttatggatttcttcataacttaagttttttttctcttttgaatgcagactattttattgtgttagaatagaatttaatagaattatctattaaaattatattttcaacatataagagcttttgacaactgataactggatccttccaaataaatgcattttgttaacaaatgtaaagtttagaataaaattgctaatggccctacctgatactgtgaaattttaaactctctaacagcagttgttacaattcttggcctgagtacatctttgtccatggctaagacagttctcactttaaaaaagcagacttgacaggacttgaagttaaccattcaccactcagcattccatcctgaaagccagagctgctcctagtcatagctgatgccttacacattacccacagtggcctggtgggcagaggtttcagttttcccagtttacattaggactcctaatttcctggcatcacattttctttgaaggttttgatgagtcccattgtttgaaatttgctctcttagccagttggaagaagcaagaattgttacttatgcctgggctgaaaagaaacaacaggttgaggtggaggttgaactctggtaactacacctggcttatggacctgttttcgttggccaggaaaatggttggttcagagctgttaaatgatagtattgcagaaactcgggatagtgaataagacgtagcactaattagactgatgatcattgtgtggacatctcctggcaggagctgagtagcagttaccactggatgacatgccattctctttttctgtttaaagtaggtcggaatcattcccagcctacctgtttctgtatgtgtggttctgttttcttacaaagttttgactttgtagccccagcaaaagaaagacattcacttaacaaaagcatattaacatttgcctgctgcttgctggtttgaggatgtagatgtgaatgaatagtttgggcctttcctttgaagggacagcataggcgtgggaacaacacaatagttgcagctcctcttggaaaggctaatcttctggactcaaatcagacaaacgcctccaacctccagaaatctgcacatgcagagctcagagagagaagaaaaccaacttcttccaaattggcatcttgaagtcagttctgaagccctagagtataaatgtgggctttgtggtttgaagtttttgttctcttttgttgtctattttgctgtgattcacttctactgtgagattagttagccttggttcactcagatcataggcattctgtatataatactgaatactcacactagaccaggaatgtacttgtaagataaagttcagtgtaaatcgatatattcaaaccacaggggtgctgtgctcagcatttctccggagggtggggaagaccatctggtgttctgtaagagtgctcccagtcagccaagtagacctcagtggtgtcatgtggacagttggttggctttgtttccctggtggtttaggtattgttctcttgactaatgtaataacatcagtttttattactgcagaatcggaagttttaggactacataggagagctatccacatacaaattacgaagtgagatgagaaattgggtacctaacccactattccgtaagaaatatgtaatatttcattggaatgtattctggggctgggagcaacatttcatttagctatgaagcatgccgccttttaaggagctatatcagggtttatattttaagtaaaaggaaaacatgttgaatgtaatttcaaagaagtataaacaataaaaacgtataccgattggatgtgatgatttgactggtctgtttcctgcactgctcactcacctccacactcatttcattatcactaaggctgggcatctttgctctcagggttagcctttccctctacacacttctgttactagggattgaaccttttcttgtgtgagttaggcaagtacctccaagatgatagtcatctatcttagctggaatcgtccaggaaggtattaaaaaccagggagaagctgggttagggggcaaaatgactttaaatcccagtattaaaggctaagtaatc

SEQ ID NO: 19227 - DNA, 2953 bp, Mus musculus
aaaaactaaagctgggctgttctccgaccaatggaaattcctcggtcccttccctcccagataacaatgccttgtttgtgactgctgcgccgccctctggggtgccatccagtataagatagagggttggggtccctcccccatcatgtgatgcacatgtcacaaggagaggctctttcacttctaacacacctgactgctgctggcaaactctgtatttgctatgcagggatttcaaataatttgcatgtatttcatctgctttcaagtcttttaaaataaataacaaaatagcaaaaaatattttaagatgccaaagccatgtggaattttttttaaagccttcattgtaccccattcctttggttttcatttttataacctttttgacattttcacttttgtccacttaacattctatggtttgttttgacagatcaactggttattgggtatattttttgcccaatttttttttttcttacagtatcaaaatagacaccaaatctttgttgggaattaatgaaaaattcttggtatttaaagaaatctatccaccccaaaacttaaagagagtcatattctccctttgtaaactgcagatttgggccgtgtttgtatgggccaggagcctttgacaaagcacttcagcttcctgtttctgagaatttgttcacaggcagaattatgtcacggtccatgtactaggaccggttcccctctgccacagtgatttgatgtgaaagtgtgccgtcttttagggaaaactgtcagtacttacacgtggctctgcatagctcatcctgaaactggttatagaaatctatttagcacgctcagctgctatttcccttctttgacatagactctattaggggccacatttccctcaagggtgagtactctttaaatatattttcagtttctgatttagagacattgttcaccactggactagactaaccttggatgccggtcagtgacgactttgtcacactaaataagatggctgttctaggcctaagacactgtcttgagggtcagtaagtgacgagtcagatgagttaactgtggggaaactagaacattcgagccaagaattattgtacctcgcctttgtgctgactcaaaattggccatcccatgaaaaagtaccatgacttcatggaggaagtgaagggggagaagaggaaaagatctttagccattattaaccttttgtaaatactctaactggcaagcttaagacagtgaagacatttgttctgtcgcttgttaacctttaaactgtaatagtgctgctgacaagggtccttgcctgtaaggaaaactggcaccgtttccataatgagatcttgggccaccgatgcagcagaactaaaagcattagattccaaagcagaagaactcagccagtagtactcattctaaattatgtagtgtaaccaagcgtgatcgtccagaccttttatatttttctttgtacagaggtcatgtactctgggtgttttaaaagaaacattttaaagaaacccacagattgtcattctctatcttgttttctcacgattctctgcaattcttccctgtactaaacacaacagagaaactggactgttttgtatagaatactgcttccagcaaataaaccatcacaagtgcttgggggtttgtatgtacacgatactctcagaggtaataatgcatgaacctattttatatgtaaaatatgtacagtattcatgtcaaccatctctttaaaagttagcctataaatattgttgtataatttctttggtcagaaacatttggactaagtcatgtcacctgggtcaggatttctttcagtgccatttagcaaactgtctttagtctatgcaaatagcaaagatttacagaatgcaactgaatgcagcttcactgttaaatttcacctgagggctcctcattattcttctggaacccagaacttgaaagatctaaaggaaattgaatctagtagagctcatgtctaccagcccagccgcctgcagcggggagactgctgtttgtgcttatctgtgcaggcgctgaataaaacggggcagctaaattctccagttccatgtgcctcctaatgtttaaaagaaaaaagcaaagtaacttgttaaaaattgacttgcaaaaaagtagaaactgttgggtggtggtgtaaagaaatggcattttcccaccaaggacaagccatccagttgtcagtcacaccgtatgaagcagcaaaggtgaaggagagaaaagggtatgtgtacaagagttgctttgcatggtctcatctgagatggttgcattcgaactgttgtaagaattgtaagaatcttgacttttttacgtttggaaacatcaaataaaaatggaaacaacctctgtatgtttatttttagtttaagaagagcctgttttcatctttcaggtacatgcttttacagggggctagagaaatggcttaagagtgtttgctcttctttgaaatgatctgacattggttccagcacccacagaggttcacagcatcacacacacaggtttcagagctatgcctttgctgtatagaatctgttccctcagctagatttatatcatgtgcagccattctatacttccatgtggcattctacagtaaaactcacatcagacttcatacacacacacacagctcttgtgcacttcgactaacttggattggtggcttaacgccatgaagtttcctaataggttaataaccaaaactagaaaaataacaggacattccttactataatttccactcaaacatgtaaaagaactagaagtttcagagcagtgattaaatgcagtagtttgggctgggtaagtagtaataacacatgcctttaagctctgggagacaaggagagcagcactgctatgctaatcaatcacaggttcaaagccagcc

SEQ ID NO: 19228 - DNA, 1181 bp, Mus musculus
ggactctaaaggaggagttagctcttacagctgcccatcacagactctttagaactttggaggtggcaggctggaaatctgatcaactggggaccacgtggtgttacacagtggggttttgtatgttttccttatatgtacaaaagaattgctgctgtccatgacccatgcggaagcaaggaaatggcttcctctgtgtgaacagttctgggggtgaggatcaaatccatgtacgtgataaaagattgctctgtcactgacctaccccttggcctttcatggtagaatggctgatgctgaacttactttctgtattgtgaaaggagtctggttgtgtatttatatggcacctttagacttttaattaatttattttcttctattgcttatttaatcttggaactctctctatgcagcacaacctggtcttggactaaaaatgcagttttgatcaagaagaaggaagactaaagtgtggatacttcagtccttcttagaatggggaacaaaatacccatggaaggagttacagagacaaagttcggagctaaggcggaaggaaggacaatccagagactgccccacctggggatccatcccatatacaaccaccaagcccagacactattgcatatgccagaaagactttgctgacaggaccctgatatagctctctcttgtgaggctatgccagtgcctggcaaatacagaagtggatgatcatagtcatctcttggatggaacacagggcccccaacggaggagctagagaaagtacccaaggagctgaagggttctgcaaccctataggtggaacaacaatatgaactaaccagtacacccagagcttgtgtctctagctgcacgtgtagcagaagatggcctagttggccatcaatgggaagagaggtcccttggtcttccaaattttatatgccccagtacaggggaatgccagggccaagaagtggaagtgggtaggtaggggagcagggtgcggggagggtataggggacttttgggatagcatttgaaatgtaaatgaagaaaataactaataaaaaattggaaaaaatgcagttttggaggaccgaagagatgactcagtggttaagaggacttgctgctctttcagaggtcctgagttcaattcccaacaaccatatggtcgtgcacaaacc

SEQ ID NO: 19229 - DNA, 1213 bp, Mus musculus
ttgtgttgacctcgtaggaaacatctggcttttctttattgaactgactccaatctcaccgaatagctttgcagcatgttataggcgatatggaggtttgcgttacagctctggtggttggaaagtgtagggagagggccactgaggcagatcagctgagctgtgccgacaggacatctgattcctcctacctgccatgtgcatcttccccagcactggcacaggggaatctcacttgtgtcactttatctgtttgccgaggaccttacaggccctcgtttctgcatctcggcttttgagcaagcctatttagatcacacatttgggttgcagaatcagaattgtggtgtttgagaaaaaagtctcccactgcctttccagaagaagcaatatgatttatagctttggcatcttaatttcagtgagtaaaatattattttgtactacttgtataatagcttctccttccctattttttcttagcattctgaaataaaagaaaaggaagcgggaatgaagaaacacgaagaaaacgaggctaagcttactatgcaggtcacaacattaaatgaaaacttgggtactgtgaagaaggagtggcagtctagtcaacggagagtcagtgagcttgagaagcaaacggatgacttacggggagaaattgctgtcttagaagcaactgttcagaataatcaagacgaaagaagagcactcctagagaggtgattgatgtctgatgaaattagtatttgcagggcatcgtggtggttgtggtggtggtggtggtagtgtaggtccacctttaataccagccctcaggaggcagaggcaggtggatctctgagtttgaggccagcctggtcaacagtgagttccaggactacacagagaaaccctgtctggaagatagatagatagatagatagatagatagatagatagatagataatcgatcgatcgatcgattgtatctattataaataataggaatattgtcattctaccttttcccactcgaccaaaaattgaggaaagtgtgtaacccctgcaggtatgtaagcagccattaaaaaagtcagacttaaaaaaattaaatagctgaattaatgtattttgtataaaattaccaaagtattcctttacctctattctagaaaggtctttaataatttcctaaatattaactttgtgtgtgcaatctgttctgtaagg

SEQ ID NO: 19230 - DNA, 3382 bp, Mus musculus
aaatgtaaataatctttggacagaaaatagcaatgtatttttttaaatataatttaattattcacaaatgatgactacaattccttagcttcttcctctcagagtaaatgtacagaatgtctggacggctcctatcatttgttgcggttttgttgcacaacgacacagtgattctattctcttggtggagtcatgcacaggaatgtaacactttctgttttttcctctataggtctgtagctcaattatgttgttgtgttatacatattacttgagtgttctaaatgcagtgtatgctaaatgatgtgttaaccatgagtttgcgtgtgggttttgtttgggcagtattgattaaattctcaagtagatttgataaactcctatgtaaaatttatggtacttctgggattgtatttatgaaatgagttaatttgcatttctctatcttatttctgacacccacacactgtcccctaaaacattgtatgtaacttccctttctgagctggagggtgagtagtagagccgtgtggtggcttggtcttggtttttgctggtggaaagttttctgaagtgatctcacagcgcagcctcactccctcaatttcagcatctttaggaagtttgctttccagccttcataaatgtagctcagcctcagtgcagttgtgcttgcagtagggcctttgtaaagataggaacggacactgctaatgtcgcatctgtacctgtgaagactaagtcaagtggtaaggaaatagtagccttcttctcggtacttcctctaaccaaacaggaaagactaaatacagcgacagaaagctggcgccatgtctctgatgaggggcccatattaacttgggatcttttaactttgaaaaaatagtgctatgagattacacaaccgctacagagcagagtccgtacagccccacctccatatacctaggagctcctaaatgatgataaaaaggaaaacactggctgctgctcgaccccttaaaagtcatttgtctaccaaccaataaacttgttcttagaaagcatcagaagactgaacttgccacatactagtttttaaattatctttctgtagaagaaatataaagttacacatcgaatcattacagtcatttagtgataatagcagagaaagataagagctaatatttcatttgcaagaaagaatttatattacacactgctgtcaggagtatgctggagtcttcatgtttttatgacatacttacaacattacacaaacaagagactgacatgtaatttttaatcatttagcaaagttaagccctgctttcagtaatgactaaggacactgattacatcccaggacttggataagtatatccttgagcttatatactgaagtgatacaatggctctatattaaaaataatagttgggtaatatagactgagctgtttatgctttttatataattgtgaatcctttccggtagtcctaattctacctttttggtttttgcatataaacactttgactatgttaaaaatgcagatattcacagcactactttgtgaaaattctggattaaaatatttgttcatttcatcctttaattgaagacactggagactttctttttgtgcatcctcacttcacaaaaaaatagaagtggctacaaagaaaacccgtatgtgtttatggtaggtttcctgttcccccaataatcttatgccacaggtcccaaataatgtccctatcacacgccactttactgatgacacaatgaagccaaacaaaccaccgttcctcttaactattaccaattcagaatggactggacacagaaatgtaagattttttttttctcgtttaatgaaaaagtcttgtgaattctttttggctgtacacttagctgtttgctagtagtattgtactgtcagtgggctggagctgccgcatacagagtcccaggtcttggctatcatgcacagttggcatcaggtgttggcaaactgcacaccccagcacagaaatgggagctgaaatgaggttgtgctgggttgtgcacagtaaactgtatgtagagagtgtctgtagtaggcagcaggggaagctgctgatacaggacttacttgttttgaagaaaggaaagaaggagacaaacacacaaacctcagtgcagtgtacaaataaacattttgttcaactacctcttaaagtggagttagctagtgtaatggtttccttatagtaatagtcaatagcaactgccaaatttacgttcccatgcctcttaaaaggtcttcatgattactttctatagctttgaggtccttccttgtggctacttttttactcttgcatttgcataagatattaccctctaagtggaaggcaaatgacagccgtatattttgatatttgtgacctgtttaattatagcagtttttttaatgcactttggctataaaaactatgggtaacttgatctataagatttaaatgtgccatcaatttagtattcctagacataagcttgatgaatgatcttctataattataatgtgccacatttttctgtgtcttaattgccctttgcctgaatttcaatgatcaaaatgttattgttgcacatgtgaatactgtgtataaaacttcctaaatttatgtaaagttgtataatatagaataaagaaatcccactgtgttctctctgtaagaagtaatgaacttactgtaacatggtccagccacaagtctgacattttatgctctctgaagtggatcatatatccatagcctctgtacatacttttgcatgagtattttctctgttagtttttgggttcattatttatattgtgtttactacttgtgatcatgtagttgtgccttatttttgtgaaagagtttagctcagtaaatactgtaatttctaatcccagtgattagaaagttaccgattataaataaataactgataaattataagacagcatttaaatctgtataaagaacaatggaaggatccttactgaattgccacttctgttttttaatatgttaaagatgatattaaagaccatttctttctagtagatgttatccaatgactatgattggtttgcttgctttaaaggagaacatgctattagctgttttttttaaaaattcaccaagtattagggctttgcccttggatacaatagtggccatgttttaatgttatataccttaagatagtaattaagttcctgatcccaagagaattcattaatgccattttggttgaaatgtctcctcttcatccttcagactaagtttgtagaaaatgaacaaaactaaaaagaaatattaaaaaacaatcaatccgacctttcattgtatatatacattt

SEQ ID NO: 19231 - DNA, 1240 bp, Mus musculus
gctttgggtgggctcctcttggggatggattatggaatttaaaccatgtcacagctgtgaagatctggcacaagatagagtggtaataatttttttatttctttctttttttttttttttaatttagtgacagtgccatagtttggacagtacctttcagtgatttaaatagcctgtgagtccaaggaaaggatcactttatttgctagggagtgaagtcgaagggtggtttcagtttctcccagaccttatacccaatttgtcacagcagtccctttaaggaaattctgtctttcaaagaaccctctttcgcagtcaaccttgcaggggaatttgcactattacacttgaaagttctcagtaacttttttggcagctcaataggaaagctcaatgttttaagcatggtagtactggaaaaatttttacacggagacttttacctagcacttaaaatgtataaatgtacataaagacaaacttagtacgcatgacctgggggaaatggtcagaccttgtgtttttggcgttgagagtagggagcgaccaggctctgccatggcagcaggctttgaaaagacccttcaaaaagacactgtctcaactgtggttgttagcaccagccagctctctgtacatttgctagcttgtagttttctaagactgagtggagtaaacttcttatttttagaaagtggaggtctggtttgtaactttccttgtactcaattgggtaagagtctttcccacaaaccaccatctattttgtgaactttgttagtcatcttttatttggtaaattatgaactggtgtaaatttgtacagttcatgtatattgattgtggcaaagttgtacagatttctatattttggatgagaaatttttcttctctctataataaattgtttcttatcttggcattttaatcaatctcttgtcatgattacagaggttcagctacaaaatatttttctcagacgtcttagatttgtaagctgtgtggatgtcacttgcacactggtcacacaaacacattgggagaggtgtaattagaaactaatcagaaggaactagaggaaggcttttagattttttaactcaggttaaaagcatggacacattcacaagctaatgatctcatgaggataaagacagaggtaacatcttccaaaagtggcgatgcccaaaggatcccagtcactgcttcctggggaagtgaagataacaatcctctctgg

SEQ ID NO: 19232 - DNA, 1200 bp, Mus musculus
aaagtaagctgaaaacctaagggaagaattcaccagtcgaggtcactgaaggatctaccggggttcatggagaaaggcatccccactaatgggtgtctggaagccatctgttctactgcatggatgactgcgtggtccttgacctcagtgaaggaaatgactaggtagaacgtgactgacttaggactaccggcctgaacatgtgactcagttgctgcttttggatgagcaaggaaaacagcgtcgtgaggtggaattggcttgcgggtttagaatattatgggtatcgagtaataaagaatgagaggattgatttcaacctcagaagtgactcttctcctgttgataaaatggtccgaagcagccttacatgctccagcacactcatctgatgggacaagcctcatttttggctgctgctgcttcttctttttttttaacttaccatttttaattatttattttatttaaggggatgataaataattacatcctttctccattccttttcctccctccagacctttccatacacctgttctctctcagattcatggcctcttctgttattgtggcatgtatgcatgtatatgcatatatatcctgaataatacaacctttagtcacagccccaggaaggcagagacagaggcaggtggatctctatgagttggggccagcctcatctggctgttagcagcaaactccaccacctccaaaacttaggagttgctgaaggctcagatgatcattggcagcctcagccacaaagctgtttatagttacagtgtgtgcacttgagacttcacactgctgcatactttgtaatctatatagtgtggctatcgctggcaggcgcttgcaggctggaaatctgtataagttgagatgctgatttaactggatttgcctggaataaagcactagatactgtagaggtatgtgtgtaacttcttaggctgaatcctgagtttctccgtgtgctcactcgtcactggcaacctggaccgccttatatatcctgagtttgtaaatcttaaaggcagggaacttgaaatggcagagcgcagagcgtaccttggtagagggatcaaaatgctgagtaaaattgatcgggtacaaaaaagaaacctgaaaacatccacttggtattttaaaattgccactttttgtttctttccgaaaagtttgtggagaagt

SEQ ID NO: 19233 - DNA, 1111 bp, Mus musculus
gttctgtagtgtcctactaaaatattcatttttttacagtgtattgcaagttccactgcattacatgcaaattcgattcactcatacctagctgtttgtggattcaaactcataagtgaaccattactgtggcgaagttcctggcgtcctgacatctctctgtgttttgtgctgtttacagatccgagtggtgaatgcatttcgtagttctttatacgaagggttagagaagccagaatcaagaagttcaatccacaactttatgacacaccctgagtttaggatagaagattcagagccgcacatcccccttattgatgacactgatgctgaagacgacgccccaacaaaacgcaactccagccctccgccctctcctaacaaaaataacaatgctgttgacagcggaattcaccttacaatagaaatgaacaagtctgctacctcttcatccccaggaagcccactacatagtttggaaacatcactctgattgtaagatgaatggtaacacactagctgcattgtaaagaaacaaatcgaaactgagtcttttcacatattgtgacggacaagatagtattcttgtctctggacttcaacagaagacacacttgtacgaatgtagatttatttttttaaaaaaaacaaaagcaaagctttctgccagactgagggtgcttttttggggtgtgggagaaacgaactgacagatgaacagcggtgactcggcaggagtggcctgtgggtcgtcagtggtacctaacgttgtcctgactagcagagctgtggtttatctcagttcttgatgggagggagggaggagtgacgctgggtgagacagagagccctggatcattgagtgaatactttaatttctgctgttggctgttaataatttggattatttatgtttataaatgatacagatctgtttacaaggtttgtagatactttttttgttcttcatagacgggaagcttccttatagtaatgcagagaaaaattagtccttcaaatactgctgtattttcaggaaaaaaaaggggggggtgtttctattgaaactgtactaaatttttgcctacaatttatcttgttacatatgtag

SEQ ID NO: 19234 - DNA, 2487 bp, Mus musculus
gaaaaaagaaaacaagacaaaaaaaaaaacaacaaaaaccatgagcagtggtgttctaatgaagttatggcatctgtcctaattagtttcttaaatacatttactacttaatggttttgaaagaactgtttaatttttaaattttttgaaaacttgctaataaccttttgttcagaatttagtagattgtttattgcgggacatcaaatacacaatgaaagatgcttgaaatgcctttgttatttcaggccaatcaaattaaactatcaaagtacaagagaaacctttagtctttttttttttttgtttttgtctaaatatgttagttcagtgatgtcttagtgaactgtgagtgactgcattgatttttctaataactgcgtagagaccttcacacagcatagagggggctgttggcattttgagaaaggttaatagagagaggcatacatcgtttccttttgtttttgaaacttgtttgtaaacataaataaatatgcccttttattaaataaatacacagcaatggttcttcagacagctcagctccttggttctctacgtgtgccgcattggcctgtctcctctaaccacaactagaataaatttcaagctggtggcagcctcaggaagggctgtttgaatcctttcttggtcaccccatggagtcgagctgagacagcagttttgccacctagcacacccttcatagaatctacttttatctaaagtaaagtagtctcgccattttatacgaagtaatgaccacagttgtctgatgtatttgttttttattaagtgtcccagtcacagattagattaaagggatggcgcatgaagatttgaggaagcggctaaacacgatctctgtaataaccaactctatgccgaactctatgctcatctctgagacaattgaatttccaggctctctgcttcttttctgtctaccttcttcctttgtctgcctctcgtcttgaccttttagaaagtggtattgtttcagggcgcagatctcgccagttaaacaatcctcaggctgacctaaagtttacgaggactactacatccaagaatgctgacctagcaaagaaacatctagttgatggtgcttgatatatatatatattttttttttgggcgggtgggaggaatctttttctccccatcagttgcctgcagtaactctctgcaagtcttagaaacacatcggctctgtcccatcgatcactgtacatttttactcatcaggtgtttgtagttattcatactgtaaaaagaggtagcatgatatgctgggacgcatatttagaccaggagcccaaggtggactcctcgtcttgaatttgccattaacgtgctgcatgatcttggggcagtgactcaccctgacggagggtgggggactcctcttgaagaaccctttcaactctaagaattgaccctatccactgaagaagcctgtgaggcatagggaatagagaaagggaaatgttctcagctttcttttttattttggttatgcttaaatatgaatgtaattaccaagagaatgagacctgcatgtgctctggagggtttgtgtctagcttttccggttttttttttttttttccaaaactcaaggcaatggctttttaccccacctctaaatccataagtgggtcttaggacatccgtgaagtcataatagcaaaacacgctcggtgtgcgtttctctctttgagacactgtaatttctaccagaaatgtccacagcattatgtaagtaggaaaaaaaaaaaaaaatacaagcaagctgttaaagatcttggatcccattctatagtgtgtatacctaaatcaacatctgtaattcacatttttctcttttattctctaaccaaaatcagaaagaaaaaaaaaacttgtttaattttgcatcccaaatgtttttaatctttgtatattttttagactcccttttctccccatcattgcctttccgtggttgtaaatagttgtcacactctgaggatgagttacgtcttgtcatcttacaaatatgtgatatggtaattttcataacagattatcagttttgaaccaagaaaatggtgatttgtttataagagaaaaaaaaacaaaacaacaaaaaaaaccacctggcttcatttctgtgaaattgctctttgaaactttcatttccacgtgtaagccaactgggatactaccgtgatggtgttgatttcttttaatgatgcttaccatctcttttagccactgagccttttattatttgtctatttgtaaagtttatttgtcttaactcatttaataaatatactgtttatctgtttctgaatggggactgaactttttgacccttgggatgatctgaacaccatattttggcattccttttttcctacctgagatttttgcttttaacctacgtaatgcagagtctataaaatacttggaatgttaggatgggtacggggactc

SEQ ID NO: 19235 - DNA, 1321 bp, Mus musculus
gacgccgttgtttttttgttgttgttgttgttttgtttgcagactgtttcaattctggagcagcgactgtctttgacagaagataagctgagagactgccttgagaatcagcaaaagcttttcagcgctgtccaacagaagagctgagcagggagggccgtgagcgaggtcaggtcagtcgccagaagacgggctcacacactctggaggtagccgaggccttccacacccctgccacgcactaaccgattcttcagagggtgagcaacgaaaccgaaaaggttccaggcattctcagggactgacttaaacacacaaatcaatgtcaaggatcaagttatgctcctcccaggtctaattgcagtaataaagttatgaacattttaatcaccccatttcccccctcccccatattatttgaaatgtcagcttttatttaacatgcagatccccaccaggaaagtaagcggacctctagattttattgttgcaccatcgcagaatgaccatgcccaggcagttcctgaaggtaatgaatgtgtttcttaggtgagcacagccttgaggggaaaccattcgcttgctttcagatagcatctgagatgtagaaaactgagctggctcgtagttctttcaggtcaaaaagagtctgccttgaaaccatgctccctccctcagtattgccacagcaagaatcagctgcttgtgattagcaagcgtgctcacgtgacaaggcaggcgttttccttgtctggtgggaactgcatgggacgtgcgcatctctggtgttacaggtgaacacactgagtggtctgggtcatactgaacctgtggccacagctcacagagattatgcctgtgtgctttcagtacgctaaaaagccaaaatgatgaaaaggatgcacacatgaatcacatgtattattgcttaaggtgattctggtggctgaaataagtgcatttttatttaggaaaaaaaaaagtgcatcgtctattttagtttaatgaattgtgatttgaaatgaaaatgggtcaggcattctaaaagatcttgaacacaagttaagaacgtttctctatcttaaacaaaatggaaatcaaagttaaaaaaaaaaaaaggcaaattcaaggcagctggctctgggcacacagaacaaaggccggcacggctgtgtagcaggggcagatgccatctgtgtacagaaaaatggagaaacaatggtgtgggaatggagaggttgttctccaagcggtttcggttttgtgcctctgagctgcttttctcttctgtctcctgtgtgttgtaagtgccttctctgtc

SEQ ID NO: 19236 - DNA, 2219 bp, Mus musculus
attactcaccaaggctaagctgaccccatttctcaaccgactgagcctcttggaggaacgtttattacgtaatcactacccgtggaagaacagagaccgatctgagcctcggagggctcagacatcaggacatcagcatcccaagtggcttcgttcctttgaaaaaattgctgtagcacttagcagtctgcttaaaggagggagagaatcacactttgatctctgataagcgcaaattcaagtccttgagctcagcctttcaacatcactggcggttggcgtggtctccatcacagtggcggccattccgaactgttgtcgctgcagctctctccctttgatcccatcctgccaggtctcggagttcgcctgccatggctctacttactgcggcagcctggttcttgggaaccaaaaacccaccctgccttgtccttgccgcccggcatgccagtgcttcttccacgaacttgaaagacgtgctgaggaatctgatacccaaggagcaagccagaattaagaccttcagaaagaaacacgggaagacagttgtgggccagatcactgtggacatgatgtacggtggcatgagaggcatgaagggacttgtgtatgagacatcggttcttgatcctgatgagggcatccgtttccgaggctacagtatccctgagtgccagaaactgctgcctaaggctaagggtgggaaagaacccctgcctgagggcttattttggctgctggtaactggacagatgcccacagaggaacaggtatcttggctctcacaagaatgggtaaaaagggcagctctaccttctcatgtcgtcaccatgctggacaattttccgaccaaattgcaccccatgtctcagctcagtgcagccatcacagtcctcaacaatgaaagcaactttgcccgggcatatgcgcagggaatgaaccgaactaagtactgggagctcacctatgaagactgtatggacctgcttgccaagcttccgtgtgttgcagcaaagatctaccggaatctgtaccgggaagataggaatattgaggccattgactctaagctggactggtcccacaattttaccaacatgttaggctacacggaccctcagttcaccgagctcatgcgtttgtacctcaccatccacagtgaccatgagggtggtaatgtaagtgcccacaccagccatttggtgggcagtgccctttctgatccttacctgtcctttgcagcagccttgaatgggctggcggggcctctccatgggctagcaaatcaggaggtgcttgtctggctgacacagctacagaaggaagttggcgaagatgcatcagatgagaagttaaaaaactacatctggaacacactcaactcaggacgggttgtcccaggctatggccatgcagtactgaggaagactgaccctcgctattcctgtcagcgagagtttgctctgaaacatctgcctaaggatcccatgttcaagctggttggtcagctgtacaagattgtacccgatatcctcttagagcaagggaaggctaagaacccttggcccaacgtagacgctcacagtggggtgctgctccagtactacggcatgagggagatgaattactacacagtcctgttcggagtgtcgcgggcactgggcgttctgtcccagctcatctggagcagagccctaggcttccctctggaaaggcccaagtccatgagcacggatgctctgatgaagtttgtgaactctgagtcaggataaaatgggagacggggggaggggggggacgactgcccataagaaaacgaggataaaaatttattaaaaataaattctaatttttgttttgttccaggggcctttaagacttaagatttaactgttatatgaggcattgaaaatatatttgaagctttaaattgagacttgaaaggcaaagtgacctcctcctcccctcaccagctcaactccccctcctggtatgagctgcccagcaagctgtcggatgaactgccctgatgcttgtggtcagggttagatccggccactcaccatctctagagcaagagtctggctcctctcttctttaggtcaaagcaggttacagaaaagctgcagtcactccatggagctttcgtttctactcttccagtccccaaatcatttaagccagagacaggtcccctttatgtccatagaaatcat

SEQ ID NO: 19237 - DNA, 1192 bp, Mus musculus
cacgctgagccaagtgctagaaggtagcttctaggcaataaagccgtcccactccggactgcagcccccttgagcttggtgatcgccagacttgctcaaagcaatcctgctgctctttgcaaagcaagtgttaagctgggaaataactaaatagatgatttcgtgctggtctaatcatagacgggtgctaaatcataaatttcagtatgggctggtgatagctagagccaggcttgtaaaaataaagccgacttcttgccacatattttgtgcgtgtttctgcaattgagagaagcctgctattatttggtcttggcatgctatcgtagaactactgagaaacattgttcttggccaccacagttggcaggaaaaaaatgaagctgcttcggagggcttagtatgaaactggggtcttaccctttaccttcattttagagggttcatttctgccaagaccagaggcgtttcccagttgagtggcctgtggagatttgttggtggtcagagtcccagctgcctaatcttttgtctttaaacaatgaagggcggagtgggacttggtgccagaaagaacccctggggccaaggcaataaaagtcagccttgggcactgggcaggatacagtttatttttcacttttattgtaaaaagcagctaaagactgaaaaggaaagtctgctttcctcacaggccttcttagaaaataacctagcagagtttctctcagaaatagcaggttgtggtggtcacccagttggtattcgaatccactgataatcgccaattcaaaatcctcacaactataagactgtaatacagccagatgggtaggattttcccctgaacccgtgaatgaacactcctgggtctttcgttcacccagcagttactatagaaagaatgggcgtgggggtgctggatgtggctgcacagctgtgttccctaggatgtgtacatcagcccttaaaccaaaagatgccggagttaattgctcatcctttttaattagagtcacagttttctttgacgtattttggaaatgccttagttgtacagaataattttcagaatactcaaacattaccacgtgatctacaggctcagcttttttcttccctgcatttatttgctttctcaaaacattttatcgacacggatatttttactatatcactttttccaaataaa

SEQ ID NO: 19238 - DNA, 1201 bp, Mus musculus
catgataaagtatatcatgcatcacagagatgacatgttagcttaggaatgcatttgtcctgcactctaaactgtaaagtagggaaagtgttacacacacacactcctagtggtgctcactaatactctattctctttcacactgagagtgctctgacataagctacattaccatgactactcatgacacttgctccccaaagggttctgcttctggctttaagctttagagtaattagagtaatctcctccatcttattctctctggtcttcagttaaaatcaattttctgtttccaaactaataccttcgccattcttacctacctaagccactacactcagttttgcttaactgaaggcaacacaatgtgacatttacttttaaacactagattcctcttatggtatatattttattaagtatttattttaactactgatctttcataaaaattttcaacgtttagtttaaattgttagttcccttgagttaactaatctctaattatatcttagaaaccatacttccgaaatgttttctaagaaactttttataaataggtcacaagaaacatgttctgcattaaagacccattccttttagtttcccagaggacctgacatagatttctttctttctttttaaggtaatttaactctagcactaaagccagtgggtgttagttctcgacccaggagattttggtaaccatcaaagcagtatcttgtttcagtttttagagtgtatctttgtgacttcagatatggagtggagaatacctcatgtactataacttgaagatgaagttactattctctctgtatatctctggaaaagtttttgctgataatcactacaatgaaaattctaagtggaggacagctcagtacataaagtcaaaggaaaccttttatgataacaaacataataaaagtttgaagactattttagtaaatttatatagctagtcaagtgattaagataaatattaatatccaatagtttttatagaaaaacatcttttattagcactcataataatgtctgtcacaaagaaagtactcatacttgaatttaatttatttaaaacaaatccattttgaatagcaattattaattattaccaatcaatgatacccaacctcatttcatactagaatcctgtgggagcttttctgaaattgaatcatgcttcagt

SEQ ID NO: 19239 - DNA, 1161 bp, Mus musculus
tctcaggttgagtccatcgacgtttacatttgtacttctctaatgatgatgaggggtattttcatatagctattggttattggtatgtcttctgcccattttttcattgggtatttttgcttactaataagttgaatgtgctatttaaagtagtttttaatttaagtgaacctcagtagccaacctttgctaaaagtcgtattgctcacaggacaaatatttctaatcaggctttcataccttcagtgctgtagaaagtacagaatttaatttcaaccagtgactcacattttattggcagttttataaagtaaattctagaattagcaaaaactccctcctaatcttgctgatgtacatcttgctgtttattaccacccctgtgtggcctttgtgttcactctttatgacagtatttctaaaatcctctacaactcatttactccaagtaaattaaaaaagcctgtgttgcttgtcatctgtgttgtttaattgaacgtgctatcttctttttcattccaggcgctttgtttaatggcgttaccatttattcccgcatcaaacctgttctttcctgttggatttgtggttgctgagcgagtactatatgttcctagcatggggttctgtattttagtagcccatggatggcaaaaaatttcaaacaaaaggtgaattaaatgctagtttgttttgaaatgtaaagttttagtattttagtctgcatgtagcccagttctgtaagccatactttcagtctttccattatagctataatttaagttagaaaagctctgcccctcctcctcattctgtgttctctctgcatggcttgttacagcccagcacagtaagctgaggcagacccatgtgaaaacagtgctgcttttactgaggctaaagcccagatgagcaatttcacattcataagcagtgactaagctacactcatcccattggaatgagccatcttgagtgcttagtgtgtataaaatatgtttagcatgcatatgggttttttttttttggttgcattaccaattaaagaaaattaagtttactgtatcaataaaattgtcatatcaagcaaatttctaataatcaaatgatactaatataatactacattttgatttacatctgacttttctctatatctct

SEQ ID NO: 19240 - DNA, 1244 bp, Mus musculus
tgtttgaaaagtacaataatgtttaaaaatgtggttctctagtaataattatataatagttccttgagtagcacttatctaaaatgcacgggattataaatgtccagagtgtggtttatttttatttttcatttttttattttatttagacttttggggggttttcaggttttggaagtagtgcaggatagatatatacatgagcacttgtggggataccgttaatagctaaacactagactcatgtatgcttcatgtggccctgataggtaaaccatcaatacagtatttttatgcctgtattttgactaaaacacagcaaattaaatgtgatacataattttccacttgtggcaacataaaaagtgtccaatttgagagcatttcagattttaaagttttatttagaattatacagctattacatttcacctttaagaataagactacgctagtaatgaatagcacatgtaatatagtgcagctgtaaacatgtctttgtgcatgcttcagtatgcacatgcaatcacgggaactcgccctgctttgaactattttacaagctgattgttcctctcaggttcgagagctcacggatcttctgaaggcgaaggatgaagaggacgatccagtcatgatggctgttaacgcaaaagtggaagagtggaaggtgctgtgccacaggatccgacccttctcatttagtattttgatttgactttgattttgatccttaaggacttatatcagacaataacatgttgatttttaagaagttcattccatacctgggtataaaagctctaaagcttctgtatgtgctcctcgagcttgttcatttattagacaagcactttccaggcaagagtgatcaggaatggcatcaggggaaagatttatcagtctcatgtggaaagccttttcagaatactccatttctttgtctaacttccattttccagcctaagtccagagctgtaccccatcagagactaggattaggatggtgagatgactgaactagtaattctagtaaaagctggcccttctagcatctccacctctggccacgcccactgaacccttatctgcagttaggaactgtttgttatctgggaaggtcagatagtttatgtcgcagctgtagttgcaatgggacgaagctgcattcatcctgcaggggtcagataatctgtaaagctctagaaagtaacagttttagctgtcctgttctagccatgcaa

SEQ ID NO: 19241 - DNA, 1195 bp, Mus musculus
aagctcttaaaacaagtaagaacaaagaaaattcactagctgatgatttaaatgaattaaataatgaactgcaaaaaaagcaaaaagcttataataaaatccttagagagaaagatggaattgatcaagaaaatgatgaactgagaagacagattaaaagactgtccagtggactgcaggtaatttgtttttacgtcaaataatttgtttgatctgtaatgtataagttatggtcctccctcattttacaatatgtgccaaaactatctccagttgtttgattagtttcttgagaggcctctgttatagtttctgactatagtgggacatttttataaggcacagtggtagctttcatgctatcctgatactcaatgtcatatagaaagcatgattaatcatagcctcccagattttgataattggaatatttaatgtctcctttaatattgtcatgtaaagttatatcttaatgtttttagagcaaaactttgatagataacaagcaaagtttaatcgatgaacttcaaaagaaagttaaaaaacttgaaagccaactggaaagaaaggtggatgacgtagacataaagccggtgaaggaaaaggtatgtgaagtgaacccatgaatagtcttagactaagtgaggcgtgcactgataagcaggtgatttactctgagtgtaagggcctcatacatactgtgtatgggcctaaataaggctgagatgtctaagacagatttctgtcatttagaaagctgcactccacttgaagacacaccagagagaaacctccatgtcatttcctgatattggagggccattagtgtctcctcacatcctatgtagctcgtgagtttctcatttctccccactctttaattgccagcgcaaaccctaagaaggattccatctcatgctgcccagctatttttttttaagatttatttatatttaaatacactgtagctgtcctcagacactccagaagagggagtcagatctcgttatggatggttgtgagccaccatgtggttgctgggatttgaactcctgaccttcagaagagcagtcgggtgcacttaccctctgagccatctcaccagccctgcccagctatttatgtatccatctctttctccagctagtactcaggtttccagaggtcacatgactcttggagtacattttttttt

SEQ ID NO: 19242 - DNA, 1178 bp, Mus musculus
ggatccaccttatttacgatcaccaaacccagacactgttgtggatgccaacaagtgcttgctgacaggaccctgatatagctgtctcctgagaggctctgccagtgcctggcaaatacagaggtggatgctcacagccatccattggactgagcataggatccccaatgaagaagccagagaaagtgccacagaccctctggatccctttgtctgcgtggaacaggtctctggggcatgtgggcaaagcgttggatggaatgacagacagatgcacacaggagaggttgtgtagaatctgaatgtaatttgtcaaattgagcatcaaactttttatacagaagaacatagagaagttgggtgacacaccaacaaggtacaaagtggttactggattcttacacaaaacagaggactacaaacagagaaggtctaacaggaaacacctgggatagaattcattgttaacaactaggatcaaaaagagctccacctaaggttcacttaatcttagaagccagggtcaagggcttcgtgcccttgccatagttcctattttagtctattgtatagtccaccttccccctaggtcattgtaaatacgtgtgtatgggtgtatctcagcaatctatagttctaagtatctactctggttcctccttaggtctcaaacttccttcttcctagatggtggtaaaatcccgtgtagggcagtgacttagcttttattcaaagtgatagtgtaataccagagtcaaatctgaatgtcactgaataggcaacattcttactgaattccaagcccatggtctgctcaaggtctttctaggactgttggaacactggtgaaggcttggctatgtcagaattcaatcttaaaaggcacttataataagataatactaaaagagagcacatggatccatacaccagactaactcgggaatggaatatgagtatatgggttaaagagaatgccagactccaggaggtgagtttccatgaaactctctgcctcgggagtggcttccaggcctctcagcatgtcaagctgactcaaccggagtgtgtggcaagaaaggacccaaggagctgaaggggtttgcagccccataggaagaccaacaatatgaactaaccagtaaccccagagctcccacagattaaaccaccaacca

SEQ ID NO: 19243 - DNA, 1099 bp, Mus musculus
gaaaatatcttcttgaattaaagtatatttttcaaagaattatttaactaaaataaaatgtgtgtgaaactcacacacctactaattaatacacttttgaaactattaaactatgaatgaccaagatctatcgtgtttttaagtcttagaaagagactttattagaaaatgatcaagaaaagatgttgaagtattgtttatatttcttgttattaataattacatttcaattttttatttcataggtatatacagagtattgggatcagatccaggatccataatagtttctcaccttgaatcaaggatttatatgatattcttctcagatttactttgtgttaaataacatttaaaatatatatttgcctcaagggtgtctttaagaagattaatttccaatgcctaagaatagcaaagtggtaaagagagatttggatgatgatgtcattgaatctgtcaaagacctcctgtccaacgaagactcagtggaagaggtttctaagaagagtgaactaattgtcgatgttcaggaagagaaagatacagatgctgaagatggatctgaagctgatgatgaaaggccagcctggaacagtaagctgcaatacattctggcccaagttggattttctgtaggtctggggaatgtgtggcggttcccatacctctgccaaaagaatggtggtggtaagttgcattcctttgctttaacgatgaattgttaaactccgtaaagggcaatcctgtatttcaggtagatcctattgttactgcattctcattagttctgaaattgtgaattccattacaaagctagggagacacatttttgtgggaagtcagtccagctctgggttcagatgaagtttccataggaacagattggcctcctacaaatactcagggattgcttaaggtaacacattcccaaactttgtccctggatactgtaaacattgctgaagtactgacaggagtttaaaaaaacatgttatgttctttatgcatgtcagacttttgggatcgataagaatctaaagccatcaacactgatgaagcattgatgttctctctgacttatagcctctgaatttta

SEQ ID NO: 19244 - DNA, 1833 bp, Mus musculus
cttcggttctatcaagcgtcacattgccaatgcagaattctagccatattctgaatgattagactttataatcattgaatttgttgaatgtcacttccatgacttactgtcagtcagagaaagcgatataatcatctcaaaattgcacatataaacccaagaccaatgtaactccttcataagagcacttagaaagactgctgacgtgtattctctccccgggtttcccaggcatcggaagaatttctgagctacccgatgtgggggatggtcgtctgtttctctctgatggtgctggccatacttcctgtcccagtggtgttcatcattcgtcgctgcaacctcatagatgatagttctggtaacttggcctccgtgacctataagagaggaagagtcctgaaggaacctgtgaacttggaaggagatgacgcaagcctcattcatggaaagataccgagtgaaatgtcatctccaaattttggtaaaaatatttatcgaaaacaaagtggttccccaacactggatactgctcccaatggacgctatgggattgggtatttgatggcagacatgccagatatgccagagtctgacttgtagctgaacgaaagcaggggttgagtttggttaatttttatcagtgagcatcggttctcctatgagaagcattgggcttcactatcacacggtgatctcaggtgtccatggctatgatctttaatcccaacagttttagacagttcaagaacagcaatcctcagtttacatttgctcagaaatgatggcagacaaagcttacattgactgaggtcatattttgccaggattttttaaaaaaacaagcactttggcatattttcaaatatttctatctcttaaaaaaaggtgttacctcagtttctaataatttctggatttaatatcattggcaattttaaaaactccctggtatatcttacaattcataattttgccttcagcataagttccagtattaccatgaacagttgtgtgagccggtgcctctcagcacattcccatgagtatgttctgtagatagtctgtacttaattttggtagcattgaaaccttcctaggcacttagttggagaaaactgcaaagtattttcttatatgatagccgcatagagcaatagtatcaaagggtaagaaggcactgatactggggaaaaggttaggtccagatgtgactttgggttccatgtggttggctgtataatttgtgtaaaataggtgtgtggaaatgattgatgggagtggctccatactctcaagaattatgcagactgcatctttcttatgccgtgtgcctaaaagtctacttaatatttattgtggttttgagatcacttatagtatatttatataatatacttgcaatgcatagagatgcctaccaggactcttaagtgctgatttgaaaacttgaagcaagatagcattttgatttcatatgtttctgttttgcttcattttatgcaaatacaaattcttttttaagtgattgttaaaactgtatggcattacattttaacctacaaataaacgaagtttaaagaacggagttcgtgtccctcattgagttttgcttggatcacctgaactggattatgcttcttacaactcctctcagctggattgttttacatttcagccagggcttaagcagtttataataatcatcacattccaagtcggattaacaaagtcacagggaggagaacacttgccagacaaataaacaggaatttaataactgccgtgtgctttaacatagtcttataacatggaagagtgcttctagcttct

SEQ ID NO: 19245 - DNA, 1177 bp, Mus musculus
gcgatgtcccatctattcgagggatgtggtttcacaggaccccagtcaatggctatagtcctataggtgttttaagtagggaatcggggatccagggcatgcattaagactgtacttccgtcctttatagtttgctctccctctgtctttcccatccccatcccccatcccccctccctctcctcttcctcttcttcttcttcctcctcctccttcttcttcctctctctctctctctctttctgcatgtgtgtgtatgtatgtatgtgtgtgtgttttggttaatttcaactgttcacacatcatatgagcataatatttcaatttaggcattgtttatatccaattgacctatgggcatgccttggtgggaggggtttatcttagttatgaatagacctagcctattgtgggtgttattgttccctggtttgtgtccctggactgtataagaggagaggagatgggtagttaagtactaagctcacaggcaacatggatgcatctgattctctttgctcttggctgtggctgtagtgtaaatagctgtttaagttgcgacattggcttccatcaatgatagactgtaacatggaagtgtaagccatataaaccctctcctcctggaagttgctttagatcatggtgttttatcacagcaacagaaaggaaagtagtccagatgtcttccatgcagctagagttacctctgcttggccctcattgtaatagtactaactttatgtgttctaaagagtacacccttcttctgtcctcgctgtacccatgactacaagttaggaaacgtgaagttctttaatcgccttgcttttccagcgatagtttcttctgctggatgctctctaactggctgtcctgctgagtcatccaaaagcatgggcagttttgggtgtgcctcccacgccttttctttattaccaaaaggagcctgggaaatcagagaattctctgttgcctcaagaaaagtcccttccctataccacaagactctgccttactactgtcagtctcaggagtaatcccatcagaccttacatcccatcccagaccgtaacaccccgtctttagcggggtgtcgtgactcacacttttaaaacccagcacttaaaaggctgatgcaagggaagctctgaaagtccaatgcaatcctggactc

SEQ ID NO: 19246 - DNA, 1139 bp, Mus musculus
aatcttctcagaaggctgaagcaggaagattgctggtcattcaaagctagcttgtggttcatagtaagatgccatcctataaaacaacaaacatatttaacacatggacttcttcctgaatgattgctggcttacccctgataatccctgcacacaggaggcttaactcaggaggccccaatagtgagaggctaagctgaggtagatggtgagtttcagaccagcttacactattttaccttaaaacaaaaccctgcttaccccttgattttattagaggtagtttgtaagactgttactacatataattcaagcaaaactgccttaacgtgcacagcaaggcattacttcagatcttaacttttttttttttttaaaccaaaatgttgtctttcaaagctagggcaaggattgcacgcacaaatcatatgcagaatcaagccaggtcaaatcccatcatggactggggagagagttacaaagtcccatatggagcttaggagagtttggcaattgatggctggggcgggcgagtctgccacgtcagacagcccatgccccagtaggtggctccacacccatgcacgtgcacatgttggcatcaggaagcagactcgttttttaaaaagtacaaaagatgcacatgaagctaggagggggaagtgcagagaagtaagggatgggatggaattgaggaagaagaaaaggtgggtaggtttgaccaataatacttgtagggatgtatataattctcaatttaaaaacaaaactgagcattatttgtgttgcaaataagaagaaagtatgtagtaggaataaaagaagaaatgagggttggtggtattttgtttttggtagattcctctgtcaggaaatagtaggtgagacaggtcaatccttggagctcattggctagccccctggtttgtggagagcccttgtctcagatatggtggtgagcagtgccttagtctccagacatgtcatccactatgcccaaacctacaggaacactcatgtgcatgaggattagaagtgaagaatgacactgtctcacactgacgttttcagaagtacataatggaagcaaaaagcccattgaatatttgaggctgggggatcaggattgtcttggtaag

SEQ ID NO: 19247 - DNA, 1196 bp, Mus musculus
gcctctcctgagtcagaacgtgggggagccctcacattgtgggtctttcatttggtgcgttggccgggaaacgcgaccacccctcacacccgagaaccgacttggaggtatggggatcccctcttgcgtgcgtgtgtgccggccggtgtctctgttttgagtgtctgttttctgaaacgaacattggaacatgtgcttgttgtgttgggttgtttgtgtcttgttctatgtttctgaagtacggcgaagtctgagtttggatccgtctgagtttattgaacttgtgccttggttttccggttgcgagatcgtgggttcgagtcccacctcgtgctttggttttacacctggcagagtgagaaacaagtgagattctctggttttggttgtctaggtagaagtggacgacggtgtttgtagacgatggggtgatggggttttctgaaatgcgcgcgtctgtatttgcagctgtccttttgggccgtaagtaccggaggactgtggtcggcagacgtgctaagaggaccacaggctgtggccctgggggacgccctgggaggtagggagagtcagggacacctggctgtctccggagatcggtcagagggaccgagttctgttgaagcggaagcttccccctccaacatcgtctaattcttttgcctgcttgtggaggacaagaaagggtcgagtgtgtctggatctgttggtttctgttttgtgtgtttttgtgtatgtgtttagagctatgtaaaaatctaaaaaaaaaaaaacaaaagcaaaggtaattctcataggtgctttataccctgactagagatagtttacacctgagatgtgagaaaatgggttttaagaaaagtagtactctccgactatctgggggtaatttggtaataaaataaaataaacagtattaattggtctttggagccctgaatctgtagttaggaatctagtgtggctggagaagccctgctaggcgctgattataaacgctgctcttatagggacgagcagcttctcaagttctatggtaagggaacagatggctgcttttcctacaaaaatctctgtgcttgtgattattggattcatcaggtgacaaggtgctcctctcttgaaattacagctagaaaaattaagaattttgtttggtttaaatgagcaaatgtatacggccatttcatttttgt

SEQ ID NO: 19248 - DNA, 1158 bp, Mus musculus
ccaatgatggtgatgtataatgctcaagtattctcctgcttttttaccactaactgggaactgggtttggccttgattcagacagccttggctctgtctggacaggtccagacgactgacaccattaacactttgtcagcctcagtgactacagtcatagataaacaggcctcagctaatgtcaagatacagagaggtctcatgctggttaatcaactcatagatcttgtccagatacaactagatgtattatgacaaataactcagctgggatgtgaacaaaagtttccgggattgtgtgttatttccattcagtatgttaaatttactagggcagctaaattgtcaaaaagtctttttcagtatatgttacagaattggatggctgaatttgaacagatccttcgggaattgagacttcaggtcaactccacgcgcttggacctgtccctgaccaaaggattacccaattggatctcctcagcattttctttctttaaaaaatgggtgggattaatattatttggagatacactttgctgtggattagtgttgcttctttgactggtctgtaagcttaaggcctaaactaggagagacaaggtggttattgcccaggcgcttgcaggactagaacatggagctccccctgatatatggttatctatgcttaggcaataggtcgctggccactcagctcttatatcccacgaggctagtctcattgcacgggatagagtgagtgtgcttcagcagcccgagagagttgcaaggctaagcactgcaatggaaaggctctgcggcatatatgagcctattctagggagacatgtcatctttcatgaaggttcagtgtcctagttcccttcccccaggcaaaacgacacgggaacaggtcagggttgctctgggtaaaagcctgtgagcctaagagctaatcctgtacatggctcctttacctacacactggggatttgacctctatctccactctcattaatatgggtggcctatttgctcttattaaaaggatagggggagatgttgggagccgcgcccacattcgccgttacaagatggcgctgacagctgtgttctaagtggtaaacaaataatctgcgcatgtgccaagggtatcttatgactacttgtgctctg

SEQ ID NO: 19249 - DNA, 1154 bp, Mus musculus
acagtcagaaacataggttaggacctccacacacgccaacatgcatgttcaaaccatacacaaggaatatatgatatgtggaaataatattaatatagaaatgtataaattctatacaatcaataaaaactcctacatggaagttgatgttctagaagtaaatagaattttttttctcaactttttaacttgttggcaaactataaattatcattttagctcttaatattgattttaaatataaaagcttttattttgctttgttggcttattaaaataattctttacaagtatgtacctattgtctcttccttaatatcaaggataatacttttcttattggaatttctgttaatgcacaatgattagaatatgttactagcttgatgctgtgcaggtttaagtgtttctgccactactgagcagtggtgtttgttttccattatgaccctgcctgacctcgttgtttcttgctatgaaatcaaattaaaggctccagcagtacagagctagatcatgttccccgttctctatcagctagacactcgggctttccatctgaacgatggaaagcatcatcagttctgtaccagctgccttcactactagttccaccaaagactaaaagaattaggtctgcaaaagcaattcatttaaaacagctgagaaaaaactgcagcgagggggaagtaaatcaagccatgttcttgctagatctgtggcttcgctaacttgtaggtatattgaactgatgttcaagcagcttgttctgttcccttgctttgacacgagctcctacttcccagtgtctcatcactgcgtccttggttgtttccagctgctctacctgactgagctgctttcctgtgcttgcgtcccagtagtgaagccagagcccgtggggagagttacagtgttcagtctccttccgcttcttagtgtctttcagattgcatgacagtcgtggttatgtgattggtacgtgtggctgggtggtagaggtgtgcagtttacattggaaatttttctctgtgtataggccacattttacttgagttttcattctctatgagctgctgtttgcaaagcagagtcattaatgaaaggagaaaatgaaaagaaaggttagtaagggaaccccgtttctaactatt

SEQ ID NO: 19250 - DNA, 2553 bp, Mus musculus
aacttccagctctcacagaagacagttagtcaacaggtttttttgttgttgggttttttttttctttttctttttcttttttctttttgatgtgccacagtttctagtttctcaatatttaaattgtttgctttccatctgagtttgggtttgtattttttttttccttctaactcttcatgtgtcagagtctctctatgttcacagccttctcatttacagaaaacttggctcttctgagcgtcttgtcacgtgttaggctgacgtgttctctcccacctggaactgaattgtggtgggacacttgctgtcactgtttgtgcaatacgcatttatttcttacatgagtgctttaacgtccattgaaatttgatctttccagtcctatcttctgccctcatctgtcactttttgttttttattgtagtataagatgctagatgctgtacttttcacattcattttagcaggtactgagtgacgctgtatatataaataagtgtattgttttgatttttagaccaccacatggcatgcttgactattttcttaattcagatgtctgcagtgcacagtgggctactccataaaggtctttagagcagagctcgctcacagtgggcaggaggacctgaaagattctgcggtttatgggacctccccttccaagcttttctactgtaaactgctttgctttttttttcattcggtagtagtcagacctgattacaaagtagagaatcgcttcacatttcacacgcctatatttatctgagtgctgtctgaaactgttgtgctagccacagtagtgctaggagatcctttgcagacttaaatctgtgagtggtgttaagtgcactgttattgccatgtgagggggcatcaactctgatcccaccaccatgttcagaccgtttttatacatttcagtggcctttttttaaggaaaaaactaagcaaaatgaagtccataatgaaagtggcttttatttggacaaataacttttatattttcatcaaaccatgcaaaaaatatatatatattacatcttcctggcacataactgtctccttaaccattgaacagttcagccattcgaataaattgtacatttaaagcgtatagtagctgactgtattattgagtgtattgtatactatattaaatgtgaatttgtacccttccattttaaaaggtcattgtgttctactgcctattttagattacttcggggatgggaaagggtgttttggtaagtagaatttaagtcctctctcttgattggttttatgaggatataaggttatactcttactaccaagctcaggattcttttaaaggtacaaggataggtgtgaggatttatttttggttatatttgaactgtatgaatggtgggtctgaaaacagagtatttcacggtctagtgaggaggtaaactatgcggctagttgatcagtgtgagtgactgcagcgtgttctgggtgcacaacagttaggcatgctgtggtttgtatctgtgaagtctggatgcctgagaagaatgagtaaatgcgtgtttctaatattttagtgttttgtatttaggttatttattctttgtatctaaagttgaacagctactgtgctatattgactttattggtaggactgagcagaccttatttctgcatgaaactagttgcaaaacccactattttggaaataaaaatgtattttgacatatacaaataaaatgaataaaactattttaaatgtgtgaacttttaatgaaaacagtttaaatcttgttctgagatatttaaattctgcatgggtattttttcactaaatgctttacttggataacagtttgaataatttttgaaattgtaatattgtgataatttgcacagcaatgtacatgctcatctgtaaatgcgaacttaactgccatatttatgcaatctgtgtaccaatttggacaaatgtttatgtattttacataaagctgtctgtatgcagaatctgagagctagtttttttatgccaagtggacaaaaataatggtaattaagattcaagatagttgctttgtagcatgagattccatttccataaacatttgcagtgtttaaaaactaaacttctggttttttccttagctctagactcaggcataagaacatacacaaagatactattccactgaaattttaaatcctttccactaccattattttccatcttgggtttctcgagggttcagtccacccgcacagctcgaggtggctgagttgcgcttttaacttctcatgtgggcctttgggcaggaacctgaagtaaaccatgttcttttctctggatttccagcactttgtgtatttttgttcacagcattgtctgggttgctcttgtttttaaaatgaagaaaaacatttcagatacgactgtcttgaaagccaagggaaggggagagagaatctgcagacgcatctcagagaagatgcccgtgaagagtgatgtgggggtcgctcatcactgggcttcttttacccaaaactctatttcca

SEQ ID NO: 19251 - DNA, 1174 bp, Mus musculus
gcttccttgcagagcgtcggtccggcagcgcgctcaccccgcgcagtccccagcgcattctcgcttcccgggcaggcggcggcgccggcgggagacaggagtcgcggcgtgaggggcgcccccgccggcccctctgggaacatggcgaccggcggctaccggagcggcggcagcaccaccacggacttcctggaggagtggaaggcgaagcgcgagaagatgcgcgccaagcagaaccccgcgggcccggggtcgagcggcggggatccagccgccaagtcccccgcgggatcgctgaccccgaccgcggtcgcgggaacctcggagctcaaccacggccccgcgggcgcggccgcacctgccgcccccgcgcccggcgccctgaactgcgctcacggctcgtccacgctgccccgcgcggctcccggctcccggcgggcggaggacgagtgccctagcgccgctgcggcctcgggagcgcctgggtcccggggcgatgaggaggagccggatagcgcccgggagaagggccgcagctcgggacccagcgccaggaaaggcaaggggcagatcgagaagaggaagctgcgggagaagcgccgctccaccggcgtggtcaacatccccgcggcggaggtgagccgggcggggcgggccggtgcggggctcggggccgcctcccgagtcttccaccagggagctccctcggtccggggcccggagttcccttccactctctgcagcggggatggagttttacttggagtaaatgattgctgggaagttaccccgacccagaaaagttggacacgtgctcttttttccgcccctggaaccggattattgctttagaatgatagacagttggtattccccaggatttggcagcctagacttctgtctgtctgtctgtctgtctgtctgtctctgagtctgtgtgtgtgtgtgtgtgtgtgtgtgtgtgtgtgtgtgtgagagagagagagagagagagagagagagagagagagagagagagagagagatcaagtgttagggaaatcgattcgtggaggtgatgacgtcttctgatttcccacgtgtccatctcgggctatcaggttgttttatctccacttccctagcagtgtttacaagcaaaggcacctttaaagaaagcgtagccttagcaata

SEQ ID NO: 19252 - DNA, 1187 bp, Mus musculus
ccaaaggtagccaggaagaggctctctttcactactgggcagagcttgagcactagaggacctcagagcccacccccacagtgacatacttcctccaacaaggccatgcctcctaatagtgccactccctactggccaagcttttttaaacctccactttatgctcccataccaagcactctcttatttcctgtaccatctcccatctcccacctttcacctatctcttgagataatctctcaacaaattgagaaacttgcctttttgggggtgggtgggggggtgggtggggttgacagagctgtctctaggtatccgcttcctccaccagcccagtgctagggtcacagatgtgcattagccaacccagtttttagttgggtacttggatctgaactcggctccttctgcttacataacaagtactttatctatagatccatctctacagaccatttattatgacagaagtgatcagaaaggagagaaacgattcccaaaagttgtcctgtgaccaccacatgtgtcacatacaggcacacaaataaaaaaaaaaagtattaaataaaaaaaaattgtttgctgggcagtggtggtgcacaccttgaatcccagcacttgggaggcagaggcaggcggatttctgagttcgagaccagcctggtctacagagagagttccaggacagccagggctacacagagaaactgtctcgaaaaaccaaaaaatcaaacaaacaaaaaattgtttgtgcaagatcaactatagattaaaatttaccagtttgatagattttcttttttacatattaagttttatatatatatttaataagcatcctttaagtgtgatattatatcatgaatctttacttttttcatatttaaaaatgttttagatttacatattttatctgtctgagcattttgctgtcatgtatttgtgtgcatttggaacctttagaagaacagtcagtgctcttaaccacggagtcacctctctagctcctaagcaggaatttcacagtgttggggaagtcctgatcccattttttaggtgtgataatggtttcctctgttttgatgaactgtgtctgcaaatagagtccgtaaataaatgaaacttaaaattgagactagtgatggacaaatgagggcacatattattatcttctctactgcctatg

SEQ ID NO: 19253 - DNA, 1196 bp, Mus musculus
aactcatggagatctgcccacttctgccttctgagtgctgggactaaaggcactcaaaagtcactacagtttgctgctgctgttgttactgctgttactgctgtttctcttcctcctctcctcctcttcctcttccccctcctcctcttcctccttctcctcttcttccttctccctctcctcttctactactacaaatatggctactaaaacatttaagattatatgcatgacctccctcctaccaccctccttcccttgggcatgcagctcttttgtccggggtcccatgcatgcttgctaagcacatgctgtactgctgagctataagcccattgccttggtcatttgcttctactaaaccccaatgatttagagacaggaaagccatagtagccgtatacagcgtttgatactttgacgatagaaagcattatgtggaaggcaaaaggcagtctggatagtgacatgtacagtgtcataaacagttaacaaaaatcagtcatcttgtcagaagtgactggcatatatctttcattttattttattttttggagacagggtttctctgtgtagccctggctatcctggaagttgctctggagaccaggcaggcctcgaactcagagatcctcctgcctgtgtccctgggtgctggaatgaaagtcatgaaccacctcttggcagcacatacattttaaagatatggtggcagagaatcttctgtaagtgtcagctataaaagtttctttcctggacagggtaagcaggggaaagacacccagaggcccaccagttatgtggcccacatccaggggacggccagtgtgtggcctgccagccaggtagcccagtagccacaggagccattgtgacgtgcaagtatgtggtggagagatggaagagacgtagaagaggtaaggtctgggcattatgaagagaggtggaactagagacttgaggattgaaaggaacagccagttgtgagtagcctgccttgccaccttgaggccatggtgaagacctagtaaatgtccctggctcatattaccacaaaaggccatgcagatgtctctggtctgggatgccaccagggaccatgtttatgtcctagggctgcgcagagctggctctgccccatgcgcctgcaccttgcatctgggtagcacagtagacatggccctggtggcaggggt

SEQ ID NO: 19254 - DNA, 1186 bp, Mus musculus
tgtgacatgtggtttctaggatacttataaatgctagctacacgaaatttgtaacctgacataaaattgaagcaggatgacagtatgagggtgggtgggggagtgtttgaagcttgatcacacaaccttgaaaatggactttgtagataatacgctgctaaacgcctgggcttggctgcatgcttgcaggtggctttcctctcagccttggagtatgtcctcaggttgcatatgctggtcagcaccctagactactgggagactctggcctgccccacaaactccactgacttcctgggtcttcctggactctaactttcataactcatattctgagctgttttcttgtgcccattagtgatgagaggtaagagtaggcccaaggttgggtggcattgagggttaccagttagaactactgtagttcagggtctgcttaaaaatggagatttttaatgtcattttttactaaactggagattgtctaaagatctgattcatatatcctcctacaaaggcgtgtttttggttccctgtccttggacacgtaagaatcggaggcaaagaaacgtggtggatttggaaaggtctgggaccagcttgccccctgcaggctcagaatcaaccatcccacagaagagtcagaaagaaaaatttttaatttttttttaaaatgtaaaaaaatagatctgattcatagttcatcaaacatctggacaactcagtggaaaactaataaaaggcactgtgactttgatatcaaattatttctgcttccataacttttccctccgagtccatcacccggcaccacagcaagctgaaggagagtttctggacaggaggcagaacaacccccactgaggcactcctcttcccctgggggcctgaaacactcagtgtttgagctgctccccaacaaggaaagccagcgctgcagacctttggtcacgtggtaaagagtaacacatggcttttgtataggggacagaagagctgtctcctgagccattgtcttagaactgatgtgaaacgtgcccctgcagaagcatgcgcctactctttttaaaggcacgctagttatatcctgctcagttatcctcagctgcagcagtagtagtcgtcacataaccttggggttgcttaatccgtattatctccttcttttggtgcaatagtatttgta

SEQ ID NO: 19255 - DNA, 1302 bp, Mus musculus
aaaaagacaaacaaacaaaaccaaaaaccaacaagaagcccaaacctatcttgttccctagtagataactggttctctagagccgagtagttaagttttttaaggcactgcattgctaggtatgtggtgtggtcccttcccattcctccccaccctacctctgtatatcttttggctgaaggtagagaagtgacttaaagtactatgtcttgggagacagataaggccagcacgagaagtgcgtctccagccatcagtacatattcttagttcaaattttgtatgattcgttgctttcctggtgcgtggaaaaacctaagtgtgaaaacttacgatggagtagtgtgcgttgtttggaaggaacttctttgtcaagtcctagatccaaaccctgtgtgtgtaagccaggcttctttctgtccctcactcgctaacttaaatcctcccaggaatgcacagtgcccctgccaaaggtcttcagctgctgattgataggaagatctgtggccaaacacgcgttcttttccaagacgtttcaggcataggttaatactagaggttggaaaattgagtagcttcatgatgcactgtgtgttttcatccgtcggatgactgagctctttccaaggatcttttgaaaggacgtgcacgctcggaggctgcgatccgaagccttttcacggatcgcagttggaagctgttaattaacgagctcaagttctcaccctcactttgtagtctgtagtgcaaggtacatttagccaatgagactctctgaatcggtaaattaaatatttaaatattctacgtctactatggaaagactttcagggtctttacggcggttgtaagcttaactgcttccatgctttcatttttgttgatgcaaattaaacataatgtagaatttgccgttcggactataccattcgggcattgagcacgcatgcgtgttgtacagctaccatattgtctgcagaaccttttcacacttttcaaacggaaactggggatccatgaactcaagaattttgtgttttggggggctcccagccccactctctggcagtcactattccactctgtgtctctgtggatgcgatttcccagggtgcttctcgcacaagtgggacaagtccactgtctgatcctctatttctggcttgtttcatttagagcagtgtcttctacagttgttcctatggtgatatgccagaattttccttcttaattaaagctttttgtcttcaatgttttgtgttacggttcacccatgccatccatgggttgggtgaacacagg

SEQ ID NO: 19256 - DNA, 1227 bp, Mus musculus
tcacgggacctcctttcactcagtctcttctccatttttgtccctgctgttcttccagacagaaacaattctgggtcagaatttttgactgtgggatggcaataccatccctctacttgatgtcctgtctttctactggaggtggactctacaagtcccctctccccactgttggccatttcatcaaaggtcccgagagtctctcacctgccacatctctggtgctttctagagtgtccccctaccttccaccgccccccccaaggttatataactttaaattgtgtctgttcattgtgctttggtcatttaagtgattgccttttcccatgcctaccacactagtccaatatgtctcttgagtttgggtacttctgggattttgctctttaaggcttttcttcttctatcactgtgttacagaagggccacactttacctctcagcttttgacccgctgttcttcaatgtgatgccgtcaagaaagcagacttgcttgtttcccacctcacttgcttctgcttctcactccttcttttccccttcgttttggcagtgattcataatcatgtgcacatttgagggttggagcctgcagagcccatactatggctgggatttgtgacttcctgactctggagcattttcttgtaataactctacactgctttttaacaatgaccctgtagtaataacacatatatacttcagcagttccagtgcccaaagcagtcattgtgtttactgatgtaattacagcattttaggactatgaagttgcaagttcatatacttgggaggacaaaagtcacagcgttagcagtttgattcttaacctcccagcctagaccattctctacattttattattatgaagttcattgtgtctagatcataatttgaaagtgacatgcatatcattattttaataatcatacaggaaaatatatcctaaaatatgtttgtacttttagtgaatcaattctacaatgcaaatattatctaatttttcctttattttgggatgcaaatccaaacactttataaaaataatccataatcactactgtttatttgttttccttcttataaagaagttatttccatatttaagaaatattcagtaatatctttaaaatattaaaatttaaatatttaaatatttgaaaattttaaagtaaaatagttatattctatgacttctcttcccccttgggaatgctgaca

SEQ ID NO: 19257 - DNA, 1148 bp, Mus musculus
tatagcacaatctttctggaataaaataggctagctcatatacagatgaaaactatcattttatacctttagactattgctgtctgcttcaaaaaattttaacactcccctactcctttaggtctgttggcatcttattctaatttatatcttagtgtgaatagtttgttattcatgactgctgaatccagtggcccctttctttttgttccagatttttaaaaacaggtttttttacttagcgtatacaatgttgagtttccttctgaaactcatgtcaatggaccatgctcatatcctccctgacattactcccaaatcttgtcaatgtctttccatcccctgagtagttcttctgccctcttgttttatctatatttatgactctatgccaaagactcctttcttcagcctatgttgggtaatctttaggtacccagcatgtggaatagttggaacatttttcctttatcattacataaagtgaccttgctcagcatctttttgtttatcaataaaatcaattttgtgtaacgaatgtctataagaccaggaccttgccctctgcccccatgctttgaacatatttggtttgaacaggtatatatgtgtaggaggtaatttaaggtgggagaactttcccgccatgggccagtatctctcaggatcaccgtaggtatcattaaacacaggaccttggtagacaaatgtccaatatataatagagtttgcaaatcttgtgatgatactgcactaggtcaacagaactgatgactgcttttattaccctaattattagtgacttattgggggaagtgagaaactggcaaacaggcttatgtaatgtaatccttttaaagattatcctggcagaacagtagaatttttaatgcttttcaccatttaaaaaaaatatatatatttgttttgtgcaagcatatgtgaaggacacagaggatgtgtagaagtcaaaggaaaactagcggaagagggttctattcttctatgagggtttggggactgaggttggcaacttggcagcaagcacctttactcaatgagccatcttactagtcttactaaaatttttgaagcagacagcaatagtctaaaggtatctatctatctaactacctatcatcccatct

SEQ ID NO: 19258 - DNA, 1127 bp, Mus musculus
tgtggtaaattcatgttacaatgatttttttccctccctttttagcatctgcaaacagtcgaaaagataaatctttaagaattatgagccagaagtttgtcatgctgttcctcgtctccaaaaccaagattgtcaccctggatgtagctgccaaaatcctcatagaagaaagccaagataccccggaccacagcaaattcaaaagtaagagccgtcatctaatccacgtagccgcacaaaaagagaaggcggcagatgctgaaataaatatgtacagaagagggttttattgacggtgctggtttaggaaaaacgtattccttgtgctcacaaaagccctctgtgctttaagaggtcaatcatctaatagaacccccaccaaacccagacagaccccttactccatacctccgaggttaccgtggacagggaggcagaacgcacccggagagcgcaggccagggagggtgtgatcgctgtgcatttctctatgctgacactacatccaagcagactgtctgagtgttctttcccctttcttccccctcccccgcctacttctctgaagggtggagatgaaagttgtctacaggtaagcaggcaaggaacgctcagggttgggggaccgggcgggggtagggctgtcttggaagggagagagtctctcagtgccacacccacgcaccttccttcctctgagagccttgcagcagggttcgtaagtgctagtgaattccccagtcaccttttggggttttgctagaataatggccacccggtgggtgagatggttaagataaattccagccctggcagctaactctacatcaagtggccatcagaccctttattcatttcttgaatagaaaagtaggcacgctatcttgtcttgttttgtttgtttgtttgtttgttttggggttttggtttttttaatgagcctcttctgtctttctgtgtctccccactttcatacgtgcaatgtccttagaatgcattcagatgcccccatgcctctcccccttggctagggttttagtgagcagttgctgttttttcacaactatacctcgtgaccttgaatctcaggcattctgtgtacccagaagtatggcttcactggttgc

SEQ ID NO: 19259 - DNA, 1235 bp, Mus musculus
ctgcttgctttgacgagccctcgtgggtaggaatgtccacaaagcattcctattaagaaatccacattttgatacgaacttttcctcttctctctctcctggctagtctcatttatgttaacctttgttgctactttttcttattgttatacttaattattctgtttgtgaattgaccatattcacctcagagaacttgggattcttggggtgggggtggggggcgtcaagcagttccatccatggaaaacaaaagtcacttccatattcaggtcccacggggtgtagcttctggctcttccggaagactggtctttgaagctttccagctagacctgagtgccagagactgagatggggaagcagcagtagtggcttcttgttgaatgcaagaagaactaactgttaaaggagggcatgggctttgggtcagcactgaggggatgtgctacctcaaaccatgccatccggggtttccaaaacccttgcattctggtacaagagttggggaggtataacttatacttgaacctacctgctaagtttacattgctcaatgtaaggtgctatttctgtacggaagtgactgtaatgtagagctgcttcctgcttatctcgttgcactgctaggctgacgtagatgttcatctattgctgcttgccgcttcgttgtcccgggtttcggctctgctctttcctcgtggctatattatctatagccacctacttggaacgctactactacgtgtaaaccaatctttccttttagaaaaaatactaagctttataaaatagcaatggaaataaatgtatttagtaagacgtgtatgttatattacttgtaaaacattttcagtgtgtgtgtctgtgtctgtgtgatatggcacatgggtggaggtgaggggaaaacttgtagcagtcagttcacccctcagttgtgagtcccagtgatcaaatccatcggtcagcttcaatgacgagcatctttgcctgccaagccgtctcgtagaccctggttctgttctctcggctgcagtttattgttaagactgccaacagcagctacaacagccacatggatgctcgagtgctttttactgaggcctccctgtagttcttgcaggtatgcacacacgcacacacagcatctggctgatccgaaagcgtgggaaggcaaaaggagttgggagcgcggaagcatgctcttggccttgtatctgaagtccaactggaag

SEQ ID NO: 19260 - DNA, 1177 bp, Mus musculus
tgtatccccaagatggaagactcaggatatatatagtcacagcctgaacaaagcaaaatcaaatgggacagttagtgtgaagagctcagagtgacagacatcaggattcctcccaaacccgtgggctccttcacaggcttttcacagccatcccgacacatggcatcttgtctttagttaggctggcttcacctcagcctgctgctgacccatgcctctggcctccctaaagtgctctaggacacagtgccaaggctcagttgttctctccgaccccctcatgccttcagaaccagttccagctgcatgactttacactgctgagttcagctgccagcgtgagaggtacctcggcccctctgggccacagcttctgtgtgctgaccctgaggaagtactcccacatctgcatcctcgatgatgctggtctcttcttacttactgctcatctcttaactagccagccaacgtaaatcattctagagaagcagagattttacttcagtggtgctaatctcttgtaaccacagccaactctttagctccagttgaccagactgccgcttcttcaaggcctggctgggtcctctctggaaggcagtgattgagcagagtgtcggtgtgggcaagacttggtcttgcaaaagtaaacattgcttagtattaatagtatttactctcttggattcttagttgtattggggccaaaagctgatgacggcacttttgcttaacaacagggcactaggtaaaggatttcttgctagcacttccttttctagccagacagccagaagcccttcactgcctagctttgtgaaccagagagggaggaaaggaaaagagttaagatactttatgtaggtagatatacacagacatacattcctacattctctctttggcggggcccaaccgtctgcctcagtcaactccacatgtattcatgaatgcatatgtgcatacacatatacctacctacctacatacaaacaagcaagcatgtacatttggatggatggatggggcagagctccccaagtctccacagcacaccacaccacctttctttcttttctctggcctttctatagacaaaagttcttagaaaattacctcacagataaaatgttatacaaaatgggagttactaagggatgctgatattaagttcaaa

SEQ ID NO: 19261 - DNA, 1194 bp, Mus musculus
ttgaccccccctttggagttgttagaattctcttaaataatacagtcggcttcctgtgacaatcacagtcgttcctctggattcaccctcagatacagatatgagaaaaaagttacatgtgaatcagtcaagtcaacacattttgcatggttaaattaaagaaataaaaatacttgcgctcctcatatgtagggacggaataaaaaaacattcttctcatcgcttattgggggagctaagtctgctcacctaggctacaaaagaggttgaggatcttcaccatagggtgatgaccagggacacacaaaaaacgaactctgcacattgaaagaacagtttggatttgaactgcagttacagtttgcagtcatgttctaagatccaacactgcagggcataaagaaccttgagtagcacttccaggagccaacttgctcccttattgctgcaacacccacttgtgatgctaattgtactttgtggcccatggaccatggcttttgttacaagctaatcttgaacagttgctttggtggcaacagtcaccaccaattccttaatcatttaaaacgtgttctggattgactctagtgggtgaaactagtcttgtagctattggcttttgtcttttaaatacttgttaatgtccctcttcaaaacttagggaatattagtgcctgcaagaacattctttgatgataccctataaaatgaattctaaattcttgctagtccgtgtaaaagacacacagtccaggtcttttatttacaagctgtgagcttagactgggcaggtttcagagctgttctaactcacatcccagccaatgtacctcatggctatgtgctcacaatccatcccctccttggacttctttcttctcctctcctttctatacctgtgacctccagccaggtatctgaaagccggcctaccttatactgcccaaccacaggctttatagccttttatagcccaaagagctttgggagcagggtaacataacataatatgttgtatgggaggattttgtcaggggccaaccagatttgggggcttagtacttagcatttgaaaatatagcagtaccagaccagtctcctaaacaacatttttttttgtagtattgaacagaggtttgaatataaaaataaatataagagcgagttaggaggagaagagatggttcagta

SEQ ID NO: 19262 - DNA, 2239 bp, Mus musculus
atattaaaatagaagaaatatttctggatcattaaactctgatgactatgtttgacatggaatcatacagtaataagcttgatttagtgaacttgcagcatcctagcctgaagcctggcactctcagtctcagggctgtagttgactgagctggttactttaggtaatataactagataccttgtgacagtcagataacattataatcgtgatgttttatggtaatgtttctaaaaataattataaaatgtattgttgcttattttgcagaaatattatggctcttcgaaatcatttactttcaagtacacctgctacagattattttctgcaacagaaagactacttcgtcattttccttctgattttgcttcaagtcataataaactttatatttaagtagaagttctcaacattgaatccatgaacaagaaagattagatgtgatctgggaccattgttcaaattggcttgctctttattaaagcatcacaacaaacaaaactaggagataaatgtagaaatgtctacctacttttcacatcttttatccttaacccaaaacaagagctactgtgtttggttactacaatgggctgtgtgttaagtgccagaacacttgtatgagactgtgcctacacgtgagtatcgtagacccacgtgtgtataaagagctcttccctgacagcagttcctgtgttctacagtgtgctgtgacgtattctgataccagtgttcataacaaagatgccgtcactcctataaatacatctagggtcaactattgtcttcagaagaccggcatataactttcattagggaattacagtgggaaaatggtagataatagacatattatgagtaatgtcaatacattatactgttaaaaccatctccaagttacctagttcagttagtcttcttagatacaccaagaaaaaatacgtgagtgatcagaattaatatattgtaagggacaagtagaaaatttttaagagtttacacaagattttctaacccctagcatttaatgttacagatataggtgaatacatagttatgtgtgtgtgtatatatatatatctcactattaaagactggtaagcagctacatggatctatatgttacaatcccaacttaagcacttgctgaaaaggaacggtcagaggtgtttaagtaggttatgtgaaatcctgatgattcggtgttttctttatgaaaaactttttagctttcatttagacacaagagtactcaaggagtaaatagaagagaaaaatgtaatatcttacttcaaaagtcaaaaaaggtggtaagaacagattgcagtggcctttaaaacattaaaataaaattgcttaaatgtgcaataagttgagcattggagaatgtcaagttatgaagtttgtcatctcctcccatcatcctgtggcaagccagttctgtacaagtctttctgctctgctcaggcagatttgttcctaagaggttttgcctatttattcagtttaataattgtgtttttacataaatatttattattatcaaaaacacttctttaaaaggtagttaagttttgaaacatcataaaatgtagattgttcaaactacaggttttagaagggtttgttgagtgacaactaagaaagagctgctgttggctgcatcggccttcagctgagaagagattgagctacaaggaaagctaactctgctgtgagaggacagctgcagtgctcacactgaaagcctcttctgatgaatacaggtgtccttatgttcctatgaacagccttttacagtgtggtgttagcaaaacaatgctgtatttcatatgaaaatattttaaacttttaacagcataagcaagatgtacctgtatccagtatttcattatggagttttgggttatatttcatatttgtcaatatattgtttgtattcatattctactaccaatattatgctcaactgcctattcattgatgtgatattttgtaaatattgtacaatttgatctttatatgattttaaattactattaatttatattatatataacttgattggttgatcacgaaaagtcttttcattgttaaaccctgtaatgtaaaattgttggtgacatgccttagagctctttctaaatcctttgtgttgtttgtgatctgaacagtgctttatttgtgttgatatccacgactggaaaggtaattgttgggtttttttttttaattt

SEQ ID NO: 19263 - DNA, 1206 bp, Mus musculus
tgaccagttttgtttgttttgtttttcatctatccaaaacttcattttctcacataaaaatttagataaccacaattattgacacagttgttaaatgtctttagttttctgccatttagtgagatattgctggctaagacaagacaataacaggcatgtgtggtgttagtgtgctgcagcaatcgatttaacttgtaattcctaccacttctgtctctagtatgacttggaaagcggcagtggtcatctttgtcacagctcagttgacagctgcattcccttaaaaagttggccttgtgagatacaatcctcatttaatatttcatgcttttgtgcctttaaggaaatatttttgttagttttttgttacagaaccataatgtgttcaaagtgtttgtagcttatttgtcataaaagggtcatttgtctgggtcactgtgtttccttttatctagctgaagaatatgtaaacagtaatgccgtacttttataagggtttgtgtagtaactatttcaaatatattcatactcagacatcaatgaagtaaacttgtcagatggctctgagtattgtagacagtgcctttttgatggaattcacactgttttcgggtgtcaacttgtgccatattcacagaattttgtggaaggcagttttaactttttgaagaatatcgtcatcaaaattttaaaaaacaaatgtataaaacttcatcttttttcagtgtttagcatttctagtcagcagtaaatagtctggttttgcttttgtttttgtcttatttcaggtatgatggcatacgtacgcgatgagccatacacgagactgtagactattacattaaatataaataaagaacatgttcgtttatacaaattttccgatttgacccagtgggagagacctttcataattcaataagtttacatttcaatgtctttcatatttgactacatataaagagattctttaaaatgtataacctgccaccactgcataatttggtttcattttgttatgtattgtgtgggtttagtatatccaatttttgttacaattaaaggactattttgttacagtttttaattgaagatggactgttaacattgtacaggaccagtgtcttattaataagattaacatatttagtgagagccacaggaaaaccttgacaaaaatgaatgtgactatactttatgaagtat

SEQ ID NO: 19264 - DNA, 1181 bp, Mus musculus
cctaaaaggcgtagaggcgccccgagttagaagcaaaaccagccgaagacgctgccgcggtggtcacaagaaaagagttgttagttctcagctagagtgggaaaatggtttcagaggagaagggggtggggagaggggagaggcgtgctgggattaggtctggatgcggatgggaatcctagccaggatactgcaagcctgccactaggctgtgtccctaacccaggcgggcaaggagaaccaggagcgggacctatgggtcgtcgctgtgggattgggatttccatcgcagcgtagaagggagaagagatggcgagcacaagaccgccacaggcgggaagcctaaggtgccggggaagaaggacggctctgtaaccaggcaacaaggcccaggcccgcctcccgctcccgttgctacgcaacgccgaggccagggggagggcgtcggagcagccctacgtgctgacgctaattgtatatgagcgcgagcggcgggctctcgggtcttttttagcgccatctgctcgcggcgccgcctcctgctcctcccgccgccgccgctgccgccgccctgagtcactgcctgcgcagctcccgccgcccggctccgcgtccgagcctcctggaacggtaacggctgggggccgggagggccgggtggcgggggcctgcgaggtgtcgggctgaggccgcggggtgagcgctccggagcggccatgcggcctgagggaccccggggagcgccggcggctgcggggcgcgcgggacggcgaggccgcgggagagcggaggaggaggaggaggccacgccgcggggcgccctgggtcgcccggccgcctctgcctcggtggagcccaccgcgagggcaaccccggcgaggcgggccgcggggatgggggacatggaaggaacggtggccgcgcgagttccgcccgcagggaggggctgtgcaggccgcgcggcctcggcgcgcaggagccggggcacgtggggaccgcgccgcgggcggccggagacccctgccggggcccacccgacacctccgtcggagttggaggaggaggaggggtcgccacgagtaccagtcccgccacggtctcaccggctccctgggtcttcctggagggaactgtgctagcggatgggaggatggaggggcgagcagcctccaccgccaggg

SEQ ID NO: 19265 - DNA, 2094 bp, Mus musculus
gagcatagtcagcctgagtttctaggacctaagacttctactagcttagactttaacccagatgttaaatgaggcccatgtccacctatcgtcccagacggcactctggagattgaggcaggaccgtagtggccttgtagagtgcccagttatacatggcaaaaccttgtcaaacaaaccacagaggaaatttgtccttaatcttaccccctctactgctagatggactcttatgtagacaatgattctccaagatgatgagaaagatgttagttaccttttgcctaatgaaaccatcctggttaaactttaagcaagatgttgagtcaaagatcatagtatttcttagccatctttactatgaagttaaaaaaagaaagtgtccaaagatagtacagtcctctgtaagtggtcgtagccatcagcgataacagggtgtcttggtattgttgattggtttagtgttttgagacatggtttctctgtacagccctgcttgtcctgctttgtagactagactggccttaaactcatagaagtctgctgcctctgcctcctgacgactagccaggatcctctgttgtagaactaacaccttcattcttagatttaattacttaaccttttctgggatatctcatggtctagtatgcttgctgaagctgtagtaccattttacaaggacaaatcttacagttttaaattatttgtgttgtatatagtctcactgccacagccacggctgcatggtatcacatcttaccaaaaacagacaggacaaaagaactcagtaactcactgcggaacatcaggcctataaactcaccactcagaaaggttgaggcaggagagtcagaaagttgaagcccatgttcagctacatagggtggactacataaaacaaatgtacaaaacctgcagcaagtaaataccattgcaaacctcgcatcctagttgctaaagaggctgggcattactgccctgtggaaatgaaggttcttcattagtgatgcaagaatgtagtctttggatatgggtgaaaagctcacaaactaaccaaatgcagcttgatgtttccactgtggttggctagttaatacagaggtaggaaggagactggatcactgaatttctgtactgaaagaagcatatttatttagaccgtctatacaagtttctctaatcttgttttgtaattcatacatttaaactatggtgtgatgctatgacattgtagcaaagaacagtctgaacttgatcaagatttggaagatgttgaagaagtagaagaagaagaaacgggtgaagaaacaaaaatcaaaggtattcttttaaattacttgaggagccagctatggctggcacttgtgttctagaggagattagtgggaactgtcccccttccctggacttgtccattgtcctccgtctcctgatccagtccttgagttcaggaactgtgtataggacacaggaagaaaggaagatgggagtgtagtcactgacattcctcactgctgctgtgtcaggaactgagcttcttctaaactgagaaatactggacgggttggaagtagactttacttggcaatgcttctaaactgtgtttactacttaattgtatagaaagcattgtgtgtgtctgtcctcttagacaccaaaaggacacttgatagtgtctatgtagtaatttgtccaggagtagtgctgatggagtagatgtggtccctgggtaccaaggtgactccctttcagctttagccagatgggttttaactgtgagagcagagttcctaattgatgttgccaaatgcctattgttataactgtatcatttagttactaaactagctggtctccaagaatatagctgaaaaaaaattataaatttagcttatataaattaaatgtaatcttaaaaagacactttttggccttatttacaacctgtggctattttgctatattataatcttaaaattatacatgtacataaaatctaggcacattttgttagcattaaacaacttccatataactcctttatctctggcctggtaagtgtgttgactgccctcagattactgtcaagag

SEQ ID NO: 19266 - DNA, 1128 bp, Mus musculus
ggttttgagacccgaaccctgtttgatctggcttcaggctgacgatgtagcttcttggcgtgtctagctgtcgctacagattctgcggaatctgacttaagctgtcaggcttgtgggagaagtagaaaaaaactgatctgagtgaactgataatagttgaatttcttaattgtaactacttcagtggttaggtcaagaattattttataaaaatttggaaagaattcaacctggcttaagggtatttcttgtgtttgtctggatattttgttttgtttggtttctattgatttgtcctacttgcttttataataaaaggatctgtatgtcttttgaattttagttactttaaattccttgcttcaactcagaaacttacccacttgaatgttgtatggaaagtgtgacttgtgtttttctgattttctgtaacttttcagcttgcctaaggtagtcaaaagacgagtgaatgctctcaagaatcttcaggttaaatgtgcacagatagaagccaaattctatgaggaagttcatgatctcgagaggaagtatgctgttctctatcagcctttatttgataaggtaattatttatactgctttgtaaggtaactcaggagacaggcttggtacttggatctctcagtggggggaggaggtattagaggtgtctgagagcagcagtggccaggattaaaggctgtggtaggtagttactaattaacccagaaaccaggagtgtcagggtttgggtgctaatgttcttacataagctgtctctttattttagcgatttgagatcattaatgcaatctatgaacctacagaagaagaatgcgagtggaaaccagatgaggaggatgaagtttcggttagtaccttgtagtttcctgtattttagatgctaggatggaccataaccagttgtttgaagtagcatttataagcaactttgtaaatactggggataagatgagctattcctcagcctggcagtgcctccttttgcatttcaagcgtctcctgtagtttcctttgagcttttgaggactgttggaagagcatgtgattttcaggtgaaaagctttgctgtgacctacctgcctgcagtgaaggatgacggcggtga

SEQ ID NO: 19267 - DNA, 2011 bp, Mus musculus
gttttctttttagagttttgtcttagaatttcactttgaacccaatgactatttcacaaatgaagtgttaacaaagacttacaggatgcggtcagagccagatgattctgaccccttttcttttgacggaccagagattatgggctgtacagggtgagttgcccatcctactgtgtttgtgattgtaagtagaggtacaatcagtacctctgtgtatcctgtagggttcttaggtagtcagacgctttggtctcccattttcctctgggtctgactatcatgtacatttacgggaaggaatagactattagtcactttattatatcatgttaatgttattgcaaatcaatagattttaaagttttgtttaggaaatacccaaattttaatttggcatgtaaaaatcttgtatttgtaaaaatctagctatcaaatgtgctaaaataattacatattttgtttcttaaggtgccagatagattggaaaaaaggaaagaatgttactttgaaaaccattaagaagaagcagaaacacaaggggcgtgggacagttcgtactgtgactaaaacagtttccaatgattctttctttaatttttttgctcctcctgaaggtgagtagtgagtagtagctcagtttctgttgggtgttggtgtgtgctgtactgtaagctgggcttagttatcatttttctgatgtgcatttcttttaattttgcagttcctgagaatggcgatctggtaagttgagttactaaaagactcactgtgacattggttggtcttgagctcagatccacctgcctctccttccccaggcactgggcttaaaggcacggcctaccatacctgctaaagactcagcattgcttgatgcgtggtagtgtttgccagcatgtatgtatgttccatttgtgtgactgatgtccgtacaagtcagaagaggacagcatcctctggaatggttctctggttttgtggatgctgggaactgaacctggctcttcttcgagagcagacaatgctgttaaatctctgaaccttattaacctgctgagccatcttcctagccatatctgttatttccaaaggaatgccttcgtgtagcagggtttcttttatgtttttctctttaatcgcaaagtcttagatgataaccagtcctaacttctatgtactgcagtttttctcggtgtatatgctggcctgctggcttattgttaggtattaggtattaacagcatgcaaatccagcagttttagatggcttacttgataagtggcaagtaggcaggattggagctttgtcacaagctgactgactgacaattccctctgataggatgatgatgctgaggcgatactggctgcagactttgaaattggtcactttttacgtgagcgcataatcccaagatcagtgctgtacttcactggagaggctatcgaggacgatgacgatgatgtgagtgcatttaagtcctgcagtggagccttttgtcgggtgccacagtcagaattgggaagaggctaggttggctgtagtaggacatacagggctcatggtgccgctaagcccttggacagcttttcgcttttctcagcaaatttgaagaagacttctttaggatagtttcatttaaagttgggttttgtttttctgttagaagaatgattctgaattactaaaacgtggttacctttatgtttagtttattttgatgtcattgtcatgaaacaaccagaactcttatgttcatggcagcatttatacgggtaatacagagtctgcaaagaaagggtagggagatgttgtagcctgtagctggcacagagcttggtaactgagagcactgagagcatttctgctcaggtctttgtaatacattttagtgttcagatggtgggtgttaataatctgtgcttgctgactttttctcactcacactttcacttgtcttttcagtatgatgaagaaggtgaagaagctgacgaggtaatgtttaccaaa

SEQ ID NO: 19268 - DNA, 3054 bp, Mus musculus
agaaatgctttgaactttggattctccaacgactattaaaattatttgattcctaaaggtcccagtttataattcttggaattttagggttagtaaaacattgtctcttcaaagtttgtaataatctccaggattcattcgaaacctaaaatttcctttattttgttcatctaccatttgctgtaaaacactgggaagatactttaagcatgtagaagggaagttcagagtaagctattttgatagatatgaattaattagtgtcactataatcagtggttgttttgaggttataggctatcccaggaagtaatgcttcattaatgtacacttcagtgactttgagcattagtttgtcactatcctgtattttctgccttcactgtaattttttttacaagatattatgataactaaagtacttgtgtaaaaaatgcatcacagtcggtagaagatagattgacgtgttgttttcctttaacagaaggatcagaacccagccgagtgcaagcagcagtgagcagtgactggccttgaggacggccgccctgtaatagcctaaacatgactcatttacttacagccttatggttttgtattttcttggtagaatcagtaagtttttaagggaaaggagattgatatttgaaagacgagtttgttctacctagcaccctagctctagctctgtcagatacgttaatgcatacatcctctctaatgcatgttcatttattgctgcagtttggttcttctggagtattttcatcatttagctattggaatacaattatgaaaaccaactgttgaacatacttggagtagctgtttctttcctaaagaaccaaagttgttttcagctaatagaacaggttgaagtccgcctgcattagctgtgttttccctcatcttgttagagggatgcacagggcacggtgacatcatttccctcatgttgttagagggatgcacagggcacggtgacatcatttgagggaggaaaattgtcgttaagaatttccagtaagatcaaacttaataactgagattatgaaagcatttttatgttttcgatgatataaacaaaagtcaactcgtttatagcaaggtgaacaaaccctaggttctcttgaagttgatagtatttaatgtattttgaaaattaacctccattaattaaatcttttctttgtggtagggcctaccttctgctttcctggaaaagatgaatatacatcatatgaacctattttgagtttttctgttgtttgtttgcctaattttgtttttatagcctaaaataaaaatatgacacagttttagctctcatgggatgctgtctcggtttgtactgattgaggctattgcagagggttagttggaattcaggggtgcctagttttctatattgaacaacgctggaggagctaatacacacgtgctttaaaaaaagtgatatgctctagtttgagcagaaaggtacagttgtgcttgttagaactgaaacctttgtttggactttgtttattctgtcctcaggaggatgaggagtgtcgggagccatgctgtttatttactgtgcataaccaagaatgggtgggactgttgattcaactacctcaactctgttaaggcatattggggtatatctcacaaactctcagtcttacttgcaaaatgctcaaaaaattgggcctctataccatgagtgtgatattcagcattatattcacaccaagctttgatgattaaactggagaatgaagtttaaacacttctattctagatctgagcatgtggctccaattttagtgggaaggaatgaaagtagtgtatgatttcaagagattgaagagttttgggatttttgagttttaccccccttcagatatttcaagtgaccacattataaaacaccctaaggtggtaacgaggcaggggaggatggcatgaagttgcattaagtttcagaccactgagagccacatttaaaatacctcaggctaattactgttcactttggggcaggagtaggttttgccagggtatagtaattggattgcactccaaggaaagttcctattgttaataaaatttacgtagaggagaaacgtttgtttgaggtggtagttctttctgtgaggttttagtattcgaactcttagaatgtgaacacattcgagagctgacttcttcctgagagttttaactactggaaatccttaaccaattatattttctttattttgagaatgatttggttgctttttcttagatggtttctgctattttctgtaatcatagttcatctaaacacagcctattttcgtgaacattgaagtttgtaacggaaagataggatctcattttcagtgaacttccagactagcgcactcttcccttccctctgtaggaagtagctgttgccaaagcgaagaggtagctggctcttgtataatgggaaagtgccgtgtggagcttcaggggtcagtgtttattatgacatctgtcagtccccaaatggttctattctctacaagtctgaaatatgtaatctgaaatccttaataaaattggatctaattttataaaatacactggtgatatttgaagtttttataactatacataactttgaagatgggagagccgctaattctgtgcttaagccaaccactctgacctgttaaaacttgaagagctttagcaagttaaatctgcgataccacgagaagaaaaggatcctgtggtctagcacatttcattgtctacagacgttccagttccgagctcacactttcattgttagagctatgacatttgtgtgttttcctccaagaaaccatggaaaccctgtacagttcttttcctctttttaaaaaataatgtgcattggtgtgacggtgtcacatcctttagaactggagttacagttgtgagcttctatgtgggtgctgggaattgaacctgggtcctttggaagaaaaagactgctcataaccactgagccatatcttcacacatgcagttcttcataaatacaaaatcttgatg

SEQ ID NO: 19269 - DNA, 1589 bp, Mus musculus
tttgagatgcgaaggttttagctgagtcagactcaggaaatcatgaccagtttccttctgtttgtggccgtatgctctgtaaatataaatacgtaggaggtagatgcctacgtgtacattgtgcccaactggttccaggcaagttttgcctagctgttttaggaatatctgttattttaaattatatagatttttggaatgagtcatcaaatccaatgtttgttgccattggttggtcttcataatactcagaacatttggttttgaggaaaatacgtgcaaaatttccacttaatttcttttattattttactccaggatttaaaaaacaacaacagaaaatccaaggcctctaaatcaaatctgtcactgttctgagtgaggaaatggtaccaggaaaatgtatatgggtatcttaccctgcagtaagcatgtgggtcccttctcccactgaggccagaggagggcatagactccactggaactagaggtgtaggtggtagtgagacagtgtggggactggatatcagacactgggctttgcaagagcagcaagaattcttgagggcaattggatttagaattatcaacatgagtattacagatctggaaatctgagatttcctgggcgtgcgttactcgctgcagtccttgctatggcaacctggtcagtctgtattcgtaatgccgaaagacaagttaactctgtagacttagaagaaattcttttgactgagattttattgaaaagtttttaaatagccgcatgtgattcagttgtcccccaaccacagctttagtccaaaagaaccaagttaggatatttgtgctttacccagatggtaattataacagacagtaataggagaaccgacttagcaatgagaaagagagatgtgtatctgttacgcaggtatataggccagtctggataatcgacagagtagtaacctgtgaaacgaagaagagtggactcagtttcccatgctgtgctaacccagcctgcatagtgccccgggaaaacagcttaaggtttgcatacatacgtgagacctggtctcgtcgtgggttaactgtaaaaccagaattaagaaaaagttaggtgtaggggaagctgtgtttctaattctttacaaccgtgaccttgatttggctttaagtacaatgattttcaaagatcagtccagttttggctgcagtatcaataagatatttttcagtctttttatatgaacttgatatgtaaatttttgtacaaaagacatattaccaggatgattgaaaaaaaacatgccacaactaccagatgaatctggttttgagctatggttgaaactaaagattaaaatatgatttgtaaataatgcaattaaagtatttcttttaattaaagtagtttgtttatgatgaaggaggtagcagtttctcatccaacccagcaggacaccaaagtctcagccgggtatctggcttatcagatgatgtctccccctcccttctaagcagccctacccagcctggcttctgtgagccaggctgctacagaggtggcagcaaagaaccatgggattggcagagctgcagtcgct

SEQ ID NO: 19270 - DNA, 1206 bp, Mus musculus
cggtgggtctgagtgtcagtcaactcactgctcatgtctgatggttggtcatcaggtctgggttgtgcctccagccatagatacatcactctacgtattttcataccctctgctcataagctctctgagccagtctcatttcttgtctggtgaagatcacaattaatagaggaaaacctaccctgatccagtatatctccagtttaattttattaattgtctattaaaatatgcttcattgtcatatacatgaacttgaaggtcattcattcaacagtttttgtttttgtttttgtttttttttgttatacacttatagcacccaagaaatatttcttcttttactgtttttaattttttattagatattttctttatttacatttcaaatgttatcccctttcctggtttcccttctgaaaaccccctatcccctactctgtccccttgctcaccaacccacccactccctcttcctggccctggcattcccttatactggggcattgagccctcacaggaccaagggccttgcctgccattgatgactgacaaggccatcatctgctacatatgcagctggagccatggctccctccatgtgtactctttggttggtggtttagtcactgggagctctgggggtactggttggttgatattgttgttcctcctatggggctccaaacccagtcagttccttgggtcctttctcctccattggggaccttgtgctcagtccaatggttggctgagagcatccacctttgtatttgtcaggctctggcagagcctctcaggagaccgctatatcaagctcctgtcagcaagcatttgttggcatctgcaatagtgtcagggtttggtgactgtatatgagatggatccccaggtggggcagtctctggatggtctttccttcagtctctggtccacactttgtctctgtatctcctcccatgggtattttactcccccttctaagaaggactgaagaatctacactttggttttccttcttgagcttcatgtagtctttgtttttttccttttaaaaaattgagccagagttctccatctgtagccattgctagtctggagttgcatcctgagctggccacagtcctcttccctcgtcctctgtagtgctggggttacagattcaagccattccctcctgtgtcttcttattttattttgtcctct

SEQ ID NO: 19271 - DNA, 2946 bp, Mus musculus
ctctgaaatcctgggcagaagaaggtccagaggcgtcgtgctgtattttgagctgtataaaatacatgtggatgtgcaaggaccctgaactgtcctcggtacacaggtgagcagctgtgtacccagcctatacaattctatttgtttctcagattctgcatctgcctgatgtcatgggcctccttcgaagttttagatggtgttgatggtcaggccctgatcagtcagcttcggtggactgctcctctgatttctaagcctccaattgggcctctttgatacaaatagaagtcaggtatgtgacttaaatactaaaaatattaatattcccgtttgaattcgatgggaagcccttgtgcccttgtcttcaagaagttccaaatcacctgttttccaaaggtccagcattttgtggggacaaggccttgcctttggctcatcagaagacctgtctttccatcctactgagtggcaaaggtttggcaaaggacaaggtggttttcaaacagctgaagattttcttttgatgctatgaggatgaagtgtacctccgcgactgcacatcatgtccaactggaagactcatgtcttgaattacatactgcggacataagtttggtgggacggttttttcctacttttgagttactggtgatgtaaccagcccatgggtctgacttgatcattatgacaggtcgctgccctccagtggtaccactgacctacagaaggacatcatggcagagcaggaggctgtttaaaaattgagccaggagggaacttttttccatctgccttcaataatgtgaatgagtttaatgctaagagccctgaaacaggcctggtttacctggtatggttgcagaattccttcatcaactgggcagtcagacctctgctgtgctgattgagactgtctccaccttctctgccctcacaaacagcagttcatcacttggtcctcagaacctccttccagcaggggctgtatatttcttgatggaaagttggaggcagggttagaagtaaaggggaagtgagtggcatatcaaaactggtctgtttcagtccctaaaatggggggttatggagggtgggagtcctgaggtgagcagaaaagaaaggtgctgctttatttgaaatgttttcttacctcattctgtgccccagtaaagggtccagcctcatctgtctggcttggccatgttcctgtcactgctccactgcctctctggtgcagctcatgattccaggtgctgcttgccacactaggttttctctcgaccaatttcagctcatcttccagtgctgctcctccgaagcctacacaagtttcctttttccttttgttgtcgttttcgttttctaactttaaatttttatgttgttttgttttacctgtttttatggaagccttagaggagaatctctcatggctccctctgtttggattggaatgggaaaataacaaaaaaaaaaaaaaaaaaaaaaaacaacctttttttaaatttacaaggcagtgtcatgtctaagtgtttctcttatataaggctgccttgctagtatatctccctgcctgtcatgagttctttcttcccattgctacttggatacggcctcttaggacttactgcagagccaggaatgctggcatacacaaggaaggagttggttctgctccacatttctaatcctattgtgtatgtatcttccttctcccaggagctatttgaagtgtgtggactaatttggattatactcaaagagttgaggcaattatagtgcttgagccttgagactgtctgttgttgccttctcagagttttgcagctcagggttggggcctagttacagtttggatccttagtccaagaattttgagaacgtgagtaaaaccttggcaggagctaaaaaatacttaaaagataccttgctacatgagttctttaaaaaccttcagtgaattgtggaaaaacaaaaaagcagtgtgagattcctgcttatataaagtacttgggaaacatgaaagggagaaaggccatggcccactcactcttgccttcagatagggagctcaaatgtgactttagttttcttgccttttctggttagaacataaagatgtgggtagtagtttggggtaatgggtttgctcatattacttcccttcttgttactgcttttgttttctgtctccaacattttcattagggctgtagctccccactctgtgtagataaaaggtgggttcagtccagctattattgccctgagggaacaaactacttttttgggagcaaatgttctccagcatatagttgacagtggttaggagccctccccttcccctgccctcctgtaacagcagaatcctatccttcctcttctgttcattgtattgaccaaccagtaatcctattatgtatctgagtgtgtgtatagggggaaggggttctttacattttctgtggtttgtgcttttttcttcagtaaattagttcccaccatcgcatgcccaggggccactacctggcattatcgcatgctgggatcattgggggagggtagtttgaaattcaccactgtcctttgttttggagattcttattttttaataagtaatccgtcctatacaaatagctaattaactcttgtgttccccctgcccatatggctgctggtgtaaataaattgcattttcccattgctaaatgataataaaatttaaaagaaatattttgactcatcttcttaatggcatgtttcccaggggttgttggcatagcaaaatattttaccactcttgaatctaggtacttgaatgggaggtacatcaaaatccacagaggaactctgtctagcttttatttctcatataatccttcaaatttggctgtctattaaagaaaaaagtacataaagttccctttttcatatgaggtaaga

SEQ ID NO: 19272 - DNA, 1196 bp, Mus musculus
tttatgaaaatgtcagcaaaatggcaattgcatacttcataaaattgggattcaaagctattgaaaaattagtaagattatctaaatataaaataatgatttgttataattttgatttgttttcaaatcacaaataaatggcattgttcttcatactaccatcaaagtgaataatatttgctattttcatgtttagaactaaacatttttatatatcagtaaattttgagaacttatacctaataattttgaagaatattaaggaagatcactgtgtgtctaaaatgccttgttcaaagaaggacactcttggttttctctttctcgtggttttctacctcgtactgtcatgataattctgtggtaaactaggaattccatgcctcccttccacacattattaaagggataatttaccagttgtttgatgcaaagtttatgtgattttctgcatgctgatatctagcttgctgcatatgctagtttttcatagagtttcctctctttgtttaaaacactgccactcttaaccatgtctcatttatagaaagacaactgttttgatgcctatggtaatcatctctttgatcaaatgagaaatgagaaaaatttaaatccctgcaacgtctacagtttccctcattttgacacctatctaaagatgatgtcaatacactgttacatatatttcttaaatgcaagtttctttacattatacttgtttaggaatatatttacattcattccagtatgtgtgtttgaattatgcttcagtctttcaaaaaaatttctcatttttattaattagttattttatttctttacttcccaaatgttccccccctcaaaatatcccctcaaagagttcttgcacccacaaccaacttcacttcgcctctgagaaggtgctcccaccatgtatcctcccaccctgggcatcaagtctctatagtattaggctcagtctctatcactgctacctatgtgcctggagcttctgagcttgtgtagactctggttggtggctcagtcactgggagctcccaggcatccaggttagttcacactgttagtcttcctatgggaataccatcacagtcattttcttcaatccttttcctatttctaaagggtctctgagcttaattcaatgattggatatgaatatctgatcctgtctcagtcatctacttgta

SEQ ID NO: 19273 - DNA, 1105 bp, Mus musculus
gtgatttgtaagaatctgaatggattttaaaaataatattcactggggctggagaggtggctcagtggttatgagcatttgctgctgtttcagaaggtcagaattagtcctcctctccagctccggcgccgtagccatcatgaatgacacagtaaccatccggaccaggaagttcatgaccaaccgtctgcttcagaggaaacagatggtcattgatgtccttcatcctgggaaggcaacagtaccaaagacagaaattcgggaaaagctggccaaaatgtacaaaaccacaccagatgtcatctttgtacttggattcagaacccacttcggtggtggcaagacaactggctttggcatgatctatgattctttagattatgctaagaagaatgagcctaaacagactcgcaagacatggcttttatgagaagaaaaagacctcctgaaaacagcgaaaggaacgcaagaatagaatgaagaaggtcaggggcacggcgaaggacaatgttggtgctggcaaaaagccaaaggagtagatctgtggtgacttgatgttttgctgtgatgtgcagatttctgagaggacaaataaactaaaaagcttctaccaaaaaaaaaaaaaacaaggtcagaattatggttcccagcacccaggccagggggctcataattgtttaaaactccagctccaagaatttagataccttcttggtcttcatggacacttgcactcatgtgcacataaccatatgcagacacacacctagatataattaaaagtaattcttaaaatctttaaaaataatacttatctataaagaattttgtaacgctttctttttaggattttttaggggctgagagatttctcagaggttaagaatactggctatccgtcagaggacctggcttcaattcccagcacccacgtggtagttggcagccatctgtaattctagttccaggagatttgaagtcctcttctgtctacttcagatactgcctgaacatgcgcatagataagcatgcaggcaaaacacccatatacatactctaaaaacaaatacttctttttaaaaaatgatgtcaggtcaggcagaga

SEQ ID NO: 19274 - DNA, 3242 bp, Mus musculus
cagatcatcgacgacgagcctcaagctcagagcagcggagggtgctgttcctccggctaactgctcagcctgtgaccctcaaaacataagagaactgtggatcattgccctcaacatgaagactgccatattccaagtcacatcattttaccaatggagttatagaattaacagtattttcaattacgtttataacactgcagagaccttaagtgctaaacttagtggagtttgtgaccagagaattggcattttctacaaatgttaacaaagcaattaccaatggcctttttacatattttttctttaatgaggaataatatgcatgtagaaaagacctacttaaaggcttcatttatattcttttaaatcagatctttatttaataacttatatatgatgttggaatggtatacatttttgcagtcctttgtattttgtggtagtttgaattgtatcacttctaaacagcatactgtttttgtttttgttttttgattagcagatacgtgaagttctatttttgcagggtttgcacaggcccctaactgtctactactttgatataatctataaacatcctgtatgctgagctggtaaaatacattgtaaattacatattaaatattttatctgcttttacaagcgcaaggtgcaaaaatatatacaattgtcatcttgatgactgtgaggtgaattaaccgttggtgataacacctaagcttttgactctgttatagcgctcaccaccccttcccttgtcttaacgtggaagtgcgcacttacgtgttcacagacttacctgactcgcttacttaccggctgctgtcaccttccccttcccctttttctgtttcttttttcctttctttttcttttttcttttctttttttttggcctctgtatgtcccagtgatccaaaagcagcgtttgcctttttattgttattaaacaagtttccttctgccagtgttgttttagaatggttaccttataagaatttgagtgccgcttgccaagttttatttctgcaacgactcaagttttctgtaggcctttccaggagatgggctctgtggcctgagaagagggctcctgtagtagccactggccaaggcgtctttatgcagagcatgagtggtgatgtacgttcccaaggcagcattcttgggtcccttgtgggttattgcttgtcagaaatgaatatacaaagttgtatatcactttataagagttttcctgagtttctataggaagaagcattttgtaatgttgttacagcagactctgggaagattctattataaaatcatattcttgtttattttgtaattagtcccaccttagttttttttttttttctttagcattgtactgaaatttgttcatttagaaaagaatcaggcactgctcacagaaaaaaacagattgtggaaattaacataaattgttcttgttctaatatatatctatatttcccatttctgtcatgcttggaaaactagtaaatgttgtgtgtaagatgagacgggacggtccctggatttccttcttctaggaagtagaatataaacgcagttagtaagcattgctgaaggtacaccgagcgagtgcttccagagcactccagaggagtcgcttaaaccttcccaaagaggctggaaggtcaatggcttccaccttccaatctaaataacaggaactgaacttagccttgtcttctctgagccctccctgtagatttacttgtttacttattggccttgccaaatgcaaactgctgacctctgtgctgtgtgcctcgaaatggtcagagtggaaagagtcaggagagtgagctgcggtttgtggcccgttatgagacgactgctctgtaccagcctgggtttctggggaagttggtgtccatccatgcagaggcttaaggggcagcagaaagtgtgagtcgctggagaatgtattcctaccttctggccttttcaggagtaaagactgctgccaatcctactgttgtagataggaaatagactcttctcatcacaatagaatcctgtttctaaattagagatgaaatgaaaataagttaaacttgactgttgaagagctagactggagtttttcatgctcggttgtatcagattcacataggatcctctgctgtgtagtcgcaggtaatgattgctggggtagaaaacgtcctctatgttgtcctgttcttgctctgtctctgtctgtctgtctgtctctctctgtgatctatgctgattcaataacaaaaataagcaatcaggtgtacctgctgtgctatgaagcatggaaggttttaaggcaaatgaggtgaaaggaaactggccaggaccagtcccctgcgggcacataaaagggaagacaaagccgaggcagactgagggacagggttctcctggtactgtcttccttctgttaacatctctgtgttcctatagccatgctccgaagaaaaggcacaagacacactgcgggactctccacatgtgtatatacctgtcccatcacttaaagccagtttaagacactcattactatcgtcggtatgttaaaatatgcagtcactgttcctgtaatcaggtcctgctgcttggtttgctctgtgattatggaagaaggatgcttttaaaaatgtattctgcaacagtttgggggtaaactgatctgaaaagaaacgagtatcatgttatgaaatacatgcctgttgtgtttgtagtgtctcctaagaataccctaaaattatgattattactgtattgttatcttttttttttacatattagctctaaattattgctttttttgttcaattttctttttttggtgttagagaacaatagtatttcttctctctctctctctctccctccctatctctcccttcttctccatctttctccctccctatctctcccttcctctccatcttcctccctccctccctccctctctccctccctccctctttccctcctctctctactttagtttccaataataaaagataacattgaggaaatagaatgctataccccaacaatgtttataatcacattgacattacaattattgaagtttctagataaggcaaaatatacatatgtgccaaataattagagcattttcaaaaagtagatgtgatactgtttcttttagtatatagtttatcattttctgttttataaatgctgtcaggcttctacaccatgagtct

SEQ ID NO: 19275 - DNA, 1164 bp, Mus musculus
cagcctgggcattaaatgagaatcaatatctgtctccctgtgtgtgtgtttctatgtctctgtctttctgtctgtctgtctttctgtctgtctgcctctcccccccccccccccccccaggttaggactatagctccgttggtgtaaaccaattgctttgtacactcaagttctggctttcacccccacataaaccaggcatgctatcacatgcttgcaatcccagcactgggaagggtggagatgagaaattcaaggccatcctcaactacacaagaagattgaggccaagccagactagagactgtttctcaacttgattgaaaagaaatatatgttttacattttaaaattattttcattctgaaattttgactgggattgacatacctgggattcagggacttgcttgcttgtgctgtttttaatcgtggtatgagccatgcttcagtgtcttagtgttgctgtccgagatctgcttcttggttacttagcgttgtcaagtaattatgtacattctctggagcacttgaattcatggagtctccaagctttcctgtgtgtgtgtctgtctgtctgtgtctgtctgtctgtctgtgtctgtttaaatgatttgagtcttcagtgaagttggcatagactttgggtaaaagagaaaaattatctttttttttttttcccctatggactatattaagataatgccattgactctgaggaattaaatttaggaatttaaaaggtgcgtgcgcgtgcgcgcgcatgcctgtgcccttctggagagtacaactttctggaatcagttttctcattccacagtgtggattctgggagtcagactcgggtcatcagacttggcagcaagcacctttactcctgagccgtcttagcagctcaagaactgttcttattttgtacctactgtgtgttaaacattgtactaactggggatatgaagctgagaaggtactgtactggcagccagctttctcttctttttacaggactctgtcatttccacggtactcacccgttcccgtggcaattacttctgccttgtgtgtgtctttgtgtctgcactcctgggtaactcttttccttttttagttgtaccctatgtgtcctcactgaaggaacttggattgtgcaccttaagtgacatct

SEQ ID NO: 19276 - DNA, 1228 bp, Mus musculus
gctcctgatggagccctcaagggttggcatcggggaagcagggcagctgaaaccattgggaaagcagttgatgggaacagaacagcaagtcttgttttcagcctttctgatttcttttgctgtttctggcagccatctgtgtatgtagggtcctggctagagaaatggcaacccccacctctactgtcgtgaaagtctggagagctgccatcttctgaccatgcagattctagggtctgttcatctgtcttccttatgtttgacttcatgagcgggtgtcatcaccatgagaatgaactgtcctggcaaccacgtcccagacaaataacaacatgccctaaaaaccccaaacacagtgtgcagcttaatcagctcacccgctcacagggtatctggtaccttaactcctgccgggtctgagtattgtaaatactcaaagtaattgttgaatcagttcggttgacctgggagtatattctgggggaagcgcttaaagatgccaggtggctacctgaatttctgagtactgtaatgatcccagcatttctcaattgtgtgaaacaacattcatgagtttgaaaccaatgagtcaggtacttactgtagcaggagtggcagactggccaagcaggacccctaccctgttctcttttccagtgcaaaagggccattctcttctgtttgccctagttgttctctaaaatgttataaatgtggacacttctattttaaagacttgttttgtttttatttatgtacctgtgtgcacatttctgtgcacttaattggagacggcagacgagggcgcctgagtcccgggagctggagttacaggcgtgaggaggcgccctatgtggctgctggaaactgaacttgagtcctctagcacattagcaaatgctctttatcactgagccatttctcggccccctgatagagtcttttaactgtttttaaaacattggtcttagaactaagaggccaggcatggtggttcacacctttagtatcagcaccctggaggcagaggtatgtagaacgctcaagttctaggccagcttggtctaccatactgagtgtcaggccagccaggactacatggtgagaccctgactcagacaaaacaaaacaaaaaaattcccaaaagattcttctttaaataacatattattttagagttgtgtgcacacagtatgtgcaggatatgtgcttagaatgttgcattcaa

SEQ ID NO: 19277 - DNA, 1160 bp, Mus musculus
aattgccaaaattatttgaatgattcttcaagattaggctgatccctggctaaggtctgtgtaaggcagacaagcattattgatcatatcaagtttcctacaatatcctatccgtaaaaccggaagcaatgaacatgaatgacactcttggaatggataaatgaacttcctgtttggcctgcttctgggccctgccagattctctaacatcatgtacgtaagtatagctcctcaaagcgactgacgtttattttaattttactttgtttttggtttcattttttactttccctacctttatgttgtgctatcctggtccacttgacactctctgatgcctgagagattcttgtttgggatttagtttccagggccgtgtttacagtaaaatagcaggcagtccttttagttcctcctctaagtctctgagattcttcatttcagggttttaaacataagcagtccatcttaaggaaagtgtaactgccgcggccacaagtctgctagttgcacttgaatgttctagcagggttgttgactgccctttctacgttctggactccttgctgagactgtttaacttgaagattaaagaaactattgcaaatgccagtgcatcagaacctaagagtggtcaaatattatgtgcaattttttttgtaaagaaattttaatttataataaagtttaacagtttaaagaacagttaatagtgggactgttttgtgttcactactttgaagtattaagtggttgtcgtgcaaaatatttttaatataagtttttaataatggtcctctttgttcacgtctcgggtgggtaagggttgaagtaggagctaggggttcttcccctgataccatcgctttcttctgcaactccttccccggtcaaaacagcaacaaaacaaatgactttaattggtgagcacaggccttctcttttgagaacagtgagcagataggtttacattaagcactgactgtgttctcaaaaacagggttaatgtcaccaagttgcagtttgagttatctacccagagacatgctggcttctgttactacataggccatggaaagagaaccggcttctttttttttttttttttatggagttgtttgtgccttgctaggatagttatgactgaacaatgcagtaaa

SEQ ID NO: 19278 - DNA, 1568 bp, Mus musculus
tgacaaattagaagagcggcctcacctgccatccaccttcaactacaaccctgctcagcaagccttctaaaaagacttcccttttcttggggtatggctgtctcagcacaatactcgacataactgcagagctgatgtggctcaggcaccctggttttaatcccttgaggatctggcaattggcttacgtaaagaaagggtcaccatttgaggtcctgccttaccaattatgtgctgcccaacaactaaatttgtaatttgttttctctactttgagcagggtctgaattttttcatttattttctttttgccagcagacagacttgggtctataaagacaagcaagtacactgacagaaattaccatttagtttcttaaatgtaaaaaaagaaaacccacaaaagactcaacaaaattagaccacaaaatttgcattgttcattgtagcactattggtaataaaagaacagatgtttgtgcatttttatgtgaagatccttctcgtatttcatttggaaggatgagcgaggtctgcttctttctttttacttcccctgtgtttctgaaaggcggtttggccaggcttactgcaggcatccgactgtagagatcgccacagtctctggggctccagggctgcgctgtaactgagcttcatccagaatgagcaaaacactgtccagtctttgttacgattttgtaataaatgtgtacattttttttaaattttggacatcacatgaataaaggtatgtatgtacgaatgtgtatatattatatatatgacatctattttggaaaatgtttgccctgctgtacctcatttttaggaggtgtgcatggatgcaatatatgaaaatgggacattctggaactgctggtcaggggactttgtcgccctgtgcactaaagggccagattttcagcagccaaggacatccatacccaagtgaatgtgatggggcttcaagacgtgaactgagacaattcactctggctgtttgaacagcagcgtttcataggaagagaaaaagatcaatcttgtattttctgaccacataaaggcttcttctctttgtaataaagtagaaaagctctcctcactgcagtgttggctttgatttgaaattgtgacatttcttcttctccagaaaaacacagaggaaaacctcaggttttacagattctgaatggtgtgacttgatgtcagtcgtcctcttcttttccgatgtcggcagatctgttgatggggccaccctgggccccttacttaggaaggtggcctcagcattagctgaggggagcattgggtaggttggagctacgttgcaagttagcacctgaccagggtgggacccaaccagaaagtttgttctgtgagaaattgatgaggaatttggtggtagaaatttgagatttatttagtcttcatgaaatttaccttcagcttgctgacctggatggttcacacttgcaggtgactgaattcttaaactgtgtggaggcaaaactgtggcttaaactgccaggaggactagagatagggaacaggctatgtggaataca

SEQ ID NO: 19279 - DNA, 1223 bp, Mus musculus
aatactgaaacagaaagctcatgttggccggctgatagttttggaaacttaaaaaaattgcatagattttatagattttggtataagcttataattgttaaagttttaataaagacattagaagcaaaagaataagcagtaaacaaaacataaatttataccaatatgataagtttgttttgttgtatgtctaggtagttgtgacttgacataaattccagaatgccttcccatggtggttaaaaaatgctgcacccccttaagccctcacactcttcaacgttctaaagtagacatagtattgacacacagtttcatatgtgaagacttggaaattttaaaagaaaaaaaccctgtgtttggaaaaattgtatttggagctataattattcatcaataagtaatttggttgtatgtggggccgtgaaaatataccatatagtcagatttgtatctttatctgagtcccatcacccttagttaatctgtttcaggatcgtagcagtacgtactcattttgtttctgtaggggtaaagtaaagccagacttccaaaatactactcttgataaaagtaatatttttgtctaggtgacaaacagcatgtttggtgcttcaagaaagaagtttgtagagggggtggacagcgactaccatgatgagaacatgtactacagccagtcttctatgttcccacatcggtcagagaaagatgtaagttacgctgtctttcctcagcagcgctgctgtgttccctgaaggaggagcgtgtgagctccaggggattgtctgtgctaagcataggtgtaggtcctggggacaaacagataaaccttgctttgccatggggaccattagtatcctgggcttcttaaacagtagtaatgctgttataggaagtactcacggacatgcgctaaagactgtaactttggggtaatctgggatttttgtttcatgataagtattttttttataataaagcaagtgtacttacaaagttaagcgagcacatttgtacgtcttggctgtaattcttgcttgcaagttaagaatatccttctccacagctacagagaccacagtcaaaagtctttggtactgtgtagattctacagcataggtatgctttggaagagtagtggatcaataattccttccacatgaaaggttattaagtttataggctattttaaaatgaatgaacttaagtcatttcactct

SEQ ID NO: 19280 - DNA, 1187 bp, Mus musculus
caagaattttagaataacatgatcttcagtgatagccatattatcattttgaatttgaagtagcacacatataatagaatgcatttatctctaaatcatttagcttctatattattaaacaaatatacacatgtgagtgacaatgtaaatttttactaggatggggtatagttcagtgataaagcacttgcctagcgtgtgctgggttcagtctctagcactcattcccccaagtgagtagatttattatttaaaaatctcatcttctgtcatcagattgctttaaaatgctggtgtcaatttacagtgacttccctacagcctctgcagtgctggggctacaggtgtgcaccacctcacccaccttaatacttaacattttattatttgattaaagtgactctctggtggacaggtccttatttgtttctttatcaacatagaagcacttgaggaattaatttcttcccaaagaatataattaaaccaaaaggtctctcatttttaagagttcactggttctgtctgtgtaatccaactttcattctgttgactgatggtgctaacgtgacgagagcagagagttaatgttgagtactcaagagaacaagagtatgtaaggagtggctaggcagcatacttgaacatactctactagcatgatttcatgaaggccaggtaagccctatccttgcatattttgggaaagtgttcagagctttgccctttttaggttgttttaataagtattttgaagcagtctgaaagatgattctggggttgggaatatgaagagataaacggagtcataatgttgatactggacattcagatctttatagcatgatttccttatttttcaaagagcagaagaatcccatcgtttatcatgttctggttggactcctttcttatcgtttgctggagtttgaacttcagagctatggtgtcaaccctgctgtaatatctcaggggagctcctagtgtggggctggtgccatggctcaccctccaacctttccttcttcacttcagcctccagctctgagctttcccatccccagagtagcaaatgttgaaagaagttgcacaggtaagtagatgcgggaaagctgggctcaacagtgctctcttattcattggtgttttgagggtgggtggggccatcttgccagtgagtcattttg

SEQ ID NO: 19281 - DNA, 1238 bp, Mus musculus
tttacatcctttagcgtggaaataatctttgtgagcgacatgaatcaatacatatatagcttacattcctagcatctgagtataggcagtggggtgggccatctagttaatgattgaatttgaattaactggtcatttggagaataaccagagaatatttaagacacacaaaaaagcttggggtcagggggtgggtggttgttgttgttgttttcttgttttttttttgtttttgttcatctatgtttcttcctgttgtgtgtaatgtctggtattgtgacaaagtagtggaagcaggtgtgaacgaacagttttcatatctgataatctctacctcagagcccagtgctagttgcctgctctcaatacctagggggagaatgggacagagtctaagacagttagctgctttttaggtttgttctcattgtattttgtgtgctatgttgaatatttttgttaatgttatgtatatttacatgttagtaattttgatggcttttggataattccactctagagggagaactggtgggcggtccttcctgtgacacgacccttgagtgacagttctatttgattgcctccagtactgtgaggaaaggacacgactctatggtgaggactgatggacatacattatctgagaaaagaaactaccaggtaagatttttttccctcccttttctccatttgtcataagtgtattgagctgttttaaagtaatataaaattgtaactaacagtaaatacaatctcctgaaaatttgtggtataagtttaaatattacataatggaattgacagcttgaaataattgtgaatgttttacaaaatgacatgtttataatgtatatttttaacaccagaacaattttctgacatatgccaaaattttggattatctgatatataatatatgatttttggctggattcaaaggcagtagttcataaagtattttacacacattcctgaaagaaggaaatgtaaattttgggttatagtttctataatagagtgatagagaaatgtacatagcattgagtaggctatagaagaaatataaatggaatctaggaatatgtgacccagatcctgttttgtcactaatatgctgtccttacaacatcagattcttgtttcgctccttacttaacacttcttaacactatccaatcttaattatgtaggaatgctcaaaaggtaatggaactgtaacattcctatttcttcct

SEQ ID NO: 19282 - DNA, 1183 bp, Mus musculus
ctttcagtagtaaattttcttgtagcacctttgtaaggccagatatgtagatagtgctcaaatttggttttatcacggaatgtcttattttcttcatctattgtaattaaaagttttgctgggtagagtgttctggactggcatcggtggtctattagagtctgtagaccatctgtccaggccctactggattttagagtctccattgagatgtcagatgttaattttaataggtctgcctttttatattttacttggtcttttttcttgcagcttttactatttctttgtttaggttttttgttgttgttgttcttttgttttccccaggaatttcttttctggtccaatatacttttatgttccatatgtttatacttcgatatgtagctcctttaggttaggggaattttcttctatgatttttctgaaagtattttctctgtttttgatctgggtttcttcttcctgtattcctactgtttttgatttggtcttttcgtcatgtcccatatatcctggatattttgtgtcttctcagttcttaagctgatttagttatttccttctgctgtttgtgctttcatgggtatttttttaaagggacttattctttttctctgtcaggacctctgtcatattcacagaggctcttctaaggtactcgtcttgcactgcagctgtgtttcagtactcggggcctgctgtggtagggttgctgggctctggtggagacctcccgtcctggctgtcactgattgtgcttttagaatggcatctaagctgtagttctaagtgctgatatctggactttgttagttgggtgctttgttctttggtttctgtttctcacactctctggttcttgggaaaatgtgtagaccgtatgtttccagatatttttatgggatcctgctaggtgtggccactagggggttccaggtcaaatgtgtttctaggtgtaggtagctgacacttaggaatgggaaacaactaggaggtggagaggaaggttgaggggggtcacaggagggaggaaagcagggtgttccatcatgatctgcttagtcccttgggaatgagcacagagaataaacagaggccacagcagaaggtctgctatagagctgggattagaatggggattggatgtggagaatggagtgagcagtgaatcttgttt

SEQ ID NO: 19283 - DNA, 1210 bp, Mus musculus
tcaagtgtctactttgacctgcgttcaacatggcaacactagtgaccattgttagtgactggtaaagctgggtgcccacggagcccgagtggtggctgacggtaaagctgggtgcccacggagcccgagaggtggctgacggtaaagctgggtgcccacggagcccgagaggtggctgacggtaaagctgggtgcccacggagcccgagaggtgcttggtgttaggcgtcaggtgctgcattgggaaatgccgagtttgggtttcagccaattgtacattttcattgaaacttgagcagtagttgagatgacacgttatgacttacatgtctcttctctgtttgcgcagtcgatcagatgttttgggaagttatgcagttgagaaaggagatgtcgttggcaaagctgggatatttcaaagaggaactctgatgccctgtgtgcggggccgtgcgtgctgcccctccctggaccactgaaggatgacggaacatttttatggttactcaatatttatttctaaggagaggccacagacttccctcctcttgcacactacactgagaagtgctgtgatttcttttaagctgactgagctgtatcccttagtggagcacactatgaagaattgcaggcgctagtgatggtaattcaacactgcaaatcaaaaccaccaaataaatatcagacggagtgcgtgtgtctttcttagctctgactcggcatagagagttgcagaagacaatagtagtcttccctttgttcccctgtgagaggcaaggaaggagccaggtggacaggactccttcctgtctgtgtgtatgctgacatccatacgaaaggttttatttattattattctgtccgctgtaatgtagtgaatcccttgatcataatggtttgctaagtgcaataaatgaagaacagtgcgcgtgcttgagcatcctggcttcatgttagcactgagcatcatcatggaatagaaggagtgttaagattaatggatgagggcgtggtctagacggatgggatctgccagctctgaagctgatactcacggagagaccaccaacatcattcgcacaagtaaaataggttcgtgtgcagacatagtgtagggggggcaaggaaaacagcctcgttgactccactatgatcactacgctcacgtttctggagaatagccttggacttcagatatttcctacgt

SEQ ID NO: 19284 - DNA, 1151 bp, Mus musculus
tgaggagaagagggtagctgtatttgaattgcatataatagactttcagtcaaaacttgttaagagataaggtcattacataatgacagaaggatcagttgattggatgatgcaattaagtatttccccaataacaaagcgcccagatgtacaaagcaactgtcagatctgaagggaggaaagaagtacgggaatagagatgtgttgctgtgattgctcagatagaaaagcgagacgaagtagcagggtggatcgaccatatgcccctagacgtacacagaactctccacaatacagaagaatccacgctcttctcgtgtgtacatgaaatattgtctgggataattcctgttacatcacaaaattcattataaatttaaaaagatagaagatccccaatgctttttttccattcttctcagatatattcttccagtctacccacaagagaggtctgggaaacctttctgccacagtgaaatttgattagaaataacaataacacagtaaaatacacaagtatgtgtatactaaaacactgaattggggttaaagacggaaccaaaagggaatttgaaaaacttgttgagacaagttgagaacatagcataggagatgcagcaaaggcggtactaagaatcacggtagtgagtgcctacaggggagtacaggagggcacgcgcttgaataccacaccttaaggaatttgaaaaagagcaaactgagccccaagttagcaggaggaaggaaataccagagtgtaaaaggagcagagacaagaaaaaaagagaaaatatcaacaaaactaagagttgtttttgaaataaagcaacaaccaggatcttactgacctgagggagagataaggctttaacaagatggaagcagagcacagggaagacactcaaaggcatagagtcctttaaggaaaaacatactccagtcagaaaccactagaaaagaaacggagaaattcctagaaatgcacttcatcaaaatggagggaagacgccatggagagtcagaagagacctgtgacaagcttgtcagtgatggatgtggccagaccaaagagagcggttcagagctggatggcttcacataaataaagggagtgtcaccagccagcgacacaggataacacacatccc

SEQ ID NO: 19285 - DNA, 1329 bp, Mus musculus
ctgtcacttgtgtgtcactggacagtgaggggtgattgtcagcatgctgtgctctctcctcactctagcttagccgtgggcaacctgagtaggttgaaatccaggacccctgagtcgttctttggctttggtgtaatgtgaatttggtaaactttcctaatccttacattattcaaaatcatgccgtaaaccacgtgtggtagtgcattccttagaggctgcggcaggatgcttgcaagttcaagtctagtcttagggtgtgtggtaagatgtgaccttcacaagatggaaagaaagcaaaaaccaggctagcctgttttgggaagtgtattgtttatcgagtagctgtttgggtcaggcactgcgaactgctgagtacaggcctgcacactgctgaattgtcctgtgtcctcctaatagtgacagtgattgtgtggtgttccgtcctcatgggaagtgggcctgcagtgactactgagacagaggttctcgccgtatttgtagtcaatgaaaatatagttgaaaccatacttgtcattgtttacttttccttaatagtgtgggttgttttttttttttccccttacaggaaacgtgtccccgatcaccacccctgttaagcattcccatttgctgatgaactctgggccagttcatagcaaagttgtacttggaagacttcaacctttaaagaagactggtggaattgacctgtccatgatagccttaagtttgaacattagctgaccttctgtgttaaacatgggtctaatttatttactgtttcattttccatacaattcagttgatttacaagttcatttctcatactgtgtattaaaataaaaatccagttacttagcccttaatgtcttactgatctgtatatatcctgtttgaaattactcacggaagcagtcgtacctctgtagagttgtttcagcctaatcaattactgactttaccgtttaataaagtaattatcttagttatgcatacacacacacacacacacagtcaggcatagcttttactgaacattaatttggagtagaagtactgtaaggtagagttctgacttagtttaatatgagtaccccttattacattagacaacctttttatttctgaagtaacgtttaaccatccacagctctctctctggtgccttaatagggtagcattttcctatcctaagtgtgagtgttagatgtcataactgtcttgttagggttttttgttttggtaaacaggaaatgagcataggtatgtattaggtttaatttacagttgacacagatgtggaagttaatcagaatattgaagcgt

SEQ ID NO: 19286 - DNA, 1169 bp, Mus musculus
tagctgtgtgcaggtggccactgctgctgacgtcacgggtgcactgggcatctcaggtccagaaggcagcatgccagagcactccttcaccccttaggttccttctaccctgttctgtggtgctctcagagacctggttagggccgcgcactcgggcattcgcttcctggacttgggcccgttaccagactccccatggactctgcccactgcaggcagccctgccccatgcgtctacacaaaaccccttaaaagcacttgtgtgggctcattgtcattttgtttagtttcaagactggctgtcctggaactcattctgtaaactaggctggccttgaactcggagattagcctgcctctgccgccccagtgctgggattaaaggtgtgtgactccactgccaggcctaacaatttttcttgccagttttttcttaaaatagtgcttttgtagatggatctagctaaatcaggcagtgagatgcagtaacagctttagttttattatgagttattaggaatgttttaatgcctttaataactaccttttcagatatgaaggaaggtaccatcggcgatatggcagtactgggtataacagagagttttcaagtgaagcgacaggttcttctgagtgcggctgaagcagcagaggtgatcctgcgagtggacaacattatcaaagcagcaccaaggtaccagagtgctcgtgctcctagggaaacacaggccggagtccagggagcttgataattgtgtataatgggacagttccgtcttagtagacggttacacaaactatctaaagtaagtagtcgtagttcttagaaaggcataggaggaaactggtttgggtagccaggggcacactcatactggaagggttaaagagccaggcttctgaaggtcaggtatcagggagcgtgtgggtatctggtggttttaccaggatgagtcaggccgcttgctttcctggatatccttataggtgcgtgtgtgcctgacctggtgggtctgttgttggagatggtcttgctgtgtaactggggctgccttccagttcagaaccctcttccctgagcttgcagtgctgaggcggcaggcgccccgcacgtggctcacaaacatgctcaaggctcctttccacgttcacgctgtagaaggtgactt

SEQ ID NO: 19287 - DNA, 4090 bp, Mus musculus
tcagggtgatgtggtttgtgtctgtactgatgctgtagcgttgcctgtgtgtattctcttttttagttgtttctttgctttattaagtttatgggtcctttgctatgtgtatgcctggtgcccgtggagcacaggatcccccagaactggagttactgagggttgtcagccagcacgtgctgtgcaggtttactaatgcatccttaagtttattaccatctttatgtttgttgtaggttttcttttggataaaaaaattggagtaaatcaaccaaagagaattgaaaatgctaaaattcttattgcaaatactgggatggatacagacaaaataaaggtgcgtggctacatttcttgacaggctgttgctggtgctgttaacgtaggagtcagttacaccaagcagatgagacacctatatacactttgaagcgtatgttcgtagaaacgctgaagtacgtacggtgtattttaagaggagtgaaccttacactgcctttatgtcttcaatcttagatatttggctctcgggtaagagttgattccacagcaaaggttgcagagatagaacatgcagaaaaggagaagatgaaggagaaagttgaacgtattcttaagcatggaataaattgctttattaacaggtgtgtaacctaaagttacttttttctcataaaaattgtatttcctatcaagttacttattgttagaaactgctgcacacggttttacttaagattgcagagtgtggcagttcctccaggctgctgctcggaggactgttagcttccgggcaggtctctgtgttctaaggttcctcggtcctttattttcactgtcctcagcctcacacggagtgcttgctgtggatggagtaaggctaacatcatgcaaagccccatgagtgttaacagtgaggtaacagtgatctaatggaggtgacgccagacaggtagaacatactggggattcagttatggaggtcaggacaacgtgtgggattgcagtctctatcgtttgagactcaaggattgagcatagatagtgaggctggattttttatttccggtgaagtaaaagtgcttgcaggtttgtgttgtaatgtaattcagcttgacaaggagccattttgagcataacatgtattttattttcagacagttaatttataattaccctgaacaactcttcggcgctgctggcgtcatggctattgagcatgcggatttcgcaggtgtggagcgcctcgctcttgtcacaggtatggaaaatgcataccttaggaagtgcagtttccagtacgttactgtgcagtgcactgagaataggaagaacccccttaaagagttgagagtatatactttgagttaggcctttaatttccttacattgtttgaagacttagattgattgattgattgtgcatgtggatatgtgccctgcttcaccagtggagatcgtagcactaatgttttcctcttcctgtgtgggtcctgggtctcagctcaggttcgaactaccttgctggctcctctataccattacaggcaattctctctgtacttgagtttctcagatttttgggtgtggagtgtagtgattgactgtgtatgatgaaatgacatagggtaggacccaagtctaaatatgaaatacatttctgtcagatgtgtatactcacgcagagagattgtcagatgtgtatactcacacagagaggtcgtcagatgtgtatactcacacagaaatggtttacgcagcgcttttggttgatatgcagttttactggcctttcacctgggccattttcattcttacagatgcacatttggggtttccgtttaggaatgcttaaagtgtatgccagattttacgcgcacgcacacacatgtgtgcatgcacacaccacacggtttgccatgactctagagtgatgtttcaagacagtccattctttctcacagaataaagactttactttctgggcatgagcaaatctgagcttaaaagaagagtctcgagtattaaatcttaagttaaaccttagtttgttttgctgaatgcttagctccttatgccccgtgtgaggtaaagtcagtgacctttaatgacgacatcgtgcccttcagagcgggtcaagtatgtaccttgtgcttgatttgacatatcttttctaagtttctaatttacaaaattacggtaaaactatttaaatgagtgaatcaattctgtaacagcctcaaacccacagatgtgtttccggtgatgttcgcaggtggtgagattgcctctacctttgatcacccagaacttgtgaagcttggaagttgcaaacttattgaagaagttatgatcggggaagataaactcattcacttttctggggttgcccttggtgagtgactgtaaatcttggcttaaggacctaagtccttgccgacctctggaagtgggaaaaaagttgtaggactggagagatggctcagcggttaaggacctctggttctgagttcaaatcccagtgaccacaaggtggctcacaaccatctgtatgagctctgatgccctcttctggtatgaagtcagcggcagtgtactcatactacataaagtgaaacttttttttttaaggtttctatagcactgaaatagatatcctatagatagataccctatagatagataccctatagatagatatcctataggttgtcgagatggctctgagtggaagtgcttgaaacttgaagaccttagttccctttctgggaccctcatggtaggaggagagagccaactctcaccttggacttccatgcatatatgcacccacgcacatacatgcatgactaaggattattaagtggactggatatatgtgtcttatgagggcaaatataaattttttttaattaggtattttcttcatttacaaatataaattttgagagagcctattttatgttctgtttcagtgtcttaaagtcaggttgatacttgctgccttttgaaatgtgtacatttagcatagaatttttttcttcatcactcagaacatttatgaacatggatttttgcagagaagcattgctaccaaagcccaagactagtcgagtcgttacttactaagtcgttacttggagtgcagatgatgctgtggtgagtggctagacggtcactgattgacgtttctccttaggtgaggcatgcaccattgtgcttcgtggtgccactcagcaaattctggatgaagctgaacgatctctgcatgatgctctttgtgttcttgctcagactgtaaaagatcctagaacagtttacgggggaggtaagcatttcaagaatgttacatactttgtttcttgacagtaggtccgacttagatgtgaacatcttggcttttatagaaacagagacggcagagtgcataacaagttctgggttacatttgtaggctgctctgagatgctgatggcccatgctgtgacacagcttgccaacagaaccccaggaaaagaagctgtagcaatggagtcgtttgcaaaagccctgagaatggtaagctatgaagagagaggtgaacatacatttcatgggcttgattttaaactgaatatatttttgtgtcctagagaaaaatttttctctttgcctttacaaaactacagtagtccacaatgttttatattttgattctacattttatacgtaatcatgaatcattattaagaaacaaacagccaagcagggtgtggtggcacacgcctttaatcccagcactcgggaggcagaggcaggtggatttctgagttcgagaccagcctggtggtctacagagtgagttccaggacagccagggctacacagagaaaccctgtttcggaaaaaacaaacaaacaaacaaaccagacagccaggcatggtctttacctataatcccagcacttgaggttgaagccagatgtgagaccagccctgtctgtaagagcttgtctttaagaagagcaacaggaagcaggctttccctgtaattcagctgtctctctaggttagaggcagtgtggtccttggtggttattcatcactttgt

SEQ ID NO: 19288 - DNA, 1096 bp, Mus musculus
ttctcctgtgttaccatccccaatctcacatccctctccagtggcagcaagtgttaccatttacaaaacttgctggtatttttcttttcttttttctttttttctttttcttttttagatttatttattattatatctaagtacactgtagctggtatttttctgttcacttataggtaagtttatcatgttacatatttttgcaacacatttttaaagtaacatactgttttttgtttatgtgtatctgcttttagtgtgtttaactgtcatatagtgttctgggatatttgtttccattgctgtcttgtgacagtgtagcagagctagtttgtattgcctgtatgtctaagctttttacacattgaggtttggttgtaggatacatgcatagaaaacatttagtagccaactaactatccagaggttttggtatctgcatgtattcttgaagaagtacttagaccttaatttgacagaaatatatttcttttcaggacaaaattctcctaagcagtggacgagacgccgctctgatggtgaccaacgacggtgctaccattctcaagaacattggtgtggacaaccccgcagcaaaggttctagttggtgagtataagatttgcttgttgttattttccaataatttattccctgataggctgtcagctacttaagtgatggccattggcatttatcgctagtcagatgagtgtcagaagtatcattgttacccatagtccacggggggctgctgccaccacaatttttaaatggtacaactcagtctggctgaactgccaagtccaagtgggccctttcttggtgagttctcttgctgtcataatgtgacaaaaggcctaacttggtgagacagaaaaagattaggggttaatttacatgaactcgtgaggcacattcaagctaaagtatttaacggttaaaggtcttccaaaattttgtcaggtgcatattactaatggagtttacgcttgttgtggaagttttaagagaatttagtaatgtggagaaataatttcactttttcctagatatgtcaagggttcaagatgatgaagttggtgatggcactacc

SEQ ID NO: 19289 - DNA, 1223 bp, Mus musculus
tcagtgtgccctgcacagactagtgccctgccggctcgctgcctggttcccaaccctgcgtcctcaatgttcagggtgtaacacagttctctcatagcatcctatcattgaaattgtctgacagttggacaatgaagcctggaaacaggctggtacagtgtacaatagtcaccaggggccgagtttgcattagtaaatgcaaaatagatgttttataaaggacagactttgtgttatgtttctattttcattacattgtataataatgtaagattattgtatgttctaatttgcattataaatgtttttttcctacataaaggcataaatatagcaactttgtataaaggtagcttattagattttaatttttcttttataaaagttgtctacagtgggactaccattgccaaattgtatatgagatatgaatcttcccctatggttaatttcttttctaaacattccatatttctctaatgaaagacgtgatactgtactatgcataaattgtgttttaatgctgtttcatatcagcaggttaatcttgggttggcaaacgtaaccactgttattacaataaaaccttgtgtgtgtaacggcgtcactggccctctggcccctctgtctttgttcttgctaccccatcagtgccaatgtcagacaccctgtagcatggcaataaaacagaccgtctacactgaggccgagtgtggctttgtggaggaagtgtgggtgggaggaccaccccacagttgtcatagtgtgggcctcttgccatgtcagccgtgttgtcaggcataaggagttatctacgatgtaaacatgctttaaggacaagtgtgcgagtgcttggaagctttgcttttgatgtaacaggtaataactagttgttaatctttggaaaagtcagagtccttgaagtacaatcaagcctttattaactggagtacttaaagaataagctaataatggaattttgttccacaagggctaagcaacacttttaaaattctcttacttattgtattagtatactttcctatcctaaaattagaatgtgtaaaatgtggctccatcttagactgtagcatctcgcgaggccttcctgtcagcatccgggcgtaaatacccatgatgggtacaaggtgatactgaagctgagctgacacacactgaccttcagcgttcaggaaaactgctctgtggaatcaaatctgatg

SEQ ID NO: 19290 - DNA, 2589 bp, Mus musculus
aggcactccttagaacactaatctcctgatagctactcactgtccagcagcaccccattctcacagtgcctacttaccacgagaattgaagtgaatgccgtgctgggtgacctgtcctcagcatcctgggggatgcatagctttcatgtctgagttgtggttggcgtttgaaccttttataaagtctcttgataatgcgcattgctaacataactctgggccctgagaggaaccctcatagatcactgttcacagggtatggtcgccagcatggaacgtgaggattttatttcattagttaaaggctttttgtcttgggccaaattcgtgtcaaagaacaaggagaaccacacttccttttgtaccagtcagcacctctgtcttgagtgtgctgtgattggaaggcagccaggagacagctctgtgtccccacctcctggtgtcatctgaagggcgtgtccagatagcatcttactcagagttaggatgggcttaggagtcagtctcaggtcactttacccaaaagcatttgaaagtctacccctgatctctcggtgtgtctgcggtagattactgacagcacacatgtgtctgcagacactcgtgccattcagtcccatggagcttcagtttcccctttggtctttgggttgtcttaccttgtatgtaatgcttttttcaatttacaacacaatgtttgtgtatcgtcttggaataggattgtgtgtttgctgttactacttaggctgcgtttttgttgttacggtcctgaaggtccatttgggactgactgttattctctagctgggttgcccttgtccagtatttatttatctcctgcttgcttttcaagttgatgaaaaaaatcgacgtttgggttttaaagttcatttgtgtccatgggtgatctctttagtagctgagaaggaaaggaagagactcttaaacatgtgagtccccgaaggtcctgtcctcgctggggcgccctgcgctgcactttagcaggggttgtctcagctccatggctgcaggcccgctctccctgctctgctgtcctcccacgtggagctgggctctgattaccctgtgatgctggtgagctgttaatattgttgccagcataacaggaacagggaagtcttaaagaggcgccgttatgtcatagcgtgaagtgaagaaaggccactcagactgatgtgctcccagaccgaccactggacagtacagggaggggcagcctgcgggataggttatcttttctctaaagttggagacattcctggttatgatctggatataccaggtcaagaaaagggttcagtcatcggcaggcagtgtatttaggaactcatccagagcagcggctggatttgcagaacagtagtgcggggccataatatctagatgtttcatcatcttcagcgccattgcttcatagcatagcagacgcttcctttcctttccctctgcgaactaaaatgtttgctgttctcttcaagagaatagtggatacatgtgcagtttacatatttaatacactgttccattcgtcctttcttctgagtagcttgctaattgtgccaaatttcagtggtggttttgtggtgtggggtaaggacgcttatgggaagggcgcaggtccagacagaattagccctccacctcagagggctggtctgcgcggccgtctgcaggctgggtgctttgttctttctctgtactcttcacttttcccttcagatttgaattagattttatattttttagctgactaatatcatcattacagctatgctttaagtagtatatggcttaagaatgcaaatgggaccaatttgtctgctaagaatttgattttagggtacaatatgaatattaggaagaggtaaacaggtgtgttaatttctagatatcttctggaaaccacctttgtttctgtttaaccagtcctgtagaatccctgtgtcctttacagtcgtctcatgatgggcatttagctctgtcctggaagaatgtacctgctactatttggtgaattttagagtgagatattttattggcatatttgtagccatatgtctcagattttctgaatcaaacctaatgtcagatcattggttttgttggttagaccatgttaccccactttctggttttggaaatataatccttgctccctccttttctccccagataaaaacccttgcttagtccatatagtccatatagatcctaacacttctacagaccagggctggagactgatagggcatcactagtgtttcctgactgttgtgtcccagtttcatcttcctttgaaaagtgaaaatatggtgccttccctccctcccttcctccctccctctctcccttctttctccctcccttcctctctccctccaagaagacgggcaaatcgttccttgttctcccactgctgtggagtgatgagacacgcactttactcttgaagactcagcaaaaagactcacttctcagcatatccataatagaccacatttcggacttaggaaactttgccaagcagtctctgtcattacagatattaatgttgcctcccccaccccc

SEQ ID NO: 19291 - DNA, 1178 bp, Mus musculus
ctcttgcctcagagtctgccacctctcggtaggcgccacagtctggtcactgtacccatctccccttctttaggttctcagcccactctgttagttaggctcccccctccatgcttcctctctgtgctttaaaaaaggaaagaaaaaccctttttctgcccattgattgaagatctgcttctttaattacgtgacacctaagacggtggtacgtggtgctcttcgtccttagaagacttgagacaggacagttataaagttgaggccagccttgccatacttacgtgtgtgggcttgagtgtatgtatgtgtatccatatgtgtgtgcatgcacgagccctcagaggtcagagggcagtggatcctggacctggagttacttgggcttgtgggccatcatctgagtgctgggaaccagacctctgcaaaagtgctaagtcctctcacgtgctaagctgcctccagccccggctctccttcacttaatagcttcagtggtccatggagtctgctttctaagctcctccctcaaacccatatttccatacttagctctttgtttgtagcctcaggttaggattgtcgcagctgagtccgtctgcaccagaagagtccccagcacctacacagcagatagaatagacccttgcttccggctcctggggacagtcagccactcagcactgttggctgtggctctaaagccatgactttcttcctcgtgctactgctgttgtgttgctaggcttttatcctagttcagttttctcactcaagtgtatcctgcgggcaactaaattttaaacacacacctgagtatctcccctttgtggttaaaatgaatgagttttaaggagggtggggaaagaatgctatataattttaagattttcaaaatgtttccatcaattacatcttttttgtaaacttaaaaaagtttacaggctggagagatggctcagcagtaaagagcactgactgctcttctgaaggtcctgagttcaaatgccagcaaccacatggtggctcacaaccatctgtaatgagatctaactccctcttctggtgtgtctgaagacagctacagtgtacttatgtataataataaataaaaaaaagtttacaaaatttaataatttagcccttcttggtaaaaaaagaacaacacatatggagca

SEQ ID NO: 19292 - DNA, 1177 bp, Mus musculus
agaagattaggaatagggcagttggggtggaggtatgtcatccaaagagaaaaactcatttggccccagaacttgtaagaacatttagtgttactgcgtctggagaacccctagagggctcgaggtatacacagccaccagacttgttgccgtggaattctaaatgtttcctgcagtgtgatggctaatttctattgtcagctatctagaattattttgattaggttaattacaatgggatgacctgccgtttgtgggtggcatcagttcccagcctaggattctgtctgtccgagaagcagaagtgcgtgaggtccatcctctgctccttgacagtgcttacagtgtgaccagctgtctgcagctctggggctgtgactccccactctcttggactgtgatgccaagctctggcacacgtaaaccctttgtcccttaagttgtttttgccagggtatttcatccctgcagcaggagaagtaactaaggatgggatatcttgtaaatgctagtggtgggcacatgaccagtcatgccttcaggagcgaaccgaagtgttctggaggcagaggagctccactccagctcagggaaaattggtcaggacataggggaacagtagatggaaatgataaagacagagaagattcagaaagtttacaaaatagataaaacgttgctattctgaataaaataattactttgaaggttttttccctttggtcctgggggtaaaatccatggttccccgcccgccccaagcgagacctgtgctgctcatccagacaccacaggcttggagatagttttctttttctttttaactagtgatttcatgttatttttaacccaacttcttttaagatttatttttatataggtgttttgtctgtacatatatatatatatatatatatatatatatatatatatataaatcttatataaataaatctttactccagaagagggtattaaacctcatgggactacatttgcagatcattgtaagccaccatgtgggtgctgggcttgacctctggaagaatagcctgttctcttaaccactgagccatctctccagcctataaccaatgatagttcttcaactatcattataagcaaaagcaatattgaacagtataacttcatatgggatcacataactgtattggaa

SEQ ID NO: 19293 - DNA, 1361 bp, Mus musculus
ggcattccttgggtgtgtatgctccttattccaaagtaatggtaagtatccagaggataccaacaatgtctcaaagtcaaccgtgagttagcagctgcagcctcagcttggagagagcagtgtggcttctccgtgggagtttagacttcctccccgctccacccaccctgttcagtgctctgtctccatgcaggaagcggtggccttaggaagtgctgtttgtcctctggtgtcataagaggatgggctcactcagctcagctcttcttcttcagttgcagaacttgaagtgaaaaccagagaaaaattagaagctgccaagaaaaaaacaagctttgagattgcggagcttaaggagagattaaaagcaagtcgtgaaactataaactgtttaaaaaatgaaatcaggaagcttgaagaagacgatcagacgaaagacatttgagcaactggcggtaagtcggctgcagagccggggcgccgcggagggacttgccacagacgctgcggtgtttctgggaggagctgcgagcgcggtccccagccggccgtggctttctcagagaggactccaggtacccacactgtcaggctgcctcccggggcacatgtgtgctctaagactcgatgctgggtagcattccacgacgttaagcacaacttttaaagtgtttgttttgttttaaattgaactctatgtgtagtttatcctcctcaggcaggcgtagcggttgtgttgtaaagtctaacgtgtgcgggttttgtacctctctcctaggtaggattagtgactggtatgtgtgtttagttcttcaggtccacatctgccccggtctacctcttttgtatatgatgtatctaggaagtgtttaataaatgtagtttactgctcctgtgtctgcctcttgtgacttctccaatcactttaccgccttgtgtttgcaaataaatgttattctttgagaattttacacagtgtgctttgatcatattcgccgatgcccctctccttctcccctcccagctccacctgacctacctgatccaccaactttgtgtcctccttttcatttgaatttaacccacccaccctctgggagtggaatcttggcacagccttagaaagctgacaccccttagcccagaaaccgacatctgtctgtaacccctcaggtggggctcctgggaagacttcctcctaacacctagatcatagtccacagttcacagaaatggcccagcagtgatgtgtatgaaagactgaagacccaaggcgcgtgccttcctctgtcacccaaaccctgcaatgacaggcttgccccaccatgcccaacctgactggctttttttaatattgagga

SEQ ID NO: 19294 - DNA, 3732 bp, Mus musculus
tcagtgtgaataatgaaaatttataattacactgtcttcatggctcaaggaattgtgtgtgtattcctgtaaccttgttgatctatgcttgattagagttaatcagctgatttttttttctttttttttcctttctttcatttttttttttaaaagatccagccttaataaaaggttgtattaaaagcacctggctagcatgtgttatgcaaaaaatagcagagacagactgactgtcaatttgattgcctatttttataggaaggtaaaaatctgaattactaaagaaatttagataaagtcctaaagctaatttgtgttaaatgttttaaagatcttattacctgtgagagatctgtgcattgactttttgaagtttacgtaaatttaagagcagagcttaaggtctgtgccataggttgaggtaatgagcagcttgagaggtttgtacttttcttcagtgttgtcttctctgcttttaaaacactcagaaatatccataccactgccagttcattttaaagcatctgtgagcagggtattttttgaaaggtatcattggtgtttaccacaactgttgttagctctcagaaatgatttttcttaagtgtttaatcttgttgaaatgcaattaccttttaatttgggagttgtatcaaaatctattttcttgttttgtatataggtcttgtaagtttttgtcattttttagctttttttaatagttcaattacaatgccctaatgtgaagctgtgtggacatacatgtgtttacaagggggattagttaatagtgagattaacaggtaagtacaatgtccatagatagaatttctctgaacattttaaaaatggaatcaaaaaatacatatacttgaaatgaaactggagattttgtactaattttaatcctttattaccttttattttttctttttaaaaaaatcagttggaaccctttgtttgctctccttatgtcacacttcttgcttggcctatttcactcataagcgactttggatgcagacagtgtattagccttgcttgctgctgctggtccattactttaagtgttgttaggaaaaaataaaatagctttggtttgtctaattttgcagtgtctcctacctgataacacatgaatgtatagcagtaaaagtaaaaattacaaaccttgttatttgtcaaagcccttctgttgtctaggagccagtttcatttgaaaactggtttttaatgtgtaaaagcaatccaaagagatgaaattttacagacaccaaaaaagagagagagagacaaacaagtcagagagaagaaaaaaggagttaaacacgtgtagttcatatagagaggcagtgacagcttgagcttgtcttgagtcccagcgtcgctcagtgctgtgtagtcacattccttgcagctagtagtgagattccacaaggtatttctcctgacgtggcactttgaattcaatatactgctttgagggaaaggaaatagatttgtagaaaggattccttcagtgtaaatttacatgtgtttatgttttgtcagttttcatcagcaagatgagcaagattctaagtgacttgccatagttgttgatcatgtcaggccatttcatgtctccttaacctataatcttaagcagttaactacaatttggaatttacaaatagcatgtagcttaaggtattattttaatttgattctcctatggagactgttgctttagtttttactagtttaaagtcagttctaaaaataaacatggacgctttcatgaacattgtataatattttatagtaaagggggggaagttgtttaaagggtaagactttatctttccctgtgttgacacgtgccaatagcctgagtacattctgtttcatacaacaagatgccactgcaagactcttccactggagtgctcatgtcacttcagttttgctacccaagtggttgttgcagtgtctatatcttgcaaggtggccccaatattgtgttttaagcttcagcttcagttattttaagaggaagtttatgctctgattcttcactgagaattcagtattgagattcttgctattacacagatagactgatttctaaattttattcatgaacttcatttgcatcccatagccctctgtaaatgtttcccccagttgtatgtacttactaaatgcatgctttttcattgtacatactagacattttttgtgctaaaatttattaagtagggtttttgtagcaaagcattctatttttatgttcttatagtgtatgtgttaacattaatattcagtttaaacactggtgtatttatttttagcaacttgactcctagaagccttagactaatttttaaataaacattcaaccaaaaattatgaatttcttgagatgtggccttatacgtggtgttttctgtgttcataacgtgaaatattttaaatttagattttatttaaatcaagatttagaattagtttcattttaagtcaaaatagaaaatgtattaagcgtctaggcttctgggaggaagttcttaacactcttctttcttggcattagaaagaagcaatatgaatttatgaatattctaaatattcaggccattgtattgtgttcagattgctttaggcttgttttagcccagtgtttctttaaagttccaggtggttggcattcatgaatatacagctactgtggtttttatatgggtgtatgaaatcttggttacatataggcagatttctgtttttaaagaattcctgctacattaattatactgtatcaggaggcatttaaaatattaggtaacatttaattgaagtcacacaggtcttggatggtattcgtggatagtaaatactacgagcagtttttcatatcagagagtgagtaccctaaaactccaccatgggagtaaattaaaataatttcataattggctatacccttcattttagtaaaaatacttcattttgaaagttatttttttgccacactgtttactgcgtaacacttctcagcatttctgtatgcaaactattttaaaatacagtgatcaattcgtgtttattttttacttcggaaattgtagtactcaggtggtattcaatgggcaatgattctttgatgtgaatcataatgtattttgaggactgcaactataacacacgactttagccttaagaaaaggtctattactccttcctttgcatcccatggtatattagcaaagtagtttacagccctgcacagccttacaaagttgttttacaatttttttatggaaaacccttaacaagagaaaattgtatcatattacagtgctgatgagttattgaatgatcaccctttgtaaataagttgtctgataccagaaggccaaagaaagtcttgagattttagctattgaatgtggtgacttcataagatttctgtgcaaaaggtaaggtgagattccattcagtaggcattctgttgatgtccatgaaaactagacttccatattagcttccttcaaaaggctcattcccattttattaaaatgtttgtacttgcaattttgtgtttaatgtttactttgtcttttctttctttagcatttaggtgactgttcagcagttttctatatggccattgttggcctaaaactgcgctagtaacaagcatggtatttatcttgtattgaaaataaaaacaaagttttggtaatactt

SEQ ID NO: 19295 - DNA, 1114 bp, Mus musculus
cagcatatgttaattatattgatatgtggatgaatgaaaaatatctacattcaaatccaagcattttccaatttattttgtagtgtgcatattttagacaatgacttacggttgttctcatcatcacagaaacagtagctgtgtattttcatttgttactgtaatcttattcttttcaaaattatcatattttgcacaaaacagtggtcctcatgagaatcattgaatttcaatggaagtaatatgtgaaaagaatatgagaatttcttactttgaatttgtaaattcagtttgtaaacatgggagcatttctccaccatgtaagcagctactgtttgagttaccttttattttgtgctagaatccctaacagtgaatagttgcacgacatgtgtatgtatagctaagccaacattttttttttgtgtattctggggaatagcaaaatctacatcacaaattttgacacattacagctgaaggaagaggaacaccttccaagacaaaagagtcttctcgggggaaaagtgacgcttgtccagcagtttgcttcttgtgattgaactgaacctgtaaggcttcatggataaactgaacaggaatagatctgaataaagcaaatctgcataaatggtaaccagtagctctacttttattttttatgttgcttaactgttttatttgaaggaaacctgtgtgatttaaaaagttaatagcttttgcaactttattactggttatatatatttggccattataatgtgcaagcaattggaaaaaagtcaagtaaatgcttgtttttatagtagtttgttcttgttaaaatgttcctatgataatgtctgtaaacagcaccgatttgattacactagatgtagtgttgtaataaactgtttatggggctgatgtgtaaagctgttcacgttatttgatgtttacacctcagggaaaggcttgtgttcagcaatatctaaagataatgttactatgacaacatttttactgtcctttaaaaagcattgcaatagcgtgtttggatatgcatcaatctaatcttgcgttcagtgaattaaacatgactaattaagtgtctattgcccttgattttgatatt

SEQ ID NO: 19296 - DNA, 2199 bp, Mus musculus
aatgaagaaagggcagacacacttagatacagacagaatcaggggtctgctactcctgcaacttggaacttcgtggatgggtgcagtcagctagtctagataggaggtctctctagagtaccagttgctgttggaaaaacctcccagaggaagtcgcttctttcgttctttctgcacaccgatcttttcttcataaacactcatactcagattcctctgtgtagctagcctcctctgtatgggaatcctctttgccagtgttcaatggggttcagttaggtagggccttggagttcccacagggccatggcaacaatccgttccctcaccattcattcattaggcgctgccgctactcataccctaatcagaatggcataagattatttctgaaattttacattaatagtttttctactggtggcttgtagctgaaaccatagaaagtaaaactagcggtaaaggaaagaaaactgtattaaatatcttttgaagctgtacagttaacggacagcattaatccagtaatttcttttagaagacgtgaacgatcaagagaacgggaccatagtagatcacgggaaaagagtcgtcgccataaatctcggagtagagatcgccacgatgactattacagagagagaagcagagaacgagagagacaccgggatcgggaccgcgaccgtgaccgagagcgtgaccgagagcgagaataccgtcatcgttagaaggtgggcattcctttttattattttatttagtatgtgtgtgttattaacagcaattataactccaaggctgttgtttatacagtaaatatacctacattttaagtggtccaagtacttgttctgatttaatcttctggaagcatctgaaaacaggtaagccatcacaggtaaaagattttgaccttttcccctttgaatattgtattcatgagttatttgtgacttagatttcagattgtttatagtcttaaagcaagaacaataatcaagaggactcattgtgtacttctaaaatctggaaattgggattcttgtaatcacatacattgtttgcatgtgattttaaatatttatctaatatttaagtgcttggatttttaaaaataattttttattcttccttcctagaattaattctatttgtccctgaaacttttaaagaagatctaatactatagtaggttataaatcaaaaagatgtttttcagctgcgaaagaggatttttttttcccttttagaaattacttttagatgagaattgctagcatttgattgtatttttaaaggaacactatctttttaatttgcaaagaaggcagaaagtgggtttagggttcatatctaggaacttaaaactgtgccaagccatacattccaagttagaaatacgtggaaataattttctttgatgtttcattcataagccataatcattgtctttttttttcctgtattttaaatttttcttgtgtacatttttcataaagtaggatgagttgtctgtttatgcttcatttttacatgtagtttcattttatatttgtgaacagtgtttactcatgaagagtggggacagagcactgtgaatcttttgaatgtggcaggttatcaattctgtaaacacctttgctccatatatgagttaaagtagacttaacaaatcctttataagtgtacttataagtaaatattttacaaaaatttactaaaaatccagttggaaaattgttaatatttaaattgtaattggctttatcatgtatgtaattctgtggctagcagtttctttaatcatcacatacataacacatatacatacaaacacgatcccttttgaaaaagaaaaaaaatgtaatttttatgaaatacaagtttcatgacagtttttgaagtgaggaaacccattttaatagcttgtcttacatcttgaatatttatcaaaacccttttactagttatatgttatactaaaattttaattctcaaaacatttctcttagttttaaaattactaaagttggtactgtttggatataaactttggatgttgtatcatataaatctaaataatttttaaatgaagttcttttagtcctagtaaaaatcccctaaggtagattgggatcaagttattacttaaaatgtcgaaatatctgttttgataaagtattgatttttcaagtggta

SEQ ID NO: 19297 - DNA, 1078 bp, Mus musculus
ttagagaggtagcttaagagttacactggctgctcctccataggatcaagggctgattcccagcacccatgtaggtaggggtcacaaatttgataacttcagttccaggggatctgacatcctatctggcctcagtggacactactttttctttggatacaaagacatatatgtaggcaaaacacttggacacatgaaaaagatataaatattagctatggtatagcttattctttgcaaaatagtaactgtctctctacatgacaaagcaattaattgcattgctttgttaaaatgagagtcttttccaaattccaaaacactgaacaaaagtcattgtctctggttatcttaaaagacaattttcaggtcaggtcgaggtgacacatgctattaatcccagtacaggattcaaatttctgagtatgagaccagactggtctgtagagagagttctaggacagctagaactatctcaaaagataatttggaaacaaaagtttgtttaatgattaaccttgttttttttttctcctgcaggtgattatgggagtgctattgaaacattggtaacagcaatttctttaattaaacaatccaaagtctctgcagatgatcgttgcaaagttcttattagctctctgcaggattgccttcatggaatcgagtccaagtcctatgggtctggatccaggtaaaatgttcctgtctcatgaatttttaaaactgttagttaacacacaaacacacacacacacacacacacacacgcgcgcgcgcgcgcgcgcaacttctaaaaaaatagaactgtgattttatttactgtgtacctagcagtatttaaaaaaaaaaaaaaaaaaaaaaactctgaatgatatattgaaatcccgagacgcaaggaactctgtcttctctttactcttaaacatctgtgtacattcaagcacactgcgtgatgtcatctctcctttgattctcataactcccatacttacttactgttccctagccaaatgagcccttctcctggacacatcaagcatttggccactttactgagttttatgcttgatattcc

SEQ ID NO: 19298 - DNA, 1225 bp, Mus musculus
aggcccctttccacctcgcccaccaggtccactagggcctcccctcacacttgctcctcctccacatcttccgggaccacctccaggtgccccgccaccagctccacatgtgaatcctgctttttttcctccaccaactaatagtggcatgccaacatcagatagtcgaggtccaccaccaacagacccatatggccgacctcccccatatgataggggtgactacggtccccctgggaggtaagttaaacatgtcgtactgaaactctttagtcagtaaaagataaagtactgtgaagtcttctatattttagaaatgtagtttctgtcctgtagaaagatcagatttctaaactgcaaaagatttcagccagaagacagtgaagaagggaatttgatctgaaagggaaaatagcattctctaatctggaaaactgtctctaaagcaaatgccaaaagctgcttatgtggagttgtttacattgttactaacttgagaacttttaagtaacaacttatcatttctttgtctttttgtagggaaatggatactgcaagaacacctctgagtgaagctgagtttgaagaaatcatgaatagaaatcgggcaatctcaagcagtgctatttcaagagctgtgtctgacgctagtgctggtttgtatatttgtttcagtcttgaatcacactaaatccaggggctggagaaatgacttagctgtttagaactggctgctcttccagaggaccctggtttgactagtaaccatctgttcattacggttcctggggatccaaggccctctctggcttctgcagcatcagccatacttatcatgcaaagacaaacatacacgcagtcaaacccatacacatacaatttaggactaaaacaaaatgcaaagcttaaatgcagcttataagacaattttcttaactccgtataatccgcatagttagtctcaaatcattatctgtcacttaggtccgtgtcccgtcccgtcccccccccccccccgtccccccacacacacagggtttctctgtgtagtcctgtctgtcctggaactcactttgtagaccaggctggcctcaaactcagaaatccgcctgcctctgcctcccaagtgctgggattacaggcgtgcgccaccactgcccggcctgtcacttagttttaaagtaataaaggaagatacatgtcagtgtagtgggaagaccaccaa

SEQ ID NO: 19299 - DNA, 1154 bp, Mus musculus
ctggcattcttgtcctgccactctcatcttggagaacggaagctgcattctaacccttagaggtggagcctctctatgtactataccttctgatggggagaagctaatgaagtagtcactgacttttctgcttgctcccaagacctttactacttggtagaataaatgtagaaggaaaggccttgttattaatagaaattcgagtggtttttgttttaatttttttggcatttaagatttaactgaaaaatttattacacggcataaaataatctcttattgaaatgaagatttctgttgaaggttttctgttttggcctttgtagagtactggtattttaaaagcgacttgtttatttctcagtagaaatacatttaaacttgactattttaagactaagcgagtatttaaataaatgtgaatgttttccttgccaagtactttacataggtctgaggcatccataaattgatgaatagtatgaagaacttagaaatatcttctaacaacagtggttacaattcaggaaacgtttaataagtgctacttatgagtgtttggatgtttgcagctacacagtcaggacagatgtctggggaagggaaagccggtcctccaggaggcggttcacgcgcagcgtttcctcaaggtggtagaggacggggccggtttccaggggctgttcctggtggggacagatttcctgggccagcaggaccaggagggccacctccaccttttccaggtaaaacttttttaagtttatcatggagaaaaacatgtctgcctaataccttttttcctttctctctttttcaagtaatgcattattaatgtgactcactctccttgttatgctatttttggaacccaggaaatttgatcaagcatcttgttaaaggaactcggcctttgttcctggaaactaggattccatggcatatggggcacagcatagaggaaatacccatttttggcctaaaaggtctttatttttctccaaacttgcttgactttatatatagaatatttacatccgtcttattttcttacctcttaaaaaatcctttcaagaccattttccctgtttcactttctagcttggcatcagagtagactgtaaggtgggtgagaaatgtgtatggtgaaagat

SEQ ID NO: 19300 - DNA, 1172 bp, Mus musculus
gagaaaccctgtctcgaaaaaacaaacaaaaaaaaaaagaagaagaagaagaagaagaagaattggcagcctgatatggtggtgcacatcccagcagtggggaggcagaggcaggtagatctcttgagtttgagggccagcctggtctacacatcttgtttcagagagagagagagagagagaaagagagagagagagagagagagagagagagagagagagagagagagagagagatttggcatatgtttatgttttgtgaatttgaacaagctatttatttatgaaaacagtgacttaggtaagagctaagtgtctgatcagaacctacatattggtattagtcacctactagagtatggtaggttgccgggcagtaactatacttagacttgcgaaaaataaaaaataattttctcttaccgtttgttttcctttaaacattaaattcagacactaaaacctgaatgtttaacactaatacgaggaaatgtcttgcagtggacaacagatgaggacctaactgaggccgttcattctttgggagtaaatgatattttggagataaaattctttgaaaatcgggcaaatggacaatcaaaggggtaagaatttaatttttttcctaatgtaatctgatagtgattacaatttacaaattagttttctttaagtttaatggtgataacacacatgtagaacacacgaacacattagcactgacaaagtggcttaggtagtaaagatccttgctgcccaaacctgacaatcttagttcctaggaacctgcatgagcacactagagggaagatcttaggctgaggttcctacttgaattttgtattgcttgtcttttaaaaacacacagaagctgcatgagatgggactgtggacagactaggtctgttgcctgactactgagtatactcgtaagattgaaataactgctaagaagcattgtttttgttgtgatttaagttagggaagagccaggtagtggtggcttaaacttttttttttttaaagatttatttatttattatatgtaagtacattgtagctgtcttcagacactccagaagagggagtcagatctcgttacggatggttgtgagccaccatgtggttgctgggatttgaactctggacctttggaagagcagtcgggtgct

SEQ ID NO: 19301 - DNA, 1501 bp, Mus musculus
tatattttaaataatctccgcttggaaggactttggaagtgtatgtgagaagtcctttccatctcctgcagatgatggtggaccttcctcatcaagggctacagaagtacttgatttctgttttttttgttaataataagaacatttaatttatttagtgtctttcatgtaaagagttaaagactatgtgaaggattgtatatttaagttattgaaattctgaaactgtagtaatctaaaatgtgtgagttgtgggctgcagagaagactcagccagtaaaggcacctgctgtgtacacccactgacacacatttgatccttggaacccccaggaagagtgaaccagttccacaaagttgttccctgatcttcaaatggatgcacgcatgcacgcacacacacgcgcgcgtgcgcacacacacacacacacacacacacacacacacacacacacacacacacacagttttaaaggcatgaattgcatctggtggtatgtaagtgaaaacacacgccttattttccagcattttcagctttttgtcataggggtgtggcacaagtgttgcagtttgtcccaggttgaaaagcctgaggctggtagaagcgcctttttgcctcagctccgtggttcctggtggttgcctatgtttcaggcctgtacttaggctaggtttagaaaccagcccattcagaaagactgaatcagaacatggataaagtgaactcattctaagatgactcgtctatccatgtagattaatctcctggttcataataggcctcttccctttgattgaagggtcacgtctaagtatagaaaacataaaactgtaaggtagaggaagcgaaggatagctttgtattaatgttgcgttaaagcttcagagacaagaacaagaacactcctcccacgtgacagcatttgaataggaggcggtgggtgcggcagcctgggcagcttcagtcccgatttacaataaagtaccttgtgtgttattagttcttaaatgtttatttagaaatggcattgatgttatttatttgcaaataaatggtttattgaagaattgtgaaagagatttgtcttacacatttttttgtcagtgattttgtttttaaagatttgttcattatatgtgagtacactgtagctgtcttcagacgcaccagaagagggcgtcagatctcattacagatggttgtgacccaccatgtggtggctgggagttgaactcaggacctttggaagagcagtcagtgctcttaaccaccgagccatctcagcagcccccatcagtgatctttttataattcatttttattttatgttcattggtgttatggctatatgtctgtgagggtgacagaaaccctggaactggagttacagacaggtgtgagctgccctgtgggtgctgggaaattgatccattgctctccacctttttaaaatttgtgtgtatgaataattcgtccacatgtatatgtattgtgtgc

SEQ ID NO: 19302 - DNA, 1148 bp, Mus musculus
tatagaactgcttgaataactgttgagaagaataaccttgtatgtgactcagctgaacacgcatggctctgtgcacagcgaccctgcactttactgtttgagtacagaggagtttattatgttggtgtcagtcacaggaactgtttgcgtgttcatgatttctcacatactaatccttcagtctggagtgtctgtcctatgctaacttcagcgtaggcgattccagaatctgtcctgatagctcttcagagcccctcccccacgtctactaaacatttttgtttcccctgctagtatatcttaaaatttgcttattttgcttcataattcctgttgaatttatatctccagcatgcaaatgactcttgatacaaatggttaatagttgttaaaaggttagattttgtattgggcatgtgttagactggtatatgttgaattcttgatttctttgttttgatccactttttactttctcttacaatcttcagactctggcacatcgctgagtgagagcagacgtcagcctgaaggtgggagtgatctgaaggtaatacttgcataaagttcttactctaacacacttttctctttaaaatatcctgtctgtaagtgtgggtgtgtgtatgtcctccagccaaaagaaagaggtgatgctcacctggagctgagttacaggtggatgtgagctgccccagacatgagtgatggaaaccaaacacaccccagcaagaacagcacatggtcttcttctctgagccaccgctctagcttcatgacacatagttcttgaaaattgggagggttacataaaacagggtgtggaacagccaatgtttaatgtttattttgcaatattttactttcttttatgtacttaggatcctttgcaagcgccaccagaagagaaaccttcatcttctgatttaatttctagactgtctacctcatctagaaggagatccattagtgagacaggtacatagggacattatgtgacatactaaacagttgcttggtgtttccattttgggtcaaatgaccctttgacagaggtctgagacctaagaccactgaaaaccacatggttgcattatgattcatcacattagcaaaactatggctatgaagtagcaatgagaatagtt

SEQ ID NO: 19303 - DNA, 2087 bp, Mus musculus
ttagacagggcaggagtgcttgagcccaaagcccgctcagcagcacagctctgcccgtgctagagggagcgtctgcagactgacagtctcattggtcttctcgcggctttgggctttgagtgagttctagatactatatatggagttacaggaaaacccatctttaaacggctcaaagcaaagctgtagagggccagcaggtagagccagtaaccgggtccctgcccagcactcataggtgggttcgcagtcgtcctggtaactgcttccccagcttgcttaatcctttcatcccagtgttttctgatgtggcctccctcctgtactccctgcctcccacatcctgagcagtagataaggagcgttgtatgtattggaaaaactggactgaaccaggccttgcagtttatgtggcaaatcagagcaaaggctgcccaagttctaggcagaaacttggtgaaaaacaggaaagatatgaaagacaggtagaaaactagctaatatttagctacttgtatgaggttccagaggaattgagaaatgtttttagttgagatgtagacagaatacatggggctccagcaaatagagccctgggtatttaactgcaaaagtgtgtgtctgccttcaggtatcttgtcgttttgccattcacagcagccgctgatgaccgcagaagagtcgggtctcttggaataataactttttctaagcatacacttcctgtgagaaagcagcttaagacaaagagacgtgtcttgtgataatacatcttatctggaattttcttcttcacaggaagaggtaacttttaatatattaggattttttgttggtagtggtagtttttaggttttttttttttttaaccaaataaaaaagcctgggttgtatccccagcactgccaaaacaaagccttttcaagtcatcaggccacaggagtgctgagctcgaggagaagacacacccctaggtctcaaggttgggcagtgagtcagggctacgagttccttggccgtgtagaccgcacagacttccagggcagcccaaatcacatactgagttctgttaaggggaaaggaagggtgcctggtctaggactttttttttttttcctggcctcactaaatgtgtattttggagaatggcattgtctgctgtgtatcagtccatgtgcttccgtgggtctttgttttaaatattgtcctcagtttacagagttgtgttattatgccaagaactgcagaacatgccgtcttcaccatcatggacctttggaatcatgctcaagaaacattttctgtgtatgtttaatgtttaacagtttcccagaagctaacggaaagtcttccagcacagagagcctcaggtttctgtgcattaggaacaacggagttgatttgtactgcgtacaaatcctagctgtagataagccctggggaccggagttgatttgtactgcgtacaaatcctagctgtagataagccctggggaccggggtggtttgaataggtaggtgggtggggtatgataagtggctggtgtcagtaggaatgagggacagagtgggagtatggtgaatcaaggcgtgtttatatacgtgaataaactctctactattagaaccatacaggctgataagcagttttttacaccctgaagactttcatctagttgaaaattcctaaggaaaacacactgatgccctggagcaagcacagtgaccacaatgacagacactaggcagcactgtctttttgttgccaatggaactgaatgtagtttttaatcctatgtcaaatggctagacttaaactctttgctaaaaaacgataaggaccctctgttctcacttatgtcttgcatactagagcccatgaagaaagtgggcctctgcatatgtggaagtgctggtctgttctgcttgcaaacccacagctccaatgcagcaaaattccaagtcccttgtcaactaatggaggggggtggggggcgggaaaaaaaacaggcatgggggactgttcgggcgccgtgggacggtcaagggggtctgcaagagagagagtggggactgaatggcaagag

SEQ ID NO: 19304 - DNA, 1235 bp, Mus musculus
ccctcgactgacgaagatcctttctttgccctaactgtaacggtagtccttcaaagatgccgtctaagaccttgattatactgttctaggagtggcttcggggggatgtcatcccctgtgatccgggatgcggaggtgacgaggactgcccggaagcacagtgctcacaaaagagttctaagtatccttcgtgtcaggattgcagagtgcagggtgccgtgaatcagggctgtgggattaaacattagctgggatagaatttggcttacctccattggggtttacatatatgtttacatacacgggacatacatgttctcagtgaatgtcagtgagctaagatgcctgtttctctgaaaagcatgttgtctcactactggtatgccatagtagtcaaaacttattatctagtctctatctgagaatttaaatgacaggtggctttaacagctgtacagaaaaggtggtgcccataaaacactttgttcttgaaagaagtgtgctcatgtatctgtgtagtaaatccttgcttgactttaatgatttttcttttctctacatggaaactttccttaattcttcctaagttcaggccaaccaagaggacaattttggtactgctacaccaagaagccagatcattcctcgaacgccaagctcctttcgacagccttgtaagattttgtttgtgctttggaagtatttaatgaagtagccagctggcatttgtataattttcattataaaatatttagctacaatatcaggaagtaagcataaatagtaatgattacagttatctgagctcttatgaacaaggacctgtactctatatcagtacatagtaactgtgacatactgtatctgctatcctctatatcagtatatagtaactgtgacatgctgtatctgctgtcctctatatcagtacatagtaactgtgacatgttgtatctgctgtcctctatatcaatacatagtaactgtgacatgttgtatctgctgtcctctatatcagtacatagtaactgtgacatactgtatctgctgtcctctatatcagtatatagtaactgtgacatgtatctgctgtcctctatatcagtacatagtaactgtgacatgttgttatctgctgtcctctatatcagtacatagtaactgtgacatgctgtatctgctgtcctctatatcagtacatagtaactatgacatgttgtatctgctgtcctcta

SEQ ID NO: 19305 - DNA, 2556 bp, Mus musculus
gacctgcacagagcttttttttttttttttttccttctatttttggcctagggttttcattggtctggcttctaggacagcagcagtatggagtgccatcttttttggaataaagatacaaaaatgtcttagctgccattaatatgaagactagaaaacagcaagactttatcttgctgtttcctttcgttctttattgtactgtttctgttaacgcgtatttttccccttccacaggtctgaagaactgttgcccaattcagcagtgccagcattccaactttgttaaacctaccaacatcttaaacggactttcctgtggtggtaccctgagaggcggatgaaagctactctgtcagtttgcacattctaatcactttccagtatcacgagagatttttacttatataatagttctagagtatgcagctggtaaaaccagaggctacatccagtattactgctaagagacattcttcatccaccaatgttgtacatgtatgaaaatggtgtactgtatactttaacacaccccatactttgtattggagagtacaataatgtaaatcctaaaagcaccactattttagcataataaaagaaagtccaaagagctcctatatagactactccagataactttgcttctttgatacttgtagcttattgtaattttttttaaattcaaggtcattatcattgtattatacaaaataagcgctttgattaacacagctatatagtttttttaatttttcaaaaacctgtggagacagtgatcttgtctttaaaatatgatagtcctttcagtataatgtcttagattaaagacgttgcctttaatatctgttgggaaggaaatgtccagacttttcaaatctccttattatatgtttccttttttgtttacatagggaacaatgtttatagttgtgtgtacagtgggggtctacaacaagaagtgtatattttcaaacaattttttaatgatttaacaatttttgtaaatcattttcaggcttctgcagctgtagattctcactgtgactcccttgcttgctcatgcatatgtgtgtctgcaataccaaatatacaggtttagtatctgcctgttagtgattgtttcccatgtgtaacgtttcggttgagatgttaactggtggacgagtactgtggatgtgaatgtgggatgtcattttaatcatgtgtaactggtcacaaggcctaatttgcagtaactattgctgttttatttaacaatgccttgttgttttgtatgcataaatgtttgggtgtaaagattgtgtgtccatccaacagggagccacagtatttaaattgaccaacctgatgttacaacgactttgaggtggccaaatgtaaactaaaagccttaattaaagtggtgcaattttgtataacttagcatccgtagttcaataaatttggattgccgtgcaagggcttgcattatagttacttgccactgaatgtgttttgtgtaatgttttaacagtgctagtaaataaatatgggtttacctttttaaatgtaataggtgttattttacacagtgtgatttcataatttataccgtataggtaaatcagactcttaattccaagaatgatgaatgaaagatatcagggttcagttttggttttgttttcttttcttttctagaattgtttgactatccacataaaaccaccctttgaacttttctttgagaaagaatgttataaagcaagcagtattacttagggacaatgcctttggctggtgttcagtaactctgtggggaaaggaggaaggattcaaatactttgggtactgcactatggattttcttttttctgatagaatacaaatctttggggaattaatacacagaaatttccaccatttatgctcaaaatattactatggttatacaatttttgatgtggattcatgctacttttcttttattatctctgtcttatgtgtgctatgattgaactctgtgaaatttataaagaagctcttaaacgttttcatagtacttgccagctgctggagcaactacttagtggtaccttctagtttgcaggtgtgccagtcctccacacgtgctgtttgaaatgggacattaaaggctttcgtttgaagacggtcgtactcgttatgtatttaaattacagggcggctgcactgcagggcctgaagtcagtgttgttcttcgtgctctcgggttttagtcctcgagacatatggtttagtaaagcctgggctgttggggattttttatatatataagcatctggggatgcctgatttcactttactatcttcatccactggcttagcaatagtaagtgcaacaaccgagaccaacccaagggccgccctcttcgaatccatgcctgtaagattgctaacctgggacacttgacattctgtgctgggtgatgtattgtggggcttaccctatgcatgtaaaatcctaaactaacacccactagccgtgataacccagttagagtgaataaaagaactgcagacatcagatgtgcc

SEQ ID NO: 19306 - DNA, 1228 bp, Mus musculus
ggcagagcagactgctgcttttatgatttgaggtaaattatgaaacttaaagattggcaaacttgcagaggcaggagtaagttatcatggactgcagaatggaagaactgtagagctgggatcttacagtgtggctcaggttagcctcaagcctgtgtcttaagagttctgagattgtagggatgcgccatcgtgcctggatgctgtgtttccagttctacatgtcacagtcatttttctagaacattgtcccagggaacagggattttcctctattcgttgagtatatgcctgttctcagctacttacagttgatagttgtatgtggttcaggttgtttactgttgtcttaagatggtttgagaaaagaggggtaggtatgtcatgttagcttgtaagtcgtaaaaagctcttagtgatgtttctcagccaccaccccaaccctctttttttcttctccttttcccttggatattctaattgaaattattattaatgcttgcttctagattcttgggtcttaattagtaaattgaaggaagtgcacatagattgcatactaacaagggaaaagcagagcaatagtacatgtcaggtgtgctgcagagacatgagtaggctttcaattaggaggacccagggctccaggtcgttgtcccgggccttgctttatgggctcttggcaggagaggaggcgtttgactgcaaagggaatatgaggctgtggggtggggtctctgttttgcttggctggttttgctcactgcctttctcgtgatgcatccagttttaatcatatacaatgcccagctatgggtaaacataagatggtacttaggaattctctaaaagttcactgagcacagtttgccttactgcacaatgtcccaaaactagttcagggcagatctgccctctcatgctattcctaatgtatctaggattattctctgtccatgacacagggcttcttgagacttgctaggggagatttaaaaacataccctgttgtttgtggtggagcgtgcttgtagttggatgcaagttgtgggtctttggatgctcacagttgggggcgaggggagtcttagaactccctgtggctagtgcctgctctggtgcaggtcaagaagggtatatgggtcgcctaaacagagtggtgtcacatgcccataagctatttactatacttctctgccccaaaaagagggaactaaaaagtattgtc

SEQ ID NO: 19307 - DNA, 3071 bp, Mus musculus
ttcagtctttttatatatagtaagacttgtgtgaactagtcccttactaggagacaactggtgtcttgaagtttgatatacccgcacttgaagtgtcgtgtgctttctgggcctgtgagggagtagcaaaattcctactcactaggaactttctcttcatgcactttgttctgttatagcatgtaacctgagttttctttgtattgcaggtaaaggcaaactctgtaaagcaggagtttgaaaagcaagatgagctaaagcggtctgccatgagggcagtggcggctttgttaaccattccagaggcagagaagagccctcttatgagtgaattccagtcacagatcagctccaacccggagctggcagccatctttgaaagtatccagaaagattcttcgtccaccaacttggaatcaatggacacgagttagatgtgtgcgccccgtgaggaccattccatgtgaccgcacaatgcactgaacgacaggttgaccacagccacgggagagaagtgtccagagcttcacgatgttccactttactttccttcccgggaagtttgtttggctttcttccattgttgtttttgtagcttttacttcagaagtctgtatttccataagccagaggttgtaaagccactgatgtttttagtggttagggcaacatttgaaatgggaacttaaagcttggatttatgaaatgtggaaatagggtccagtatctgtttgccctgtaatgtgtaggattaaaatgttaaaactttatgaccatggatttcttggttttgtaaattctctcatttaaaatcaattctgcaacacgaagaccatgtttctttccttgtacaacctcttctttcagcgacataaaatgatttttacctggcagatagagtattcatttaagatatgttatatttcagagagattggcatcttagccaagatgctgaagcaccacctaagtatacggcctaacaatatccctgtgcacactgacttttgcatgaacaggtttacaactatgtcttgtctgtaacagcatgtacagattcttcacaatacacattaaaataagcagtagtgcaatttttcagatacttttgcacaccaaatattatctggtgaaagaggagttaatgttgaatctggttttctaactgccagtgtgaatttacggatgtttccagcaaatcaagtcacagcaattcgcaacttcttactattataaattacctcacacatttatggttttcctctgttccacagtgtccgtgcgtgttctcaaagccagactgttttattcttgttgagtatctgcagttgttactggaggacaaaaacctcacctgtgcgtttaagtttttgtttttaagaaatttctcaagttgctcatcactggttttgttagctaaagctttcttagaattgagtcacagctcacctcccccagcccattggcgagctaacttacctattgtctttggtaagtgttgagtatttgctgggccagcaaagcttttgcaattgtttcccttgtagttgaaattgtatccaacattctgtgagctccttgcatactgcctccatctttgaggtgttcctggaagagctagctattccaaaaataagagcactcttctttctgtgcacacaacgtagtttacatgtattggagggaggcagttgttaaattgagtggtcggtttcaagaactcagcttgaaagctgcaccgttggactgccgtaaggtcgaatgcacaattgcttgttccggtcagagcagactgtggctgttggctttgattgtacagtgatgccaaccaagggcattgactggtgctggtgaggctttggattatgcactggcttattctatgaaatcggtgccatggcaaaataaggcaggtgataattttataccatagtttgcacaaaactaataggaatttattttagtatattctgcactatgcattgctatggtatagatgtggataaagttcggcttggggttatgtgatgtgctctcacagtggttacagcacaagctctgggactgaacagattttgacattgttgtgttccatgactgtcttagttaattacctacagttaagcccctaaactttcattggttaccccatggttacatgttacactttgtttttctgagtcttgcaagtcaactcattttcctacgtcactaaattcttgtacgaagaaaatcctgctttagtggttaaagtatcacactacctatacatacagagccgaggaactagacacgtctatacacaggccatcagaagaaggctcaggggctccagtgctgagccacactgatgctgtggtgatgtggtccacatctggactggaagcagcagacccaccaccacacatgctaggaaggtcgagcttctgcctgcctgccagttctcccaggcggttcctagaagtcagtagtgcgagggagcaagctggtggcgattcttaggaatgtgctgagattactttagaactatatggagtttttaaaaagaaagctcagtatacattgcgtttggggtttagactgtcttattaaacttagacatgaagaagtctaacctaagaagttatttataaagttagtaggattgaatgcaactattttaattgtatattttattagtgatatctaaaggctgcttaactgctagcagttagaattcttaaaagattggaatatgatggttttgttaaatgtttgtatatttacataatttaatcataattaaacaaccaaatgagtcctccttagtctttacattccttgggtaaacaataacacagggaaataattctatgggatgttttgatatttttgtatctagctcagcctcagacatgaagccatgattgaagttcaaaatattgaagtatagaaaaccctcaactgctgaggttatttaatttcacctaatttgttcctatgtcttcagagccgtgttagctacatgataaagtgtataggaatgctttgtaattggagtaatattttctgcccacatcaaatttgactgct

SEQ ID NO: 19308 - DNA, 1164 bp, Mus musculus
tatttccatgctgttgaaatatattttttggcctcatttaatcttgtctgatttttcagtgacaccccccccccttttcattttccttgaagaaataactgcgatacccacaataactaagacagtttagagaagaacactttgtgattgtgttttaaacttggcatgactgggttgtttctcttacaatttttcaggtgactttctaaaaactttggaagacccagatttgaacgtaagaagagtggccttggtcacattcaattctgcggcccataacaagccatcactgatacgggaccttctggactcagttcttccacatctttacaatgagacaaaagttaggaaggaacttataagagaggtgagtgtgctagattgcatcactcccccgcacttaccttttccttgccacacgcttgcatgtcccttcttgttttaacaggtagaaatgggtccatttaaacacacggttgatgacggtctagacattagaaaggcagcttttgagtgtatgtatacacttctagacagctgtcttgatagactggatatctttgaatttctaaatcatgttgaagatggtttgaaggaccattatgatattaaggtaagatgtttgtgaatgttggtaaaatgatttaaaactttgatgaaacaacttttatgcttgtaatttacttagctgtataagaaaaattaattcatcttacaaaatgtatgtgcagaagcagacaaaagcagttgcattggttaatacacaagagaaagccaaaacctctttttacctaaggaagggatgtagatcccaaatgtttaagattcgtttccagcctccttcatgaatagtgcttacccatattctttgccttggaatcacacacatcctttcaggcccattttgatgagtagctagccaccagttttcttactttccctttgatgtcatgaaatctcttgggctgagtattaacctttgtttacctgctcaatacaagacgagccctgttaagcaggagttgtgtcagaggccaacctggagccctgtcctttcagatacactgcagtctgcagaggccttagaacagagtcatgttgcttcctaggtttagagctatgtcttgttttcctgtttatcctatttagttatgtttgagcaaa

SEQ ID NO: 19309 - DNA, 2435 bp, Mus musculus
gaggaagtccctttgggtcagcacactaatgacgtgacggtattatgattgcaggttcccaacattgttaaagccctgcacaagcagatgaaagagaagagtgtgaagacccgacagtgttgctttaacatgttaactgagctggtaaatgtgctgccgggagcactaacccagcacattcctgtactggtaccaggtgcgtctttgggtacttattattcattgtttgtttgtggcacttacagaagcttgaataaatgtttcacttacaagagaagtttgtgataatttgtaccttattttgaccattttgaacacatgaagttagatccttgtaagaaaagggatttaatattttctatagatttttatgcttctcccacgttagaaataaaatacagatagaaaatttaagtctttgaagggtggcttttaattctttgtgaaaagtgcatagaaatgattagatgttttattggcttttcaggaatcattttctcactgaatgataagtccagctcatcaaacctgaagattgatgcgctgtcgtgtctgtatgtcatcctctgtaaccactctcctcaagttttccatcctcatgttcaggctctggtccctccggtggtggcctgtgtgggagacccgttttacaagatcacttcagaagcccttcttgtcactcagcagcttgtcaaagtgatccgtcctctagaccagccctcttcgttcgatgcaacgccttacatcaaagatctcttcacctgcacaattaagcgcttaaaagcagctgacattgatcaagaagtcaaggaaagggctatttcctgtatgggacagattatttgcaatcttggagacaatttgggtcctgatttatcaaataccctacagattttcttggagagactcaagaatgagattacccggctaacgaccgtcaaagcgctgaccctgattgctgggtcacctttgaagatagatctgaggcctgtgctgggagagggagtccccatccttgcttcattcctcaggaaaaatcagagagctttgaaactggggaccctctctgccctggatattctcattaagaactacagtgacagcctgacggccgccatgattgacgcagttctggatgagctcccccccctcatcagcgagagcgatatgcacgtgtcgcagatggctatcagcttcctcaccaccctggccaaggtctatccctcctccctgtccaagataagcggatctatcctcaatgaactgattggacttgtgagatcgcctctactgcagggaggagcgctcagtgccatgctagactttttccaagctctggttgtcactggaacaaacaatctagggtacatggacttgctgcgcatgctaacgggtccagtttattctcagagcactgctctcactcataagcagtcttattattccattgccaaatgtgtagctgcccttactcgagcttgccctaaagagggacccgccgtagtaggtcagtttattcaagatgtcaagaactcaaggtctacagattccattcgtctcttagcactcctttctcttggagaagttggacaccatattgacttaagtgggcagttggaattaaaatctgtaatattagaggctttctcatcccctagtgaagaagtcaaatcagctgcgtcctatgcattaggcagcattagtgtaggcaaccttcctgagtatctgccctttgtactgcaagaaataaccagccagcccaaaaggcagtatcttctgcttcactctttgaaggagatcattagctctgcatcggtggcaggccttaagccatatgttgagaacatctgggccttgctgctaaagcactgtgagtgtgcggaggaaggcaccaggaatgtcgtggctgaatgtctagggaagctcactcttattgatcctgaaactctcctcccacggcttaaagggtatttgatatcaggtgagtaacaagaattggtcatctctaagtttcttgatagttagttgccttgaaagatgcctaatgaggaattaccatctgcttttttaaaacatgtttaaagccatgtgtgtgatgagaaagcacttacatgtgttataatatggagtgatatttggaggtactttgttcctcagagcaatgaagtctaattgggtaatgtctaaataagtgctatctagttctttatgctagctgcattttaatgttgctggtttttttatttaaaatatagaaaagacaactcttgaatttaatatgaagatcttggatatacttatatcgaaattgcaaaaattattgagtttaaaggcaaaaaaaatacttttgacttgtcagtgtttagccaattagaataaataggtaataattcataataaaagagttaaaatagtgtatttaacattttgtgagg

SEQ ID NO: 19310 - DNA, 1153 bp, Mus musculus
aatagatgtaaatatttgtgctatgtgtgtgtatgcatcatgggcactcatggagtcagcagaaagcgtcacaagctgtcatgccagcttttgaaaattgtaaatgttgacatttatttctgtccagtttatgaagaactacaaattactcctttaattttgactctgtgggcatatatgaattttcattgattctcagcatattgtgagagaagaccatgctaaatgaatgctcagtaaaaattttactattcccacttgaacaatatagttaaaataggtgtatggtacatgtgtggaatgcatatcctaaaattaaatattttttgaaagataaatcttttcaaagatgaagctcgtgggacagaagttgtggtgagataccactttgctattactgctaataactgaggcaggcagggaagcacagtttgcatgtgtcctttaaagccgttcttatctttatatttagatgccctaaagaagtttatcctcatgtttctaccattataaacatttgtctaaaataccttacctatgatccaaattacaattacgatgatgaagatgaagatgagaatgctatggatgctgacggtggggacgacgatgaccaaggtattcagatggaacacgggagctgccctgtgtcctgagcgaagtcaggcttagggtagggaggatgcccattgtaccttggttttgttccttaggggttgtcttgtttgtgatgctcaagcctagaatcttggacatggtagtgggcaaccattctactctttatatttcttataaagcatttggttttttaaaaaatgatctaaaggtacctactcagagcagtttgcttagtattgatagatcctgcattgaggccctgattaatgctcacgaataatgtaaacatgtggttaaagtcagactgcctggtaggaatgcttcaaggggatggctacactgtttggtttggaggaattctatatctaaatgggtagattaacgagtatatgggttggtaggatgcctgttattctttttttggtttttcgagacagggtttctctgtgtagccctggctgtcctggaactcactctgtagaccacgctggcctcaaactcagaaatccgcctgcctctgcctcccaaatgctgt

SEQ ID NO: 19311 - DNA, 1190 bp, Mus musculus
ctctccagcccatcacagacattttttgattctgaaaaatgttgtgatttatctttttttcttttagcagtttgtttattattgttccatccattcacctgcttaagtgaagaggtgccttactggaagtcacaagtctgcagctaagcacatgccaccctttagaagtcaggtttatgctgtgtgtttggggtaggagggctggattctgttcatttgttgctcttctgctttctatggcagcaagctgaggaatagatttgagctactcctgagaaaataaaccttttagggctcttcgctttcagtgtatccttgtttctaataatgatgagtccttgtgggtagtatttaaagttaatttaagttgaaaaatagctaagcactttgatatagaaaaatgtgtgtatattaaatatctgcagtgaggggctctcagtaccctgtcatatagtatagagtacttagtagatttctgctctaggagataataatggaaaggccagaatcaagactaagtgaagctggccgtggtgaaccagtaaaactgggtatgagatggacagaaagaaccagagagaagaagggagaagggatgctaggcttttggacgtgtaggcattcggaaacaagactctagacaaaacacattgaagtcttggaaggaggaaagtgacaagatcattgtgtgtttggttttatttggtgttttgccagccatttggttagctggcctgtagtagtaatctgggcctcactcctaggggttatttggggaaacacacctcagatctatccatttagcttaggattttgcaggggatagtgagaatttggcttttctctttcattgtgagttctgatttctctccccagtttgtttagagtctagacatactgctagtgctctggcatgttacacttacttgtttttgtttgtttcttttcctttaaggcaaggaggactgcttgttaatttccacccttcaattctgacctgtctgcttccccagctgaccagccctagacttgcagtgaggaaaagaacaattattgctcttggccacctagttatgagctgcggaaatatagtttttgtagaccttattgaacatctgttgtcagagttgtccaaaaatgactccatgtcaacaacaaggacctacatacagtgtattgctgctattagt

SEQ ID NO: 19312 - DNA, 1167 bp, Mus musculus
gcctccagaagcagatgcgatgttgactcagtgtgttgatgtctctggatttgtattttttgagttggaagaagtatcagagtcaggggtgtaagggggacggctcgggacctttcgggagaagccttggggctaggaagtggagcagaacccaggtgggcagattaatgacccacaggatttagggagcggccgggagagggacggcagggcttctcagggctgatgtagatggaagacatttagtggtgatgtcccatggaagtgttatgacatgagaacagttgagtgtgtatttcctatcactgtgatgatctcagtatagcaggcagaggtaggcagccatccagaggtggcgcaccaaccaaccacccctggatggctgctcccatgaagtaagcagtctgtcaaaatgcaaagcaggctactacgtttttattttatgtttgaacccaggctaataaatcccaagcagttgacaagtcacttagctgcgtccagcctctggtcccactggcacagtgcaagcgttaacctttgtgtggcgcagctttaaatggctcatgaaaatttcagacagaccccagtcacatttgcactgactgtgtccgatgaccaccacagtctgtatgttcctgtctatcatcactttgagaactcatgttgtgggggaactgggcgatgctttgatgctgaggacacggcacattctctgtgctctcagagctaaaggtctcatggaagggagtgtgccatacatgcaactcagacgcctacgtgtaggtaattcacagaaaatgacgtgaggtgtgctgatatccggagagtcgctgcttagatggtgcctcgagagaagttagtttccagtttccatgtaggatctggttggatttctgtcccttttgttttcctgatatttttgacgcccggttggcagcctcacgtcactgctgacctctcctctctgtgggatcttatattccagcaaacacaccacgagcacttatttaaatgcctgatcattggcagaaatgcagctgtgttcattattgtcaattctgatttgtatgatgttcccatccaaacatacctcagggtacatttgcgcatctaattacagcattaaaactaataatagcccgataaagcgctgctcagacaaatgtc

SEQ ID NO: 19313 - DNA, 1140 bp, Mus musculus
ggaggagacagtcaacagggcataggcatttaagatgatttgcttgcgatctgagctctttgcatcataacctccccactgtaaagaactgtacctttgtaagccaaaaaaaaaaaaaaaaaaaaaaaaaaaaaattctgagatgtttggtcttcattgagtagcactcagtggaagctctaatctatctccactgaggaccaacaatagacagttgtacactgatgtttgggagcatccaaggatgtttgcagcactgatcatctccatgtcactctttgcatctatattttaggaccaactaaaacccagtcggcatccgtccttcacataactctctgaatggtagtgggaagactgtggtcttgggggaatagattccagtccacagtaacaggagaaggtggtactgtcttctcccatctttgactgtcagatctctaaataaggaagcccaattgcagatgagctgcatgtgcgccctctgtcaaagttaattgaaagataagcatcttcctccaggtgcttagcaaatcaggtgaagcccgtggctaattactctcaaaaagaaagtagaataagcccctctgtgcaatcttcagcaattagataaacaatatcaaataaattacatttttcatgattcttaaaggaaacaatacataggtaacttgatctgggaacacaagaagatggagtcttttggaagaaaataacgaaagcagcagtttttccttctcttgggttatttcagacagaagtctgggctcgtaattgctctgcccaattgctgttttatcatctctaagttgatgtgtttctgttgtttattaagtcaaattcccctttgaaagtaagcagaaagtaaagaatgacatattgagtagccttccgtgaaaatgagctgagagatttagaagtcttcaagatgaatcttgtgtactgtatggcaaacagacctcaaattgtggatgcaaacacatttttttttttaaccccagaagcaatgcttgtttctgcagattttggtttttatttctttttctgtttggtgtgtaatactgcctgttgagtgttcagaggacagcaccctgtattctctgccctttatcgcccatgggcagaggcatcaagaactgt

SEQ ID NO: 19314 - DNA, 1614 bp, Mus musculus
agtgggtttgtagctccatcctggagactgtcaattgtgtggtcattggaaaatgcctacgcagtgtgcggtgcatggtaacttgctctttccctcctacgctgggttcatctgcctcagattcctcctggtggatggctcatactctaggcaggaccatcagcgctctaacaacaaataatggctgtcttcaggcttagccttttctcgttttgttttgttttgttttttgttttgttttgttttgttttgttttgttttgttttgttttgttttgttttgttttgttttgttcctccctgctcccgagcagcttttctcgctcttcatccttactccatgtctttggcaatacaatgtttcttgttgctgtctgctgccttgtttcctttctctcccgctttggcttttcatctcactgccctttcttgtctgcaggctctcaagtggtggagacaatatgtcccggagtcttggcaggtgcagcagagatccagatgtggcagtagctcatggcctgctgtcaaacaggccaaggagaggattggttttgaactccagggaaatgtccctctgtgctccagctttgcttgagaattcgtttttggaattcctctctatgggtaggtccctaggtccagtgttgaatcttaagggggtggggcgtgtcactgttttccgtgaccattcttctgtctagggattgctgggtgcctcatcttaggtcttccgtgggaagcagggaggtgaagcattgccacaattggctgagatgtgacaggttgctgctatacccaccttcctcctgctacatgtgaggatcctgctggtgaggtagaagtcctttatgtcaggtttgggatggggtgtggggttggggaagcaagagctcttttgttggtaaagtttctcttctgttcgtcaatgctgtcaggaaagtggaagcgatgtgtgtgggtgttacttggtggaagcctatgtccctttgctgtcttttccaatgagtcaggctctacctgctggactctctgttgtcagggaagagtgggtgctgagttgggcttggctcttgtatttgtttctgtcacaatggacgaactggtaaggtgaaggctgtgctgatgcaggggtgacttagaagagctgcctgccagattccaaggcctcacacgcccttccttggttttcttcttgaaaatgtttattcctttgattcacatctctaacaaccttgttgaagtatagctttcacataccacactttgtttaattggaatatattacttgaatgtattcattcaaaatgttctatgcagtgatttttttttgtatatttagaattctgaattgatcaacccaactcatttttgaagaatatttttattgctgcaccaatagaaatatcaataaaaccccaaacatatgttagccttggaaactgctaatcaactcatgtctttgcctgctagaaccatttttacatatgtgcatttgacagatatgttgttatttgtgacttgattttttccccttagcatgtttttgaggtttattcacggggttaactgtatcaagccttcacttgtattggccaagatatcctatgatatggtt

SEQ ID NO: 19315 - DNA, 1132 bp, Mus musculus
attgttgaaaaaactggtttgtccaacttattgtcttgtgctcttttgctcagaaacgatgattactcggtgacataacttctttataaataaacttttttatgaattgtttttattttactgttacccttcaaattattatatatgaccactcgattgtataagcactcagctctgtgggagaaatatttcttgtccccaccctgtgtgacaatgcattctttctcatttgcaaaaaggtcgcgtctctaattgtcactaatggatcatttccattagagactttttgttgaggccacatacccgacgttagaatctgattaaccattaggatagtttgtcttttagggatcctgtctcgagggctgtttaatgttatatttagacacacgtgtgtgcggtagaaaagccagacattgtgatttttcactctcggcctgctcacgttagtgggtgatcttgattgagcaatcacgcagtttccctgggttctggtaggtatcatgcagagtggtagtgtgtccttctgcaggtggtcacgagtgttaaagatctgcatggctgtaaagcacctagtaagtgcctgggccacagaacacttctcagtactcaggactcttgtcattcctgtctttctaagcggccggtgagctctgcttcgttcttttcctttattaggactactaattaaacatggtacccagttacatgctcagctttgagatttcttttttaacattggttttatatgaattacatctgtgttctacacacctgacctaggcctccaatgtagtcagaacactttcccctcaaaacaactgtaactcagctataaccacatcaacaaaaattcccaacttccctaagtttaggactgttaaacattttaggcagttattgcatttattcttgttctgaccttgcctattaaagagttatatttaatatgttgctactgtggggggatgctaaaactagcattattatttatctgcatcccatgtaaccttagaaataaatataactctgcaaatgcgctttgttttcccccttagagcgtatgtttgcttttaaatcccttacacctttcttcccggcctccgtctctgaagcggtcaatagagctgac

SEQ ID NO: 19316 - DNA, 1185 bp, Mus musculus
tctgacggtctgccctacagctttcacctaccctcatctcctttccctcagcagttcttactgtatgtaatcctcacaagtatgagttcgcagacactacttgctctcttctctaccccttagagccttccctaattacagtcctccttaaatcctcacttccattttactgctgtcctttctgaattctatcgaaaactctgccttatttcagactacgtcttctctgctctgtcatctagctgctgccctgtcctgtgatctcctccatatgggaaaaaacggcttctcttctagtgggtcttggtagaaacgtcacaaacagtgcctctcctgaatgcctcagtcttcgcttagctggctttcttctctttcactctagagttggtattgacgtctggatcctgcatgtgccttcacgaggctcacatgggctctgtgcatccctccacaagagcattagtcggcttctgcttctgaggcctgcaaaccctgcttccatgctcttatattgataatagagtaataagcttggtaataagcttcaagcaatgtacacttagcattgaaccatgaagaaatgtgtgtgactgaacggatcttagagctggtggccattcacgccattctgctgtgccctgatctgacgtttacgaccactggtgtctgtccactctcacaattctcacctttcagcacaagtttttactccttatttctacaggagcactggtagtgtgcaggatgattttgaatgcaggattttgagcctagatgcttaggtgtggagcgtctttggcatggattgatatctgtgcttcgttgttcacgaattggcaacaaaatcacagcaccctcttcatacaaatatttagcaatactatctttaatggcatttaatggcattttatgaccaatataataaacataaagattttaaaaaccaatataacatcttgacaaatacaaaacaaaataacaataaagtaatacacacacctgcatctatcattatcaatatatggaaatctcagcatgactctttctgaacacatgagggaagggttaaagtacttacttgtgtgcaggtcatcactaattacactaataaagtcattttgcactggtaaagagtagagatctaaactttatcgccctactgttttttgaatgaaatgcttcctc

SEQ ID NO: 19317 - DNA, 1156 bp, Mus musculus
ctgcttccacactctgtctctgtgggtatcagacatgcctggctctcatgtgttcaggaagagaaaggaaagataaccgtggagaaaattgtcacagcatcgactaggtctgtttgtttgggaaaagaaacagaagcgaataagaaaactaccacagcgcctcgtccttcggaggtgcatgctgtaggtcccatgctgaagcaaaagccacccacgtctggctagtagcagcttcccaacctgttgtcttgtgtagtcttacctcagtgctgagacgatggccattgagaggtccattttccacataaaaagagcctcagaagggtgatgtttatagtcaagaccacacagcctgtaaacagtaaatgtgcagcattgcgagcaaatcccgtattctcacgcactcctgttaaggtgctcagcaaagcacagcagttcagcctcatgggacaagaccccagggcaacaggtctgcaagcatggatactctgcagcctttgggacatggctgactccttctgaagtgtggtctgcaaagatggtgcccgtgtggattctggccctatttctgaattgtgttgtgttgtcggccatgcatccaagagtctcttttacccaggaatacaggttgcctttagcctattggaacttcatctccatctctttagttttcgtatccatggctacgtttagccaacctcataagagctatactttctacacggagactagatgcattgggcaaaactcagaatagccacttaaaaacatagaactaaatacaattcatgtcagctcacattttaaacacttatagtatatcaagctaaatattctgtagtaagggcatctttcccctcaaagagatttaaaaaaatgtttaagggagggaggtctgtctgtgcatgactttgtcaaatatttcttcaactttttcttttccctacccttgatttgcagcctgagatgaaatcaaatgaacaggtttgcctgtgtccatcaatccctgtatgatttctttaaaaaaatgcccttttccacccttcatttgggaatttggcaaatacgtgcatatttgttctaattctcccctggaatgtttagttcggctttacgcttatcaggtttgctctccagcaggagagagtgaagattc

SEQ ID NO: 19318 - DNA, 1155 bp, Mus musculus
gcacaaacactgacatctggcttctgattccgccaccctttaaagtacagttcgggaaggtgattttaatttttaagcactaaccatgggcgctgttgttaccatggaaaccaaatctcctctcctgagacatggcagcggtgatcaccccctgacagtccgaagacctgaatttcagacaatcagaggcagagcaatttgggggccccgttcatttagaattttctcttttgtgatttccgggaagcgtagcgtggcccgtcccaatttgaggaagcaaagaaaagcctgtgaattgagagccagctgccaactttccgcccaaggtagcagtcccaaacacgtttttattattctctgggaaataaggtcataaaaaagtaattgctgacacaaccttaatgatagcattttaagtatgctgcctgtaattaaaatagggattttattacggtagaccttcgagagcccagcctgtgagccattcacgtctccagatttacaaagcaagcaactttgacgcctgctgcttttgctgtgtgggctgcacacttcctttgtgcctctcctggttgccgcttatgtacaaaaccacctctctcctggcaaaaagcactaagcatctgtgtttccaacgatgccccgcagcgatggcgcctcggcttttccgcagacttcctcgagaaatgtcacgaaggagcccctctttctcctttgatttcccttccagaataaaactttcatgtactgcacaatgaggttaaaatcctacaaggctttctgattaaagtttgaagaggactctctcatttcaggccatgtcagatccatttctcccgttctttccctgatgggtagactagatgctgagtgcagtcgtggaggataaagaccagagatgatggctttgacagattacacgatgccttccctttctctcctataaagagaactgtactggcagcccacatagagagttgctggtcgccagtggggcccaacagcctcatgcttttgctagtcgacatccttaacatgttgcctgaggccccgacagagctgactgggcagcagacattttatccaagtctctgagagaaataagagcaaagagaagactctcatccagccatcttccctctgtctgaagaagct

SEQ ID NO: 19319 - DNA, 1186 bp, Mus musculus
cacagacaggcctacatgtcaatctgatggaggcatttcctatgtaggtcaagttgactactgagattagcctcacacaaattgaagtacctggtcattttcctacattctagctcagtgctatgttctgacacctttctccatacaactgacttagaaaacaccctatctgggatgatttttgtggcaacatactcttgggctactgcccactcaggctttaggttaagaataaactcattgtagattaaccccttgtttcatttggcctttaaaaggatgtgtgcatccctatataattttgaaatttgagtctttggagacagataattctaacttttgtaaattcgggagattgctattgatcttcaagttggtagtaaattgcaaatttgaacttaaacaataaataatgttttccaatcattgccactgcccttggagtgttccagtaagtttcattacatggttctcctctttgcaatcatagctctttatgagataattttcagtactttataaaccactactagccattagcgatagaagagttcttgtaataagagttcagagtggtggaattgtatatggtgatgataagtactgtatatgtaactgtacaagtaaaaccattattgtgttacaagtgtattgaaaattggattaaaatagaatagctgtactaatttcacactttattcatttactctacagacacagcaattatacttatatgtatatgtatacataatatatatgagtctgtaggccatacagtgttattatgattaattagaggcagagttttctagatatttatgtagatagaaaatgacaagttggagatgtataagcataaaatgtctattttcagaatgcctgtgacttcccttaaaatgtgtgctgcaccaaaggcagccatggtcaaccttgagtcatagcatgaaaaacttgagtttccagtctttgtcactatcctgtactcaacttaactaccttcttcaagcctccattctgtatatttgaaaactcccttgtccatctttctaggccaggggttctcaaccttcctaattcttcaacccgttaatacagtttctcatgttgtggtgacggtgacccccaaccacaagattattttcattgctacttcataactgtaattctgctactgctgtgaatcata

SEQ ID NO: 19320 - DNA, 1123 bp, Mus musculus
gtcctagttacacaactatcacaaaaacttctgtcatctaaatgaattctgttctcttgattaggaaagctgttacattttagttgaagctagaattctgcagatgaaatttaccttcgacatgaaacattaaaacaaatgtttataaatatggattagccaaaatgatcatgattgaaaggaaaatttactaatccttttcattattgcaagcaataatttagatccaactttaccactggaaagaaatgtgtagccttcccggaggctaaaaactcaaactaagacctcaagcagttttgaacctctcttaccagcagttacttacataaaacttaggaattgctgggctggagagatggctcagtggttaagagcgccgactgctcttctagaggtcctgagttcaattcccagcaaccatatggtagctcacaaccatctgtaatgggatctgatgccctattccggtgtgtctgaagacagctacagtattcacatacatgaaataaataaataaatctaaaaaaaaaatttaggaattgctgaacagtgtagtgttgagtgcctttaatctcagcacttgggatcgcacctctgtgtttgaggccagtctggtctacatagtgagttccagggtcaccagagctatatagagaaaccctgaaaaatcgttttaaatgctttaaaaaaaacataggaattatagtgatctaatacttaacataatgattaatagagaacctgaagtgtctggagagatggctcagtggttaagagcactggctgttcttccaaaagacccaggttcgaatcccagcacccagatggcatttcacaactgtctgtaattccagttcccgggagtctgacacccttacacagacatacacggaggcagaacaccaatgcaaatagttttaaaaaaatagagaacctgatgtttagtaaatgcaataaaaatcaagtgctgagttaatatttcttaatgaacttttttaacagatggaagttaaaccaaatatctggattatatttgtacttaaacttttataatccttttttagatgctattcactcgattgaatttcagcttaagtgagcaatccagccataattggaa

SEQ ID NO: 19321 - DNA, 1859 bp, Mus musculus
acagctttttaaacccaccgacaatcaagacacaggtacggcaggtgtggcggacgacgccaacgatcccagcaatcaggagatggaaatgtgaggatctgcgttcatggccagcctgggcaacatcgtaagaccctgctcagcccataccaccaccaccaccaccaccactgaaaacctcaaagcagaaaaaaaaaagtttacttcatattaatcaagaaattattatttttttcctcccaagacaagatgaacattttagcttcaaagtttcaaacttcaaactctgagaagacagcattatggttttgggcatttgtaattttgggcacatgacccaaaataaaatttttatattatttttaaatctaagtttcaaaaggaggtattctaaaatcacccaatccaagaaaaccatgatgatttcagcctctgtcctcgtgagaacagttgacaggggacacagttaggggaaaaggtgctgtatgcttaaaacactcccgttttaggggctgctggatgttttgtgataatgccatgtgatcattgcggatctcctttgccagcacactgaaccagcaaaggtggactgattgtacctgttgattgtaacacattcaaggatgctgtttgtggcgacatccttgctgtgatgctgtggccatcactccattcctgtgcctggggctctgcgtacgtggggcttggatatgcctttctgagttgggagtaagtttagcatatatcccattgtagggaagactttctcttaaagcatattggtttttaaatatttattacctagtggtactgtggcttgatcgtgtcttcccaaacctgtgtgagtttttttttgggggggtgggggtggggggtggtttcgagacagggtttctctgtacagccctggggctgacctggaactcactttgtagaccaggctggcctcaaactcagaaatccgcctgcctctgcctcccgagtgctgggattaaaggcgtgcgccaccactgcctggcatggcagagtggtagagagagtttttccatctttctcccttcttttggtgctggaactgaagccaaggtctcattccttctaagaaagcactttactgcttaattttattcctgatcctaaacataacttttatatgtaccaggaagtaaacaaacaagaccagtcatgtgatgcagctgatggtaatgcttttgttatttcgggtgccctgggactgatctgcagcatttctgagatagacctttgtgagaaataaatccactattcttttacttcatcgcccagtctgtggttttcttttataataacacgaggaattaagaccgatggtaaaataaaaagtactcattggcttgacattaatagtgttgagatagaattctatacagtttacgcacttaaagagcacaattcggtagcttttagtatagtcaatgaattgtgaagcggtcatcgcagtcaacattagggcatttttgtgaacccaagcctgcaccccatcaggcatactcatccactccagctaatgggtttgtctctgtagactcgcctgtagtgcacagcccctctaagcgaagccatacagaatgaggtcctttcggacttctttccataaccatattattaagatttcacccacattttatcagtaatatattggtagctcagctcactcattgctaaataagactcctttgcatggatatattgaatgtagagtttatccctccattagtggattgacatcagggcagtttctcctctgcccgttgtaatgaatactgctctgatctctccagcaaacattttttgtgggtagatgtatattttcatttctt

SEQ ID NO: 19322 - DNA, 1194 bp, Mus musculus
tgccttgatacaggtgctggggactctgggtaagtgactctacaccgttcttgtgctgactacttgccagtatgggagtactttgaggactcactggagagcgttcaggaaacagttccttcatgtatctttgatctttgctcctagaaaccagccattctggaagcacagcctcccatctttctcttggttccctgtctcaatcccctctctcccagtctgacagtttaaagtctcaccgtcacatcatcctgaccccgtcttcgcactctagggttgtagcgttactgagatgtgattttctttgcccactcagccttggctgtcctggctagggtccttgtcttgctggaggatcaactgtctgccctcgaatgcgttcctgccacgctcctcgtatactctgatgccttgggtgctcaactcagtccctctgtgtaaaggctccctgtgccttaagtacacactcggggcttctcagtctgcacctggctctcccagaaccctgtgatgtctcacacttaccgtttaacatccttcagtctgctgtttcggtttgttagttcactaaaggaatcaacgtcttgttcctgtctcttccccttgggcttctatagtttggagatgtttaactgtccactgagtgactagaggggagaaggcaaaagggagcaatcccaaacgattctctgctctctgcctgaaacagggaaacagcagagctaggcactgagatgaaaaagacacaggaagaccttgtttgaggaaatacaatcttcctcccttcctccagcaggcagtaatgggcgctacacttagagatgaggtttataaattacttccaaacgtggtttcagggaaagggttgactgattgactaatggacctgtcgcagattcgctaggtggggttcagtagagaccagttccgagcagcatgtgctactgccccggttccaaagtgtgacactcatgtccactacccaaagaaggtgtgggacctgcagcaggttctctaagagagttcaactgtgcggccactgtctatccctttttgttttttgttttggattggagtggagatccggaggaacattttaagtgcttgtgaattgaaattcaaggaagttaccttgacctcagtgtgacggatggcgattagggagaaacgaactaataagttcctagcataaag

SEQ ID NO: 19323 - DNA, 1242 bp, Mus musculus
gatttgaactcaggacctctgaagagcagttggtgctcttaactgttgagccatctcgccagtggaaatatatatcttttagagcttgaaaatgtttaagatagcacagtttcaactatagctataaaacccatcaatatgcgtatcctttgtatgaggcatcctgaactctcttttcctacagataacctacagagaaatgaaactagtgcgctgtgaggccagctggacagcgttcagtcagtgcccctcgctgctccagctgatgacgcccctgcagaagaatgcattggtcatatattctaagctgaggcagacatgcagagaagacggacacacgtacattgaagtaaaagacttgacctcgggcttgtcggagcatatgtcattcgaggaagcgtgtcagtctctggcgtttctgaaggacattgacgtggtcatttatgagaaggactatgtctttctttctgaactgtacgaggccgagcaagacatcgcctcctccatctgcgagctgatgagcagacctccgtggcacttaaaagtggacgtgaagaacgtcctggcgtcaattagaggcgcaaagcccaacgatccaggaagtgctgaggcagtggaagggagcaagccggaggaggtggggtcagagcagggtgacagtgttttagacgcccaagatggcgatgaccatgttagaagcaatggcgaacacgtcgcaaatgcagaaataaacgacgtcccactggatcaagatcaggtggtcgccctggagacgatctgcgccaacgcggtgactgtcctcagtgggaaaggcggctgtgggaagaccaccattgttagccgtctttttaagcacatggaacatctggaagaaacggaagtgcagcaagcctgcgaggattttgaacaagaccaggaagcctcagaagagtggcttgactgtcctaagcagagcccagccggtgtggacaaggctgtagaagtcttgctcaccgcacctacagggaaggctgctggcttattgaggcagaggaccgatcttccggcttacacgctgtgccaggtaagacacctctgacagttttgcctgcagagaaaacattttcctaaagacatcttttgctccttgtccagaagtaatcagcttgtgcagtttttctttttattttcacaggggagataaaactcggggtcgttttcataccagacaagtactttatgactgacttatagttccagact

SEQ ID NO: 19324 - DNA, 1186 bp, Mus musculus
ttgagtcaaggttctttctacaactctgctattctctaacctcacttaaaaaaggcacgtgtcccaccagtgctcttaacctctctgccatctctccagccccttcatatatgttctttatcgtggtgaattggtttcttttgattcctagctaacacatgattgtagaattttatcacatggtttttctgtgtcagttgacagtgacatgacagcatttcctcccatgtctgtcattctataaatgtagtatatgacatttgattgacgttcatgtattgaaccatcctagccttccaggagtaaatcccacttagtcgtgtttaatgtactaatatgccatcgactcttctttgctgttttgttgttgttgttgttgaggactctgtgtctattcatcaggcatgctgtgctgtagtttcgatacactgttaactttgctgctcttcttagaaatgcttgaaataagacgggagctggcctatgtagcaagtactgggtagtacttgagtgggtaggactgagaggttcctgatgacatgagacagtggatgggctcagggaaggacagggacagaaggtgacagacatgacactacaggaaactatcagaaacaatacgtgaacaccaatcaaactatagaggtggtcctgagcgtgtccgtgagtgagagaggcctcggtgaggcaaggtcagacttaaggaataatttaaactattaagggatatttaacaaacacatttgatttttttccctcagcaactctgtactagatgcagagataattaacagttgctgttctgaaaacactgacttggccagcccctaaaatgacttctttgtggcaccttggctaaattctaaagtgccaaatgccaggtttagaggggcttttgggaggaatgacgcatctgagaactgaagtaacgtaaggaggaagcgggattccgtccctcggagcttacactttacctgtgaggtaagctcatggggagaggacgtttctgctgagctactccgtgctgggagcaacacaccaaatgtcaccgtgggaagcgtgcctatttaaagtgaggttaggaaaataagattgtgttgtagaaagacccttgactttaagcgtctgaagattaaacacagcctgcctggtagtatgcaggcaagctttgcctctgtgatccctc

SEQ ID NO: 19325 - DNA, 1182 bp, Mus musculus
tcaagttgctcctaggttcttaaggagaatttttttttcagtgacactactttgtatcacacacacacatctgtagtgttcaaatataagtctccaagtttgtacctcaaatgaattattgaaacaaatggacttcctgatttgcaaggaactacctccacacttccaaaggaacgaacttgcagcctatatcactcattgatttccttcccccatgtttgaaggagctcaaacctcacctctccctcattgaaacattttttttggtaaaagacacttgatagaaacacaatttttttacatacttttgcaaaaataaatgaattaaaatcaagccaaccttcaaagaaacttgaaattttgctacaaccagctcagccttttgcctaatgcaatgaaaaaggaaaaaaatagatttctaagatttgttgcctagaagaatatgcttgaccgatattttttcatgtattttacacaatgtgatttttgtaaaaaaatgtctcaagcagatttgttttggacgcttcttgtgtagagtttctatgcctttctctcctattaagtgtgctgactttccagagtgttacccactgggccaggaggtagtttctcatagtggcttgtgtcagtataagttaatactgaagccaaatgaaacaaacaaacaaccatgtctcttccagctgttttcagggaggttacttcaaaggccacgtgccgctctgagactggcagatggctcactgttgtgagtcgccaaaggagctatggagagattaaaattcaacatgactgttaacaatgcattaaataatcaaataaacagtggcttataaatatcagattctcattccgggtcttcggatgggccttacagaaacctcattttggccagctcataaaaactgaagcagcttctcgtgttggccagactcggcacaccgagcaatttccatctctgatgaagttattccttatttcctgtatgttgtacaatcaaaacacactactacctcttaagtcccagtatacctcatttttcatactgaaaaaaaagaaaaaaaagagaaaaaaaaaggcttgtgtccaatggaacagtgagaacatcataaaatttttatatatatagtttatttttgtgggagataaattttataagactgttttttactgttgttggtc

SEQ ID NO: 19326 - DNA, 1182 bp, Mus musculus
catctttatcaggatttttttttctcccttcctgggaggaggttaaaaggaatgtttcaaggaggtctttgaaacccattttcttcaaatgttcactgcatctaagatcccatttttgtcctttatttgcttcagcataccaccaggctgccaacaaagaggggcctgtgtgcccaggaattttctgcattcctctcccgagtaggcatttctctcagctagaaaggccctttggcaaattccctctaatcattggatttaccctgggttctgataggtgccattcatggagttggtctgctggttcatggggccgaggcattaatggggtcttttcatgataaacaaaacctgggtaacattaccagaggaatcacaacgcgactgttgttaggaggtgactgtgcattccccgccccctcaccctcaccccaacccccacccccacctctctctctctctctctctctctctttctctctctctctctcattcttccccttagtctttttcccctcctctatttttacaaatatacatttttggttgggtattctgtacgaccatctctggaagcagatctcctgacccagctgccgccggcgagacgatcaccaaatcgcaggcctctgttggcaacaggatgattctaaaacccatacctaatagttccacggcctgcagggagatctgcatgttcctaaagggttgaacatcattggaggaacgcagcacgaagcctctgctttatgcgtcttacctctgtattccctgccatttaactgctgggagatgctttgtagttgagatgaacaagagtgtggcctcaggagctgctcagtcagcttcgccattggctgggctgcctgtatcagacttcaccgtccttgctctggacaacattcattcctgtttctttctcagaagagtggaaagctgattagttggaagctgggttctactgtagtgggggaacaaaacataaaaaccggtgaaaaatagtcttcccattcgagataatatgagatgctgcagcatcattttttgatgggggtggggaagagccagtaccatgaagtagaacatgagtggttgggcttacatttccaggaaagtgttatttcattaatgtttctggggagggggggggtgtagttcaaagtaggctaatggttattttta

SEQ ID NO: 19327 - DNA, 1130 bp, Mus musculus
agtaaatgcctattaagagaaatgatgaagactatatgtcactttttggcctttattaaaaaaaagagagagaataatttgcatcttattaagtatgcattgtaatagaaagtaacggttcagtattagaaataaatccctacaaaccttctcaatggattgaaatctatatcatttgtgtaaaaagagtctgtgctcatctttggggaattaaactcctgtgtgtattttcctgtgttgaggtgggtagcactaaccacattctatggggtgcttcccagtggtccattcctgtcatagacaccagtgatgtagaaaagtcgtttaggatgtaattatcacttctggctgttttattttaacagggtcggactgagttgaaagagcagatttctttaacatttgaattaattgccttttagagttgagatcagtagtgaatgtttaaccaattatcccccagttgtctctaaataaccttgttatttaagtaataatacataatctgatattcctaatatgaatggtttccctttcttctatttacaaatgaactaaaataggacttttttgaaacccaaaagattctgtgttatgtttctgtgacacttagttacctgtgtcctcaggggcagtacaggtgggtcttggttggtatcaatcagtagatatttaaaatatgatgtaatcactctgaaaatgcctcatcacaatataagttaaggcatctttaaaactcaccacaaatacatgatctgaaagttaatataagaatgaaggtagattatcctcttgatgtccctgtataacactttcccttgaatgaataggtcggagtggtctcatcctggcctcttcactttaaaaggtttagtgtggacaaaaggaatggtaagacttgtgcctggtttaacatataaggaaacaaaacaaaacagagaaagcgtatccgtttccaagcttgtttggttttcagtgtctttagccagaagtatctacagctggccccactaggctgcccctcttcctgtaattcctcttgtccatacacatacttgggtaattgctagaacacaaatccccctcccctcatagaagacctttctctgaaatccttctatcttccaggc

SEQ ID NO: 19328 - DNA, 1222 bp, Mus musculus
ggtgagatggctcagtgggtaagagcacccgactgctctcccgaaggtcaggagttcaaatcccagcaaccacatggtggctcataaccatctgtaacaagatctgacgccctcttctggagtgtctgaagacagctacagtgtacttacatataataaataaataaatctttaaaaaaaaaaaaaaaaaaaaagatatgtttaagaacttgaatagggggctagagagatggctcagcggttaagagcactgactgttctttcagaggtcctgagttcagttcccagcaaccacatggtggctcccaaccatctgtaatgggatcggatgccctcttcaggtgtgactgaagaaatgtactcatacacataaaataaagaattcttaaaagaaattgaatagggtttgggtgaacagtgctagtatattggcttacccagcatgtgtatggtcccactttttgatccctagagccaatggaagaaaagtaaatgtttggagtttattaaagtacaaaatacatatacagtggatacaaattggctgaaaaaaggagttttcatgtgtgtgtgagaccctcttttccacgataagcggaattgtagcatggtgtataagatacagcgccatgcattgttatctgactgtcctggcttcagtgtgcacccaggccatgcgctggcctggcgatgacctggctcaggaggaaaggtgacacaagcatgagaacctcagtgtggtctccagagcccacattcaacacagggtacagtggctctgctcggtggtagcgggaagaggggcaggcaaagacacttgcatggggaacctcactgctcagtcctctaactgaatgtcaggtttactgagagaacctgtctcagaaagtaagggggagagccattgagcaccgtgtgtcaacctttggtctttccagccacatgcccatatatgcaccacaaaaccccatacacatgtacacacactgcacataacacacacaattaaaaacaaacatacctgcccatccctaccaattagtaagcttttggattttctataatttttaggaccttaaatggcctttatttatgaaaaatgtgcctatatttgtacctttatatataaacttatattcttgggatatttttttctttttccaggcaaggtcttgctgtgtaggtgtggctggctggctgatgtggttaatgtgttagtata

SEQ ID NO: 19329 - DNA, 3217 bp, Mus musculus
cacatctaagacccgtgtttgtgtgtgcgccaaagtgccagcggctagaaaagaagaagcgatctcagagcttgagtggaggttaagtgagggtcagctcttccatctggatgctttatacctgagactcgctcacctcccgtagcctgcctgcctgcctttattcccagcactcagaagcctgaggcagcaggttggggagtctgaggccagcctggtgcgtagcagtttccaggccagccaaggctgtgtagtaatgttttgttgctgctgttttctgaaggaatctccctcctgcttcttgcagttaaccgtgttgctctcctcaggtcacagcttgcatggaaaatgctctcggctactgaaaccacatttatgtgacagctccctgcttggtgtgtcagtccctcccggcagctctctgctgcaggatatgcctttgaagtcacatggctagcgagcattcacgtgacgtcctccctttgcttccctcaggtacaggtttgacctgcgtctcatgttcaacagtcacggcagcgtcagaacgagaaggttctcgaagcatccgctctagcagcctctgcgttggatccttgcacagccttttccggtgccgtggttggagtgggagcccacgcctcgggagctctggccttgctctttcaagtcttgtttgaaaaataatccagtcagctgacttccagtactgtgaatccgcccctgtcagaagtggctgaccctgtttctcctcagatgacaaccaccactcctgaggtctttgtcctctccttgtcccttcatcttggctgggcacagtatatgagtccccacgtggtcgagtctggatctgtaaaactcttctgataatggcaatactttagggcagagataaaaccttttggtattttagctagcccccaaatcaaaagcactgtatagcatttcacaccgagcccctcaccaaaactcacacagttgcgagaagagctgctgtctgtggacacgtagagaaaggacattcatgacatccctgtggtgtggttaatgtgcgacgtgtcgcccaagctctgccctaagaagcttcttagtgactccagccacctgagagcgcccaggagcaccagggggggccagatgcgcttcctgagctcttggatcagtgcgctgaagggccgcacttacaagtgcctgtctggagggttctcaagtgtcagcgccacacaagtcatcctgcctggctgcagttagctgtcattgtcattgaaaatcttagtgtctcctggtggaggggaaggaccggctgcctcaccccactccctgatctcacaaaagtgcgagtttccagtcctgactaactagggctccagtcagtattcccctggccggcttcccagatgccctggacggcactctgttccttaaagtccagttccaccctgacgtccacagaggcagcacggagtggcgaaactcggttccagcctgtcgtcggcagtgagcgggtttagctttacacagcctctgcccagctttaacttgtaagacagctatgagtcactttgagaattccagaggccatgttggggggacagccattgagtttattcctttacctcatgtgaccccagcaactttggtgatactgagaggccagcaggcagtagagtggacacctcggccgtggccactttagagggggaaaagtttaagttttaaactaaaagttacagaattgaatgtggataccggcttcattcacccccacttggattctaaacatgaccagtgaaatagtgaaagctgaccacagttgttcccaaataaaggtcggcagctcctaccaggtctgggattgagatgttagagtcttcagttttatagccggctcctgaaagcaggcgacatcagagtggtaacagtcagtaggctgcagtaggtgtcctacctcgaggccctcagatggaggtaacacattaggattgtgggacacaagatcctctctgaacctcctggttaaggaacgttcctgcaaacattcaagtagaccttctataacagactgcagcgtgcatggcctctacccacaagagatgcactgcaggaggccggccctgttctctgtactcagcattttgacatctcctttgaaggccaggtatatgtgtaccagtgctcttcaaagggagaaccattaaaaccaacatggaatgcagggacttcgccttataagatttccagttttaaaactgcccctcagatacaatttcaaagtagggtacacattagagtgtctttgagttcaacaagttggtactgttgcaaacaccttctgaattgccagcgcccgggtttttatgtaaaaatagagtggctatggaagttacaccttcatctgtgggaagtattctcaaacgtaggggtatctttatcttatgttttctaatggaagatggcagcccagaatcctcaagacaaagcaaggggtatcagctgatggccgcgggactgatgggtgtcctgggttctttagctcaccagcactttgcgctcaatggactttgtaaattctcatcagctgttgtagaagttcctctgcctggagctgtcatctcagccgctcccttagaaagtgcccttcaacggaccctgttcactgctgcacttctcaatgaattaaaactgacttctgttctagtggcaatgtgtcctttgtttttagtccacaggtgttgattctcacaatgtataagaaggtggctgcttcgtggagttctgtagttttgtggtgctagggtccaaattcagggctgacataaaaggatcaggtcagcactgtcccccggagatagaccttccggctgcaaggttagccaataacctagtgaaaatggaccgtctcctcctcgtgtgcgccctccgcctagaaagctcttagataccagtccctgcaagtcatctgagacctgggaagatggctcagtaactaagaacacctgttcttgcaaaggacacccccccccccccccccgctcccaatgcagctcccagcccctacatggtagctagcagccatctgtaactccagctcagaagatcaggtgcctcttctgacccccacagcctcctgcacacacacataaatattcataaactttttaaaaaagaaacccgctgataagtgacttacagcttctttgagcgacttgtaagaagacag

SEQ ID NO: 19330 - DNA, 1191 bp, Mus musculus
atgttccttccaaccaaagagacgcatgtgcaatagacaggcgcaatggcctcactttccacagcagcttgcaaatcggagagccgagggaagggtgttccgattccggaggggccttacggttggtctgcctctagtctagataggttttgttgtttataaattcccaaggaattgttaacacggtgacacccgatggaatcgtttggaaattccaaggtgccccagctcttagcctttctatgaaccgtgccttctatcgagaatctgtcccttggaggtggccctcctgacttgtcagagaatgtcgccctgtgggaggcagatccaagtgtgggttatgctaatgcaagctccctggacaatcggatcttctaagctattagaaagagttgggaaaaaaaaaagtagagctagctataaaatatgaatggcacatcttgtttaattttgcatgtgatttcttttttcgtgcatcaatgaggtttagtgacattgtcatccgacacgctgcctttgttgttcagggaatgccttcgtggttcttgtactggttttaccattgggtttgtgtatgctgccaccagccacctggtcttctgactactcctcccagtgtgcctagcgtttgtgaggcattggtttctctgattaagacactgttagacgctaaagtagcagctgatgggtatctgtgaatttttttttttttacttgaagtagactgtatgaagcagctccctcctccgtatgcctccaaacctcgctcgatggcgtgtgcacttcacctgaagatctgccagtccgaggttcctgaagaccgatgttctcgctcaaacactggttactacagcagccgttgttttaaagcataaaggaagaaaaagcataaaggaagcataaagcataagggaagaaaaggagccccagaggccaaagagatatatatatatatattttaaaccgttgttcagattctccggtaaagcgaaagccagctttgctataatgctgttttctcttcggaatgtgatggtacagggatggtggtaaatgaagggtggcgcagggaagcttttaaatctaaagtgaaaagctatatttataatgttgaggactttaagttttatttttatagggcagatttttttttctcccctgaaattgtgtctggaatggcaaaattgttcc

SEQ ID NO: 19331 - DNA, 1330 bp, Mus musculus
tagttcttattctcattattgtgtatgtgtgagtgcattttgcgggcatgtgtaccacagcatacgtgtggaggacaacctttacatctcaggggcatgtgtaccacatgcagacgtggggagctgattctctgtggggttgactaggagaggagggaagccataaaaccaatactcaggactgtgaggcaggaggatcgtgaggtcaaggctagactgtacaacacagcaaaaccttgccctggcggtgggaggggggcccaccctcccttggtttcggggagaacactgaagtgatcctgtctgcattattcctggatccagtcatggcgtcttcctctttgtccctttgtcccccgacagtgggaagctttcagcctaccggagctgcagaacttcctgcgcatcttggacaaggaagaggatgagcagctgcagagcctgaagcggcgctacacagcctacaggcagaagctggaggaagccctgggcgaggtgtggaagcccggctaaggccgagggctctccctgcccggaaggcactgttctgggacgcacaagagagtcgcgttggttgcctctcttctcagagagctgtcttcgtggcccggccactctagggtcttcctcttttctctgtagacacagttgtcaaagcctggtcacgcagcatcttgcgcctcacgagggactggcacaagggactccacaagcttgttctgttttggcatggcgatgttacctctcgcaagctgtgagcctttgggcatcaggcatcccagcgtgcttggaagcatgagctctgggctgaggccccctgtcttctactagttactttagtgacgtgattctggtaaccttcaggatgcaaagatgagctttaaggcttcactaagcaaccgctaagaccgtgttctacggtgaaactacctgcatgttttcattctctgttggagcagccctacccacctgaactgaaggacacaggaatttaggaactctgggggactgggaaaagagtttggaagagttttgacaaagaaagtagagagcaagtcgggaaggtagagggaaggtaagggcccagggctcggggaggtagtgtggcttctaagttagcgttagaggagaaaggtgtatttgtctgtaaaagagctaaaagcattcagggtcaatgttgagcttggttaaagattgcttaatttgctagtggtaaaatgtggggtcagagccaaagagccaggagctaagcccaaagggatccacaaactgcagccgacccgcagtggatttaaccttgactgaggtggtccacaggtaggtgtgcctc

SEQ ID NO: 19332 - DNA, 1206 bp, Mus musculus
gagaccctgggtcaaaaaatatttttttgtaaatcaggattaatcttttcaagcaattggaggaaatagtcaatattattttgattgtcagagacagtactagacaataaacggatgtttcttacagctctgggatttaaattaaattgaatatatgaaataaaagccaaacatgggggatggaagtggttgggaacacttgctactcgcacagagggtgggcttgaactcccagcacccacagcaaatgggtcacaacataattccagctcccggggatctgactcacaccctccagcatcatgggcacagactcaaatactcatatccaattctttttaatttgaaaaaaaaaaaaaaaaaaagccagatatccctgtaactcaccattttggaggctaagactgaagactaatctgcgtcatatggagagctgaaagccaggctgggaaggttggtaaaacactatctccagagcggaacaagaatgatggaatatatgtggttcactgttgctgctgtattgctgggaacatactgcatttcagtctaacagatactgggcagtcctacttcaagctaaccgtggctcacactcgttatttccttaacagcatacatgcaaatctcttcttcccccttatcgtgaggagaagcgcctggacaagccgagatgcagagcacctccaaccatctgtggctcctgtctgatatcctaggccagggggccactgcaaatgtcttccgaggaaggcataaggtaggtccagtgctgcctgtcaggctcatctcgacctggtcctgtcttccaacaagcacgccgaagtccaaagagaagggattttgtgggctttgtgattaagatttagcttgttttggggcggtgaacacctacctagtggtgctagtttctgagtttacagaatggaaaaacactggaagagattggacagtgtttcccacctgccttcctggtgtgacatgcagtggagggaggcatgaccgacaggcggacaggcagatgcccagagtttaaaaggagcccactggtgattcgcgtctctaaatagcaccatgcagggtggattggaggtggaaggctgtgttgtgttgtagtacgaggccgtctgcagctgtaggaatggggtgggattgaagggttgctcctggcagcatggcaacaacccccagcatcctggtgaaatc

SEQ ID NO: 19333 - DNA, 3701 bp, Mus musculus
ttttaccagtaaatagaaatcttccgggctggtgagatggctcagtggttaagagcacccgactgctcttacgaaggtcaggagttcaaatcccagcaaccacatggtgggtcacaaccatccgtaacgagatctgactccctcttctggagttgtctgaggacagctacagagaacttacatataataaataaaaaataaatcttttttttaaaaaaagagaaatcttctaaaagctatttcctctgactgctattgctcatagcaatattggttgttaccaaagagagactagcgttcagaagccttggggggaaaaaaaaaccatcctgtcttgacatgtgtgctgtttccatgcttgtcttccaggtgttcttccagagagcaaaaccctaaggactggacctcccggcccctgtcatgatcaggaactccagttcataatttataaagaagcagtttgtgtgtgtgtgggtgtgtgtgtgctcgcgagcgccatccacactggtcctttagcattgtttccatcatattgcagtgtatgtgggattttctgtaaaatgggtgtaatttttcccttaaaaaggtgtgtgacaacaagagaagttgcctgcatgccggtttaaattgtttatgtaaaaatgctgttataagacatagatttatcctagttccttaattttttttccttttatgaaactttaaagttctttataaaatgcagcagtggaaaactgactaacaaatcgaatgtaaagttgggaatgtttggttctgtgtatgcagacacatgagctgtggggtaacaatcaaaacgtaatctttcatagatagccattacatttctttaaatttttcaatgccgatgtgtattctataagagaatagcttcctaattaagtcggtttagaagaaggtgctggtgtcacacatttttttataaaaaataaattttacatagtgaaatacaccaagtcttttccggagttattacaaagagcctcctttccccaccttactcacactgattcccacctaacaatcagcagatgggagtgtgggttccttatgtcacaggctgtgccccagcggtcactcacaacataggtctgttgagtcttttttaaatgcactaggagccaactctgtccatctgtgatgggattagaaagcccggtgtttttctgtgatattagatgtcctccgagcacagcccacttggatttgtttgtttggttttgccttgagactgggtctcactatacagagcagcctgcctccccactgctgggattaagctgagaagcaccaagtctgaccacccgtgtgttgatgacttgcagtcaattaactatgtgtgctgcttcgtgcaacaggagaaagccagaagagcagcctcgggaaagacagacggaagtccggcaacccagctgtaggcgcttacactgaaatctaagtctgtatagtgaacgccagcggcggccgacttctatcccaagcactgcgcaaaagcagaggaacggaaagggaaagggccaggtcatcctcagccacatagtgagtccaaggtcggcctggactgcacgagagtctgtctaggaatgcagttagtaaaagcctggcgtctactgcagagtatgtatacttggtggtagagggcttgcttgaagacccaagttccatccctagcaccacagagcagggaggggacacagatttaggagagatttgtctttttctcctttggctgtgtgttgtccagggatatatatttcctaaaatctttttaaagtgaatttatatgtgcacatatgtgtgtgtagggggaggataagaactgaattatttgaaacaggttattatttgaaactgtattactctactcagtattttggccaggtcccagtcccgggttgcaggtgttgactgccaccaaggtttgatacgggatccaaattcaggcccccatctcgtccatcgagcactttgtgaacttgaacccacgcccccccccccccaatcccctagaatctttttctgatttttaactccaggagagatagcattttccttacattataaaataaaagcagtgaagtaaattgacagctaaggatctctatttcatctcttgaacgatgaaaatagtgacgtatatatagtacttctataaataacagtttttaagaaataggtaagtggggcaggtttggtggcttctgcctgtaatcactgcattcagagggggccaaggcctgtttcaaaaacaacaaccaagacaagcaaaaccaggtgttgctttgctatgttcctgtacactgtgggagaggtaatagcatctgtgggacacagcagaattgtacaagtgtacaattagtgtgtagcagagcacagcagttacgagcttgtataacgaggactctggatccagatttaagtagattcaaacaccacttaacaccagtaaccgattttaggaccttgagcaagttaaataacttcttcctgccttggtttccccgtcagaaatggggaacagtggtagctacctcataacttgtaaagaatccaatgaattaaaacacaggtctcagtattagcttgtattactgtactatcgagtccatacacggctctctaaagccctacagagggttcatgtgtttagacctgagaaatcaggacatggaaatcagagcatatacataaggaacttaattttaatgtaatcatgtctaatgatcctcatcttcattccttgagattacccaagtaccgtcatgaccaagaagcctttccgtcattgagtacctgatttttaaaagcaagcacccaaataattctctctagggaatctcatttgttacaggtgagaagacagagggttttatggtgcctgagttagtcctgtgcctaaccagtggagtttccgtctctgtgcttgctaatagtttcacaagtggcttgacttttttagaagtattatgtggtattttactgtgtatcacttctgtggtaaacatgtgaagtcctttggcttagtcatacttcataacttttgaacgttgggttttttgttggaagaaacttggatgaatctgtcatgtcattaacagaactgaaatattctattgtaagacgtgcatttgcggttagaatggtcttgttgcctaaactgtctaaaattctaataaaataactttctaagaagtcattggagtgggccttttaaaatctccattttgagtttgatgaaaacggattagaagtgggcagagattcagcttcagccccctgtttcagtcaacgcctctgccagcccttaaccactcccggctcccgtcctcggagatctgctcgccctcggtctggagggtgccttaggtagaaagaggaatttggtgcatcgtgcttccttggaagcaaatccttgtaaggaatgcctgcttgagcaggacctgatcatacagcagtttacctcttaagttgtcaagttcaagtctccagtgttaccattttcaaaaacagaaactgaaagcgacttaaagagtactgatggcatgaacggatacttgcttcacgcagcagccaagcgacgttgaaacacaaacccgccccatctactctgcgaaagcgatcggcggccagcccgctgtccacgggtggccgtgggcgtcacctccttgccgcacgccggccgc

SEQ ID NO: 19334 - DNA, 1157 bp, Mus musculus
tgcccagttcatgccagcttttctcagcagtttgctgacccttgaggcatccaaacagccatattgtatcgggcagtaacagttatcttaggaacctctgcagagttggtcaggactaaagtttagttcattgatctgcttgctcgctcaagtacaaggctagggcttatcttagcgcctcgggcatgaggacacagggtaccaggaagtaataccctttgcccagcacaagagttagaactaggagactttaacctctgcttccattttcagtctgggattgtggcagaaattccgttcttgtatgagtacttgatgtaagagccaatgtggtagagtgtatttcctgtctctcatgcttgattaaattaaaggagaggcactaaaacctaattttcagttatgaccaaacttccttgtaggagaacggataccagtccttgctgagtagcgacgatcagctcttcatttacgaaacggccggggcgctgattgttaacagtgaataccccgcagaaaataagcaggccttaatgaaggacctcctgacaccactgatggagaggttcaaggttctgttggaaaagctgatgatggcgcaggatgaagagagacaagcatctcttgcagacagtctcaaccacgcagtgggattcgccaggtgagcccaggtgcagctgagattgtacggctgtgtgtctgcacagcaaaagatgtgcatccgtgtaggcaggacctctagtgcgggtctttctgacatggacacactcaactgtttgcaaagccaagtcagttactcagagggttgtatagccctgtgtctctccagtaagtcagaagtgcagcggcagagagcacagagccttgctagctgcgagttcgtcatgcaggctctccagatcctctgtactctggggccgagtccttagtgtgagtcggtcttgtgtctcaggaggcgagccaaagcgtcttgtgtcccagcagccactgtgacattgggctttaacattggccttcaggaggtgtcctgacgctcgctccgtagtgttagcgtgtctcaaaggcccaagcccacctttactactctccctacatttttttattagcagcatggagattgaagtgattgctgagttatcctgggaggttgttgtaca

SEQ ID NO: 19335 - DNA, 1386 bp, Mus musculus
ttccctgtatttcatgtcaattgaatatttgttggtttctcatttatctttccagattttttttgttgttgctattctgaccattgtgccccagtgtgcttcctagcatctctctctctctctctctctctctctctctctctctctctctctccctccctccctccctccctccttccgtctcccccccaccccagccacagggagagatgggattgttttcagtttcacaaacactagtattaatagttttacaaaatgatctaattagtattatactgtaattagaatcttggtgagaaatttctgtcaggaggtgaagtgggagatgacaattgatactggtccttacagcagtacaaccatccacaggtccttttcaggtgaccctcagctccatccgcatcagtctttacctttaaagggtttggtagtcacctgtcccaagtcagcccaagccatggttcagtgtggaaagcactcagccatgtgctttaaccaagtgttttagtttctcacacattgcagttcatttttataaaatcaaaatgacggacttaatactttgtgcttgctccatagtcagggcatccggtgaggccccagcacctctgggcgtggtctcttgccttctggagatgattgacgtgcatgcagaagcagcttctcggcactgcttctcggcactggctgctctggcctcctgcgagttcacaggggagcggatggagagagaccacggaagcattgagctgttactgctgcgtttgtcccctggagctcctgtaaacgttagagtcagatcaaggctttcctcgggcttgtatggagccactgtctgatggggtgtccacagagcatgaggctcatgcagggccggggagcccctcccaggcctcctggtcaagtggggtccagctgtacaagggttcactggccaattatctgcatctccccactttcacacaaacttaagccagttgtctttaaacaggtgatagtgattgactctgcattttctccaggctctatacaaataggaacaaatgttgaccttacattgaaaaattggaaacacttggaattaaaaaccaaaccatttttcttctttttgtgttttgctgagaaactgaaaaaataatccttggtatgtatttttttgtttttttttccaccattagccttaatgatgtcgttcccagtacctaaaagaatatataggcttcagtaaaccatggagggatgtatataaaacacatatataaatatatattacttaaaatggccaaatgtatatatatatatatatttgaattgtatatttatttttaaacatattttgagtaatctaagaggtatttacaaagaacaggaggcagatgtgaa

SEQ ID NO: 19336 - DNA, 1177 bp, Mus musculus
agctggggtttgtctcgtgggagcctcacgaatgctaggtaacacacccaaccagtcttgtgtcttgttgtttttttgttttttttttgttttttgtttttttaagaggggaagatgtatttctatgtgcttatattctaaaaattattttgagttttcccttttggtggactaactttatttttaattgttagagtctgatgcttccataaactatagcaaaacttagttaatacaaaattattacaacttttacaattgtaatcaatacaaaatttatcacaaacattaatgaattttacagagttccaaacttaaaataatcaatacaattattgtattactacaattattacaaattaatacaaaattaaataagcaaagaaactcaagcatacaagcttagtctttttcaataagacacacaagcccttcctgacgaggtgtcttttttaaaatgttttttatgacctgtattcatcttgagtgtgtacatgtacccacgtggggagtcagaggacagctcgtgggctttgttcctctcctggcactgtagaagtgctggctgtgagctcagaacgcacatattagcttgttggagagcgcctctactcactcagccatcttgctgcaccgaaaaaaaggatttctgaagatttattctcacatcttctgatttccttggctggctggtcctggtcatagccacccttgtagcactggactggcaggaagcaaggctatagggattcgtgtaataggcttgcactagtctcccctggattgaattggccactaagtggctgcagttgtcccacctttagtacagttaccagctctgagtgaaaggtcccacagctccaaacctgtgttcagccagctgcactccacagtgccagtccatgggttttgagatacttaggcttcagatgtttgctccacacgaagatggccctgggttgcagcatctcagtcaacaggggcatcccatgggttcctgcactaagtgtccatatctcacagggtgcagatctgcagacctcaggtcctccccacccctacccccaccccactacattcttagccctggaagcaactcctataacctctgttaagctttggcttccattgccattatctcctgtgacacccccatagattcgtggctttgcaggaa

SEQ ID NO: 19337 - DNA, 1230 bp, Mus musculus
tactgagatgccaaagcttttcaattcagactccattttagagaacctgacctaagtttgaactcaggtagactaacaggctgataattagcattagtttccaagttgtaccccaacaaaacctgaacctagctccagtctctagcctaatccccaacaagaccagtgtctcctagttattcccccaacaaaccttcaccctaggtcaccagcccacctcttgaataatgaccaccagtgcagaggggaacagaagttaagttgaagatctgactcccagcaccaacctatcatgctaaaggcccagcaccttgccaatgagatgcctgtacatgtattttgtgcttactgcttattgtaaagccttgacccaatctacatctgtggatcctctaccaccaaatccttcctgaaggaatggtgtgccttgagggggtagtggtaggtggcaagctaggtggaatagattaaatccatgctgtgatttgcatcagattgggtcctgtatgggttttgggatatcactaacatttcccttgcaaatattactatcatcattttgtatatgctgatggttttggaagaacttcactatcttagctctgcctccagccctttgctcacttttctttgttgctgctgatatgttggaaagcaaataagaataataggaggccttgaagcatggctgggtagtcaggaacacttgttctctaagtttcagatctgaacttgatcctccagcactcatgtaacaattcaagctagtctgaacatgcatgtaatacccacattgggaacagagtcaggctgctctcttagagctggctgagcagttggcctagccaacaaacaaacaaacaaacaaaacaggcaaggcttgagtcaattgagtggatatctgaagaagaaaccacgtgataagatctggtatgtgtaggcaaatctacagaagcaatttgaaacaaccacacaaatacacacacacacaggcaaacacctctgcataacagttacttgtgcacatgtgcaacaatgcgtcacatgaactgacagtctcaggttttttgtttgtttgtttgtttgtttgtttgtttgttttgtcatattggaataggccccatccaaggatgctgagccatgaatggatcatagacttggtacaccaagaagccttaaattgattttgagcatgtggagaggccaactgaggggcctttcttgctgtcc

SEQ ID NO: 19338 - DNA, 1195 bp, Mus musculus
tggcctctagagatgtaatctgcatatttacaggtaaacatgccacagtcactgttagtctcctgctgaggaatctcctctgctggcatgctgtgctgcttccagtccagagggttcagatccacattctttctagctttgctctcctcctgcagatagtggaaaatcagctgaaggacctctggtctcttgtgtcccatcgaatccaggtagacaatcgtcttctctctcatgtaggtcaccacaaggctccagtgcatattcaggtttaccggcaccaggatcagttcctttgcaaagaggtctactgccttggtccatcttttgactgacttgtagcccccactctgtaacttggtgtaaaagaaggtattaaaggcgaaaagtgcagggtatccttgagtttggtttctggccatgagaagattcatgtaaaaattgatgactgtgtcattgagccactcggtgtccctcagagtgcgcatgtcttctcgagtaattgccatcttgaaggcacgacacaagatctcgtcttttggccctgggcctagagcactactgatttccttttgcatgtctgctgtgatcagagggcctcggtccagccctgtgctcctgtcggcatatgtaggagcttttgctttgaccgtggttattggcatttgattggggagaatgctgttgctgcctctttctgtggagatttgaggtgttgcagaagcatggatctctccatccacacagccattcagcttctctaaggcatccagtagaatccagtgagaaccaggagaatcagagctccctgagccactgggttgaaggtagaccaagaagcttgccatcattccattgtggtgattctgttcaatttcttcaatggtgctgtaaggaagatagggacctttgcccacatccacagactttgtctcactgaaagccacttctccagagactttgatacactctgtgggctttagctgtaatccagtctcttcttggggttttcttctctgacccttggctacctcttcacacccaagctctcgttcacactgctcccgtttcagtctttttagaggttgggttggctctgaagactgcacatcctgtggaccctctgcctggcgtttcctcttttggcctctacttgaatgctcacagtacactgtcccaggctgggtactaggttgcc

SEQ ID NO: 19339 - DNA, 1195 bp, Mus musculus
ctactagaggcaaggttggtattggtcagaaggaaatgtgctgttgaaaacaacatcggactgtagtggtgagggcattcacatgccccagtggtagtttggggcttccttttctggggttctggtggggagttaatcctatgtttgccaaccccagactcctcactgagcacatattcatacagcaaaggaagactaagtctgtagcctgtgtttctatggtaaaggagagaaaacaaggccacctctaggtaccttctactaatttataaggaaatgagaacccggcttgtctccaacatgtttcttgggtggtctcttctgtattttaggggctaaggaggtcaaggagactcatacatcacacacataatctcctctatgaaccctttacatggatgcatatctagtccaatcctgatgctctattaaaaaggcacaaccaccacatcttttcctagagcagtttccagaatgctttctccacccctttaaaaatcaaaatagttctaagtttgccccaaacattaagttctgagatttcttattttattattgttccttaggtttcctctctcccatctgtctccttattgttgttagatgttcacatgtatataaatacatgaacttaacctactggattcctttagtgctgctagcatgtgcagcatctgcttagggttgagcacttggacatggatagccaattagggagcatgtaccaaggagacctcactctccttctcactagtcattatatacctttagctctgtcagcaaatggtgggaggttgtgacattttaccatccatgttgacatgtcttttcgggttgtcattgtctaggacttgtttacataagcatgttgttaaaatgtaagggatatagtttccctagcctatgtacaagtcttgcagcagacatctgggccctccagctcttaaaatcttctgcccccttctctgtggtcttccttctgcctcatctgtagcagctgtgttgtcagtgtatcagctgtggctgggcatcccacagtcattaatgtctgggttttacttagtgcctttcattaatgggttctgtctgctgaaatagaggtctccttggtgggagctacagacacctgagggtacaagtatttataatgtggttttaaatcatcctgttttaggaaagggtcagtgttggcttc

SEQ ID NO: 19340 - DNA, 1173 bp, Mus musculus
ggggattgaagccccatagaaggaacatcaatatgaactaaccagtactctcagagctccttggaactgtaccaccaatcaaagtaaacacatggtggaaattgtggctctagctatatttgtagcagaggatggcctagatggtcatgagtgggaggagagtcccatggtcctctgaagactctatgccccagtataggggaatgccagaaccaggaatgggagtgggtggattgtggagtaggaggaggggagagtagataggggattttcagaggggaaactaggaaaggagataacatttgaaatgtaaataaagaaaatatctaataaaaaaagaaaagaaaaaaaaaacataagaaaaccaaacacacacacaaaagaaatgtatttggtccaacattttcaatgtctctcatatttatatcatctctataatgtgttcataattttgataattgacattaaaagatttccttcaaaaaaagactccatagaaagtaaaaccctgcatagatttctttgttttactttctaggtggcagcctcaggagacaaatgaaagccttaagaattaccaagatgctttgcttcacagtgatctcacattgtgccctgtaggagtgaacacggaatgttacaggatctatgaggcctgctcctttggctccattcctgtggtagaagatgtgatgacagctggtcactgtggaaacacaaccagtcagcacagtgctcctctgcagttactcaaggccatgggggcccccttcatcttcatcaagaactggaaggagcttcctgctattttagaaaaggagaagactataagcttacaagaaaagattcaaagaagaaaagtgttacttcattggtaccaacacttcaaaacagaactaaaatggaaatttactaaaattttagaaagttcattttttattaataataaagtttaattatgtctagtaccatgtattcataagtgtaaatagttatagtgctgtctaagctgactccatcagctccatcatgtaacagaccaaatactctcctttggctactactatgcacaagattaaagagatggcaatatttttctaagcttgaactggcaggatggttgagtggttaaaggtgcttgctcccaagcctgatgacctaagttcaatcccc

SEQ ID NO: 19341 - DNA, 1173 bp, Mus musculus
aatgtttcccttgccgattgctgccaacctcggtgtctagaaggggcttgggtaagctttgttctgattttttgagcttctggaagaagcggaatccagagatcctaaccttttattttcagctcttgcagcccttaaacatctaatgatcctaagttaatgatgtgtcggtatcattttcccctcctctgtttccttaaagctatgagcaaattgggatgtttttccaccgggaaaccaacggaatcagccctcgttctctccattcagcaccccctgccttgatgaaagcaagggaaatctctccttttgtgtgtgtgtgtgtgtatgtatgtgtgtgtgtgtgtgtgtgtgtgtgtgtgcaagcgtgcgcgctctagaacacaatatccagtagccacatgtgtccacttagatttcaattagttaaaaattaaataaaattaaaaattaattcaccaagtctcactgaccacatgtcatttgcccagtagccacacctggctagtggctactgaattagatgctacagattagagcattcatatcacgtgggaagtcctattggccagaactgaggtctgcatgttgggagagcatgagtctagtcaggctgtagcggaaggtgcagggagctgcccatcgcagcagcccgaggtgagcagtgatctagggatgcacagcacttgcctacaatgcatgaaatcctgggtttaatctcttgcacgatataaatggggtgtggtggtacatatccataatcccagcacatgggagatggatgcaggaggattagaaattcagtggatttaaggccatgctggaatatgtgagagcctaggaattgaactcaggaccttcagtagagtagtcggtgctcttaaccactgaactctccctctctctctctctctctctctctctctctctctatatatatatatatatatatatatatatatatatataaatttatatataatatataaatagattagattaattgatagatattggattagatatatagataatagatgatagatagatagatagatagatagatagatagcagggaaagccaaagggaagaagtctttatacctcatggccttactgaggtagctggggcatgggcttagctccaccttccaaatgtctagggtcttctgt

SEQ ID NO: 19342 - DNA, 1322 bp, Mus musculus
gctgtgatgagattctaatttcagtgagtcagtacctccagggcagctggagaaagcaatgaaattgtctatgcaaggaacaaacagcctgaccctaccagatctaatagagtcgtagggcagacttcagccacaggacaggattttgtgttgggagcttatgaatgtcagggctcatgaatacagagaagtattacagcctgcagaccacagcccacctctctgggcaatcttcgggtgctatgtggcaatgtggcgtcatgtgtgtgagtgtgtgtgtgtgtgcactggaactttcagaggatgctacatgggcagcctgacttcctctctgagcctcgtggcccctgtcagatgtgattgccactgctctttcaaattcaaaatgttatctgtgtaaatagctttggtatttcttttccatgtcttaggtgaagttttgttcatgtaacaaccaggtacgaggtgaccgaataaagctataaacatactgttcagttgtcgtgtgctgaagatggagaacctgggtcctccatctctcctctctctcattagatgagtatcttgtgcgtgtttagggggtcctgccgttacttcttcattcctgattcgcctctaattttctttgtttctttggaaaccccaggaggcgcctactaaggatcaattgtaagaatatgtatatggtgatctgggtttccaaaaattaccctatatatagtgaactgagaagaatctgcctggagattggttttcgaaccacgtacctttatgcctcgtgattgtgaaacattgacttttgtaaacccccaaatgaaaacctgtttagtaaaggggatatattttgtgtgttttgaaatttaggtgcaatgtcccctggaaaaagctcaagaactgtatatgctcaatggcattttaaataaaatactatatatgtatatataaatatgtatataggaaatctttaacaaaatggttttgggttttttgttgttgttgttttgtttgtttttgtcttttgtctttgaatttgttgtacagtttcttcttggtgagtcacggaatgatgagagtatcgtgatttacgacgtggtcatcacttgttgagtgcagactcaaaaatcaaattcaagtcagattcttcttcatagacatggtagtgagggctcgtagattccagccctgcctcgagtgaagcagctgtggatggaatatacagtcacacaagaagtttctagaggggaaaactattcctaagagtaacatttttcctatttgagaattccatacaatggattttaatctttcactctcccaccctt

SEQ ID NO: 19343 - DNA, 1145 bp, Mus musculus
ctggcgacggccttcttgttgatgagattgtagcgtgccttctcttcggccactgttgcctgtttactgcgctgaagtcccctaccattttaaacaacagaacaatgtgaagcagttggaggctgttgcctactgtatgtctgagtttgtgattctgctgccaagacacagaacgggattgctataaataactggattcagtagctaaacttggaacagttaggtctgcactgccgcgaacagcaaagcggtgccacttctctttagagggagtatttaaaacttgtaggcatttctgttgtggcttttgaagcagggttgttttggctttggggaagttcctgttttgggaggtaaacactttgaatgtgggtaagtttatgtcatctaaatactaatcctggtgatatgtgcactgcttgcttccagggagtgttgtcatttctgtttcatctgtgtctgcgtttctattacaaagcagtagtttggaggatagtgagacagctcagcagtcaggagcactggctgctcttccagaggaccgtagttcaattctcagcaaccacatggcggctcacaaccatctaactccagttccaggggataggacgccctcttcaggcctgcctggccaccatgcacacacgtggtgagcaggcatacatgcacgcaaactatgcacacacacaattaaatcctgtggctagcaattttgattgaaggccagagtgttttatcttgtttctgagtactcctggaatatgttggtatctactgttgctcatggtgacagactctattacactgctgggaaagatgggatccttgagtaagaaaaggaacattactgaattttgagatcattttcagttgctacaaatacaattacctaaagttttattttaaactaaaactcagtaaatagtgtagccacaaaagatctcttaaaccatgccattatttgcaaaactactgtagcctaatagcaattactacttactgtgacatttttctgggtgcaagaaagactcgaaagagatactattacagtcttactccgcttatctaagcaactaagatattaagatataaacctaaatgcaagttccattttctctgcagcttttactccctctgtgtcataa

SEQ ID NO: 19344 - DNA, 1225 bp, Mus musculus
caggaccttaggaagggcagtcagtgatcttaaccactgagccatctctccaacccgggatgtggtatttttaattatcatatttattatgtatgggagggcatgtgtgggcattctgcctcgcatgagtggtggaagtggaggttggcttgagggaattgggaagccacactgtgtagctgtcctgactgcacctgatgtctcactgtaggagtgtctggattgtagaggcaggctacccatcaggcattgtggttctgtggatgaggctcagttgtgagtcttgtgtggcaagtgccttctgctcagccattgtgccagcccatgggtcatagttttagtatgttagttcctaattttattcttttgacttctatgtcaatgtaagcagaagataaagcaactatgcttcaaagtatctgagaggatttgctcattgaatactaattgactccccccccttcattgatacaggagacttctcaagagcttgggatgttcttcttgaccacatccagtcagctgcactcagtaaaaacaatgaagtgtccctggccgctctgaaaagcttccaggagatattacagattgtgtcccctgtccgagactcagagaagcccgagccccctgccgttagcgtgcccgtacccgtccttctaggaaacctttccggcccaggcctgagcaggccgtttgtgaggacagactccattggagaaaagcttggcagatgcggctcggagacgcctgtggtgactgacgagctggaagatctgaagctctggtgggctgcctggaacacctggcacaggactggatctgaaagcacagagccgcccagctccgtcgatgagctgacctttatccccagccagcctttccttacagccttagttcagatcttccctgccctctaccagcacataaaagctggcttcagcatggccgacttgcagaagctgggcgtcatcctgcacagcgctgtctctgtccccatcagttctgacgcctctcctttcatccttccgtcttacacggaagcagtcctgacaagtttacaggaagctgtgcttacggccttagacgttctccagaaggtaatgtgatttcagtgcttgcctaaaagctgtaaggaataggattctttggatttttattttattgttttgtggtaaatttcagaagataaatttaggactttctgagattgctatgtatgtacact

SEQ ID NO: 19345 - DNA, 1234 bp, Mus musculus
gcagagcagctgactgactgtgcgctctaacagcactcagtgccttccctcacttcctgtggatggtcacagctctgtcgtcattaactcacatacttcactactgctgagaatatagtctgtgttatgtgaagataagaactggtttttgtatgatattataagttattaagtgatacaattatgttgtgatgctattgttttagttaagatcttaatgtatatcgtatagctaagaattataatgacaaaaaagaattctaatgactagatgctatatatatatcaacacattgaaattaatgatttctttctacttacacttgaagttttcataataaaaagtacaggacaatgaaagttagtgataaggcaaaataattcgccaccttttctttaaattagaggcgctgatgagggaaatgcttgtattgaatctcttctgaagcttagaacaaaattcgtgaataaaattatatttctatacttttctttttagtggaatatatcagattattttttccaaagaggggaaacgattgaaaaagaattaaataaagaagaggcagctcagcagaagcaggccgaggagaaaggagtgtctctgaaccggccgttccaccccgcgccaccgttcgactgcttgtggctctgcctctatgccaagctgggggagctttgtgtggacccccgccctgccgtgaggaagagcgcagggcagaccctgttctccacgatcggagcgcacgggaccctgctgcagcactccacctggcacaccgttatttggaaggtactggggacggtggggctgctcgttttccgctttcagtcacatgtgtacactttctaaacagtcattcctaggcgcttgtttattttatgtatatgagtacactgtagctgttttcagacacaccagaagagggcatcagattccattacagatggctgtgagccaccatgtggttgctgggaactgaactcaggacctctggaagagcagtcagtgctcctaaccactgagccatctcaccagcccaaacaaataaatttttaaagattgattttcattatttttactgtgtgtgtgtgtgtatatgcatgtggacgcatgagtgtgtgtgtgtgtgtgtgtgtgtgtgtgtgtgtgtgtgtgtgagagagagagagagagagagagagagagagatgcacacaagagcagaggtacccacagaagctagacgttttt

SEQ ID NO: 19346 - DNA, 1228 bp, Mus musculus
atctttgaagttggtgtgtatatgggatattgggaaatatggccgttgtgcatcctctaagaatgaccttgtctttcctgagctgaccgatgattaaagtttttgcgtttagattagctgttcttcactgttggtttgctagactgttcccactggtgttggaacatggtttccctgcagttccctctgaggacaagcacaaagacaatctcagtagccgtaagtgtcagggaaatactcagagtcgcattaagcacaggacagtttcctagtgcaaatgtcttatattcataaccttgatgtaattcctggagtagtattttcatccaaatttctctaaaggctagtataccatttgctgcttcctagtttaataatacagaaaaaattaccaagaacagttttcaattatttattaaatcaacactgattttaaaacaagctgctataatttacaaagaatatgtcctttaaaaaattattacactcgtatgtatgtgtgtgtgtgagcatgtgcacgtgtgcacacattcacatgcaggcacacaggcacacaggtggaggtcagaggacaactggcgagaattagtccttatcgtccaccatgtccatcctgggcctcaaactcagaccctcaggcttggtatcaggcacctttgctcaccagccttgtcaccagcccagagaatgggatcctccctactaatgtgaaaaagacaggggctgagcagggaaaaccgctctagctgattcttagctgatgcccccatgactggcagcaaccatggccgaccaaacagttaatccttctgaacgtggtaaagggcagaagaaatgactatatgtaaactttatgtttgatatttaatacagagtcagagatcatgtgataaaagctgaaaaataagaaactgggaaaatcaagtgtttaataaaaataataagcttgttaaagtgtatgtaagaaaatgagcaattgttattgtattttgtataaaaatatcttgtttgaagacatggttctttaaacaggaaccaaggttatgtaaaatattatgatgaattttaaacatagtatgtggtttgtaaaagggcatttgaacttcagtttctggcctgttttgcagatatagaacctccagtgccgatccaaggaaacagtaacagaaggtctgtcagcacgctgagaccctgtgctaaggacgcatacatgctcttccaggtactt

SEQ ID NO: 19347 - DNA, 1296 bp, Mus musculus
tacgtgctcttctaccagagacaggacactttcagtgggactggcttcttccctcttgaccgagaaactaaaggtgcttcagctgccacaggtatccccctggaaagtgacgaagacagcaatgataatgacaatgacctagaaaatgaaaactgtatgcacactaattaacgaaagtgcaagaagccataggagagactttcctgctggtggtgtctatggagatgaagttatcaccacatgaaacagaagtctgagatgaggagtttcagatacccgaatgtaaatcctttatcagattttaacttgtgcagtacttgaagtgaaacacaatgaaaactttaacagaaattgtctcttaatacatttacagtcttgtatttacaagctaaatatatataggaaatcacaaataaatcccttttaagtttgctgctgttttgatgaattatgttttctttaattttttggatgtgacttaattgatgacaaatgttaaatttgtggatgttggtcattaattttgctctaataatactgcaagaaaaccatggctgaacttagttcttgggtaatctagttcctgcgcgttaggctgcctgtctgcgccatccgggtacttagctgctgtgtcggtgtggctcaaatactgcagtgtccttggtacaccagattctctgatctgtccctggtaatcagtgtgggtctgttcccaccacgtgaggaacagtcttgaggaagttcccttttgttgtctcattaaagtgcaggccatgacattgacttccctcgctgtgggaacgaacgccttctagatttcacatgccatcagaatcattttcagctacatgtatgtatttttcactgcaattggaatctatttaaatttttcaattttgttttggtttagaatgcttatcttcactccactgttggttcaatattaaaggtttttgctattagtccctactccattttggtaatttggcaactttttagctctcccagttactgtagctttaaggcgggctggttagtactctgtatctgtagtaagaattgcatcacagttaggcgaggctttctgttcacgtactagcctttaactcatcgataactgggctatagaggtaggtctgttaactttctctgtgtgttcctgatggaattcaccatagccttacagcttttctcggaaggtaacctgtataagagaaatagcgtttgcatgttccagagtcagaaccttgcagcacatgacgcacacaaaccttgggtttcatttagcttctcaca

SEQ ID NO: 19348 - DNA, 1237 bp, Mus musculus
tttaactgtactctctaaagtttcccttaagtaactgcagctcagagcaccagccggctcagtccttcgctggctcgctccttcgctggctcgctcttgccctcccattccatctgatctatggttctcaggacatagcggagactgctggctgcagacgctggaaaatgtaactcggaatttcctacaatctcagctccactttctcccgggcgccggctcggggctggagccttgttattgtcacgtggccgcgggtgccaggcgggccaatgggcgcgcgcccgccttctcgccccgcctcgccgttccgccgcgccgggacatcgcgccccgccgcccgccgcaggcggaaaagtttctcggcgtgccatcccgttctcggacgccgctcgggctgccttcaccgtggctgccggtcctccgctgctggctctcccgctgtgcaggggcatgcgaggccttcagtgcggggactgagccaccaggagcacgaggcggcgatcggcgtgtccagcccggtctgggagtcggtgcttttgggggtgcgcgaggttgtagagctccgggccgaaccggaggcggcggggcgcgcggcgatgggtgctcccggactccgagcggccaccgcggcgctgggactgctgctgtgcgcggggctggggcgcgcgggcccggcgggaagcggaggccacggggctcccgggcagctcttggacgacgatgcgcagcgcccgtgtccagccgcctgccactgcctcggggacctgctggactgcagccggcggcggctggttcgccttcccgatcctctcccggcctgggtcacacggctgtgagtatcagtatcattccggtggggtgaaggagaccggcccgccaggggtgcgagaccagaagagtccgcctaggcccggggctcagagcgcactatacagcgcccaggccgctaccggagccctgtggggggactcagtctccctctgcatccgcgcaggtgggttcttgagtcgccactcctaggccagcagacccgacgcctgcgattgggagccagtctgcgagacactgtattttgcaagttttcttctgagtttatgtaggaaactggcccaactgtagcttctcaggggttagttagggtccctagacggtcactgcaggcgcgcctttctcttataaccccccttgctcaagcaaagccgcacagactttttctctccgcagtgcttaattt

SEQ ID NO: 19349 - DNA, 3693 bp, Mus musculus
gaaagataaggactcaacccaagtcatttgtcttctttcctgctatgctgtgagctactgagctttacagccatgaaaactattgtaggctccctcgccaaaccatggctttccctcagcatcaagacctgtgccaaggagaagggagaggccggaggctgctttggatgcccagacacacatctttcagaaaacacagaaacctagccagcagctgcagacatgtttgggaatatgagagcatgttcgcagacccaccaggttctgtgtcctatgggctacacctggctccagcaagaatgcctgccatgggcacttctctgtacccgggctccagtgccaggccagcctctcactcccaagccatagtcctactcccatgggaaaggaggtcttctctctgccctggaggaggacatatagctgatttctgttcttttaactcttaaaaatctctttctaaacttggagtggtttatattcgcccgagctccagtcctgggcctgaggtttgtgtgggaagcgctggggtacaaagaaaatgcaaatgttcaatgcaagatgtctgtctccttgcgtgtagatcccaaaagtgctcttcaggggttctgtgctagctgatgcaaggacattagctccaaaggctggggagggcttggctctccctctgtgtcttcctggtgtcccgccctggccagctctcgtctgctctcgcctttatccttctcggctgctgctcttcctctccagagccttgggagaaggactttccccggttgtacttaattgattggttgtcccaagtgttgctcttacttgatttgccaaatgcctcctgcttctcgttataggactgagtgaggtcctcatagctctgtgctctgggcagctctgagctctcagccctgttgctttcaatgtcagtcacagagtggaagtttccccaaagtggaaagctaccattgggaacacaaggggcccctgaggggcctccacctcactgccttaagtgagtcccgcccactccctgcctccctccgaggtgggcgggagttcctaccccatctctgcttcccctggaggccggccagcgtttgtgggttggttcaggtgtggtacctcccactcaggagtcaatattttcaaatttttctagtttccacacacgaggtcctgcctggggtttgagaaagcctggtggaggagtgtggtggtgtgagtggagactggctggcattcctccagcactctgcagacttcttcctgggcccgaggctatggagccttggctttcacttctgtgacaaacacatgccatttccccagcctcatttgctggtgtctgtagggtcctcccaaggtgagctgagggctgcaggtgctagccaggaacatgggagcttgactgtggcttcaggtccagaccctgatctcactggcatcccaatactgcaggaggggtcttctcacaaagctctgagggctggtcttgactaagcaataagagcctcagagttgattgaattttaaggtccctttctggcttcttggttctccatgtgaccaaagcccagtgtggcttcatgggagccctgttacttctccatgaaaccccagctctctaggcctgactgccaccagagtcctcttaccacctgcagtctgccacaaagatgccatatcaactcctctcttcccaaaactaaacaggatctatcatggtggcacggagtcagctagatgttgtctcttgctatccctgtgctagttccatgttttagaagcaaagtgatactggggaggagaggagggcaagtgagaggagccagtgcctcctgaagcccttgctccactgccaccagcccgcctgccccagtgcagactggtcttcaggagtcagtagaccaccggaccaggtgtcagcatccactccaagccatgctaggaatctgccccctgccgggttcagctctttaaggtgcctcttcagggacacagtgtgtgtctgattgggcttcgcatcaaaagcctgacgttcctgtccctcttatagggggagctttggacacaggaccagtttgataaagggccaggtaagggtttccactctgcacattgtagaggggacaccgaaggcccatgggtccctaattaaagaagttgagtgaatttgccttcgttcaaccagggacctatctcactccctcccaaagatttttgtataattgtataacccccctccccctgttaacagtggctcagaaaagctttgtactaaaagcatgggaccctcacagcaaccattcctgggagatgggtcccttataggtccatgacctgctctgttcagaggcctcttggcagtgtggcctgtttgtgctgtcctgcatccagtgtgttggcctggctaagtgaaaacggtgagctgtttcccctttgggctacttaaccacggctactccttttttaaaaatgtcctagttctcccctacacacacacacacacacacggtttgatgaatttccaaaccacggctactccttttttaaaaacgggtttgaactcctgtttagccaagagtgatcttgagctggtctcctgcctccaccccctgagtgctggggttacaggtgatagctggtctcctgcctccacctcctgagtgctggggttacaggtgatcgctggtctcctgcctccacctcctgagtgctggggttacaggtgatcgctggtctcctgcctccaccccctgagtgctggggttacaggtgtgatcaccttgctggcttgtgaggtgctggggacaacccagggcttcgtgcatgtcaggcacacactcccaactaagctacatccccagtccctctttctagaaaacagataagtccatgttcaggggagaagaggtcacaggtcaggccagctgccccatcctttagttcggggttagctcccagaactgccctgcaccataagctggtgattctccatgcctgtccttaccccggatctggctattcccgtgatgccatttggaggggagaggtctgcttcccactgtgaccaggctatgggatccttggccaccttgcttcatgatttgatacatttgttgtattcaaaaacttgaactgtaggatgccattaagagtctgtttatatttttggaatatttgtattacaattgttaataaaggctggtttaaaaacctgtgcaggactgggagctgcttttgctttccttcccttccactgacctgacactcggtggacactgttcttcctgcatgacctcgttgatcgtgaaatgatagcacctggcagagcaaacgctgggattctgatcaaggttacagaggttggagtgcattagcccctctcgggcctgggttggaaccaactccctctccccaggtacttggcaagcgtttgcttgctgtgctattgactggggtagagactgaagccctgggggaattggaggctcctgcatgtgctcttgatgctgccaaacaggccttgagattcagagcccagcatggtttccaggcacatagtaggatgacttgtacagactccaagcaacaaaagctttcctgacaccacagaattgcccagaatcatctctcagccctgaacgtccaggcacacagtaggggagctctagccagtctcctgtcatcagcata

SEQ ID NO: 19350 - DNA, 3693 bp, Mus musculus; identical to SEQ ID NO: 19349

SEQ ID NO: 19351 - DNA, 1233 bp, Mus musculus
gagttgtgactcccactctgctagtattgccctgtgggtcatttggatctctcagcctgagtttagtgtgatgaatagccgggttctgagtgcccgctctgcatgacacactgcaatgcatgctccttgcctgcgccaccttctttatttctcccagtaaccctgaaaggtgggtcatatcaactccattgaatagagggggaaaccaaggcttggtagttgataaatgccccagttcccagaaccagggaagacagaaccatgaatttggcagccagcctgagtgacagccagcctgttttagctagagtactctcagaggggctctgctcctctccctcctccttaaacacaggccgaggctggtgtcttcccatcacggtgcagatagactgactgcacggacagaaaggtcaccatccacagctcacgtgggtgccgccatagtcacctcaatccagtggtgttgtttcttgtttatgctcttttgtaggtaaactgggagagaacatgattcttaagcgagctgcctgggtgaaggtgccctctgggttctatgtcggctcttatgtgcacggagtgacgcagagcccctccctccagaacctggtgctggggaagtacggggccctggtcatctgtgagactcccgagcagatcgcaaacctggaggaggttggccgccgcttggggcagcacgtggtgggcatggcccctctctctgtgggctccctggacgatgagcctgggggggagacggagaccaggatgctgccccagccgtacctcctggatccttccattacactggggcagtacgtgcagccccagggcgtgactgtagtggacttcgtgcgcttcgaatgtggagaagacgaacaggtggccgaggctgaataggtttttggcctaagtggaaatatttaatttttatatctggatttccttataaaaagttattttctaaacctcttcaaccctcaaatttgttttttttttttcctttttagtttaaaatgaagatatataatcatgggtaaagttattaaatggtgatgtaataaagaatttttctcatttgtatagtgcttaatgtgtgagtgtgtgtgtgtttgtgtgtgagtgcacacatgccaggctttgtatagtaagcacttttacccaatctctccagtccccagcctataccagtctattatataattctggaagtttctaacacactgtcttgtt

SEQ ID NO: 19352 - DNA, 1150 bp, Mus musculus
ggacattctggaccctctttctgcagagtgaagaccccattgtggaacatctaggcagttcaactgaggaaggaaagaaagttctacgcaatgggggaaagaatttcccagccgtcttccgaagaatacaggatcccctcctccaggcagtgacccccaaccccaccctgccttagccagaccccctagaaggtgactggaaaaaagataaaaaaaaagaaagaaagaaagaaagaaagccaggcgtggtggcgcacgcctttaatcccagcactcgggaggcagaggcagaggcagaggcagtcggatttctgagtttgaggccagccagggctacacagagaaaccctgtctcgaaaaaccaaaaaaaaaaaaaaaaaaggtcagctccccaggccttcccagactggtgggactgtggggccgtgacctctccaagaagttggttggggagcagtctgtggtgttctttacccatcgctcttactgcctttttgttcctccactgtctgaagaaatcagatgaagctggctgagaaggtcaaaggactgtgggccagaggggatatttggagggctgtggatattctgttctcattgagcaccccccccccccccggagcttctctagctcgggtgaagcatgtgatgcccactgtttagttgtgtgtgtggagaaacatgtgatgtaccactgtctaggctgtgtgtggctcaggttgccttcacttgtgtttactttgcagtcctggggatgatcagggtgtgtgcccacgtacccatgtgtgtgtgtgcccacgtacccatgtgtatacccatgtgccaatgtcactatttcccaagaagggctggggtatgtatgaaatacctcctcccaacttctccctgcttacagtctgacccaggcagtctctgctgcctctattgctgctatctctgtggaagtctctgaagagcaagagggtagagagccttccttgtctctaccatgttgaacttgattccagaatttcagacctgactggcatagttgtgtctcatgaggagagggagggaaggcggaggaacagggagataagctggaaaaaaatttaaagaattatttttatgttatgtgtttgagtgtttgcctgcatatatatgtgtgtgt

SEQ ID NO: 19353 - DNA, 1715 bp, Mus musculus
cctgaaactcactgtgtagaccatgctggccttgaactcagagatccgccagcctctgcctccccagtgttgggattaaaggcgtgtgctaccatgcccggcttcaccctggttttcttttttttttttttttttggagacagggtttctctgtatagctctggctgtcctggaactcactctgtagaccaggctggccttgaactcagaaatccgcctgcctctgcctcccgagtgctgggattaaaggcgtgcgccaccacgcccagcttcaccctggttttctcatccatttgcttaggcctcatcgtccacgaagggtcttctgtttaccgcatcttcaagcgctggcaggccgtgaaccagcagtggaaagtcctgaactatgacaagaccaaggacgtgggaggagacacagggggaggggcggcagggaagccaggccccaggacctcacggaccagcccccctgcaggggcccccacccggcccccagcagcccagcgcatgcgcatgcggacgctcttgcctcagcgctgtggttatacgatcctgcatctcctcggacagctgcgaccaccagatgcccgttccagctctcattctggtcgagaggttgtcatgagggtcaccacagtctgacctggactccaggaacagggatcttaagtcaatgcatcagccagaggcgagccctcccggctgctggaggtacgacctagacaacgtgtttggggcacggtgaccccaccactgaggatctctgtggacagccgccagcttggagacattgtccggcctactgcccacagggtagagacccctgggtgacgttccagttcccacagacaccgcctcatactcaccttgaggatggccagcaggcaagcggggagaaccacttttcttcctggagagaaccatctttacctcagctttaagcctccagtcccctggctccaccatggtgacttggtaaagggagaccaatgccagaaaacaaggggctgtagacaccccccactccccaccccatggccacagggcatctggcaataagactactaaacattgacctcccgttccctgcatgaggcgggggacttccccctgctccgccccccactgcatgggggaagggcataaagaatcatttatatgcgcgtggggcctcctttctcatctggggctcttctgcagggatggagggtatgggggggggctcctcagcacgggttgggttgcacttcccagaggtgcgtatggagttggaagagggacccctcccgcccccctgcttgctggtgagtgactcaccttggctgctaggtgtcagtgctcagaggtagctgaggacggggtgtgggcttgtcacctgtgagttttatgatttagaaaagaaaaatctgagcttttttcttcctgtctacctcacagactcgaggataaatgggagacaggttgaatactatgacagagaaaactgacgggtgtataaagggttccggactagttgccaccaattactttagacagtaggtgatagagcaagttctgaaatgtggtttctgtcagaagcggcacagaactttggtgtttttgagagacaaagtagagaagcaaaagaggaagtcgatactgcaactgtgtaggacagtggccgttgtaggatcgagaacccttctgaccctccaaacaccggacctggggtggag

SEQ ID NO: 19354 - DNA, 3602 bp, Mus musculus
catggcggtggagtggaaatgttacagcaccatttctggcaccaggatctcccactaacacctcgacctcccgcccactcagagacccatagtgagactgaagatgcgctctggctcggccttgagcccagagttgagagctggttggcccggttgccatgacaccgccttgtgctccaccctctctcgcccccacacaccccctcggcagtcagggtatggcagccagtcacgtgccacacagcgtaaccacacctctgcttcccagcgcaaagtcaaggggtcacgtgggatagcaacaggtcacgtggccgtcagggccccgcccccttccccaccacacccctcccatcaaagcagcccgggttgcccactgcgcaagggtgaagatcacgtgtccagaacgtccggcgcccgccccgccccccgggtttccgcgcgcctctctggcagctggtcacatggtgagggtgggggtgagggggcctctctagctcgcggcctgtgtctatggtctggcccgaagcgtccagctgcccgggaccgatccccggtgtatggcgccgcaggaaccggctcccgggcccagataaagggccacctccagagctcttagccgagcgtaaggtgagtgcagtctcatccaggatcgggggaccagtccccgccaccaccagcaccctccagctccccacgcgtgcgcgtcgctggctgattatggaaggtggcccaatggcgggaagtggggcctttgtggtcgcgggcaagggtgtgattttggagagtgaagtgcagaatcttcggtgcaaaccctgtgcactgtgtgatcctctttgtgcctagtgcgatgtcctccgaaaggaaagaaagcattctttttcttcctccgggacaaaacgtggccggaggaggagggtttgatgggagtctttgtgttacctaaggcgcgggccctggaagtgtggaggggtgggatgttgctgatcgcgttggcgaggtcttgtgcaggagttcctttgttaccgccgggtcatccccctcctaaccgtgagagtgagtttggtattagaagcctctgtgattgtagatcccctgcttcgagaatggctgccactcgatatgaacccgtggctgaaattggtgtcggtgcctatgggacggtgtacaaagcccgagatccccacagtggccactttgtggccctcaagagtgtgagagttcctaatggaggagcagctggagggggccttcccgtcagcacagttcgtgaggtggccttgttaaggaggctggaggcctttgaacatcccaatgttgtacggtgagaaggttggattgggagtggggcggagaggacaataggacccgtaaggcaggagtgggaccctagaacgccagaggccacgttgagacaaaggggacgactagctggtgatcatttgttcttctcaggctgatggatgtctgtgctacttcccgaactgatcgggacatcaaggtcaccctagtgtttgagcatatagaccaggacctgaggacatacctggacaaagcacctccaccgggcctgccggttgagaccattaaggtgagtaggggtggggctgggggcgagggtggaccgatctttgcaatagaagttgttgggattttgaagtgatacatagtttccggtgttctgtgctttcttcttgaaaaacaggatctaatgcgtcagtttctaagcggcctggattttcttcatgcaaactgcattgttcaccgggacctgaagccagagaacattctagtgacaagtaatgggaccgtcaagctggctgactttggcctagctagaatctacagctaccagatggccctcacgcctgtggtcagtaaaaggcgttagccgactaggttgtgataggggtagctcttggtggtttcccatagcaactgaggagtcttgtacatgaagttttcagagccaggcaggtctggttcgtgaggtcgacactcactcatttctactattctcttcaggtggttacgctctggtaccgagctcctgaagttcttctgcagtctacatacgcaacacccgtggacatgtggagcgttggctgtatctttgcagagatgttccgtcggaagtatgggactagaaactttttgttgttaatggtacagggttagtcctggccgtagatcaggttggccttgaactcacagagccctgggattaaaggcatgcgttaccaccgcccgtatgggacttgaagctcttaacctaccttcagttgcacatagctttggctgcttgtcttactgtgctagaggttgaaatcagaactcacacacactcagtaaatgcttccgtgccactgaacttcacactccgtcggcccccaagtcttttacagacatgcctgttcttgaccattcgcttttgtgcatgtatggtacgggacatccagcctacccagttcatactgaccaccttgcctagaaccaagaaaccatataggcatgccctggatttaggatcttcccgttcctcgtctccacactctctagttgggtctacataacggttactcctcaattttttttttcttttaaaaatgtatttatttccatgtatgtgagtacactcactgtcttcagacacaccagaaaaggacttcagattacattacagatggttgtgaaccaccgtgtggttgctgggaattgaactcaggacctccggaagagcagtcttatctgctgagccgtctctccagcccccactcccctatttttgatataacacatactttgagtctttttctgccttaggcctctcttctgtggaaactctgaagccgaccagttggggaaaatctttgagtaagtatttgataaggaaaaggaaagacatttcctgctgccgcggagacaggagctgggaaaggcccctcctaacagagttgtcctgtccccacagtctcattggattgcctccagaagacgactggcctcgagaggtatctctacctcgaggagcctttgcccccagagggcctcggccagtgcagtcagtggtgccagagatggaggagtctggagcgcagctgctactggtactggacctgggcggggattgggttaagataagaaataccgtggcctggggaactggctcagtgggtagagttcctttgcataagtgtgaggacctgagttcaaatccccagaactcatatagaagttgtgtgcttctatggtgctactccttttttatttatttatttatttttaaagatttatttattttatgtatgtgagtacactgtagctatcttcagacacaaccagaagagggcatcagatcccattacagatggttgtaagccaccatgtggttgctgggaattgactcaggagctctggaatagtggtcagtgctcttagctgctgagccatctctccagtcctgtagtgccactcggggcgagatggacagatccctggtaatacagcgctgacagagtctccaatgagatggaaggcaaggactggcagcccagactcttgacctctgcatgtatacacgcacatgtgcgtgcccgcatttcaca

SEQ ID NO: 19355 - DNA, 1658 bp, Mus musculus
atgaactggagagaagttttgactgctgtggcttgttcaaccttacaaccctgcgcctacaagatgatacttcctgtagtgcggtaagatgaaggattagtcattcctgggacattcactacagctttttggacagggcaggtgagcaactttgaattctctatatatgtctgttaccaggtgtgcaaaactaagagctctacatgccagatgtgtggggagaggttccttaaacattcagacaaagccctcaagatcctaggaggtgttgggctcttctttagtttcacagaggtaatgactcctcatgtacacactcaagccttcaaccccatggtccagaaataacctttctctcttcctctcccgtagatccttggtgtttggctagcaatgagattccggaatcaaaaggaccctcgagccaaccccagtgccttcctatgagacttttgacctcccagatagcatctctgcagcctaggctgtttctagctagctctgtatccaaggaagaccttgaattccagaccctcctgcctcagcctcctgctggcatcaccacactcagccagcccctggatccttctgacttggctttgccatttttttgttttttgagacagggtttctctgtatggccctggctgtcctggaactgtgtaaactaggctggcctcaaactcagaaatccacctgcctctgcctcccaagtgctgggattaaaggcgtacaccaccactgcctggccttgccatctttacaaacacctaggggtggccctatggttttgttttagagaaaagaggtcccttacctcacccccaagaactggtggttggacttatgtctgttttgatgggaacacgattatggatgaggggaggtaggcctcgggccctaggagggtaactgcaccccccccccaagacccttggcttcaaggacagagtcagaacaccaagagaaaaccagttataacccagggcctcacaagtgctcggcaagcatttctaccaatcagttgtcattcccagccccacctacagtctcatcaaagcaggaccagtgaacttagaaactaaagccattttgaccgaatattcaaagaaagcatttctctctgatcttgccagccaaagagctggactgcctgcctaggtccttgcagggaacttgttttcgtgttttttttttgtttgtttgttttgttttccccaagtctcccagtggcaaagccaattggaaaaaacattaaagaaaaataaagaccatactctttgtcttgtcttgttttcctgtataaaaaagatcccagtataaatcagggagggaagaagacagatacacctgccctttagtgtagagctaggggagggtaatgggggtgaacctcgtaaggagaggtggggacttgttatttaaggcttaaaatattctctgtaaaaaactggaggattctccacagccttggggggaaacagaggctgccgcttcagcgagggtttctccaccaagactgggaaaggcagcccctcttctcactctgcgtcgctttcctccttgtgcaggtaggagtgctgcagggctcggaaggcagagattcgcttatgtgggttaaaggtcagcatttcctaaagggagaggacaaaggtcag

SEQ ID NO: 19356 - DNA, 1193 bp, Mus musculus
taggtcccagtgcaggacttcccttggctcagcccctctttcctcccaggtacagggagccgaagaggccaataaagagcgccagcgacagagtgagctggagagcaactaccgccgggtgtggggctctcccggtggtgaagacacgggggacctggatgaatttgacttctgagaccaccctgccagccctctaaggattcctgcatcttcctgaccggccggctctgcctccttacaccccattctggggccttggaggcaaaagggcagattggagcccagcactggacttgaggggcccagccccaagagtgtatgagggtgtgtggggacccatgagggtgaggagctgttgcagccaggcctatggggtccactccccaaacacaccctcctttgcccctttagctttttcctgtcccccaacttcttagcacttaaccccactctacccagagacttgatgagaccttgtgagtggtggtggcaggaacagcagggctgtgcaggtccccgaccccacctctccctatcctacctccattccctgttgctgtttgggagctgttgcccctcccttggaacgcctacttcctgtctctgctgtctcccggtacctgtgcttctgagcccagactatctcttgtcactgaggggatgggagacctttcatatcacctcacaaacaatcccagcaaaaagggttggagatggagcacccccttgttcttcagcaatcaggtttctaaataaaaaactggaccgtcaagccatcaggctctgtggggagggcaatcaggtcagagcagctcagggtgccgatcctgcttgctaaacgtttcccagaaaatgtcagtgtgcctggggtacacaggaggcgaccaggacagctgaccaatgccctacagtatggagagatgctgttttctcctgggtaagctgaccaggcaccagcctccagaggcctgggggagagtcacagtctctgctctgctctgctgtcatcttacggacctctgaaaggataaggatttggagccaggtctcagaggaccctaaaagccgtggcaaagctacaggagacctctggtccctcctctcattatccattactatcccaggggctcacatgtatcaggtgagccctgtactgctgagttgtgcccaaccagtcacttcaagcaaatctt

SEQ ID NO: 19357 - DNA, 1204 bp, Mus musculus
cacagggggaccccagctgtgcgactcctcctcatctccctctccatggcgtctccctttcaccatttctaatttgggggagccatccaccctctcagtctgttttcatcctggtcctgacgcgttcagcttaacacctcccctccccacccaaaaagcatattctggctgggttatcttggttttggaggtccctcctcatgggaagtgggaggggtctgaatttggccccaactgagccactcaaaatgagggtgggtaaggacgatcaagtccaaacgactaactctgatcctcatttctctttgccccaggtttgggtatccggacccaacctacctgactagggtgcaagaggaactgagagccaagggtatcacagacgactgagggacagctcctttgccaaggccccccgctgtcctctactaggatccaacggaagcctctgctccccccgcctctctctgcccccacaccatccttgaggggatatgtctgactggggtgggaactcagaggggaagaggacatggtcccttcccctgcccccccactggccaagtgctccagcagaggctgttttccaaggctcccgtcccctcactccgtgtacatattttctctgcccctgcttctccagtgtccttggcttttcctggtatgtaccgtgctccagtgactaagctgagaaaggacctgggtaggaaggatggggtctctggaactccagcccctgaatactgtctcaccttggactgatattagctgcctcccccagccagctgtgtgttaagataacagtagtcctaccttaacggaccctttctctcccgtgtctgtctttgtcagtctgtctctcgctcttctctgcccctataaggagcctcctcaccgccccccccccccaaatctggaattgctgccagactgtagcttttaatttaataaaaataaagtgaaatatgcaactctatgccacacccgtcttctgttcctcggacagggtgggggtggggtgtggacccgctgaggagatggggtaatggggattccttgcatgcctgaatggaccctttctcttcctaggagtcactctcctctggcagagctaacgctgggcgttgcaataaccctgcaaagccctaggccacacttggattgatggaatcaggattaagaggggtttgtttgtggttcagct

SEQ ID NO: 19358 - DNA, 1224 bp, Mus musculus
ggcagcctgtggaggctcctgcaagaacaaagtgactgtctccaagcctgtgtgggacttcctgagcaaggagaccccagcccggctggcccggcttcgggaggagcatcgggtgtccatcctcatagatggcgagacttctgacatctacgtgctccagctgtccccacagggtcctcccccagcccctcccaatgggctctacctggccaggaaggctctcaaggggctactgaaagaggcagagaaagagctaaagaaagcccagaggcagggggagctcatgggctgcctggctttggggggtggaggggaacaccccgagctgcaccgcccaggccctcctcccctccgagcagccccactcctgcccccaggggcaagagggctaccccctcctcctcctcccctgccccctccactccctcctcgtctcagagaggacgctgaagagcaggaaaccacctgccccatttgcctgggggagatacagaatgccaagacgctggagaagtgcaggcactccttctgtgagggctgcatcacacgggccctgcaggtgaaaaaggcctgccccatgtgcggccgattctacgggcagcttgtgggcaaccagccccagaacggacggatgctggtctccaaggatgccaccctcctgctgcccagctacgagaagtatggcaccattgtcatccaatatgtcttcccgcctggcgtccagggggtaagagatcacagttcctacccgttggcttcctccaagttcactgtctcttgacttaagaaaaaaaggcaatgtagagagtatgttgttagacatgttagactcttgctgtctcccagcatgccttaggacttatgttctggagctgttggggaggggccatctccttgaggccccactgttttattggcatgacccacaggcagatgtaaaactcaggtgtggccaggcagtggtggtggtgcacacctttaatcccagcacttgagaggaagaagcaggtggatttctgagttcgaggccagcctggtctacagagtgagttccagaacagccagtgatacacagagaaaccctgtctcaaaaaaccaaaaaaaaaaaaaaaaaaaaaaaaaaaaaaaaaaaaaaaaaaaaaccaaaaaacaaaaaaaaacaacaaaaaaaaaaacctgaaaccagtcatgagagaaagggttgcccactagtaccctgacttg

SEQ ID NO: 19359 - DNA, 2680 bp, Mus musculus
gctgaagatcatggactacagcctcctgttgggcatccacgacatcatccggggctctgaacccgaggaagaggggcctgtgagggaggaggagtctgagtgggatggggactgtaacctggctggacctcccgccctggtgggctcctatggtacctcccctgagggtatcggaggctacatccattcccaccggccactgggcccaggagagtttgagtccttcatcgatgtctatgctatccggagtgcggagggtgagagagaacctggaaatgttagggggagcggggtgatggggacccttgggagacagagaccagggtggtgggtggagaaaccgcttagcttttcacaacaaagttatctcttgggcaaaaggagttgggactgttgtaccctgtcctcactgctggcctctctccccaggggccccccagaaggaggtgtatttcatgggcctcattgacattctgacacagtatgatgccaagaagaaagcagctcatgcagccaagactgtcaagcacggggtgagggttccccacagcctttcctctcctggcctgactgttctctggaaagaacgcttctggggtcagagtagtgggatggctgagggaaggcagtaggagggtgaactgagggggaggcggagagctcctgtgagtgacactgttccctgttttttcttctcacaggcgggggcagagatctccactgtccatcctgagcagtatgctaagcgattcctggactttattgccaacatctttgcctaagaggctgcctgactccagggtgattgcggctttatgttggaggtggcgggttctgagaggcttaggggagctggacttggccgttacttctcttctttgctaaattcaggctgcaggctccttccatccaaataacttccttctggtggatagggttttctcgcccaccccagacatacactgtcctttctccccttgtccatttctctgccctccctccttgctcccagtaagccctcctgcttctttagagtgttattgtcgactcttctaagtgccttgatctttgaaaaatatcttgtttctatgaaataggaggagctgggggaggggttgtttgccatcttcgggacctgactgaacagtggacttggctcaagcaactgcctggatgcacttttgctgagtggaagaaactgaatgtctggattttgctgatacttttatggggcactttgtggcatgcttcctccctggtaagccctggaatggagggctttcaggatgctccagatgtgggtgcaggcattcacacatggacagtctggcctggaggtcaggtggggagtggtcagcaggctggcacctcacaaggcaggacctaagcctaagcggacttttgtgactatgcagatgatggagaaggtccctgtggagcaacgactgttcccgactgttcccgttctcccaccccaccccaccccacgtccacctctttctgtgagcactttgggtgcaggagcccagaggctagcggtgcccgagcttaggtgcaggtgtgagactcgggctgctcttcccacaaccctgtgccttgctggtgagcagggagagcagtagaggccgggacaggtcggagtgcagggttcattgcctgggtgacaccctttcttcctgtctcactactcctgggcttctttctagcagaggggaacagtaccatctccataatttggggaggatagagctctcgagtgaaggagcctccgcatccctggggcatgtgtacctagaactccccctccttctcaaaaccctttctggttggagttgttattctgtcccatcttccactgctaatgtgtctcccaggggacagatggccttctttgtcatctcccctctccgcccccagagaggagtcagagccataactcaatccacccagtcctctccaaagacagctgaatattaatgcacgccatcctcagaatggagaggacctgctaggcatcttagctctcccagctcgtgcctgtaaagccagcactcaggaggctctgagagttcaagtccagcctgggctactgagtgagacctggtctcaggaacactccaaataggtttgggtttgagcgctggagatcatagctgagttggtagtgtgcttgcctagcatgtacaaagctctgggatccacccccagcaccacttaagccaggcgtggcggtgcacgcctgcactcctggccctgggaagtagtggtaagcaggatggggcattcaaggtcatcgccagttagttacttgacgaggttgaggccagccaaggaaacaggagaccatcttggggaaaatgattctaaggagagatagattgtctttgtctctgcctaaagcctttggaagcaagccactcatcttcgctgtttggcgctctggaggtggggtgggcattgaaggcaaggagctgctttgctgtgtgtccatgaggtcctcagggagaagcccacctccctcaccaaaggaagcagcaagatgggtgcccggttggggtgggtgggacctgctgagtctcccatccctcaagcaacctttcccctgttgaatgcaataagtgactccggtcccttaacaactggggtctcaccgtgcggctgtggtcgtgggcagtgttgc

SEQ ID NO: 19360 - DNA, 1176 bp, Mus musculus
gttctcaatatgatacactgccattactgccgaatcctagagtgcttgttttccctacttcccatcccctggcagccaccaattcgccctctgactttgaatttcccagtcattaatagttcatggaattgatacaaaggagggaggagagcttcggcaagagggctcaggtgagcgaaggaaagggctaagcttctctctctctatccccctctccgttctctccctctttttctaagtggagaggaggaagccagcctcccccccacacacacacacacacttgtcctgtacttccttctctgacaggtcagcaagacaggggcagagggagccgttctggacgaggcaaagaatatcaacaagtcgctgtcggccctggggaacgtgatctctgcactggcagagggcaccgtgagtgtcccctgcccccatcctccacttcctccccttctccccgagttctaatcatgccgcaatccccagggagcagccctgccctttattatccagttgaaatcattttcacattcacggtctgctcctgctctagaaaagctacgtgccgtaccgcgacagcaaaatgacgaggattctccaggactctctgggagggaactgcaggactaccatgttcatctgctgctcgccgtccagctacaatgacgcagagaccaagtccacgctcatgtttggacagcggtcagtatcagagtccccagagggtccccggtgcactgctgctgtcccatcccttcctgttcatacacacacagacacacacagacacacacacacataccatacacacagacacacaaacacacagacacatatacacagacatacacacacacagaaacatacacagacacataggcacacacagacatacacatagacacacacacacaagcacagagagacacacagacatacacagagatacacacagacacaggcagacacacacatgggcacacataggcacagacacacacacacaggtacacatagacacatacacacataggcacatacacacacaggtatacatacacacacacataggcacacacacaggtacacatagacacatacacacatagacacacacacaggtacacatacacacatagacacacacacaggtacacatacacacatagacacaca

SEQ ID NO: 19361 - DNA, 1136 bp, Mus musculus
tgccagggaagaggttactgttgcagaaaccttgtgccagtggggagctctgtgcattgcgagcacctgtgtgcttgctcctcatgcacaagccggcatgtaccctccgttgatgctgtcctctctgcattctcagggttgggggcggggggttggcacaccggaccttgagaactaaggtcctgagtcactctcaacccttgtacagtgatgtgcagggcctaactcaagaaaccctcaccagattaggacaagataattaccaaggactggcctctcagccatgttcagggtagcatctttctttcactatggacgttttatcccagatcccagtttgtacctgtggtcatcccactggatgaaacggacatagagttgacaggggaggtggagggcggaatccttgaatgacagtcaggttttgcaatgccttgttcaaaggaaatgggataagggatgaatgctgggtaatgagtctgggtggtcaccgcttctccctgcaggccaggaatgagccagacgtttatgaaaccagcgacctacctgaggatgatcaagcagagtttgatgcggtaagactgtgtgctacctcaggatccctctggactctgacctttctccccagatgcaggtccttttccttctctggcaagccacaacaataagtgggtatgccaaccccagcctgggtggtgtggaggtctcagggctttcaaaggccttgcccagcagctggcagccaccaatgaacaatgccagaaaggagagtcgagccagtgagattacaactaacaagacctgtaaaacccaagtcttattaaatacaattgagatatctcaaagcagttacattctggactagtgattagttaggccccagggtctaatctgtgcattgaattataaagcttgaacatagtaaatcgtttaaggttggagtagacatttttttttaaagatttattttgtttatatgagtacactgtagctgtcttcagacacactagaagagagcatcagattctatttcagatggttgtgagccaccatgtggttgctgggaattaaactcaggacctctgaaagagcagccagatgctcttaactgctgagccatctctccagtccgacct

SEQ ID NO: 19362 - DNA, 1163 bp, Mus musculus
ttctaaaagagagattcttcgccgggcagtagtggtacacgcctttaaccccagcacttgggaggcagaggcaggcagatttctgagttcgaggccagcctggtctacagagttccaggacagccagggctacacagataaagtctcgaaaaaagagagagagtttcttctgggtgttcctcatctcggatagactctgatagactgttcttgcccctttataggtgcagacaacgatgcgtgaaaacttggccacagttgaggggaactttgccagcattgatgctcggatgaagaggctgggaaagtgagcatcactgggagctggggagcggggatgacccttgcccctgaactttgtcagacccttccacagggtcactcacagccccagcccacctgacaagggcaagggttcttgcatgtggggtacacaccctcccgacaaacagagtgggagctgggggctcttattggatgaggttgtgggcccagccacatgcagttcccgtccagtaagtgctttgcctgctgtgggagagggactggatcccgtcctctaacgtctgtctctggccgagtctaacactgtacaactgtctctgaccattaaatgctgttgtaccgtggagtctctgctgtgttcctggatttcggagaggcagcactgagagacgtgcataacgttaacagtctaagccacactattatgagactatttcagctgtaatctgttcttaccgaagagctaaataaaaaaatgagtacagagtcagaaccagagtttcaaaatattctcatctgttaaattaagagtgtctcccatagaaaagcagtggaggccccacagggcaagtacaaaacagaatgaaaactcccaagggtcttgtctttacaaaaaaaaaggcaggaggcagcccctggacagctggtcatgctggccgctccggctggaccacgctgcataacccccagtggcatcgtcacaccgtctctgagcgcttgatggggagaagggccagtgtagtgtgtatggaggagagatccaaagtcctcttggccccctttccatatcccagaggaaagcagagggaacctggctacgctttgaaatgaggctatgtgtttcggtcctggggacagggataagaggggatctgtgc

SEQ ID NO: 19363 - DNA, 1411 bp, Mus musculus
tgttaggccaagtgttgtactactgaaccatatagacccctggtcccaaatagtggcttgcttttcaaaaatggcagatacttgaatatgaataaggacattgtgcctttactatccaaatgtagaagtctctcaccagccttctgaaattcacctggtgctcgggagctgctcctgatcatctgtgcccttattgcagccctgcccggaacagcagcagctcccgccaggacgtgaccttggaacccagccctacaacgcgagtaagtgcggcttggaggtgtgggggttagagccaagagtggaaggttagcgtggtggggagaaagactcctgttacctcagctaactgatcacttctttcgacttctcttatacaggcagctgtccctttgcctccccgggcccgccctggacgtcctgccaaaaataagaggaggaaactggccccatagcagccatacctggagctggaatctgaccctgactggggagagctgagtgctgagccttgggagcccctgccagccacgtgcacctgtggacagtgggtggggcactactccccactcagagcacaaatgcaacccctcccctacaaatcccatcctgagccattgcaggggtagggaagctcacccctcccccccaaagccatgtcactgaagaggcctggggggtggtatatggcccctccccatcaggcgctaaggggacaccccttccccaggtcttttatttgtttaagttatttttgcacaaatgactcttttatatttaattcgacttcattgcctcccttcttaaagctagcaggctcagtttacaaacctgtgagctactgttggctgctgccctccttcccagtgaaaggtacagagcaataagcatcatgcatctccccgattcccactagcacccctctgcctctggctcaggttgctcaaagcacagatcccctcttatccctgtccccaggaccgaaacacatagcctcatttcaaagcgtagccaggttccctctgctttcctctgggatatggaaagggggccaagaggactttggatctctcctccatacacactacactggcccttctccccatcaagcgctcagagacggtgtgacgatgccactgggggttatgcagcgtggtccagccggagcggccagcatgaccagctgtccaggggctgcctcctgcctttttttttgtaaagacaagacccttgggagttttcattctgttttgtacttgccctgtggggcctccactgcttttctatgggagacactcttaatttaacagatgagaatattttgaaactctggttctgactctgtactcatttttttatttagctcttcggtaagaacagattacagctgaaatagtctcataatagtgtg

SEQ ID NO: 19364 - DNA, 3699 bp, Mus musculus
gatcttcctgggggagggcacagcagtggccagacactgggaaacttcctagtggcctggcattatgggaatttgcccacactcctagctgaagtcttctgtgcctagacaaagggaactaggccttcatatgtcaagaaattagggaatggttttgtggtccttgggagttgaggtgctgaactcctctggtctctagggactgggcttggaggggaccgttgtggacatggccagcagatcctgaggtccttacaggcgctacgtcatgttatttatggtcctttccttgagtgctctgggctgtggtgtttcttgagttggtagactgagaggcccttctctttccttgtattgcaggtgtgggctaagctggtggccccggctttagactggatcccacaatgtttgcagagatgttcaggtagccatggtggtatgacagaactctccctcaggtacccagcccggtgtaagcgtcctcgtgcccacatggatgtctgtgttgtcaggcacaggggagctcatcacacacaatgaatggagacaatgcgagcagtgcagcagacagagctgggggccctgccgccacgcctgtccccatccccatcgggtggcaacgctgtgtgcgagaaggtgctgtgtactatatcaggtatggcttttcagagttttcgtcccctcacccctcctctcagagctgtggttcctggcaccttgttgctctctgtatctctgcgtctctggatccattcactctttgtgtcttcccatgtcctttccgccttgcccttcccaggaaagcatttaactgtcctttaggaagtgtctccagataggctgagattaaccccatacttgtgaccctgttctttcccagcccaagtggcacagagctgtcttccttggagcaaacccgtagctacctcctcagcgatgggacctgcaagtgcggtctggagtgtccacttaatgtacccaaggtcagagctgtgggggtgccagagactcaatgcataagccaattacaaaccaccgtgcctccctgagatcccaccccctcactgtccctgtccatgcttcctaccttacaggttttcaactttgaccctctggccccggtgaccccgggtggggctggggtggggcctgcatcagaggaggacatgaccaagctgtgcaaccacaggcggaaagctgttgccatggcaactctgtaccgcagcatggagaccacctgctcacactcttctcctggtgagttttcctgccactttagagaaaaatgggggaaacctggggcctggaaggtggatgtgggggaggtgatctgagaaggcaggcccagggtggagtcagtgggggcagcttggtgagaaaggacatggttgtgacttgtgggcactgggactggagaagacagcattcgaggcagggatggacccacaagctgacccttgacttctcatttattgcaggagagggagcaagcccccagatgttccacactgtgtccccagggcccccctctgtccgccctccttgtcgagctcctcctacaactccacttaacgggggtcctggctccattccccaagacccaccttccgttccccaggccttcccccctctgacaggccctgcagggctcttcccaccaccccggcttcctgatccagttccctctgcaggcagcagcagcccttgtttcctcccaagaggcaatgctccctctccagccccacctcccccacctgctatcagcctcaatgccccctcctacaactggggggcttccctccgatccaacctggtgccctctgacctgggctctcctccagcccctcacgcctcctcttcaccaccctcagactctcctctcttccactgtagcgatgccttaacatctcctcccctgcccccaagcaataacccccctggtccccctggcccccctggtcctgccactcagccaccagtgtcttcagccactatgcacctgcccttggtcctgggatccttgggaggggcccccgcagtggaggggcctggggcacccccattccttgctagcagtctgctctctgcagcagccaaggcccagctgccccctcccagcactttacagggccgaaggccccgtgcccaggcaccctcagctgcccatgcatcaccccgtccctctcagcggcggcctcgccggcccccaactgtcttgcggttgctagaagggggaggccctcagacccctagacggactcgtcctcgggcccctgctcctgtccctcagccctttcctctcccagagccatcccagcctattctcccctctgtgctgtccctactgggactccccacccctggcccttcccactcggatggaagctttaaccttttggggtcagatgcacaccttcctcctcccccagccctctcctcagggagccctccccagcccaggcaccccattcagccctctctgcctgggaccaccagtggcagcctcagcagtgtgccaggtatgagtgacaagggatttctaagctcagccttacagccatccagggcacagggggcggggagggggtagtttggagagcactctggtgggttgggggtttgtgttggagaggttgggttctgtgggtgccaggaagagggctttccaggagctgagtttgttttcttttacaggtgcccctgccccaccagctgcctccaaagcccccgtagtccccagtcctgtgcttcaaagcccgtctgatgggctggggatgggggcaggcccagcctgccctctgcctcccttggctggtggggaggctttccctttccccagccctgagcagggcctggctctcagtggagctggcttcccggggatgctaggggccttgcctctccctctgagtctggggcagcctcccccttctccattccttagccacagtttatttggtgtgctggcggggggaggacagcctcctcctgagcccctgttgcccccgccaggggggcctggccctccctcagccccaggcgagcccgaagggccttcactcttggtggcttctctgctttcaccacccccttccgacctcctcccgcctccttctgcaccccctagcaatctccttgcctcttttctgcccctgttggccctgggccccacagctggggatggggaaggctctgcagagggagctgggggtccaaatggggagccattttcaggtttgggagacctgccccccctattatttcccccactttcagccccacccaccctcatagctttaaattctgcgctgctggctgccagcctggatcccccttcggggacacccccccaggtaagacccagggtatgagctggtggggcagaataagaattaaatcaggctgggctcttctctggggaagactcagtcttggctggggtagggtgggtgcaagaagggcgcacccctacttcacccaaagtcttagtcaaacaatgcatatggaggtgctgctgtacgcctgtccgacacttcactacacgcttaaccattcttcgtcttagccctgtgtcctgagtgccccccaacctggaccacctacctccagtgtcaccacggcaactactgacccgggggcctcctctctgggcaaggccccctccaactcagggagaccccaacttcttagccctctgct

SEQ ID NO: 19365 - DNA, 1187 bp, Mus musculus
ccaggacagcaaaagctacatagtgagaccctgtctaaaagagaaagaaaggaaaggaaaggaagaaagaaaggagagatttcaaagaggcttccaaaataatccagggaaagaaatgtatggtaaatttatatctggagccaggcagtggtggtgcacgcctttaatcccagcatttgggagacagagacaggcggatttctgaattcgaggccagccttgtccacagtgagttccaggacagccaaggctacacagagaaaccctgtcaagaaaaaccaaaaaaataaataaatgaaaaataaaaaattgcatctggaaataatgtagtaatgagaaatacttaggtttggggtacttttaaagttgtcagtgctttaggctgagctgtggtatctgagaaaggggcatcaaggataccaaagtttttggctttcagcacctagagttgccatttagtaagaactatacagccttggtaggaaaggcctttcatgtaagctgaacgcctgctcaacactgccaaggagctggagatcccagagcaggtctgcactgaggctgccagtggggggatggaatctgagcaagcactgctgagtttactcttccttccctctagttctgtctccctttggcggacttgaggtctatctgggatttagagaaaacttagttggccaggactttgctattatgtaatcaagacggcaaatgtcagcaactaaaaataaagttaagcctgcctctgtccttggagttggcttcagggacacacacgctgcaagacacacgcctgtgtgtgtgtgtgtattacaagagaagaaatggcttcagggacacacccgctgcaagacacacacacctctgtatgtgtgtgtgtgtattacaagagaagaactggagcctggtctgcagagttgttgagttccagaattccaggatgcccagggatgcacaaagaaaccatctcacaacccattttagaaaggatctagaaaagggctaggaggagttagaaaggatctagagaggggctaggaggagttagaaaggatctagagaggggctaggaggagttagaaaggatctagagaagggctaggaggaggctggaggtaaaggactgttttttccttttctccacagtgttccagaaggaagtgcatcttcatacaccaccacac

SEQ ID NO: 19366 - DNA, 1150 bp, Mus musculus
catgactaaaggctaaaggtatttaccttgtcctcaaaaccttccaagggcacaggcgttccccatttgaggtctctggtgatgcatcgtggcttgaggccatctcgaagccaggaacgtataatgaacctggcattgggtgtccagtcactgccaggcactgtcttccccaaccagtcctccagacgcttttccaactgagatgaagaaaagaccaacaggacagaggacccagacaggatgacaccaaggtcagtgagtaaggcgctgcacagctaagtcaggactacatatgtaaaactaaagattcatggcttcagggacatctaaacaattgttaacaaactcattcaacagaaacatccacagccaggctatggtggagcacgcctcccaccccagcactcggaagcagaggtgagcctggtctacagagccagttccgggaaagtgaagtaaccctgtcttaaaaaaaattccctcgagtctttaagatgtgtatgtaaagaaatgctgtctgtaaaagcaaaaacattgaaactaaactgagtacagtggtctgtggtttataattctggctcctcagaggcagaggtgagaaaagtaagtttaagaacttgtgaatgcttggcacacacttatgtatataatcaggaggggtgtgtgtgtttgtgtgtgtgggggtatgtttttgtatatataaacaattgtagaaaaagccatgagagggagcagttggaggaaaaggggaagtaatataattacattttaactttttaaaaaaaaagtttaaacaactgagcagtggtggagcacgcctctttctaatcccagcatttgggaggcagaggcagacacatctcatctctgtggatttgaagccagcatggtcgacagagtgagttttagaacagccagggttacacaaagaaaccctgactcaaaaaaattaaaaaataaaaattctcacagtttagatgatgaagtatggtatttgaagtatatgcatataatgaactattacaaggccatcaaatttttttaaaaaatgagattaggggattagagaaaaaaggtttgtggttaacagaagtggctgctcttacagaggacctgggtttggttcccagcacccacactgcagctcaca

SEQ ID NO: 19367 - DNA, 1290 bp, Mus musculus
tttctccttcagggtttgtgggctgggctggattcgctgtttagctgagggtggtcttgaactcctgatgctcctccttctgcctcccaagtactgcggttacagacagatagggaacgaggcctagctgtttccacctgccattcatagtccaaacttttaattccaaaattttttattttttttaaagatttatttattttatttatatgagtacactgtagctgtcttcagacacatcagaagagggcatcagatcccattacagatggttgtgagccaccatgtggttgctgggaattgaactcaggacctctggaagagcagttggtgctcttatccgctgagctgtctttccagccccattatttttattttttaagatttttatgttatgtgtatgggtgtttgcctgcacgtgttcctgtcaccacatgcctagagtgccctcagagcagtcgttcccaatctgtgggtcacaaccccttttggaccccatgaccctttgacaggggtccggtatcagatagcctgcaaatcacatgtttacattgtggcttataacagtagcaaagttacagttatgaagtaacaatgaaataattttgtggtgggggggtcacagcttgaggaactgtatgaaagggtctcaggattagaaaggttgcgaacccctgccttagagggaactgaattggagttcagagttatagctggttgtgagctgcagtgtgggtgctgggaaccaaacccaggtcctctgtaagagcagccacttctgttaaccacaaaccttttttctctaatcccctaatctcattttttaaaaaaatttgatggccttgtaatagttcattatatgcatatacttcaaataccatacttcatcatctaaactgtgagaatttttattttttaatttttttgagtcagggtttctttgtgtaaccctggctgttctaaaactcactctgtcgaccatgctggcttcaaatccacagagatgagatgtgtctgcctctgcctcccaaatgctgggattagaaagaggcgtgctccaccactgctcagttgtttaaactttttttttaaaaagttaaaatgtaattatattacttccccttttcctccaactgctccctctcatggctttttctacaattgtttatatatacaaaaacatacccccacacacacaaacacacacacccctcctgattatatacataagtgtgtgccaagcattcacaagttcttaaacttacttttctcacctctgcctctgaggag

SEQ ID NO: 19368 - DNA, 1194 bp, Mus musculus
tttttatttaagttttgtttattttatgtatgtgagtacactgtcactgtctcagacacaccagaagagggcatcagatcccattacagatggttgtgagccaccatgtggttgctgggaattgaactcaggacctgcggaagagcaatcattgttcttaactgctgagccatctcaccagcccagtaaagcactttttgcataaacctaacaatctgaatgtgacccccagaacccacatagaggtgggaggagaaaatggactatacccagttgtcttctgacctccatatgtgtgctgagccattcttgccccactccaaaaatcatggggtttgcttgtttttatttcatgtgtcctactgtttttattgcacgtatgtatgtgcactacatgtgtgcatggttcctatggaggacacatatgtagtggagaagagggcatctggagttacagatggctgtgagcctctgcaagagcagcacccctcacctatctctgcaggtctccccacttctacctttgagatggactttagccttggctggcctggaactcactgtatagaccaggctcctttagaactcacagagctctgtcagtctctgcctcaaagactctgcctttaacctgctagggttgaagataatgtgccactatgcccactaagagatacactgtttcccatgtgtgtactggctaacctgtcaccatcaccaagagatatactgtttcactcgactgaccaagagatccactgttttatatgttcattctggctaaggtatttacctataggccagctgcctttggcttagcctgaaatttcagctccttgggaggctgagacaggagaatttcaagctcaagatatcttgggcaacttacttagaccctgtcttaaaacgtaaacaaatgtcctggaagccacttgtgtcataagcaggttagtcccagtaggcaggaggaccagcaggttaggccagccttggctatatagtgatccatcctgtcattaaaaaccatccactaatcaagcaaaaaggtccagggtcagtggtagggtttttgcttagcatgcataaggatctagactgaatctttagtactgcaaaaatcaagaccatatgcaaattacattgtcttcttactctgtgtggtgtgtgtgaaagagaatgcagatgcacacatac

SEQ ID NO: 19369 - DNA, 1154 bp, Mus musculus
cccctagggtaaatcacccgcgttcacgaactttcttcccagaagaaaactgcccatcttttctccccgtactggaaggaaagacctataccataaagtccctggttctccggatgccccaaaccctcggcctctacggagtttcctttccttgatgctgttcccaaagctaactgtcctgggttgattgtttcagggtcatggggcctgaaagaggattcagagcggggagcaagggcaggcagggtggtctgagccagaggaggggcctcggtccccagatcccgcttgggcggggggccaacagggatacacaagctggcagtagccagtggtcccgctctgccccagtaggggtctcccggcgcctggcttcagctgccccggtggtcctgaggtcagagggtcaaaacaaggtctccccagctcttcctcttcctcgggggccctgcccacagtctttgggaactcagaagtccagaattcctagggattttctacggcctacaccgcatgttaggaaacccacccagcctcctcccgagtccaaacccactcctttgcccctaaaccccatgtgcacatctgtcacagccacaggtcaggagtccaatcccagcccggccctcaggggttctgttgcctggcacaccgctactcccaccccactgagcgctcccttcttttgcggtgggtcccgtcttagaaacactgacgtcttccaacggcgctcagagacgcacctggagttccctctaccacgcagacctccagctggccgtcccaactgcttcttcatcccaacctcaagaaagggagagatttctagtatgtgggagaggcgcggacaaagagacctgggacagacacagattgtcagaaaaaaagaaggggatgcagagaaaagaaggcacaaattaaagcaaaacaagaaaacacccaaacttcctaattgctctccccaaactctcccaaccccatattgcctctgagccccaggtctccttctgggatagggtgagtccctaggcgtcagagcatctcctcagcccctcccccatcgctcccaggtggtctcccgcctgcccccctctcacctccgtcggggcgcggtgctcgggatgcgtggtccagggctggaaactgggctgggg

SEQ ID NO: 19370 - DNA, 1192 bp, Mus musculus
ttatatggttgggtgcactaagattactgaagaaatagctgcctggcaacataaaagcacagatattaaaaggaattacatatcttccaactgtttctattgcttggttaaatttagaaccatacagggcttttgtagaattaaaatccctggggattttatagttaatagacagtattcagcttttcagagttaggaataatatatgtagcttcaaaatgatttttgtaccgtcactcacaccatttaattaaaacacagagaccaaagctgggcgtggtggtgcacgcctttaatcccagcactgggggggggggggggggcagaggcaggcggatttctgagtttaaggccagcctggtctacaaagtgagttccaggacagccagggctacacagagaaaccctgtctcaaaaaaccaaaaacccaaaaaaaaaaaaaaaaaaaaaaaaaaaaaccacagagaccagtaaaaagtcagaactgttctaagaattttagttcactgccatgttgctgaaagtggattagagcctggatttgatgtagtgaaggattctttttctttctcaggtgcattgcaagaggcgaccctgtccttcctcagtgtctctcagcagtaaacctgatacagttcctaagatcccgcctggatggaggagccagcaccatatctgtgctagaaatcaggtaagcatcacactggggcttacaggtaacgcttgtgatgcttggattgttttcggagttcatacagtttgagcagcaaataacctgtgtacctgtacggaccatcaacataaggaaaggtagacttaaggaggggtactttgttttttttttctttttgtttttttttttttttaatatttattatatgtaagtacactgtagctgaactcagacacccagaagagggcatcagatctcattatggatggttgtgagccaccatgtggttgctgggatttgaactcaggaccttcagacaagcagtcagtgctcttagccactgagccatctttccagccgaggaggggtactttgagtacataatttagattaagtagaatttaaaatagaaaactattctatagtaaatatctttagtgcatcatttggtagcagggaaagtaatgctattattgcatagtaagacattctggggatgtttgaaagtataaaacttca

SEQ ID NO: 19371 - DNA, 1140 bp, Mus musculus
ggcgggggaagaggcacaggtttcccagaaggaatttcttccggcaaaattccggcaggcagaacagatccttacaatgaggtctccattaataatgtgagctcgctgctggtgtaagtgcagatccatccggggtgagttttggataattttctttctttaaataaaagtccttggacttcacaggctgagagaggagaggtgacaaaaattggcattttaaaatagcactgttgatttctctgtacaatatacactatggaaattcagttttcaaatgttaaatattgtgggggttttctggacattttcagaggctgtttttatctttaaaatattttaaatattaggtttgctagaacttgtactgtttgctgatttctacttcttccatgattattttaagcaatgcctcattcagattttgcttatgagaatcactgtgatttctgttctctttggtgatgctgttgacgcacattgcaggaagcagggaatcccctataaatatccttcactgtgtcattacccagctctccctccatgcccgactggtgactgtgcctctgtgtcctgtgtctttatgtaactgtccctactcatcagatgtgttaaggagaaatatgtcgcctttgtcgcatctccagagcctttgtgtttacaagcatctgggagaattttgctaaactgttttcctacaaatgctgtttgatgtattctctgggtttgccactgttaattttgggtggcttgtttgttccttataattggcttgtttttgtttgctggctctggtttctaaagagtgcagagatgggattccctctgcctccagtgacgtattattttgtttgcagtctttttcttctgtgagggaggggtcagagagaaggaagaagaaaaatggatctgaagtctttgtgactcgctgccggctgggcaccactgactggagctgaggctggagtgggatgtttagccatagggtacctgtgcttgtttctcctcacagcaggcttagaccagagtcggatcgctgaagcaaggtgcttgaatttaaccccgtgagtgctgatgctaatgaattttacctaattgctatttctaaatgtagaaggaaaacgagctcatgaaggtttt

SEQ ID NO: 19372 - DNA, 1165 bp, Mus musculus
tgaatctgtatagctaaagcaaaggttaggaaggatttgcgaggtataaacctagttgtgagctttaacagccctagatggttagttttggattctatttgtgctttcagttccttttaagcctgtccattttaatatagatgatctctgaagggacctgcggaggtcagtttgaagaactcagtagactagagcctaggaaaagctaaagccgccttgtgtataaagcatgcatatttggatagcacatgccaacttgttcctttaacaacatgcctgtttattttctgtcttgatttatttcttgttttgtactgccattattcagaattcttcgtaagaagtgaaaaaaaaacctagattgggctgttttgcttagatatgcagttctattttctgtggtacctcagtaatttattatatccataaatgtttcagactaacaatttaactttatttagccggaagtagggtggaggagacaagggtagctgtagagtaaatgaagagcaatggatgctctctcttcactggagacagaggcagggctgcaagtgtggtggtaagcatggttccactgcggctctgcatcttgatatttcagcaaatatgtgggtaatttctcattagcttttcaggaaacccctgtggtggacagccctcctcagccgttgctgggagactgctctgacgtcactgtctgcagccagagcaggaatagcctgtgagaggaagaactgctgggaaattaaaagatgacagttttttaaaacgtggttttcatttgatttaggggtgggtaggatatatctaaagccttttttttttaaccgtttcagtcatttccaagctccctaaaaaataccaaaagattattttctttcaactaaaagtgtctttttaattttgttttctaattatcagggctttagtaaaggtcaaggaaaaaagctcttaaaggtgttagaaaagtaagattacagtttctttttatcattcgtgttctttcactctctcccttttggaggattagggaaagatcaaagcttttgtagagggtgatttagcataatttaagaataattaaaaacacatgttgggaagacattttggcaacactgactgtattgttttatatgatttatttacttatctaattgctgaa

SEQ ID NO: 19373 - DNA, 1173 bp, Mus musculus
ttgattggacagttctcgtgggataaccagcaaggatagaagaggaagatagagaatccgaggaagggggagggtatctcatcaattcctacttctgtgagatattagagatagattctgattagagatagttcatgaagactggccctagcttctgtgcaccttgcataggccagacacaaccttgaatgaagaggtgttacaccaaagaacagacatcatgtagtggtgtgcacctgcaatcctagcactcagatcgaggcagaagactcaggagttgagagctactatacaagttgctgtctcaataaaggggagggaacgtcacacaaagatttcacttgaaccttcatgtgaccttttcacttttgtggtgattcctaacagcaaaaattctcttgaatagagataaggaatttaggagaagtgtgtgtagaagttcttctccctaacaaaaaggtctttttccttccttcttttcacatttctttacaaatcttagccctgaacagaggttctcagaacatataaaagatgaaaagaacacggaatttcaacagaggttcattctcaagagagatgatgccagtatggaccgagatgataaccaggtgaagaatggaagagggtgggcctataaagagagaaactgggaagggagaaggatttgggggaatggaaaaaattgaaaatatcttaaaatggaaaactacacagcgctgttctcctgagttgttggggcttcccactgaggactggctacagttgccgtgctcaaggccccagagagacagggtgctgaggtctcatttggcccacagctctttaggtttgcctctaacttgtaactacgtttcattttggacaaacaaggtttctccctgtgtcagccttgatgtagctgacttcagtgtcatctctttgctcaacccctccctgtcttgcagaatttacactgggagctaccaaaataaccaaaagttactttatcccatttccactcttctagccaagggctggccttaaactggcaaagttatggtctaatttaaccagttacagaggtgtgtctttgatcccctttgataaactacttcatctttcccagctcctttcaccatggtgagttaatctgactttgagtgctgggaactcaggtccctttggatccac

SEQ ID NO: 19374 - DNA, 1129 bp, Mus musculus
aagcagtgacactccacacaaagatacacacatacgtatcaataaaaataaatcttaaaaggaagtggaaaaaggagaaagacatcccccactgttagcaaggatagagaatttacatttttaaaaaatttttaagatttattttgtgtgtgtaagtgtctatgcaccacatccgggcagtgcccacagaggctaaaagagggcattgaattctctggaagacattacagacacttgtgagctgccatgaggtcctcggaatcaaactcaggtgttgtgggagagcatccagtgttcttaaccactgagccatctctccatccccctctgactcttctttttagacagtgccaccttgaagtccgtctgaaaaccagaggctgagtgggctttgcactgttgatagtaccaaagatatgtacaattgtcacatttaagaaaacacaaaattctgctagatagtatatactgtgtagtcataattatccccgagaacagtgcctttcttagatctgctcagctctgtcttacccggttcaactttctcagtgtattgacctgatgaactggtttttatcagaagaaaccgaaggtagagatggagtagtgagccccagtttctgtggctgtaagtggcgaggccgaggctgattctgtccactgttcttttattgtcccacaccagctcctttcagacagcccttcttcctctcagttctatttgaagcctaattcagattcactgctaagagtgatgtttcctgggagcatcaggctacaccaaactgtgcagataatagcttgaagaattgggtaagcaggtgcagccctcacctctccgaatatttttttcaaagcctgaaaaatcagactgtgtttttgattaaagacctaggtgaagaccagtgagatggctcagcaggcaaatgcagctgccaccaaccctggtgacctgagttcagccccaggagtcaggtggtggaggagagaactagcccctgggggtatcctctgaccttcacacacagatataaaaaatgactagcaattacaaatagaagtgggactagaacaatgcccagcagttaaaagcacatagtgggggctggtgagatggctcagtgggtaa

SEQ ID NO: 19375 - DNA, 1136 bp, Mus musculus
atgctgtgagcttccctcttctcccgaacaatagattttgctgtcattaccacattccttcccaaagaaacttgcacatacctccagccctggcccatgacccaaacccaaacacagatcagacaagcactgtgcccagacatttcagcaatctgacctgggtgtttggtaacgctcaatttggacagaatggagtaattgttctgccaatcataacaaaatgtccctcagcaggtaaaggacaggagagcactggcatctggttccatttcttctccactcaagcctctactatgtaggggtggagggctgaagctggggtgagaatcagaagccgagtcagcagccgtttcagattcttggcaggacacagttagaatggccctgaaacaagtgggtggatttgcttgctggcttttccattcagagataactctacgttcagaatagttcgaatacccaaccactgatttcctcctgctactcaggagtgtcaccttctggaccaggtgtggtggtcatgcaactgaatgtccctaacggaccccaggccccccagaatccatccatggtccaatggagtcactgcaaatactacagcgtggagcagcgtggtcagaagcctggagacctgtacagccctgatgggagcccccaggtaggcccagccctggtcatttgtttcgtttggtttggttttgaaacagtgtctcactatatagctctagctgtcctggaactcattatgtagaccaggctggacctcaaacactcaaattcacagagatccatctgcctctgccccttgagtgctgggattaaagggtgagtcactattcccagcccaacccttgtaggccaggttcttctcaggaagaatcttcatgtcatcaaccaagcagcctcttttacacatctttctccagatgttttaagggagaaacatgaaaataccaaagtgagtcctctctcaaggaacccagttatagaacagttgtagaccacgccagacatgcttggagcagagtctgcatgggccagggatgagtgctgctcagcagttaccacaagctctgggctggagcaggcggcatctaaagaaccccaggttgacctccaccctccacaaactcgca

SEQ ID NO: 19376 - DNA, 1833 bp, Mus musculus
catgtttactaattctggttcctccaatgctttctctaagctgtgccttccaaacacacacacacaagcagacacagaaaaaacaactaactacagggtagggctgttggtataagtgggtggttcactgcttgcctcgcatacgtgaagtcctggaagtaagaatagcacacagtagcacagactggtcaggacgcaggacggcagcgggaagcagtggtctgacctgggcagtgcttacgaggccgctttgtctcttgacagttgtgacttggaagctgcgggacatagaaaggataatgtgtgtttgtgatatgtgttctctctcacaggccaacgcacaaatgggcagcagccccgtcacatctcctacccagtctccagcaccctctcctgtcacgagcctcagcaacgtctgcactggactcagccccctgcctgtcctcacaccattcccccggcctgggggtcctgcacagggtaggcagtcagatgaagaggggctgctctggggctcagcattccttttccatacaaggtggaagactagaagatagcgacaggcagggagacaggacagaagcacatcctctgacatctgctgaggcaaaggacacccgcctctcctgctgctcctctgtaactgaccccagtcctccttcacagacttggtattaactagggaatgtgaggctgagtcagaaagggaggggctttgctttaagattgtttctcgcagggcagtggtggcacaggcctttaaccccagcacgcaggaggcagaggcaggcggatttctgaattcgagaccagcctggcctacagagtgagttccaagacagccagggctacacagagaaaccctgtctcagggaaaaaaaaaaggttattttgctaggcatgccttaggaggcagaggcaggaggatctctgtgagtttgagaccagcctgtacgttttgaactagattcatacgcagttgtgagatgctaatgtgagtactgggaaccgacccaggtcctctgcaggactcagtgctcttgactgatgagcatctttccagtatcaagaagaatttgatttctaaacaggcaacaatgaatttcagttacaacacctgggttacagctccagtacaaacttgctgatgtttaacaagttacttaaatttataaatagaccttagtttcctcatctgtaaaatggggttaggcatacttaagatggaaatagtcttattgctttttgctttgactgttacaagtaatctaaaagtaagattaagatactgtttaagaacttcaaaaaaagctttttttaaaatttattcattttatataggtgagtacactgtctctgtcttcagacataccagaagaggacatcagatcccattacagatggttgtaagccaccatgtggttgctgggaattgaactcaggacctctggaacagcaatcagtgctcttaaccgctgagccatctctctggcttgtttaaaaactttaaaaatactctgaaataagacatttgtgagtagtaagttacacagtacttttctgtcacaggtgttgctataagtgctttataggctgtgttcagccagccgtccaacagcagcacatggggactctctcagtattgagtttcctgttacacagccagcatttctgactgggcatcaggctccaagcctgtgtgcgctcttgtccactcaggactgcctctcatgagtcagtgaggaggaacactcatcaagctcactctcactttgtatcccagactggcttggaattcactgtgtgtagtccaggctagcctcaaactcatag

SEQ ID NO: 19377 - DNA, 2107 bp, Mus musculus
cctagaagccctcctgtccctaatctagggcatctcccctgggtcatccgaggcctgacttgggaatctaggagaggggctttcctcctcaggccttgggataccgcagtccagctgttgcctaaacgaggcaggagaggatggacaggaaggataaagggagcctctgggtgggacaggaactacagatcatacttcaggttgagctactgccttcattaaaggatgacgctctgtgaaggaatggagttgtaggtgcagctcagaagcctgagattccaattctcagccccttctttcttattcctctaggttaggagaaaggaaggctcattccatctttctgtctgccctctaccctaccttatcttggtggggttaagttaggttgatctggggaggctacgagggacaggcaggactttggagggttttttgtgttttttgacacaaccaggccactgtccagtctttcctctcacagccatttgtctctccttccctttcagtgcttggaagggtgctggaggtgactgacctccctgaaggaatcacccgtacggaggctgacaaactcttcacccagcttgccatgtctggtgccaagatccagtggcttaaggatgctcaggggctgcctggtgcaggcgggggggacaacagtgggactgctgagaacggccgccacccggacctcgcagccctgtacacgatagtggctgtgttccccagccccctggccgcccagaacgcctcccttcgcctcaacaactctgtgagtcgcttcaaactccgagtggctaaaaagaactacgacctgaggatcctggaacgagctagctctcaatagctgggggaggggaggggctggcacagtgggagcaaaggccaagcacagggagccaaggcggacggacagacggatgactggcccaattccattatggctgaagagagaagcaaacagattcttacactggcatgggactcccttgccacggttcccccttttccctggttggtccccttctgtctccccctccttcccatcttctatcattttttaaatctcttctcccaccatgaaattaatttctttcatatttttggccgagtagaattgagaggctctgccctccccttttcccatttcatcaccagcccaatctccctcccctcttttggtcttcatgaatatatttatatggacagaattaagaaaaataaattgatttccccattcgttcactttccccatctcgtctccccaaaccccacagagttaaaacttgggactcccctcatccctaatccatccccagagcacttgtatattgtttgtttgaggtttgtgccacagtgacagacacagtatttaattgcacatacagatgtttgctgggttcactgtaaattttatttaatctggttttttgtttgtttgtttgtttggggagttacttggggggaggttggttttgtttataaatataaaaaaagcaaaaaaacctgtcactggccatcagtcgctgtttgtttcactgtttctctgttcgtgtgggctgggttagaagccctgagtagacccagttccacagctgctgagaggggtttttataggttaagaagatttccctagcatgtgcacatgtttttctaaccttttccttccggcctctcccctcccctgtacacaattctcagcaatggatgagtctctgaattatggtctatggttctcacactcggcaaactgctcttgatcaagctcgttgcttctcagcgctgggcctttgtgtctatatcagaggtttcttcttgctcattaattctaatattcattacagcctgactactgagccgggcaagtccagtccagaactaggtcaggatgctggcctcattcctgtccatctgatcttctgaaaaccttcagggatggagaccttgcacctttaatccttaaaagcttaggcttgggttcttggcaggaacacaaatggcagttacttataataaaaaacacctgaacttgcagtgccaaggtggtcactcaccagtccctgtccccgtcccctgcagttgacagaactgagactcgcagatc

SEQ ID NO: 19378 - DNA, 1595 bp, Mus musculus
tgaggcttggtgagaatctggggtctgcggagggaagggtcccccacactggggttgtctgtatcttggctatgctaattgtctcctgctctctctcccaggggcccccgcgttgacctctcgccagttccgtgaggacgacttccgtagagtcgtcgattttatcgatgagggagtcaacattggcttggaggtgaagcgcaagactggtgagtagcttcagaggtccttggtcaaccagtttcacccgcctccccgcaccctagctcctggccccgcccagcagccctctgatcaacttctcccaccgatctcagccaagctccaggatttcaaatccttcctgctcaaagacccagagacaagccagcgtttggccaacctccggcaacaggtggaacagtttgccaggggcttccccatgcctggatttgatgaacgttgaggacagttgaggacacctggcggtcggtcagaagcccacagacccggaagttacctttcttcccgcctccctggaccatagaagagatgtcactcctctctgggttttagtggagggagggaggccttccatttagggcaagagccaggcataaactcccttccagaatttgtagctgagatttctgatctttaaccgtgtctacacgaagcacccagttgacatccgacttgtttttgagacgggggtctcacttagctgtgagtggccttgaactgacccttccaccttcatttcccaagtgctggggttataggtttgcaccatgacacccgacttcgccctcagctttccaccccgaccctcccactacatctcaagtgttacagactcccctcccgctctttcttggggaagagggggtgggtaagcgccctccttcctgtttttatctaataaaatgctaacctgcccagggttcctattactgtgggaggggtcccctgggccagccagcgattctactccctcaacgtgtatctctccttccctcccaccaccaccaggacccccggggctgtagcctcctctctgatcagagccgacaccagacgtgattagcaggcgcagcaaattcaatttgttaaatgaaattgtattttgcccacggctgcttctgtttgatccccagggacagagaagcaagggaagggaggggtgggggaaaggcacaagactgcccaggtgcaaggcgggagggctgtccttgaccggaggctgccggcttgggcagggaagaagcccactgcatggcagagataccccatccgagtcaggctgggaacccaggacgagcccagtcgagcctgggcagacaccgccctgaaccctgctcaaaactctgtcaaaacaaacgtggggcctgccacgtccctggcactcgggcccctgcttgctgctggcacacgtcggacacgctcaacacgtagcctgcgccacacccagtcaggaggagcagggagcggcagggggagagggggactggcttgggtttttgggtcaaccccaactgtcgtctgcagtcgagtcccctcccccacgtgggactcaagctgagggtcagaggctttttcctctcctgggagcaagg

SEQ ID NO: 19379 - DNA, 1197 bp, Mus musculus
tggggtgatcaaggcaaccagaggtgttacacagaagtgggagctggggtattctaatcatatgaacctttttttttcccagcctaccaacttcaccaacccagtgtatgccacgctctacatggggggccacggcagccgccattccctggccagcacggacgagaagcgagaactgctgggccggggacctgaagacgagataggagatcccttggcatagggccctgccccgacggatgtccccagaaagccccctgccacatgagtctttcaatgaaccccctccccagccggcccttctccggccctgccgggtgtacaaatgtaaaaatgaaggaattactttttatatgtgagcgagcaagcgagcaagcacagtattatctctttgcatttccttcctgcctgctcctcagtatcccccccatgctgccttgagggggcggggagggctttgtggctcaaaggtatgaaggagtccacatgttccctaccgagcatacccctggaagctggcggcacggcctccccaccacgcctgtgcaagacactcaacggggctccgtgtcccagctttcctttccttggctctctggggttagttcaggggaggtggagtcctctgctgaccctgtctggaagatttggctctagctgaggaaggagtcttttagttgagggaagtcaccccaaaccccagctcccactttcaggggcacctctcagatggccatgctcagtatcccttccagacaggccctcccctctctagcgccccctctgtggctcctagggctgaacacattctttggtaactgtcccccaagcctcccatccccctgagggccaggaagagtcggggcacaccaaggaagggcaagcgggcagccccattttggggacgtgaacgttttaataatttttgctgaattcctttacaactaaataacacagatattgttataaataaaattgtaaaaaaggaaaaaaaaaagaaaagaaaagaaaagaaacccactgtgtctgcatgctaatgtgagaatttgggagctggggctgtgcttgcctgttccagccaccagagggagcattgctgcatgctggaggctggcctgagaatcctaaggtccacgtctccagccccactccatcctcctgtcttgctatggcagggaagagctgttttgctcagtg

SEQ ID NO: 19380 - DNA, 1099 bp, Mus musculus
gctcattgaaggggacagggtgtttcctcacaatacccaggagcgtccacaccaggccaggtgccctctcttccatctcactctgtctccttggccctgggatccaacccactctcatttctcccttcccagcaccatgtactggtcagactgggggaaccaccccaagattgaaacagcagcgatggatggcacccttcgggagactctcgtgcaagacaacattcagtggcctacaggtccctggggcaggggtagggtgtggaaggggcagactctgatcatggctgcttcagaagtcacccctgcgtgcagtggggcgggcaatctccagcagatcaggccgagggccatgggagtgcttcccggatgggcggctgggagagatcctatgagccgggtaggatacatgccgtggataccagacagagtcagctctgttctctgcgcccagcctggcgtgacagaagctgatctctgacagacagcattctctcaccccagggctggctgtggactatcacaatgaacggctctactgggcagatgccaagctttcggtcatcggcagcatccggctcaacggcactgaccccattgtggctgctgacagcaaacgaggtgagggtgctggcaggcttggttcccatcatggtccccaacatcatcatcaggcttctcactgagctcaaggatgtctcttcagaagcctggcacccagccagcccgtgagcctgcgcctacctgaccattttattcactctaccaacaagtatcaagttgtgtggggtcagcagggtaaatgaagggagagagagctaaagtcccccatggccccagaaatcttgggggtgatgagacaatttgccagtggcagggatagttctagatatgttaggtctgagacgcctacactgacaggtgtcttaaagactgggtccagggcccaggcgcctgtagtgacttaacctggctgtccctgcaccccaggcctaagtcaccccttcagcatcgatgtgtttgaagactacatctacggagtcacttacatcaataatcgtgtcttcaagatccacaagtttggacacagccccttgat

SEQ ID NO: 19381 - DNA, 1408 bp, Mus musculus
ccacagcaaggatgctggagacctggcttctatactccccagtggccagctcttccctaccacttgcccccaacactgattgtggctctgtctcctggcttctacagcccggttcatctgccctcccaaccggcctttccgctgcaagaatgaccgagtctgcctgtggattgggcgccagtgtgatggcgtggacaactgtggagatgggactgacgaggaggactgtggtgagctgagggcaatgagccggggctgaggggacctgcatctggggagcagactgctataaggctttcaatctggcaagagtggagcccttgggaaaggtatgggtggcctcctggagccctgagtctgcaaggtcagcacacacaccctcagcttggcgagcagccaggacacacctgtgttcatgaagtctctgtggatgtacgggtagtgtgctctgtatccagagcctaaagcctctcccctccccagagccccccacggcccagaacccccactgcaaagacaagaaggagttcctgtgccgaaaccagcgctgtctatcatcctccctgcgctgtaacatgttcgatgactgcggcgatggctccgatgaagaagattgcagcatcggtaggaccagacctgagagcagagggtgggtgggcaccagggggtgtggctcaggggaaaaccagagggcagggctcaggggaaaaccagggggccgggctcaggggaaggactccaccatctgtcctccacagaccccaagctgaccagctgtgccaccaatgccagcatgtgtggggacgaagctcgttgtgtgcgcactgagaaagctgcctactgtgcctgccgctcgggcttccatactgtgccgggccagcccggatgccagggtaggagagccggatgggagatggggcaggaaccccagctcctagactcccccatgacgcccagtgtaacccccagacatcaacgagtgcctgcgctttggtacctgctctcagctctgcaacaacaccaagggaggccacctctgcagctgtgcccgcaacttcatgaagacacacaacacctgcaaagctgaaggtgctagaggccggaagggccagaagggcctgaaggggcagggccagaaggaagggtggaagggcctgaaggggcagggccagaaggaagggtgggcagggtcgggccacaccagctataaaatggagctggcctggagtggaacattcccaatggcacttcgttgctcagacttggatgcccagactcaaggtacaccgggatgccatcccgagcaaagcaaagcacaggaaaggtagaaggtaccgcctggctttctggggaagttctatgagagcaacactcctgtgtggcacacagtgtcccctcccctctccta

SEQ ID NO: 19382 - DNA, 1153 bp, Mus musculus
gatgtatttcaggcagctgtgggattgggcagcaggtggcaggtagggagagggcttgatacaatgtagctggagatagcctggggtaccagggctgctggagatagcctgggggactagaggtgctggagatagcctgggggaccagaggtgctggagatagcctgggggaccagggctgctggagatagcctggggtaccagagctgccagaatatacctaagcttggagctgagccgagaccctcctcctacagatgaggagccatttctcatctttgccaaccggtactacctgcggaagctcaacctggacggctccaactacacactgcttaagcaggtgccaaaaccaagccttctttacacccgttgttgactgcccgggcccagtatggcctccccagttcttcccaccgccaggccatggttgtctccttctccctctccctccagccacatcctgactccagacatccttccccagatacacatgtgcccctgcggcagctgacttccctgtccccatcccaaacccagggcctgaacaatgcggtcgccttggactttgactaccgagagcagatgatctactggacggacgtgaccacccagggcagcatgattcgcaggatgcacctcaacggcagcaacgtgcaggtgaaaacagaaggctgccccgtgtcggctgacaggcacaccagggccccgctgacgagcctcacaccctccccatagtcctttgctgtaaaagagtctccccttctctcacacctgtcaacactgcttcgccctgctcctccctgagccacagaaacgttctgctcgcttcaccttcccctcctctcaactcaaaagtatgcaagcacaggagactcctcctgccttcccttgagttctgtgtgctctaggcgtgtgtgggtggccccagagaccccctgcttggagctcctggtgatagccacttacggtcaggagagtggagaagccatgccccggagactgagggtgccaccagctcctccttccctgtgttccttacaggttctgcaccggacgggccttagtaacccagatgggctggctgtggactgggtgggtggcaacctgtactggtgtgacaagggcagagataccattgaggtgtccaagc

SEQ ID NO: 19383 - DNA, 2197 bp, Mus musculus
tagtagcctctatcctctctgaccttgctttttctccctccatagaggtagtgagtcagtgggcagcaggcaccaaatctgaaaccataagtctaacatggggccagcaattgctcccatagtgtgtcttagaaggagctaggtgtgacccctcacccaccctcaccaccccttctattccatcttccacattggcccctaggtggcgccctgcccttcctcttctctcgtgaccccactgacccaccctccctccaccaggtaccacagactgcagcagctatttccgcctgggcgtgaaaggtgtcctcttccagccgtgcgagcggacatccctgtgctacgcacctagctgggtgtgtgatggcgccaacgactgtggagactacagcgatgaacgtgactgtccaggttggccagcggaagctcgccgggtgaacgggagacccggggctggcagtgtcttcatggctggcagagtcttcacatctcccttctacccccaggtgtgaagcgccctaggtgcccgctcaattactttgcctgccccagcgggcgctgtatccccatgagctggacgtgtgacaaggaggatgactgtgagaacggcgaggacgagacccactgcagtgagtgccctgggaccctacccagctcccacctcacagtccttatggaaagcgccctacacggggagacacctgggttccactgtgtctcatcctctcagactccagaatagagtcacttcttcagtttgtgatgagtcgctcacctgccctgcctttccttgtcttcttattactttctcctctattccagacaagttctgctcagaggcacagttcgagtgccagaaccaccggtgtatctccaagcagtggctgtgtgacggtagcgatgattgcggggatggctccgatgaggcagctcactgtggtaagcagtggcctgaatccggttcagggcggtcagtgtcctaccccctaaagaagggtccatataccagtgggccatgttatcacggctgcctgctctgccctgtcccctcctgagtctctctgtgtctccttgcccctcatgcagaaggcaagacatgtggcccctcctccttctcctgtcccggcacccacgtgtgtgtccctgagcgctggctctgtgatggcgacaaggactgtaccgatggcgcggatgagagtgtcactgctggctgccgtgagtgggagaggccgtgaggaatgggtgggcatcaagcctcgcagccttgctttgcaaacactggcaaatgaggtcaagggtaggaagaacttcagtgggagccgtgcgtttaaggagatcacagatccagacccctcccattctgcccattgctaccactcatgttgcaggaaacttaggattgggggtgggggagtgactatcaacagctagtaagtagggcagggcaggagtagggcaggcctgaggagggactctgcctccatccccagtgtacaacagcacctgtgatgaccgtgagttcatgtgccagaaccgcttgtgtattcccaagcatttcgtgtgcgaccatgaccgtgactgtgctgatggctctgatgaatcccctgagtgtggtgagtcccgtgactggaggagtagccctgcctagccgtgctggaggtccagcctcatcatcccctcccccaccacagagtacccaacctgcggccccaatgaattccgctgtgccaatgggcgttgtctgagctcccgtcagtgggaatgtgatggggagaatgactgtcacgaccacagcgatgaggctcccaagaacccacactgcaccagcccaggtcagcctctaggtggagccctttctccttcctgtgaccccactgacctgttcccaccaccctccatgttggcctctagatggctccctgccccttcctcctcctcttctgtgatcccactgaccagttcccgccaccctccacagagcacaaatgcaatgcctcatcacagttcctgtgcagcagcgggcgctgcgtggctgaggcgttgctctgcaacggccaggacgactgtggggacggttcagacgaacgcgggtgccatgtcaacgagtgtctcagccgcaagctcagtggctgcagtcaggactgcgaggacctcaagataggctttaaggtactcaggggatccgaccagagccctt

SEQ ID NO: 19384 - DNA, 1703 bp, Mus musculus
cccaacatttctcaaacccaactccctcaagacacctgtgtacatacatggacttgatatactcaggtccatctcatgcaaaactgcatgcgctcacgcacacgcacacacacatgcacacatgcacatgcattcgtactgttcatgaccctaggctcgtccccatcccaggagatcctatcactcagcctaataattccatctacccagagccacctacaccctaaaccttaccttatacccacataccaggtgtagcctatcatcccctcccccagcctgcacatagacatacatacctacacctggccctctcttgtgtgtgtgtgtgtgtgtgtgtgtgtgtgtgcagtgtccacatgccaccccatgcgaggttctccccgctgttgtgaacccccatggctgctggggtcgtgcagagctctggaatgttaggtgggcaatttgggagtgtacagggccagggaaccctcttcagctttcggtccccccactcccacccctgctcaggtgaactctccccctgccgtatcaacaatggaggctgccaggatctgtgtctgctcacccaccaaggccacgtcaactgttcctgtcgagggggccggatcctccaggaggacttcacctgccggggtgaggaagcaagttggagctgggacaggggctgctgtggggtgtcagcacaagagacccttattccagactccagcccaggctacaaggctggactcaggctaggtcgcaactcatgacaccttctccctccgcagctgtgaactcctcttgtcgggcacaagatgagtttgagtgtgccaatggggaatgtatcagcttcagcctcacctgtgatggcgtctcccactgcaaggacaagtccgatgagaagccctcctactgcagtaagggccctgctccagcccctcccccagtcccctgtgccatgtgacccagctccatagcctcagctcatgaagagcagagcttggaccttaggaagggacggtcattggtggggaggggggaaagaagccccttcctatgcctgctgtgaccacgcacaccctcccctcacagactcacgccgctgcaagaagactttccgccagtgtaacaatggtcgctgtgtatccaacatgctgtggtgcaatggggtggatgactgtggggatggctctgatgagattccttgcaacagtgagtacatcccagcctcacccccagtaccctgccacacccctgccttacccctacctcaccacagccatctgcctcaccctagcctcctgcctcaccacagccatctgcctcatcactgcctcctgcctcacccctgcctcatcccagcttcatcctagcctcctgccttacccctgcttcacccctgccctcacccctggtttttagtctcagactgtaccccgtcctcactccggctgagcatttgtccccaggcactctgaggacaggcgagaactctgtcctgggcctttctggccctgcagagggacactggcctgatggtactggtgggccctgttctagagactgcctgtggtgtgggtgagttccgctgccgggatgggtcctgcatcgggaactccagtcgctgcaaccagtttgtggattgtgaggatgcctcggatgagatgaattgcagtgagtaacagcctgctcatgactgacagctggcccatgac

SEQ ID NO: 19385 - DNA, 1208 bp, Mus musculus
ctggcccaacgggctcaccgtggattacctggagaagcgcatcctctggattgatgctaggtcagcagcatccgggcaggggagggacaggaccagcatgaagaaagatgaagccaagaggaggatggggggaggggaactgacagatgagaaggagcagggttgtaacctgcagtcatccatctaccctccgctcttctcataccccgtgtcctctgctgagggctctgcctgcccagggcaaagagaaggtgccttttcctaactcaccctggagctccaaacgccaactgtagccctgggaaggaaatctagaagattcccttggggagggcataaggctaggatcccaacccatgcaaccttgctttctctcttcagtcccaggcaggacttgggaaggggagttccctggtgtgttgagttgtgaggatgagggaaggtgggcacctggcagggcaccttgctgagacccccactgacccctccattacaccctcaggtcagatgccatctattcagcccggtatgacggctccggccacatggaggtgcttcggggacacgagttcctgtcacacccatttgccgtgacactgtacggtggggaggtgtactggaccgactggcgaacaaatacactggctaaggccaacaagtggactggccacaacgtcaccgtggtacagaggaccaacacccagcccttcgacctgcaggtgtatcacccttcccggcagcccatgggtaaggggccttcaggcgactgaagaggagccaccagcccttggatgggcgtgggggaggtgctgggataatggggtgtgaggaggggatgagacctgggtgagaagggccagggagggatcaacacatcccaggatgctcttgcttcctctctctgggccagctccaaacccatgtgaggccaatggcggccggggcccctgttcccatctgtgcctcatcaactacaaccggaccgtctcctgcgcctgtccccacctcatgaagctgcacaaggacaacaccacctgctatggtaggaagccatctcctcctctaacagttacgggtaaactgaggctgaaggagaggtccctgctgttaagcaaaggaatgactggaaggaggggctctgaaaacttgctagcgctggaggaaagagccacaactgccaagatctgacacagtctcttcacagttct

SEQ ID NO: 19386 - DNA, 1212 bp, Mus musculus
ctggtggctgccactcggatgagttccagtgccgcctagatggcctgtgcatccccctgaggtggcgctgcgacggggacaccgactgcatggattccagcgatgagaagagctgtgagggcgtgacccatgtttgtgacccgaatgtcaagtttggctgcaaggactccggtgagagggggcagagcagggcggggagcttcatgagtaggaggaggccatcttgaggatgtaacagtggcttggtgttatgtagaggaaagggcaagaaagagccagagtctgtatgaaagaccccgggaacccaaaccctggccagaatcgagcaccggcaccttctgcaggttctgcaccttcttcgttagctgtgtgggtttgacagaaaaggtttcaaggtttacagtgggctcctaagcacttcagtgaagacattcttagctgggtctgggcagggcacagtgagttccactctccaggcctggttcctcattctgtccccatcctggtccctcagcccggtgcatcagcaaggcgtgggtgtgtgatggcgacagcgactgtgaagataactccgacgaggagaactgtgaggccctggcctgcaggccaccctcccatccctgcgccaacaacacctctgtctgcctgcctcctgacaagctgtgcgacggcaaggatgactgtggagacggctcggatgagggcgagctctgtggtgaggcgcccatgcagggcctggggttgcccagcagtggggagaggggaggtcttgtccagggtaggactataggaaatgatctggggcagaggaggcactgacctaggacttgccttggccctgcctgaggtgacaactcctgtaacaattactttacaaagtggcccaggtagacagccactgtctgccaccaactgaggaagaagaagcacagagcccttaaataaactaatccagggccatcccactctgaaggcagggcagggagggagccgttaagactcctgacctgggtcagacaccctcagtcagaccactgaaaagggaggccaggctgggggtgaggcacagggttgaggcatgatttgagctgacttctggaggagggaatttaactgggttcccggaaatgggcaacgtgtgcagaatgagtgaggagggtcgaggagatctgagcaaaccacaccgtcccagaacaaacaagtcatctgact

SEQ ID NO: 19387 - DNA, 1176 bp, Mus musculus
atggatccttcttatccagagaactcccccgaaagctgaagtttctgcccagctgccctctgcagataacatctccaggccacgctgtgtgccaagggcagctccccagttctcatctgggggtccagtggtaaggagtaggagctgggtgatataggtcaagaggccagtagtgtcctgaggtcagaagcagaggttaggaaaggccagctgctggctgtcagtgggaacaagaggaacatggaggaaaggcacagcagagggctctgccctgccccgccatcatccctggcagggtgaggggtgctggtgtctggtgtggtgacaaacagcaaggaggtagagggacatgctgtacagacaacctagaaaacttgggaaggggtgataagatcctcttggctcctccagtgttccagacctactgtatagagaggatggatgctggagaagaacgagccttaggaaaccccagggtccaagagttgacttctgtccttccttgacatctaccctttctttccttgcctccagcccctaaaacttgcagccctaagcagtttgcctgcagagaccaaatcacctgtatctcaaagggctggcggtgtgacggtgaaagagattgccccgacggctctgatgaagcccctgagatctgtgagtaccttcccgggcttgctctctccagataagagcagccatctctagcctagcatggaccttgctctgtgcttgtatttgcccgtgacacagctaaaagtgtagccgcttctccggagtgcctgcagggtgcctggtgtgtgtagcagcagcacctgggatttctcctttggctgctacgtgcccaagactattggggacagtatcctctggggctgcatctctgtctcggggagataaccgcgccaccctttccttcgagcatttcctctggctggtgctcactgagcagcctccaggtcttgccaggtaccctgctgcccttagtcccaggccaaaggccactgccctgtaccagaagccccacccctgtgcccttcccgacaccctcccctcccctgcccccaataagtggtgtaatcagaggcagctgtttaaactgggagaaaggtccccacccagccttcacccatccagtggccaggatggggaatggttcatagggtagaagacttg

SEQ ID NO: 19388 - DNA, 2024 bp, Mus musculus
aggcctcacctgcaaatgccccccaacatgagccagataaccatgccctttgaccagcctcacccccagtaagtgacaaagccattcctggccccaccctctctgttcttcccttgcctaccccacccctcctaatttcctcttctgacccctggcaggggtctgctgcagtgccagtcccaggaacatgctgtgtccagccctgaacccatgctttgctcagatgtgactatggtagaggacagctgcctaactcagcctgtgggaggtttcccccaaggcacctggtgagtagcaacccgggagtgagggctgagacaatgggtgctgtgcctgctcccctacttctccctcctctttgcagggtcagtgaagacatgtaccctcccctgatgcctcccactgaacaggacctcaccaagcttctcctggagaaccaaggggaggcaggagggtccttaggaagccagcccctcctgcaaccatctccttatgggcaatcagggatctcactgtcccacctggacctaaggaccaaccccagctggtgatcccagctggagaagcccagaaacaaagcctcttctgtctctatggaccagctctggacacctgctcatgcaggtgccttccgtctcaactgttccttggtcaagagaaaagaactggctgggagaccatgtggtgtatggaactgctgtgctctgtccttcctgccatatcagggccccccttttccagcactgggtgcaaagggatgagtggggtgttaatgctcgaatgtgatacaactgtatcacaacacacacgcacacacacatacacacacaccagaactgtgttgagccagggcctgggactcaacatacagaaacatagagacattgtgccaaagacagagggcatataggcctagggcattgaagctgggctcaggtgactctgggagggagaaaaaggaaaaagtgggtatacagtcactggtgtgagttctacccagattttaaaaaacaagactccaaagctccaaattcttgcaaaaaaagatgcctagtgacatttgagactgcattctaagagctaagcttgtgtatagctgtaccaatgtttacccaagacatgttaacctatagaagtcacacatcactgtatgaccgcacagaacatgtatcttctgcttttgccagtgtgaccttaacatatctgaaaggctgagacattgtataagacagcaacccagtatcatttggggagtaactatgtggctgtgacatgcataaagctctagcctgggtaacttgatgcttccagtgtttcctagagcctgggatataagtagggatgcagacctctctgtgtaaactccctgggcgttgaggccctcaactgctgtctcttgtacttttctgtccactgccagctctgcccccctcccccggctcttacccagtcctttttccctcactggaggggaagggggccatggatcctaagccataaaataaattttattccaaaataacaaaataaataatctactgtacacaatctgaaaagaaagacacgctaagtgttcgacaggtgctgcagtcctgccggctgaggaggcccagggtccaacccaggcctctaaggggctggtggagggaacttcggggcaccctcccacacagtgctgagagaaaggtctgcggggaggggggagataagaacgggtgggcaaactgcagcacttgttaaattaaagaaacaaactagaagcacgaaaaatggggatggggaggggagacccagttttcccaagcccccagtctcagagtgaaggttccactgtaagtcgctagaccttcctggggaagttctttctccgtgtccaagtgaagtagttcagctgctcacaccactgctggccacctggagaatatgtgtgtgtgtgtgtgtgtgtgtgtgtgtgtgtgtgtgtgtgtgtggtatgagagaaaggagagccccagcaggctggaggcaaagtccgtgcccctaag

SEQ ID NO: 19389 - DNA, 3407 bp, Mus musculus
ccttatctccttgttccttgtcttctttttatgtactcattctattcattcagccttcctaaccaccagcatgctcccagatcttatcatttataagccctaaacaaccatctgttaagtttctttctatgcaattttagttttgtaactgccacgcttttccacggcagagaacagaccttcaggtgtactgcctgcctctggtgcccattcagctgttagcatcagctacatcccctgagtttactctacttacttacagttccatttctgtagagacgctgcctctgcagtgatgttagcttccgaatcccttgcctttgcagatctcttagaagctggcaggatcatttacgagggacagactctcaagtttctgccgtttgcttggttctttcattgtgatcttcaccactgcactggaggaagtgtgtaatgtgtgtaattccttcagccagggaggtcggtgctcactcaggaatacagcatcagactcattgtcttaggatcatcgaggaggaaggtggtattttcaggaagctcttagggcttcttcagacccgcttttaacatgtaattttggaagaccctgggctttactgctagcatccaaaatgtcagctgagacacctctccaggtggccagttagttatttcaaccaatgttccccatagccttaaattgtcctaaagtgacaactacctcacttggtagaaggtgacagaaaaatgagcagtatctgagctgtggttagagctgcagggtataagaaactttgtaacggaacctttttgtctttgtgaattataaatacagtaaaatttgtctcttttcaaagaacttgaagatcctgaagaggtgggaatgcacctcagaggcagtaagtgcttgtcctgggggtgcaggctggccaccccccaaacaaagcccaccactaacaacaaaagccttcagaaatttatacctagtatattttactgtaaactcagttatacaatttttgtaggtcttgggagaccctcatgcctgtttccccaaatcactccttacggatggtagcttgctaaaggggaggaggctcttgacttcttattttaatgagaattcactgtaagtgactttgctcttctgtgggttgactcactgtgaaagacagatttcttttcaaggccattttttttaaaactgtatttgaatttggggcgagcaaagcaagctcattttcttacccctgcctggtagttggagaagtgaatgctgagagagctgcttcagacagtgaaggacagacggtgcctcttttgtatgctgtgtatccttggcctgcctgcctgcctgcctgcctgggtggctccgctggatgcttctgagcctctgcgtgcccagacactgcttgagtcagctcagtctcatccctcagaatgagctcatcaaggaccgagggagaagtggagtgagctggacactggagccatgagcgctgtgtgccagcaatcatcgatccagaagctggttccaggagtgggggtcttgatggtattggaaatgcattgcttctaatgggtctgacctgagttcataaaacatgactcccgttaatgggaacataagaggcagccggcatacaactttacagttttcctttccttatgagaacatactgatcaaagccaggaaaagtttagcaactttgataacttggttaccttgaaatgagaaagagccagttccccacccacattcttgttttctcagcagagggtggttttgtctgagatggctctttgggtcccactgttccattttaccatatgaccgcccattcaagggcatagccctctgtgaatcagttgtgttctctttagcctaccctacttgggtgattgaggtttggtgaataaaaggacccaaataggccagagaattcccccaggccttgatacccgtgaagaatttggacgggttacataattgttgaaaggtatgctgagatggatcccagagttaaaatggaccttagctgtgcccacagctcttgtggactgagtggtacaagttgaagtgtgcagacaggaaaataatgccttctagtattcccatggactcgggtccaagatgggtgcctgcatttgcatgctgagaggacaggggcaggtgtacggagctctccccttaggcaggcactgaaaccaagggagaagcacacagagtagccttgcactttacaagtgtgtctaaatgtttgtgcttgtagtcttatagcagagagtatttctttgggggaacgtaggcagttgagctaacccagagctaacccagtggcatcttcgtgactcgattatggattctgttgctgttggagaccagatggtgactacctcgaaaaggaggtttggaagtcaggcatggtaattagtgtccgcctgaacttggaaggctgaagcaaggggaccacttgagttggacattgtcaacaatggggacccatacatggcaggccctagaacccactgggaataagcaaagcatatggataccctttaacctcagcggggacagaagtggtcacatagactcagacatggggctttgggccacaagtgtcttccatgtgtcatttttctttgacatgctcttatctccccaaggtattgtttagatagggcaccactctgtagcccaggctgtcctggaattcaatttatttattacccaggcttgcctacaactcacaatagccatgtctcagcctcctgagtgctgggattacaggcttgagccacccagcccagcttcctttttgcactcttggtgttaacttaaaaatgtcgagttcatttgcttagaacttgtgggcagcactgccatggcagatcgtccccagcgtgagccttgagccagttacaacctgagctggccactctccatgtctgtgggactgttcctgaaataacagggctaagaaactactagataagttatagcctgtgggtaatgccttagtgttatttagataaaatatgtgtcattgatacttaatacatggtaaggaatgttcagaaagaacaaagttttcagggatgtctgtttgctgtgagtcttccacatttgtgtaagaaaatctgatgccatgtagttttttatttctattgtggcttgtaaataatccccactttaataaagttttatacaatttatagtagtctttttaaattaaagtattttaatgtgtgtgtgttcatggtgtggacaacttgtgtgagtctgctctcatgtggcttccaggggtcagattcaggtcatggggcttgttcttacccactgagtaacactctgtcctgagtatattttggtttagtattttggagcctgggaagtttgaggatcctgttgcccaggttggcct

SEQ ID NO: 19390 - DNA, 1129 bp, Mus musculus
cctgtcctcctgcctcctttcctcgatctttccctggagagtaagatcgcctccacgatctgagatttctcctcctcacagtgcaagaagttccgagatcagctgtccccgaagcaggtgcagacactgcgggaaaagctctgtgccagtgaactgtttaagggcaagaaggcttcctacccccagaggtgagggcctccaaatgctgtagccatttttgtcacgtggcacctcttgagcttgaactcacagcagagttgcctgggaggactggagataccaagctgtgccctccttgatggcgctgacccagtgcacatgcgtgctcgcgtgcgcgccacactgtagttctcttctgatggatcctggaccacgtctctggatctctaaaataagatgtggtacaagagcaggaccctcaggaagggtttgtttacatggtgcacctctcacgtgtcctcagtgtgcctatcccgttccgtggtgattacatcgggctgcaagggaaccccaagctgcagagactgaagggcagggaggaggggcctgtcctggtggcagacaccgtgaagaaggtcaaccgtggcaatggcaaggtgaagaactactgcagcccacagaggcccacctgcggaggctttgcccggtggtgggactgggtgacaatgcctgtcgtcactctcccatctcctctctagacatcggcgcggattctcctcctgaccaaggggcacgtgattctcacggatgcgaagaagtcccaggcccagattgtcataggactggaggatgtggctggggtgtcagtcagcagcctccaggacgggctctttagcttgcatctgagtgaggtatttgagctgcctaggtggggtctctgtggagtgggcatcctggggctgaggtgggctggatatgctagaactaaatttctcactatgggcagcattaatctctattaatccccctccccttttcctaagatgtcatcggcagtctccaagggggacatcctgctagtgagcgaccatgtggttgaactgctgacaaaaatgtaccaagcagtgttggatgccacacagaggcagctctctgtcactgtgactgagaagtaaggccatgggctgga

SEQ ID NO: 19391 - DNA, 1163 bp, Mus musculus
ccggggcctttgtgtgaggcggtggcggcgatggtgctcggaccccgcggagccgggtaagcgcgatcgggtccagccggactcccgctcggcctttctgtcgccctggctgggcgcgccccgccggtgtccccggccggccctgtcctccctcccggcgaccgggccgcggctcccgggcctccgctcggccggctcccgcggcgccgggcctgggtcgcacgggggcagcccgcgctgtctgtggcgaccgaggtgcgccttcccggcggtgctgcgccccagcccggtgctgtccctgccctggcggatcgcggggagaccgcggcacgggcagacctttggttggggcgtactccttgcaagttgtatatccatggggtgcccggagcctcccaccgtggatgagtgaccgccagggcccgggagacgcgtggttggtacccaacaatactcagacgagtgctgggcccccgggaaaagttgggaattgttggtagaacctggtgcgatggagaaaagggttgtgctgctcagggcgagttgtgcgaagcacacgcatgtgactagttgtttctccgaggtgtgcaagacctgagatgggggaaaagtgatgttaaaaacgcttgcaggaatctttcccttgcttaaggcatccagttgttactgtatagttggtaaagacagatacaacgtacctaagtaatgttacataccacagttgtgtttgctttggctatgagtttagcttcatccacagaatacagtaacgtttgagaaattagcatccagaaggggtctgggaaggaccagagaataggcaagtatcccatgaagggcgaggtggggattcaagagtttgagattttgaggtggggctggtggtggctcttatctgtaatctagcatttgggagatggaggtaggagtatcataatgccatcaagatcatccttagtaacagagcaatttcaaagtcagcctgggctacataagatctcaaaaagaaaagaaaaaaagagctgagaggtttgtttgtagactggaaaggacagctatggcagacaagtaaaggtgcaaccgttacctcttccttagctgctaatggagcattgataatagttcaagtatattcctggcatttggcattgtgaggaaagaga

SEQ ID NO: 19392 - DNA, 3109 bp, Mus musculus
gttttgtagagtgagaacccttgatgtcaaaccttctgtcaagagcagggaggacagagagccacctcagtgtagccgtctgccatctggctacctccttaaccttgcgtctccctgtcacggagaggtgtctcagacagcagcagtcttgccttaatttacaccgagtctcccactcaggatggtttgacctacagtgcagatgagaagaccatgtgagtttgtggtggatcacaagcccttctggattaaaggaacccaagtaacttggtggtacatagcagggtgtgcattctgactgtcctagttgggtgacttgtttacttggtaacagtgtgggagtttggcagttcacctttgacctgctggaattatcctgatctgtcattgcatcacccccagggggcgctcttggatggtagctggcttaggcctcccacgcagctgtttggctccattcttagtctatgaaagggtcttacccagaaaaggctggagagaacccttaatcttgcatacttataaggcggcactccagtagctcatactacctcaccctgctcaggtgagctctaagagtccctaactttgggcccagccaccgacactgccccctggtgggactcagcagcgctctgggctgtttcataagcaagtggttttaattaactcacaaagcctttctagacattaatatttattttattattattttttgttttgtttggtatacatactacccagcatctcttttcaataagtgactttaggaaaattagtttctctcaagcaaggagccacattccaacaaagggttacgtctgaggagaggaagacaggggtgtaagcaggagagagtatgccaggccttttaagcagcagtttctcccagtgtagtctctagcagaacaaacccaggtcagtcacaggaagaaggtttttgcacagttttatccttctgacacaaggagcctcctatacatatatatgtgtgtgtgtgtgtgtatacatacatatatgtatgtatacatacatacatatatatatatatatatatatatagacatagaggcagaccaaagcagtacacagttgagccggtcagcggcctctttccccggctgtgagtcggtgtgcagggccttcccaagggcccgaatggtgtagctcgagtagttgaggatacccctcaccatctaaacgaggcattttcagggaagtcagtcgttgctgtagctcttagtgtctgactcggagtctacactggggatgtgtagcacactacagttccaggtctgctgagttttctatccccgccctccctctgctgctgccgaggagtgagcattgactggttgacttgagacaggtcgctgagagtggagaaacccccttgtccttagcgtaaggcatctccgatgctgggtagtctgtgtacttaacctgaaactgtgaagttttccctttttgccataaaccaaaaggcagatctttgaggttttgcccttgaaacattaaaacacaaactgtattttctgatcccttcaggttaattgatcagggaggtccagttggtcccagtcagacatgtagcaattgggaccagtagctcacaaggcttgttgcccaaaccatatctcttcgggtagccccatgtttcctctctgtgaagttgtatttgcttccctgcagttagttcctcctgagggcactccgggacacctggtgggaggagttaactttattttgcatttttaactttacacccatttgagttcatccccacccccacccttggattcccgtttggcactatcccctgttgtattgctgtagagctctccttgaccttcatctttgcctgccccccccccactcccacccccacccccgccactaccgctccctatttttgtttttgtttttgtttttttttggtctacacttagagccagctgtacagtgttcagaacttttgttcagcaattcttaggattgtccagttggctatttgcagaacattaagccagactcggggacatccctagcttgtttcctaaggggaaactgtaatgttgatgtggcacactggcattaacagcctgtgctgcttgtggccagaggataagatgtgtccacatgtgctggtgtccctgacagctccgtgacgccacggacgtcagatagccctactcaatgaaccccaggatttggttctaaattttaaggttctgtggagctcccacagtttatgctagtcggggaataaagaggtattggtggggtcaggtgaccctaagaacaaggcatgggtgagaatttctcttactttattgtgacctatccccagccccgtgtgtaccgggcaaacctgtaaaccccagagcttttcgcccaggcagggctttgctactgattatcttccttttctggcttcctgctgtgctctctccaccagacccgagactactcaactctgaaagtgaacttaaatccctttacagatggacagtgaatttgttggcatgggaacgagccctatggagtggtctctgtctgtctgtctgggagtgcgttcacgtcccagtcccattgggtgagtcagaaatcgggtgcacagcatccatctcggtgtgatgacgcgtcacagtcaatgtcaagaggaagatggcacctgtggcagcgatcctgatattttccttctgccggtccccacccaccctgcccggagtagctcaagtctcttctgaagcagagaaacgttgctgtctaactccttccattaaattaagaagtactgacctcctaatatttaagtgtttactatctgctgtaaagttttgtatattttgtaaacctttttccccaaaacagtagacatctaaaatcgtacatctgattcttttatatttcattgttcagcacaaagtgtggtttttatttagaataaaaaaagaaacagacagagaaaaaaaaaaaagaaaaatttgaagtgagttcctttcccacggaccctcagttcagatagctgacttgctccagcttgctctggcctgctccggcctgctccagctcgttccggctcgctccggcttgcttcaggagcttg

SEQ ID NO: 19393 - DNA, 1209 bp, Mus musculus
ctcgaaaaaccaaaaaaaaaaaaaaaaaaaaagatagatagatagatttttaagagtttgaacatgataactgcatggacaatacttacttcccccgtaagacatgtattattaaatgaatatctcagttgcaggtgttgtataccttcttctgaattattggtggtcagatagacttcagagtccccaaaagaactattgtcgaggcgggagtgatctgcgagcgaaacctacaccatgagtctcctcaataaatccaagagtgagatgaccccagaggagctgcagaagcgggcggaggaggaattcaacacaggtcccctctcagtgctcacgcagtcggtcaagaacaacacacaagtgctcattaactgtcgcaacaacaagaagctgctgggccgggtgaaggcctttgacaggcactgcaacatggtgctggaaaatgtgaaggagatgtggactgaggttcccaagagcggcaagggcaagaagaaatccaagcctgtcaacaaggaccgctacatctccaagatgttcctgcgcggggacttggtcatcgtggtgctgcggaacccactcatcgctggcaagtagagcctgctccctgccctgcgaaggcctgcagaaccctgcccagtgggcgagaaataaaaccctgtgctttttggtaaaaaaaaaaaaaagaactattgtcattgctcagcaggaccaggtggtgagaccctactgctgatgatatggttatctgcaggagacctgcatacagtcaacaagatcagttaacattgtaacagacagcactaattagacccagtggatcacaataaataacagaaaggagaaacatgaaggggaaggtgatatgttaggggcacctggggaaaatgggagagaagagtcagggtgcctatattcaagatatctggtttagaggctggagaggtagctcagtgaagagcacttattagtcctccagaggaccctggttcaattcccagcacccacatcatgactacactatttataactccaatcccagggaatctaatgccctcttctggtctcctttggtaccaggcctgtaagtggtacacagacacacatacaggcaaaacacccatagacatataagtaaacagtttttaaaagatatattgtttgcatgtatgcagatgacaaagaataagcaaaaggtatgctagtaaaaaa

SEQ ID NO: 19394 - DNA, 1163 bp, Mus musculus
ctctatgacaatttttcaaaatctctttatgagatattggtaatatctctaaaatattcatcttttgcaaaggacttgttaaaatcttactattggccgggcggtggtggcacacgcctttaattgcacttgggaggcagaggcaggcagatttctgagttcaaagccagcctggtctacaaagtgaattccaggactatacagagaaaccctgtctcggggggaaaaaaagaatcttgttattactaatcaaaatcaatatgctaaaggtctctccttttcggggacaatcctgttgttaaatggataggttttcagagcccggaagatgcagatggactctaaaaggagcagtaggagtcgtctacacctgcgagatctgcaagaactacaattcccagcagtccctccggcggcgcaggtccatgcgcgcgcagggatggaggcctgtcttgttcccgccaattctcgtgtcagtcctgtccgggtctagttctttacttcatggagccatttgatcctgcggagctgccggagctactcaagctttattaccgaaggctctttccctacgcccagtactatcgctggctcaactatggcggaggtgatggaggctgggacgggatgggtagcggggctgggagccgtgtgtgagaatactttgggcgggatgtcctaggaagaagagaggcaccttcttcaccaatgacaggcagcgtccttggaatatttacagctcctgtttattgctccctagcaaatgtgaaattgtatgccccttcagattacaggctatctagaacagagctgggcacagagcactcgttaaaaatattccagagagcctagtagctcatacctataatccttacattctggagattggggcatgtggattttcatgagttcaaggcgagccagggctacatagtaagctctagagcaacctattctacacaataaaaccctgtcgtttaaaaacttatgtcaggctgggcgtggtggcacacgcagaggcaggcggatttctgaattcgaggtcagcctggtctacagagtgagttccaggacagccagggcaacacagagaaaccctgtctcgaaaaaccaaaaaaaaaaaaaaaacaaaaaaaaaacgaacatatgtcttcccattagtt

SEQ ID NO: 19395 - DNA, 1196 bp, Mus musculus
gtcatagctgtatcaggagagatttctccctcccccaaaaagacctcaaaaactgcagcccccaaagagaattcagcaaccttacccccaaaaaggtcccccaaaactgcagcccccaaagagactccagccacatcttctgaaggggttacagctgtgccatctgagatttctccttcacccccaactccagcctccaaaggggttcctgtgaccctaactcccaaaggtgcccctaatgccctagctgagagtcctgcctcccctaaaaaggtccctaaaactgcagcccctgaagaaacctcaacaaccccatccccccaaaaaattcccaaagtggcaggtcccaaagaggcttcagcaaccccaccttcaaaaaagacccccaaaactgcagtccccaaagaaacttcagcaccttctgagggggtcacagctgtaccactggaaattcctccctcccccagaaaggcccctaaaactgcagctcccaaagaaactccagccccgtctcctgaaggggccaccactgcaccagtgcagattcctccctcccccaggaagggctctaagaaagcaggctccaaagaaacacctacaaccccatctcctgaaggggtaacagctgcacctctagaaattcccatatcttccaaaaagacttccaaaatggcaagtcctaaagaaacgctagtaaccccatcttccaaaaagctctcccaaactgtaggtcccaaagaaacttcacttgaaggggccacagctgtgccactggagattcctccttcccacaaaaaggcccccaaaactgtagatcctaaacaggttcctctaaccccatctcctaaagatgcccctactactctagctgaaagtccttcctcccccaaaaaggcacccaaaactgcagccccaccctctgaaagggtcaccactgtgccaccagagaagcctgccaccccacagaaggcctcagcaactacagcctccaaagtgcctgtccctgccgagacacaggaagttgctgtctcctcaagagagactccagtaaccccagctgtgcccccagtcaagaatccttcctcccataagaagacctcaaagactatagagctcaaagaagccccagcaaccctccctccctccccaacaaagagccccaaaattccatcatccaaaaaggcaccaaggacttc

SEQ ID NO: 19396 - DNA, 1215 bp, Mus musculus
ttacaggggttacgagagtcactatccgaaaatctaaaaatatcctctttgtcatcacaaaacccgatgtctacaagagcccagcttcagacacctacatagtgtttggggaagccaaggttagtaaaatttcaggtgaattgctccagaccagtattaatgttatttggggtcagataattcattgctgctgctgtgcagaggttaagccccaattgtgataccaaaaattttatttatatagcgttgagtttcctgagatgcatttttcacttacaaacatctacccgcacctctatcctctgccctgtagattgaagatttgtctcagcaagcacagttagcagctgctgagaaattcaaagttcaaggtgaagctgtttcaaacattcaggaaaacactcagactccaaccgtccaagaggagagtgaagaagaggaggtgagccacggaatcttgaggattttacttaatctctccgcatcagcgactcttgcttcagaaaactatagaagttattcttactttgctttattgagactcttctccgtcttttaggttgatgagacgggtgtggaagttaaggacatagaactggtcatgtcgcaagcaaacgtatcaagagcaaaggctgttcgagccctgaaaaacaacagtaatgatattgtaaatgctattatggtgagtggcccatcaattaggcttcattccaaagcctgaattgccaaagcctgaaataatgacctgaattctctacctcttagcctataaatgcctctaattatctttttttttcttctttgcaggaattaacaatgtaactatttgacagcgaagacaactccccctttcccccctttttggtgtttgaaaagtggaactacagcttggtttaaaatttgtactgtttctatcactaataaagttgtggcttcttgttggatggactcagcaggtgctagatcttttcccagaaagtaaattgaagtatgtgggggaaaaatctttttaaaaacttttgatgtgccgggcatggtggcacatgcctttaatcccagcacccaggaggcagaggcaggtggatttctgagttccaggacagccagggctacacagggaaaccctgtctcgagaaaaccaaaaaggaaaaaaaaactgaatttgaaaccagcctagtctgcatagtgagttccagaacaacattgtagagagac

SEQ ID NO: 19397 - DNA, 1188 bp, Mus musculus
acagcctttcctaattccaggtcaagaggatcaacatcctcttctgacttatgcaggcaaaaccctcatacacacagaccttaacaaaaaaaaaaaagttgtggttttggttggttggtttttgaaagtatagaaaagcatcaacgagccatcattgcctgcatatataaagggcctttgacatgggagtcctttagtttaggactatttggtcagaaacatcttttagttggggtttaacactatagattaaaggcgtgctccaccacgcccggagagtttttgaaaacagatttatgtatatgtgggtgtttgccaccagtgtttattggatttctgaggaggccataagagtatctagtcctttggagctgaagttacagtctacatgaggtacctttatgtagctgtaggtgctaagaactgaacatgagtccttttgttttggttggttggtttggttttggtgttttaatcaagacaggctttctcttggtagttcctggctgtcctggaactcactctgtacagcaggctggcctcagactcctatgcctttgcctcctaagtgctgggattaaaggccatgtgtacactgcctgacttttaagttcttgagatgctaatctttctcttcaccccagcatcctaaatcctattttcccccaattatttcaagtaagaccaagagaaaaaaatataaatatacatgtgggacttgatttgtaaagagactattgtagatgctactgtaaggcagatttggggccagcctaaaatgttgtgagaccttaccattattaaaaagtgagttgcagccgggcgtggtggcgcatgcctttttaatcccagcactctggaggcaaaggcaggcagatttttgagttcgaagccagcctggtctacaaagtgagttccggacagccagggctacacagagaaaccctgtctcgaaaaaccaaaaaaaaaggggagttacttttggctatttttattttctaagtaatatttctaagatgatatactctttcgtttaagaaacaccatctgtgtcttctcatctgcatcctcatctcctcttataagggcaccagacattggaagttttaggattgtactttcaatttccctttaaaagctctgtttccaaataaaagtctcattctgaagtgatcagacagaaaacag

SEQ ID NO: 19398 - DNA, 1307 bp, Mus musculus
aaatctgtgtcttagttgtagtagtgatggtttaaagaattatcacctcgtgattgactggcattaaatgttagatcttagcttcaagtcctgttaaccatgatgaaaggggggttatttttgggttgggtggtgttttgtgtgtttatttttggcttcgtttgattctttttttttttttttttttttttttgagatatatatatatttttttctgtatagacttggctgtactggaactcactctgtagatgagaccaggctgggctcaaaactcagaggttccactgccttcctacttactgcttgagccgctaccacctggtttgtttgtttccaaagcctactttttgtcctatgataaatgaatggcattgtgtgggtagggcaaggaacgatcaggtattcaaggccaatgtgggctacttaagagccctgcctcattccctcatctcccagaataaactccctattaggaaagttttaagtcttcctgaaagtactttgttgaagcctttggaatgtaagataaatgtaaagtgaaatttaaacttgtgatggagaagagaaataaatgactgttaaatatgaagttataaatactcaaagaattcctttttgaatttatcattttctctacttataggcagcctgcttctgcaaagtggtacgatcgaagggactatgtattcattgaattttgtgttgaagacagtaaagatgttaatgtaaactttgaaaaatccaaacttactttcaggtaatttgccttttgtcttatttaaggtgtctattattactgtgatgaaacaccatgatgttgggtggaaatggattattgggcttatggatccactgttaatcatcaaaggaagtggaagcaggacagaggacatggtggggtgctgcttactggcttgctcagcctttcttacagaatcctggggtgggggcacccacaatgggctgggccctttcctatcaatcactaagaaatgtactatagtataggccttcttacagtctgatcttatagaagcattttctcctttgaggctcctgtctctaggattgtgtagaattgacatgaactagccagccacctttctacatctgtgttacccaaagcttactgtatgtaactggctttctaatctctttctctgtctcacttttttttttttttttagttgtcttggaggaagcgataattttaagcatttaaatgaaattgatctttttcattgtatcgatccaaatgtaagtaccattgatgctttttttctgatttaaatgatgagaagctg

SEQ ID NO: 19399 - DNA, 1919 bp, Mus musculus
agagggcatttccaaggatggatatgggctagtgaactaagaaccaaaaagtcttgtcacattcttaggagggtttattatttaaggtgtgcttacatgttcagtgtgtaagtaagtgttcacatgattactagggagctcttagttttgctgcctccatttaatttatataagtgttagattctcttgtagttctcttgtagaccttgctgacttgtctgtaaaattctttcagagatgccagatctggagtaagggctgttgtcatcgcctggattttgagaaaggaaaataacttctgcaagatttcacaattgagaaaacccctgagtcgatagctctaaaggcagatatgctgtacttgcctcctctaacccagttgtcaacctttttttttctttttcttttttttctttttttttttttttgaaaggcttcactaagggttgattatgtaccattgtgtggggcgatttaagtcagctaaggcagtatccttatgcatgaacatttcccatgattccatgaggcagttgatcctaggcaactgctccagcagctcggacaaataattgcatttcatctaagtctttcatcataacacaattacttacacattaggaaagctctcagcttagggaaagatgaaagttttagatcctagaccatggatttaaaggaggcggaaacaaattggctaataccttaaactgataacctgccattctttcaggatacctttcaaaattattccactaaagtttatttttcaaaaaaaaaaaatgtactttacatcattgtatgtgatcacttgtcagtgttcaggtgtattttagcaaaaactagtggatgccctaacttagatggtttttgaagcctatacacttggtattgtttggcccttaagcttttacatctcttagcatggaggacaaagaaagctgtacattgttgcttgagagtatgtacattttagaccagatttgtatttgcacagtcagtatggcaaatgagtggacaatgttaaatacactattggattttttttattttctgttttgatttcagcttatgccctggctggaaaacctcaatttatgttcatgacagtggggatttttttaaatgtctacattctttctaataaactgttggaagatttcttggctgtccttttaagtgtctgtttgctgtaatttcatgtatttaccccttactggaatggagtttggttttttttttttttttgttttgtttttttgagggaaaatttggactggtcctgtttgaacaaagaggcttgctgtactgtcacaggaaaccctgtaaagtgtgtctgtaaatgggaagctgtgggcacttggcagcagccagacaagtgttgtgacttgactgaaataaaagtgaatgtgttgtcctcctgtacattttcactcctgaattagcagtgtcaccttgtttactgctttgatccagattgagaaccactgactgacgtaaaagtatgttccagtgctctaaagctaatagtgataacgaacaccccacactcatcattttaaggagatattacctgaattcaaaagaagggtttcaggagggaggacttgggggggggtgctttactgttttgttttttggattttatgtgtacatgttttgtctatttgtctacatgtatgaatgtgtaccctgagagtactggggattgaacctgtgtcctctagatgttcaggcaatgctctgaactgctgagctatctttccagctcccttgtttttgtattttgattgcttcctgctagggagtttaaggtgctcttgactttagcaatcctgcttccattctgaatgctagattgtaagtactgcaccagtgtgctcagttcttaatggtgttggggtggattcttggttcta

SEQ ID NO: 19400 - DNA, 2088 bp, Mus musculus
tattcagttattgaaaatgaagatacagaagtttggattgttgaaaacttgctacatagaaccccctgttactttttttaaagctgtgttacattatggattctctaaaatttacaggtttttattttcttattgttatataaagaaactttgttatattaagttcagtaaaaggaaaatatcaaaaaagaggattatttgttcttgagactttttttttttggtttttcgagacagggtttctctgtatagccctggctgtcctggagctcactctgtagaccaggctggcctcgaactcagaaatctgcccgcctctgcctcccaagtgctgggatcaaaggcgtgcgccaccacgcccggcgagacaatattttttattgcagagagatgatgttctgtgacagcttaacttgaacaagattagacttgactgtttgtggtggccagtggcttttgagcatggtgcctggttctgaccctttcctccctgaaccttacagatttgctcctattcatgctgaggctcctgagttcatagagatgagtgttgagcaggagattctggtgactgggataaaggttgtggatctgctggccccatacgccaagggtgggaaaatcggtacgttggtttttggtccgtgttttccaaatacagtaaagcatggagacccttttttcttttgagagtgcttgagccttcagtgatgattagcttctgactttcgttcttctgaatttgctgaagccagatgccgttcctgagaaggggaaaatggacagaactgaacatttttgaaggctgtttaatttgggaatgcagagatctgaaatatttcttcttaaactaggactctttggaggtgctggcgttggaaagacagtactgatcatggagctaatcaacaatgtcgccaaagcccatggtggttactctgtatttgctggtgttggtgagaggacccgtgagggcaatgatttataccatgaaatgattgaatctggtgttatcaatctaaaagatgccacttccaaggtgagctccattcagaaaactaatgtgttatgtttgatgtgatgagccccgggttctgtaaacaaaatagttgtcttcccaccaccattttccagaataccagtgtacacttctctggtgtgagatatttctagactttttgatgagtaagtaatccaatttgaaagctgatttaaaaggtgtagaatggaagccactcacatatctcagtcttacttttagtttagaaattatttccagtgttctcaatttcatgaaggttccaaacagaaacattggcatccagtggaagatcccattagtggtgtctctctctctcttcccctctcttctctctgattgggaatcttggatttctctgtggcttccttactactctgctgtcttttctgacttgtgtatgttttacaggtagcgttggtatatggacagatgaacgaaccacctggcgctcgagcccgggtagctctgactggtttgaccgttgctgaatacttcagagaccaggagggccaagatgtcctgctgtttattgacaacatcttccgctttacccaggctggctcagaggtaggggggaagcctcgaggcctggtttgttgagccagttgggcatattagaagaaagatgtagacacctaagaccattattctttacttctgtcttttaggtgtctgccttattgggcagaatcccttctgctgtaggctaccagcccaccctagccaccgacatgggcacaatgcaggaaaggatcaccaccaccaagaagggatcgatcacctcggtgcaggtaatgaaaaaaaccaacctagggagataataacaccatattatacttggggctagagagataattcacagttaagaatgcttttggctcttccggttgcccagtgtccatcaggtggcttaccatctgtaactccagcttaggagacatggcgccctcttttggcttccatgggtacctgcatatacagtaaacatggtctggggcgcggagatgtacaaaaatcatgtgctaggtgaaatggcacttaccttt

SEQ ID NO: 19401 - DNA, 2088 bp, Mus musculus; identical to SEQ ID NO: 19400

SEQ ID NO: 19402 - DNA, 1099 bp, Mus musculus
gaacagtcagtggaggttaggagtggtgtctggtcactggaattagaggtgataaagcagtagtcagtgttaaaccaccactcaagccccaaacatattcttgatctactacatcttgtcttaaattacacactttacactttaaaaacaattatacttggaagggggtggatatggtgcacacctttagtgctgggactcctaaatagatctaggggcttgagttccaggtcagccaggaacacacccccaccccccaaaagtaaatttcacgtggaagttgaaaagtttccttgcatgataaggtttcacagtgggctcaagtggtgaggtgtacatgctgcaggaagctgatataactcagcttcttactgtgttttcccctatgtaggtgaatatgaccatctcccagaacaagccttctacatggtgggacccattgaagaagccgtggcaaaggctgataagctggcagaagagcacgggtcgtgagggactccagccaaaggcagcactgcaactgatctctccatatcaagcgagagctcaggtttccttccatgcaggccacacaagagccttgattgaagatgtgatgttctctctgaagagtatttaaagttttcaataaagtatatacccctcatttatgtctgtttatgttgcttctgaaacagcttataattgagctcacagtggtgggccacatttaggaaattgttagaaacaggattattattaaaaagatcaatttattaatgagattctatgggccttgtgtttcataataggctcagctttggtttttgctccaactatcactaaagtgtttttcccctggagaaaatagataaacttattcaagacagggattgcgtttttaggaaatgctgactatctgtcacaattgagggtcttgtctaggtactcattcagaaaattcttaatatattgccagaaatttgaacaagcctagctgtgcatgtttgtgcttgagtcttcagggcaaaaaaaaaaaatggtctcttaagatcccttatgaaaaagttttaaggcttcggtgatgttacaaagagtaatcttgatactgttgccactg

SEQ ID NO: 19403 - DNA, 1168 bp, Mus musculus
tagatcccattacagatggttgtgagccaccgtgtggttgctgggaattgaactcaggacctctagcagagcagtcagtgcttttcactgagctatctctccagctcagtttattgagtttttaatattgttagaacttttctattcctttatcttatttacaaggaatacctaacaagtctattaaggatccttgtgtttagttctcagccttgggtttagttcacagcagtatatgaaaggagaagtcaagagatttggggcctttgtttgtttgctttttttttttttttcttttctgagacagggtttctctatgtagccctggctgtcctggatctcactatgcaaaccaagctggacttaaactcagagatatgtcttcctctgcctctgctggaattaaaaggtgtgtatcatcactggccagctactaaaattccttgaactcagaaatctgcctgcttctgtctcccaagtgctgggattaaaggcgtgccaccaccaccgccctgcaaatttttttaggcagtatctcactgtgtggccctggctagcttggaaggctctaggaaatacagaccggaccttcaacttccacctgcttctgctatgactgagtactgggattaaaggcatgagccacccaaatttgatccctagaacccgagtaaaaatgtcaggcaggcatggtgctgtgtgattgtgaacctagcactagggaggcagaactgaaagacccctaaggctcactggccagccagtctagcctaattggtatacttaagatcattgggcaccctgcttcaaaagagatgaatggttttagaagtcctctgatctacacgtgtactgacacatacaagctctggcatgtatatgaaattgggggctgtgatggtggtacagacagaggcaggcagatttctgaggccaacctgatctccatagtgaattctactcttgccagggctatatggtgagacgctctctcaaaaaaagaattaaaaacaaaatagagggctggagagatggctcagcggttaagagcactaactgctcttccaaaggacctgagttcaaatcccagcaaccacatggtagctcacaaccatccataatgagatatgacaccctcttctggtgtgtctaaaggcagctacagtgt

SEQ ID NO: 19404 - DNA, 1137 bp, Mus musculus
gcaataacagctgctgccaccagctcctgtgccacacctagaccgcagcctcagcaacagctgctaagcgtacacaagagcatccaagtttagtgtccccttgagaggtagaagataaagggagcagaggagtcccccttgcttgtaccttcaacattgtcaatttgaagtttatttggtggcgttatatgtatgttcatagccaaaccttttctgttttttttctgccaggtttgaatggggatgtgaatgttaatggcttatctactgtatctcacactactacttcagggattttgaactctgctccccactcctctagcacctcacacctccatcaccctaacgtggcctacgactgtctttggaactactcacagtacccatctgccaatcctggcaacaacctcaaggacccaccccttctttctcagttccctgggggacaatacccgctcaacggtatccttgggggcaaccgacaaccttcatccccaagtcacaacactaatcttcgagctgggagccaagagttctgggccaatggtacccagagtcccatggggcttaacttcgattcacaggaactgtatgattcttttcctgatcagaattttgaggtgatgcccaatggacccccaagttttttcacctcccctcagacttctccaatgttggggtctagtatccagacctttgcaccttcccaggatgtaagcagtgacatccatcctgatgaagcagcagaaaaggagctgacttcagttgtggcagaaaatggcactggcttggtaggcagcctggagctggaggaagagcagccaggtataactgggtctgtgagctgggagtggagaggggaagtggggttgggggggggtgcacagtagctttttgaagtgaggaaaacttgtctttccagctctctgcagtataggctaatttgcatgttgatgtaagcagagccaaatggctggggttttagtgcagcagcaccagttcaagagtgggaggcaaattatcccaagcttgtcatgcagagctgctggcctggagagggctggtgggtgatgggcaagcctgaagtagccaggcagactccatcagaaatggcttcttgggctaggggtgtatctt

SEQ ID NO: 19405 - DNA, 2227 bp, Mus musculus
ctaaatagaaaaatttgccaattaaatataaaaacaaggtctattttatgataaataaatgatgttaggtttctacaaggatctatggggtagatacacagtatctttgccttcattttcacagtctcctgactttgctttaagagggctatatgtttcccctaatttatattaatgtattgcatggtagggtagctgacatagcagagttgtgactttgacatgatcctgaactacatagtgagtttcaagttagtctgaactagagaccctttctttctttgtttttttttcccccaactccccaattcatacactagaaagtagaatatttgggggggccttaggaaaatctgactttctaacttaattcttaatattctgctttttgaattttctttcacccccataagcagagccagtgagtggcagtctttatggtatagatgatgcggagctgatgggtgcagaagacaagttgcctctggagggcaaccctgtgatctctgccctcgattgccctgctctcagtaatgctaatgccttcagtctcctggcagacgacagccagacatcagcctccatctttgtcagccctacctccccacctgtcttaggggagtctgtcttgcaaggtaagtgacgagaggggtaggacatatacatagagttgcaaaaacagtgagagaatgggttccataattaagcccttaaactgggaagtatgaagctgtaccttgctgacagactatgagatggtgtctagtgggaataaaaaggcattgaccatggtactttgccctgtagagaacttgagagacttggaagttgtcaaggaaaaaggccagaggcctttcaagcttcaggagaaggaaagagccagcgctgctttgttaaaacttaattttgggggctggtgagatgactcagtgggtaagagtacccgactgctcttccgaaggtccagagttcaaatcccagcaaccacatggtggacatataataaataaatatttaaaaaagaagaaaaaaaaacttaattttgtttgtatgagtgttcctatgtctgtatatctatgtatcgtgtatgcattggtgtccttggagaccacaagaaggagggtgtctccagctagaccaattgggactggagttccagaaggttgtgagtcacccacttgtgggtgctgacttttctcactaaaagaccttaaaataaccatgtttaccatagtgcaagtttgagtgtttaaattcaattttatttatactgttgtttgcttgtagataacagctttggactgaacagttgcagtgactctgaacaggaagaaatagagacccagtcttcaaacttccaacgtcccctgactgagccagctcctgaccagccacctagtactcaactacatccagcagtttcaccaacagcctccccagcagcctccttgacagcatctgcagaaatctctccagctgtctctccagtagcatcctcgcctgtccctcctgaagtctttgtagcagtctctccagcttcctcacctgctctgccagccatctctttggaagcctctatgacaactccagtaacttctcctcaaggttcccctgaaccttctccagcagctgccttccagactgtctccccagcaaggaaaaatgtcagcagtgctcctaaagcgcgtgctgatcgagaagagacgactggaggagcagttgcagtctctggtagtggtgagtgtccacactctgctcccacctgcctgttctctacagaagcacatgtcacatatggtgcccatccttttgttttttgatacagtgtctcagtatgtagccttgactagcctggaacttgctatgtaaaccaaggtggcttccaattcaaagagatgtgtctgcctctgcctccaagtgctttatcctgtaactttgcttgacttcttatcttgatgtctctggtcttgtcctctaggtgatgtactgaagagacgtattgctaccccagaagaagttcgtcttcccctccagcatgggtaaatgctctagatggctacacacattgacctcaagaagctcacgaatgataggaagagaggagctcctctcttcatcttggtgggagaggactgggctggacaggagtggactacaggacagtatggagggtgcaggactgggcaggacaggagtggactacaggacagtacggagggtgtggaac

SEQ ID NO: 19406 - DNA, 1150 bp, Mus musculus
ctctgggtgggcaggctgagaaagagaagatgaagacaaagcaggaaaagctgaaggaaaaggtaaagcgagaaaagaaagaaaaggtaaaagcgaaggggaaggaagggcccagagccaggccatcctgtagagcagacaagacccttgccacacagaagcggctagaggagcagcagaggcagcaggctatcctggaggagatgaagaagcccacagaggatatgtgtctgtctgaccaccaggtattaagggtcatggaagggccagtgctgaggacatttctcgtgttaccagaaggacttgtgaattctagacagtgcctcttgtgagtctaacaagatacccatgcgcttttctctccccagcccctgcctgacttcacacgcatccctggtttgacactgtccagtagggctttctcagattgcttgaccatcgtggagttccttcacagttttggcaaagtgctaggctttgaccttaccaaagatgttcctagtctaggagtcctgcaggagggactcttatgtcaaggtgacagcttggacaaagtgcaggacctgctggtgcgactgctgaaggctgcactccatgatcctggtctgcccccctactgtcaggtaggtgttcctgggcctgggttacagttttgctctctccttgagaacacgtaaaagcttcccctaaagcaaccacagaagtaagggaaacgtagttgcttcctgtttctagcctttatatgcctttttctttgcaaggcttcatttgttcattttctcttttcttactttgcagtttctctttgtagtctttcacctttttcttttttttttttttttttcgagacagggtttttctgtatagccctggctgtcctggaactcactttgtagaccaggctggcctcgaactcagaaatccgcctgcctctgcctccccagtgctgggactaaaggtgtgcgccaccacacccggcctttcacctttttctagtaactttttcccttaatttttaaattctatttatgtgtagacatgttttgcttgtctgtttgtgtaccacacgtatgcctggtactacactgaccaaaaaatggtgttggatcacctgaaatcaagactcacagacagttgtgagctgtcttac

SEQ ID NO: 19407 - DNA, 1177 bp, Mus musculus
gagttgttcctagttccttctcatttccattgtgcttccttccaaacagtccctgaagatattgggggagaagatgtcagagatcccattgaccagagataatgtgtctgagatactgcgctgcttcctcatggcatatagagtggagccatccttctgtgacagtctgcgtacccagccttttcaggcccagccacctcaacagaaggctgctattctagccttccttgtgcatgagcttaacagctccaccattatcatcaagtgagggcttgggtgggaatggtcaatcctgtgcctgtgtaggggaggggcttagctctccagaagcccctgggtggtgtgggtgttgctcttctctgaggatgctggagtgattgggcatagactcattgtaagccttcctttgtcatccatcctgtttgaactagactgagatccatccctacagctctgtaacacttaatctttcttttctttttgctgccacttttccctcaaaacttcccccatgttcgttcccctgcagtgagattgacaagactctggaaagtgtgtctagctgcaggaagaacaagtggattgttgaaggccgactccggaggtagggacaggacagagtagagcccagagggagggtgaggcatagccagggctctggaaaatgtaaatttcaagtgtttcttttttggtattatattcttcaccagcgtcttagcctaatttctatttcttaagactgaaaactgctctggccaagcgaactgggcggcctgaggttatgatggaaggggcagaagacggcctaggacggaggcgcagttctcggatcatggaggaaaccagtggcatagaagaggaggaagaggaagaaaatacaacagctgtccatggccgcaggggtcgaaaagaaggagaggtacagaccaaagtcaattagaaagttttcatcttttttttggatctggtagctctcctttctcaatgtccgcttgtttctgtgcagattgatgttgcagcatctagcattccagagctagagcgccatatagaaaaactcagtaaggtaccatgtttttaatctcataaaagtcgggaaatgtgggttgcacaagagctgaagcccttgttcaaattatatcagttttgtagggaggttgataggcttcagttctct

SEQ ID NO: 19408 - DNA, 2907 bp, Mus musculus
gccctgtcttcccctgcccaggtacactagctcagaagagtttgcagctgatgctctgctggtttttgacaactgccagaccttcaatgaggatgactctgaagtgggcaaggctgggcacgtcatgcgacgcttctttgagagccgctgggaggaattttatcagggaaaacaggccaatctgtgaggcaaggaagttgggagtcactttgtggcatcttctccaaccttccaaacaaaaacctgccgttctcacctgctgatggctgccctgggtggactcaagtcagacaatgctgactcttgactctgcccttggcagcacccacatcctcttgttccgaatcccttttctcccttcctcctctggctcctcaaataagagatgcagagatgaggtccttctggatggaaagccaaaaaagaaaaaattttcctgtctctcctcctcctcccccccccccccattaaaatggagagagacaaagaagtcctccttccccttcccagcttcctcccctccctgtccatgcctcagcatcctggggctatttaacaatagcaatagttctagtgaatgtgtgaaactgagaaacactctgtactgtgtgcggacccgcagtgacggccagtaaagtggacttaactcccaagtgtgtcgagccggacaccgggccctgaacatgctgcttccatgttcagtcccctccctgcttctcacttcctctcactcattctgttctaactcctccctatttttaaggttttgtctcacccagtaatgtaaaactatcgtgtacgggttctttaccttccctcccagtctttttcccttatgtggaaaacaaagttgagagctctcctgtctttctgtcctcatcttctgcctcccttctagttaaccctctaaggtgttggctcctcctcacatgctgagtttctgtgagtctctagccttttctgaagctcggtggctggggagcggacaggcaggcagtgccctaggccttccagcctccttcccctgcttcccaaacctccctcttgggaactcctcagggacaactactgctgagtttgagtgctcctccgagatgggggccaggtagcaattgactggcctcagagagaggaggagagagaggtgggtgtgggtgtgtgttttgtgtctgtgtgtgtgcacgtgcacagatgagagttgtgattgtgaccctgtagtgtgatgggactcattgttccccacatgtgtttattcccgccttcccattgtttcacaccatcaaccttttgtctttgggaaaacacaagaacaagggttctctggggacaaggctgtctctcctcatggtcatttcttttccagcctcttcaaactgtgcaatcttttcagcaggaactccctctcccttcactagctttgagtttttgctggtaggggggtagaactggatctttcctaaaccatgagtgtctgggtttagctgtgttttccttccttacaccgacttcatgtcccaggacccctttcttccccagcagcagagaccctggagcacagaatgggcagagaggaggatttgggtctaccactgccctgtgtgtgactgagcccaggttagcccccagcatgagaggacagctgctaactccaagctgtagccatgggccactggcccctgctttcctgctcagccaagcccctcccatcagaaattacgggtacttgcactggggaggtggctgctagctgacctaagcagggagccaaggcatccaagcaatgttccatgggtgggcggaggatgccaggtgaggtgtagcattccttgtactccagcagtactaaagagtggggcagtgcgggttcctgggcagccctgactcctcgacccaccctcaccgcactcccggttgcctgtttctaaagtcgccttttctgtcgatgaacctcaaaacttaattttatttgagaattttttttcttttaaataagaggtggattgaagaatatttgaattgactttatattatgcataaatatttatattttatctaaataactgcgctgtaacaaactttgtgttagtcagatgtttggaactgtttcccctggcataaagtgtactggagtcattcgctactggaggtgcgggaggagggagagtggagcctctgctctgctctgtgctcctctcccagccccacctctgccctcgggaccaggcactcagaaggaggaggtcccagacttgattgtagaaatggggactgaagggattgtgggcaggatgtgatcaaaggggccatttctcacttttctttcctcatcctcactgcccctcaagctaggtggatttttctcttgttgacaaagagtatttggtagggaaagcaggttaaaaataaagacagcccttccctgccctttgtgtccccttcctggtgacagcaagaaaccatcaacaccaacaagtttccacgttccttttacagcaaaagggactttttatataaccaaatgtggtgtcttagtgactttttgataatgtacagttttttgtgaatttaaatttatttctttctatatttttaggaccaatctcatttttaataaggtttaaaaaaaggaaaaaaagtctagagaaaaaaaaataccttgtttttgccatgtgatgttccacaggtgcggctgtagaaaagtgcttgtcattgaataaaaaccacatttgataaaagactcaagattgcatgtttctctcctgaagcataggtcactgtaccttagagaatgagtgtgatgggttgacctgtgctctgggttagtgctctgtgtccgctgtgggggtgggacaggaatagacaaggcaccagcaccctccctacaccatggatgacactagacaggag

SEQ ID NO: 19409 - DNA, 3085 bp, Mus musculus
gctgtcttgtccatcatcatccttgattaccaagcctggggagtatcatgtgtgctggtcctgaacacctgacagaacctggccccactcctccaccccttattccctggcagttatttggtgtagactaaaccccagtccagccttggacatggagcctgttagttcatgtacttggccagcagtgacatctgtgactttgcctcctggaggatcttttctgcctgggttctcacagcctctcatcccagctgcacatggctgtactcaagtggtacttggctgaatcacttaattcagcaggagccatcttatttagcagggctcacccttggttgtatgtacatgccaagtgcacacagtttgaagggatgaaagcaagaactgttgtgtatactgtgcatgcttgagaatggactgagctttctctatgcagcatacccagcccagccctggtgtttggaccccttccccagggaaccagaccaccagaaataattttccttcttgtggaaggacgacggggtgctaggatagaaaaaggcaagactcacagctccctggccactcaaaggtcaggagggacttgtaaacatgcctgccgttaactattcccttctgcaagactttcagcacaaaatgtgacttgttacatcacatcccttcacgtcataagtacacctccagtagacaaagcaatggagatggggaagtgtgtccagaggtcagtgtgaaagaggaagggcagggcatggtgatggtgagaaactggctcagcagctgtgcacactacagaattgggaatcctggcctgactgtgctgctgtgcgttctagactgaggaaggggctgaggacaatggacagcataaagtacaaaatgaccagttttctcattggtgcttccaacatcaggaaggtcatacccagttatcgacctctagccctctagcactcagtgacagactcagagctctgtcctgtggaaaccctgctgacagtcttgctgccactgctgctccttcactgcctattaaaaattgttcctttttctgtagttctaaagcaatttgaataactgacagttttaaaatttgaaattacctttttaggtttttcttttgagtatactggttagggttctagtgtttctggttgaacaggtgtgagcatgggaaatgagggcaacctgtaattttgtttttatagtggttaatggcactcactgtgtaatttctgcttagtgatttccatccactcttttcctcattagctcattactcagaaaggtagcgactgaagacaggaagtagtatgcaagccatgagggatgagttgtaagcctcctctccatcatcctgcccaaggctcctaacagtctcctgagtcctgtttgcatggaggccagatagatggctctgcactctatatctcacctgtactcattttagtacattgtggttttgcttccaatcaatcagagtggactagagctcacacctgacctcgtgtgactcttcactaggctccaggcctatcccatctcattgggtcagactgtagatggactggacttttggagacaggtcctgctattacttaggaatatgtgggaacaatgatagggaccaagcttgtgaagcaaaacggctttggaaagggcaagtgctcaataataaaaaatggggtggaagtgaagcgttatttgctgagggtttcggaaggactagtttgtttttgtccctggcccttccggtcaagtgggcacctcccattttgtcgccaagagcaatacagttgagtaggtggtagacccaaactcacccagccatttctagacctgaattcagaggataaggtgagtctagaggtatatacaaccaatgcttgttagaccaattcttaccaattcggagcaagccggtggctctacttctgggtaacctgcctcttaaaagtgcctttgatcccagtagtagattcagggtctacaggagccttccctcagcagctaaaaccaatttgtctcctctactctttgctgcacctcccggaggtggtctccatgtggcagtgatgccctcatcacccttgtgaccaccgctctgaatgttcaaaataagcatttcctgtccaagcaaatccctaaactccctcgtcctcattactcaactacctcagtctgacaactcaaggcacacaagcacctacttgcctcccaccatcctttactgcccttgtctttgtggggttggaacaaatgcaaactcctcagttccacaacccaaaactgctctttctggatcgtcttctccagtgacgttggctccctacaagagcgaactctccatatgggtcagtccctgtaggacaagccagggactatgctgtgcagtcaaatgccaggtttggagcatagcttaagaccgcagagagtaaggacttgagtggtggtggtgtgcagtttgagagagctggaatggacgtctctgctcctgccctctgggcgggtcgggtgatgacttctagatgcactccttaccctggagggaagttaatttatacttaagatgcattttgtacatttcccctttacccagaaacctgtagtttcatactcccatgtctatgccaacactacctatcgctcactctccgtggctgacttctggttccatttccttcctgtgacttggaagagctttacttttgctcacgtgaacctttcttttttaaataaaacacaaaagcctcctgtctagtgtcatccatggtgtagggagggtgctggtgccttgtctattcctgtcccacccccacagcggacacagagcactaacccagagcacaggtcaacccatcacactcattctctaaggtacagtgacctatgcttcaggagagaaacatgcaatcttgagtcttttatcaaatgtggtttttattcaatgacaagcacttttctacagccgcacctgtggaacatcacatggcaaaaacaaggtatttttttttctctagactttttttcctttttttaaaccttattaaaaatgagattggtcctaaaaatatagaaagaaata

SEQ ID NO: 19410 - DNA, 1185 bp, Mus musculus
agcaaatgctgaagtattttccaaggtagctggaccactttgcccgctttctggcagtctggatgttggatgcacacatgcgttgggggcggtgtgtgtgtgtgtggctgaattggggaggctttagtgggaggtgcgtgtaggaatgcttcagtaactttccttggctgtgatacaggagagcaatggccagcagaatcaactggcagtggagcccccctcagaccacggggtctatcctttccagttcagcaaataatgaggtaagaactttatggtggggaatgctgctatgctatgctgaactggaagatggtgcttgcagctttgttctgccaatagccagacaggttaattaatagtcgtgtcctcttcgtatcgtctccagctaatgcctcctttaggattctttccccccatctttgttaaacagaaaggaactcttggagatgctcacagactccagaaggtttagcaagttacaagcctagctgtagcctgctgagcactaacacctggctgtcattccctcacaggtccagacctggggagagaagcctatgcagtcctccttgggctccttcctgtggctgatggaacctgaggaatcacgttggtttttttttttgaatgtgctacattcaagatcaaaaagacttttttttcttttgcaaaagaagtttcttgctttgtatttaattgcagcgaacctttctcctaccccaaagacaccagttgaggtgcttctcatcttcgagaggtttgggtatgttgggcttttaaaatggtttaagaacaatcgcagtgctgtgaagtcagtgaaggggcgctgcttgccaggttcagttagggactattttcaatgtgtgttttagatatgcaggcttaaaacttttgttttgcaaagctctcaacacacactttgcacacacccacccacctccctcccacgcactgtttaaggcagggtctcacagtgcagtcctggctggctgacaatgtagaccaggctggctttgaactcagcgatccttcccactctgtctgagtgcaccgccatgcctagctagttgtttttttttttttggttttttttttttcaagacagggtttctctgtgtagccctggctgtcctggcgctcactttgtagaccaagctagcctcgaacttagaaatccacctg

SEQ ID NO: 19411 - DNA, 1195 bp, Mus musculus
ccattagggcctgggctactcagtcagcgagtgcgggctcaccctgcatgacaacttccagcactccatagcagtcagacacggtagaacttttctgcagttgtaacactgaggcaggagaatcagatcaaagccattctcagacacagggtttgaggccaggcagaggtatatataaaatacacacacagagagatagcctgtgtttaaaaaaataaataaaaaggaaagctaggtgcctcgaaatgaacatgtaggacataaacattctccagtatttgtgggtctaggagcctgtgagtatgtgtaggacacatatcccggacaggtggtcttactcctcatgtgcgtcttaggatggagtcaacagagaagtgtgaagccatcatcacccactttaatggaaagtatataaagacaccccctggagtagcaggtgaggcctctgggactcgggctgggagccattggaggaatgggtactgccccgtggcccagcaactgtgtatgttttctcttgacagcaccttctgaccctttgctttgcaaatttgctgacggtgggccaaagaaacgacagagccaaggaagatacgtgcaaaatggacgggcctggccaaggaacggagacatggtaaaaagatccccgaggaagcacgaaccctgagagcattagagttggaaatggcgcagcctggcttctgtgcgtgtaggtgggaagcttgagagtaagatgtgtggctgagccctggtgtctactcgctctttagcgcagtccccaaaacctgtcatgggacatgtgggtattctgggctggcaatatggacactaccttctttcttacagggcggtatggccttgacctatgaccccactgctgcccttcagaatgggtaagggtgtttcattctaattttcaaacagcagttagtggaggtggctctggctccccgaggcttctcactgaacaaaggcctctcctgcaggttctacgcagctccttacagtatcgcccacagcaggatgcttgctcaatctgcgctagccccgtatcttccatctcctgtgtcttcctatcaggtgaggtgtgaggcttttcctactgtgtgtgttaagtgaacgaatgtaaagcttttctatatagtacacacaaagaaatggtatgttggagcataacatgtgatttttatgtgtg

SEQ ID NO: 19412 - DNA, 1196 bp, Mus musculus
taaatatatatatatatatatatatatactatttcatttatttctttttgtatgtgcatatgtgggcatgccacattgggtgctggggtcgggggagaaaaatttttggtagctggttctctccttctaccatgtagatctgggaactgagcataggcctggcaacttactaagacatttttcaggccaagtttgaaatcttgtagctgagatctcagggaaagaaagcttcaaatcaaaacaaaacaacaacaaaaaccattgtcttttattaataataggttaattgtcttttcataataatcagaacttgttcatggagaaacagggttacatttgaaaaggattagacctaagaattcttctttctagcttgaactaagcctatgaaaaccaaaaccaaaacagaacatcccgggcattaggacccagtggaagtggctcgttctgactttgggttaacttctctcagtgacgtaaggagcagacctagctcattcttccccgcaggccccccccccactccctctctctctcttgcgtgctccttttctcctctttctcctccccctcccttctcccttccctccctctttccctcccttcctctctccctctcctttccccctcccctcctccctccctctttctccctccctttccttcactctcttctttctctctctcagctccgtaacagtaaagaaaaaatgctgctatcagtgacttccaggcctgggatttcgacttttggctataacaagaacaacaagaaggtaggaaaaaagtgcttttggggaatcagctacttcctttcctagggatccaggagcgcccttggttttagaattctcctttaagaggggaacgagattcctctgtcccccttcagcgcctctccttccaccgcgtctttcctgcctttttgcacctggttctggagttaaaggaatttagagcagaagtttgtgaggctggaggaggcagcggaataaaaacaaccaactttgcaagtttgtatcttctgaaacgaagttagtctgcctgtctgctgctgcgcccatggtcccggggatagtctgacaactcagaccttgtccctaggctcacacccggcaagattattttatcattttggttaattgcatccacccttacccccacctcacttcgctttttactcaacccaccagata

SEQ ID NO: 19413 - DNA, 1583 bp, Mus musculus
ccctgaatttggagcgcttccgggagtgggcagtggtgctcggagacaccacagtcaccagtggcagacactactgggaggtaacagtgaagcgctcccagcagttccggataggagtggcagacgtggacatgtcccgggacagctgcgttggtgctgatgatcgttcctgggtgttctcctatgcccagcgcaagtggcacagcatgttggccaacgaaaaagctccaattaagggtattgggcaaccagagaaggtggggctgctgctggactatgaggcaaagaagctgagcctggtggatgtgagtcggatctctgtgatccacacactacagacagatttccggggcccagtggcacctgcttttgctctttgggatggagagctgctaacccactcaggactcgaagtgcccaagggcctctaatgtggccaagaccctgaatcgtgctcatggtcagctttctgtccttagtgtctaaagcgattttactttgtttcaagcaactggtagctctcacaattctgttgggatcctttgtgcaatattgtagccatcttcccctgggccctactctgtaagagctaggtatacagccaaagtcgccagtttcctaggtcatcaggggattcgcctcctcaggccagttctttgggtccttctacttgtgcccacacaccttagactgttcagtcctgcggtcctgcctctcggcccgtcccttatccacatgtaacttgttttgggggctcaccagattctctagagtaaatgctctctacctctggctggaggagtggcagccacaggcttggccttttctctgatgcacctcagattcttgggttctggcttcctcagttgtacctcagcactagagatgtcagtccaacccagatgcagctatctccactctgagtccatctgtcttctggatacctgatacctaggcagtttgccataaccattgtgccagttatgtgacaaagggaaagagacactagggagacatgtatggctctggtgccagaaacgttaccctcgataagttccttctgtgtatctgccacagttcaaagctccagaaaaaagacaactttacacaatccattttggagcctgttcagacccacaactcccatctcccttggccacagaatgtacttaataaaagcagtattttggtttgaggaaaacctggtgaaacagttgaatatgtatgcggaatattcagtttggacttgtctgaccctgggtgctacaatggtgataactgatgatgtccttaggggagaaagagaacgactaaatttagcaaaatataaaataaaaattataattcatgtaattaaagtttatttgaacacaaaatactctgtctataaaattgctgtcagcagtagcagcgtgtcctggctaagatggacagatctccgcagacttctaaagccacgtggtttggctctcacccatttctcttactctgcggcagatacatatgcatgtagctagaggctctccaaggaagttgcttgttggcatgatgatttcttcagagaggaaaaggggacctgggta

SEQ ID NO: 19414 - DNA, 1179 bp, Mus musculus
gtgtgtgtggggtggtgcagtgactcattctctccactagggttcagtcaggcccagccttttcagccccgtaactgtagagatgcaggttaactttttttttccccttctaattacaaaactacttttaatactttgaggtatgtcgcatacctcaaaactgggaagagtaacctcactttccaggagtggcccagggtaagagaggaaggaaacacgagagggacctgctgcagacttgcaaatgccgaagggaaggaactgtatagcacggtgggaaggctctggcgcataggcgaagaccaagagggttggtcacgaagccgttctcgtttgcctttttctgtttctgctgcacgacctccgagtctctccgcctgcgggcggcagaggaaaccaatcgttatcccggcgcttccccttaaccgagtcgctctccttgctctgggagagctcgcactcaggtaccgcggtcctgaagcagctcccacctgcctcgtttgcatcccatcttcctcttctattgacttttaaacgtcggagcaaaaatgttgagggaatttcctctagagaggttgtgcctgttctgctaatgcttcgggtgtggataatgaagagggaatggtttcagaactgggtctctgaagcacctatagacttgcgccttcttattccctgccctcatcatgaccactgagctgtattcctggccctttttaagatatggttgtttgcttgttttaatttgtagacgaggtctcacgaagttgacattggaactcatacacactgtagcgtagggcagcatttgaactgtggacctttctggcggagcctcctgagtctggattataggtatgtatcgccagtggaaatacctgcattattttatactcattcagagagtagcttcacctgtcatttcttatattactttacttctaccatcaaataaacttaccttcatcatttagatgatctgtgtgccttatttttttaagatttattttatttttagttatatatgtggggcgggggagtcataatatgtacataagtacaggtgtccttggaaactgaagagaccaccagttcccctgagctggagttatcgtggttgtgagtcctgggaactggacttaggttcagtatcaagcacagagccatctgtccagccca

SEQ ID NO: 19415 - DNA, 1190 bp, Mus musculus
ctggagaattccagccaaactgagctccacccagcttcggagggtggctgcttctttgagtcagcaagaaaacgaggaggaaagggaagaggagccagagccaggagtccccggagagcagggtcccagtgaggagcaccggacagaagccctgagagcccttctgtcagcccgtaagaggaaagcaggcctggggcctacagaaggtaaagtgccatggcccccgcttggtgacttactctgtgccaccgtgtggcgtgagggctgttgagacgatgcagggccggttcccgactgtgtcttacatcactgcagaggaggccactggggaggaagaatggaactcagcgcccaagaagcggcaactgctggacagcgacgaagaggaagatgatgaggggaggaggcaaggtagggactcttgtcttcagtggagacactggccatttgccttatccttttacatacttagatgctttccatttctgtctcttacctgtcattcccatggcagcagtgtcgggaacgccaagagtccacaggaagaaacggtttcagattgaggatgaggatgactgaaagccagatgtgtttgaccgatgtgagttggaggcacaaaagctacttttgcctgcgttggaagcaatcttctctacattgacagcccaggaattttaggcagcagtgttgggtggagtctttgcggtcagtccttgccccaggttcatcagcgtgcacagccggtctctgggtccgtctcgtagcaaatgaagagtggcgaaaggttcaaggtggcttgtcctcctctaaggactgcgtcttggcttctgacggggagctttataacccagcacggttgttcattctgtcctcacaaagcactggattgctcccattttctttctttcatcccaggacacatgattgaacccgtttctacagttgagggagagctgggatgcaccactctcaagctgacaagcatccctgatttgtgtttcatattaaatgtgtacaattaacagttgctcatctcagagcggccagccagccatctgttgtgtcttcggaagaacttttaagagtaaaattaaaagacatgtcctgaactgagcttggtagtgtgagctaatcccatcgtgtgggagacagaggcaagagaattgccatgagggagaggaaagagtcat

SEQ ID NO: 19416 - DNA, 1185 bp, Mus musculus
agctcagactccaatcactttttattacagcataacttgcgaaaattcagccgggatattcaggtacttggaagagccgggaatagtggcatgcagctggcctttaagtatagggtaagagctggggtacagagtctggacgtggagtgtccctagcagagtaaaggactgaatttagattcagggactgtgaaggaggaaaatactaaagacactgaaggcagggtctggattggcaggtcactaaggtagttaaatgggagcttgcctctgtttttcctacttagacctttcccaatggccctacccagttggctgagatgatctttaatcttcttctggaagagcaaaggattctgaatcaggctcaaagagctcaagaggtaaggttagtgtgatgttgacattcaaaagcccctgggacagcaaggtgcctggaggagagtcagggagcttgtctcagaccaggatctcctccaccctctgcggtaaaatttcaggccctgattttaaggatgaaaactctagagttcatgtgggagtgaggggatgtagcccacaccgttaatcctagcattctgggctgcagaggcaggtggatctctgtgagtttgagccctgcttggtctatgtagtgagttccagaacatccagaacatacatagagaaaccctgtcttgaaaacaaacaaacaaacaaataaacaaaaccacacaataacaaaaaaacaaacaaaaaaacccaaaacctgacaaacaaaaaaacaagtcagagttcaaacacactcggaacctcttacctcattcaggtgcagcccccaccagcccccgaagcagttgtggagagccagcagcttgagattgaaaatcgaatccagggtttacatgtggacattgaggttggcgggtgtggcaagtgctgggtggggaggactcggttttcctgccctcagaagcagcctcactggggtcccatctcctctacagttcttggtgagatccatcaggcagctgaaggacgaacaggatgtcttcagcttcagatacacagttttcagtctgagtaggtcctctcaatgtgggaggaggacaggggccatttttggggtctaggggaaggacggacaacagaagctaaatgatccagagagcagtggtcacatatggccggtggtagtacagcatc

SEQ ID NO: 19417 - DNA, 1148 bp, Mus musculus
gaacagacactggccataatctttctaggatcctgaggctacctaccatgctgggagacgcaggggtcttgagggctggtcaggacatttgcgaggtccttagagggtctggggcagtggtgtctttcaggttggaacgactttaatgttttgataattggctaagttggtgcaaagcagcatcgggcctttgtggggagttcagacatgaatggaattctgttcttcctcctccattgctaccctgggtcctgtcaaacccagagccctgcccgtggtaggcaaccacggtggccctgagccatacctgggcccttcagttctctcttccagttacctcaggtgtactcccttcgctcctgactccagttctataaatttccttctcttcctatagaggctgagcgctgtctgcttcagcccaccatgtaaaacagaattcatgctagcagctcccttgccatgatcaattccccacctacaaagtaatcctgacactctcatgaagatgtgaagctctgctgctctaggccatgccgtctctacctcccccagcgcttgagagaatcactcctggaggtttgaatggtttctgagcacttgggaattactccttatagtactcagtagagctgagagcttgaagagaacttagctattttattattttatgaataagagggcatcatttcttttgcacagtgttttgttaacatgaaaggaaaaaaaaaaacccaaaacttctgttccttaggagtgacctaggcaaggaccaggttccttgggtctcagaaccttgaaggtttatcagacatctttatgccttagccattgttggggaacccaggaggcaattgccttgccgctgctctacggtgtgcttgtggtacaacttgtgggaaacgaatgtgaggacctgcactgtggccgttctctaacggcgcatcagaacagtccaggaaggggttaataataactgggacaggggacagcagtgccatgcccagcctcaaaggcggcacgagccaaccaagaaccaaggaggcagacaaagaagatacacacaggagcagaagctcaaggagccagaagcaaaagtcgtgagaaaaaggtgcccggccaacaggtgaaattaagaaattcagcaa

SEQ ID NO: 19418 - DNA, 1135 bp, Mus musculus
tcatctactgtgtaccctcccttgtaccactgtcttctctgtgagctccattgctttactggagtcccgctttgtatccagcgctcacagatcgctcctcccacccccatctttccccactcccagtttccgcaccagctctcctgctcacccccccgcccctgcccctgcaccagctctcctgcccctgcccgcaccagttttcctgctccccctgccccaccaccagctctcctgctaacccctccaggtgctctatttcttggagcctgttcgctgtctgatccagaaccacctttgccaaaaggagttctgcctagcgtgcgagctcggcttcctcttccacatgctagacctctctcgtggcgatccttgtcaggtcagtcctccgagacctgggacactcaaaatggcaagggacagaaggtggatggttgaaaagggcacatttctgtcaacataaccctcttcttccagggcagtaatttcctccgagctttccggaccatccctgaggcctcagctctgggtctcatccttgctgactcagatgaggcttcaggcaagggcagtctggcccggctcatccagaggtggaaccgcttcatcctcactcagctacatcaggatatgcaggagctggaagtgccccaggcttatcgaggtgctggaggcaggtatggaactggacaagaagaaagcccccaaagccagccccctgggactcaaagggtcttctaatgctcggtgtgtgtgtgtgtgtgtgtgtgtgtgtgtgtgtgtgtgtgtgtgtgtgttgccctcacctctctcagcagtttctgctcatcaggagactccatcattgggcagctgttcagttgtgagatggagaactgcagtctttgccgctgcggcagcgagactgtgcgggcctcgtccaccctactcttcacactctcctaccctgagggtagcatctgtggtataccctgcacctgggttgggaggctccctcagataacttgtaacaccacagaggggtcttggggggaccgtgggtagaggagggagcctggagtgaagtgtcaagtttcccctcagataaaaccgggaagaactatgactttgctcaggtgctgaagcgaagtatctg

SEQ ID NO: 19419 - DNA, 1178 bp, Mus musculus
gccaaaagatgggacctgaatggggacagaactctggggatattaggaattgtgtttctctggtgtccacattaacctttgtgacataggaagaagcagagttacgcagtgatggtaccaagtccaccattaagccaagccagatgtcagtagcaaggatcacctgtgttcggggccaagggcctaacgagggcatccccttcattgatgactacatctccacgcaggagcaggtgagaagatatgaggggcattgaagtcaaccctgtgcttccatagagtgcttaagaaccctaagaagagtgactggaagagaccacaccttctccagcccagagatttgtctttttctctactcctaggtagtagattacttgactcagtactcggggataaagccaggagaccttgatgccaaaatctcctcaaagcacctcacaaccctcaagtctacctacttaaagcttcgctttctcattgatattggagtcaagtttgtgggtcatggtctgcagaaggacttccgggtcatcaacctcatggttcgggcagggcttatttcagagtgtgttttttgttgttgttgtcttcctttgtttcttgtttgggttttgttgttgttgttgttttgacacaatgtctcactaagcagctctggctgccctgtaactagttaagttaagcagaccggctttgaactcacagaggttcgcctgcctcctcctgagtgttagaactgaaggtgtatattaccatccctagcacccccctccctctaatatacagccttcttccaacccaacttgctccgaccatcttcattcactcaccatactttaaaaaacaaaattaagtttatttggtgtgtgtgcgctcatacacacctcctcctgcaagtactgagttacacgtgtagaggtcaaagatcagcttgtgcacgtcaactctctccttccatctcgtgggtcctgggaactgaagtaaggttgtcaggcttggtggcaaatgcctttacctgctgagccaccttgctgacctcggagttactcttctggctgactactcagggcatatatctgaattcagagaatgggaggttctggatcatctgtctcaaggcttcttttcttctggtccctgctaggtgcccaaggaccaagttcttgacacagtctacc

SEQ ID NO: 19420 - DNA, 1204 bp, Mus musculus
ccagcttgggatctgggtcaattctctgtcttcttggtccgcagtgtgagagcattgtggaagaatacgaggatgagcttatcgaattcttctccagagaggctgacaacgttaaagacaaactttgcagtaagcggacaggtgagcacccccgactttccgtcccacgctcacagccctgtgtaactcggcttgcggccctgaccctcgccacacagaatgtgtggccacacgctcagacctctgacaggtgtcccacactgctggcttccatttcccttggcttagggtttggagtgatttctctccagtctctgcctaatagttctcagagtatgtgtctctgttaccctgggttcaggagagggagctgtgggaggtggttggccacggtgattgttggttggcgcgggtgctttctggtgaggggtgtatgtgtgtgtgagggtggctgtttccttcacactgttacgtactatttgcagatctatgtgaccatgccctgcacagatctcacgatgagctatgaatcactggagcaagcagcctacaccaaacgtgatggaacacccccaggaggggaagatggcagcattgccttttatattacgtttttatggaaatgaactgaaaaaaactcttgaaaccgaaagtacaaactgtgttgtcttttttttttctcattttggttttttgagacaggttttttctgttgttttgtttttttgttttttatatagccctggccatcctggaactcactctgtagacaaggctggcctcgaattcagaaatccacctgcctctgcctccctggtgctgggattaaaggcagcgccaccactgcccggcactgtgttgtcttttatgcccaaaggcagcctttgtaccaggcttgaaggttgggggctacagatgggaagaaaatgaagggatgggttgtaatagcgtacatttaaaagggccctggcccattaattctctgtcatgtggaattctgttcacttacaaactggagatgagtatttattcagtgtgtacttaatgatgtgttagcagctgtggtgctgtggagaaagagcctgaatgacagcacaaggcgctgggaggtccctgtactcctgctggaaaaacattgaagatgggaactgatctggacggaagtaatcgagcaatcgagctgcgttcttttgttcttttctct

SEQ ID NO: 19421 - DNA, 1232 bp, Mus musculus
gtcagtatctgtaatttcaagatttcttctgttcacaaatgaccatcaagcaactaactctggcatcatagcgggctttctgcgtgatgtcacctccacggccatgaagtcattaaccaaagacattctttaagaaagcatgccaagcaggtagaggaagtgcaatggtcagttgcagtgttcagtgaccttcaaacgtcgcgtgctggagctttatcttcagcattctccggagaacccgaaatgtgttaagggcaaagggaaaagccaaagaaggaagttaactgagttctcaggcacatccttagacacctacaatccctttcccacccactcctaattagcctaatccgtacggtccaatcctccccgcgataacatctgtcaaaggctcagatcccgcccctcttccattttgggccaatggtcgaggccggggtgggtcgccggaggggggcgggctcaagtttcgggcagagggcggggcctcgccgaggaccctgggctgggcgcctgtgccggtttgtctacccttcccctcagccgcctcctttcaaccttgtccgccggttggcgcggtctccatcacagcggcgaccgctcctgttgcagctgtagctctctcccttcggtcccttcccgccaggtcccggagtttcgcccgccatggctctactcactgcagcaacccggctcttgggagccaaggtgagcttaaaggagggagcgcgccgtggcgcgcggggtggggctgaggcgaccgcagggcctccggcaccggctctccctcccacaccggagcgcagccctccgcgccttaaaggggcccgaccctggcgagccgccaacccttcccagagctcctaggccatgtgctgcgtgcccttccggctaaggtgaacgctgccggccccggcctgcagcccccggcggccgggaggcccgccttctgtcatatcaagtatccaaggtgcaagcgagggatgcagggccctggctgcaaggccagagagcaaagatgtggcgtggtcccccgaattagggagagaactgttggaggaggagtgggggatgtataaatatgctcacttggtcactggggctaatttgggctctgctttgtagggtgagtcctgtcaggacctgtttctttcctcactgtaattgaagcctgtaagtgaccccgccgttttagttttgttaggggactagagccccccagctcctctttg

SEQ ID NO: 19422 - DNA, 2392 bp, Mus musculus
ttatgtttggagatggggtcttttattgaacctggaggtcattgatgccactctgtggtaacaagcttcaagtggtcctcctgtctccaggatttcggcacatgtcacaaccctgacttatgtataagttaagaatctgaacttgggccctcagccttaactggcaaacattctaccaactgagctgtttccttggcctctggctttaaatacatagattttcaggtctactctaccaggctccaccagagcaaggactcttctgcgtccgtcctcacagagccctttgatgtacttgctgtggcaggggctggggttgagcccttgactgacctgtgactactttccctggtggtctttttatttaaggctgactgggctaagaccgaggaggacgggtgttcccatgttactgtgtatgtgcatgtaccactctcacacaaggcttcccttctaccttgacagtactatggcatgacggagatgaactactacacagtcctgtttggagtgtctcgggcactgggtgtgctagcccagctcatctggagcagagccctaggcttccccctggaaaggcccaagtccatgagcacggatggcctgatgaagtttgtggactctaagtaagggtaaaatgggagactggggggaaactgactataagaaaacgaggaagcttaaaaataaagtgtaattttgttttgtttcaggggcctttaagacttaagattaaactgtatctgaggcactgaaaatatatttgaagttaaaatataaattaagacttgaaagacaaaagtgaccccttctcccctcaccagttcacctccccctcctggtatgagctgcccagcagctgtaggatgaccgggactgaagcatgtggtcagggttagatctgcctaccaccatctctagagcaagactcaggctcctcctctttaggtcagagcaggttacagacaagctgcagtcactcatggagctttgtttctatgctgccacccccaagtcatctacgccagggacaggcccctttctttccatagaaatcatgttggatgccagctgtgtccaacactagggcctttcccaatgtacacaaacacctcctacctagcaagatctcttggttagctggagacgctttggcaactttttatgctatcagatgatcttaaatggcgtagtatttattgtgactggcacccaacatttgagttatttctccttttaaatttataccattaaagttaaggtctggggagttatgtttccttccaggcctctatacctgctgtgcctcaagctgaggatgctgggggtctccctgtcctgaactccactagggtcctctctcagcaggtctgtccgacctgtggtcttcctggtcgtttggctttatcagtacttaatgtgaactaggtcttttacttccatggaacataagccactatcttctgaccttggtttctcctgttaatatgctctggcacggaacaagggctcaggaatgaccagcctcttcgggcctggtcccaggggttctagcttttctttttgaacagcagttacacacagttcccactgaatatcagatggatggacctagggcttggggccttcttctcatcccgtgtcaaggaaacggtcctttatttatcagtgtcttttgctcttcccttaagtaagagcccatagcacagcacttattttagcagccccatttgcacagattttcagtgactcagaatgctctactgccttttctttgagaaagggttgagatacactcctgtcctgcccctcctcatcccaaagctcctgcctgtgtttgtatggaacccaactccagcaccaccacactgttgagatggacacactgtaaacccctgggtaactgttaaagtcatgatgcagacttcaggatgttctgtataaaattaaaaataataaatgtttttattaacaatgtttgagcttgctcttacgtaaggcctgaaagactcattgtgaggaaggggtctggttagcaaggtctgaagcagtgattctgagcattcctcctctggcaagctggacatttcagagggaggctgatttccaaagacctcgagtctctccccaaggttaagaagtctttacctttaaccctcttccctcctaatttggacagagacctcacaagtgcttgcctgactaggccaggagctggtctagcccagtgggtgaaaggaacaagaagcctaccaaggacaaattagaaggacactagagggcgcttgtggttagtgtgtctccttgtccttttccttaaggaggcccccaaataagggtggtcctcagaagcactagatacatgggaagtctaagaccatatgaatctgtc

SEQ ID NO: 19423 - DNA, 1207 bp, Mus musculus
gtacccccaaaaccctctctgtggtcttggaaggggtcccgagaggcggggtgaggccaggccgctgggctggagtgcgcacactgtgtatgttatgcacacgagtgtttctttgtcaatgactccagtacctgctccagtgggaggccccttcctccttccctctcagccgtttctcaccctctccccacacccaatgttcattccctgcctccccttcccaccgcaaaggaaaatagccttacagaccctagcccagaaaccctactccaggggcgagccagtgtggccccatcctgcccgccaagtttgagccctgtcttttggggaaggcagggagcagagcagcctcttcccttccgtggtggctccgccctcaggggccttagcctagcttgggtgaggacagaggtgaggaatctttgaggaccaagccccgtggtctgggaagagggaggtagaggaagaagggtctgacttggggactccctcctcccaacccaacccctatagagaagcgaccaaattcccagagatagaagggagttggggtggggagggtctgctccttgaattacttgaaggtactgactccgaggctgctgttgcccacgtaggtgtgagggggacattgtcactgcgtttgggagggccgaggacggcgggtgacgagaggatctaccttggccctcgctcactcctgctaggccctttccctgggccctcctgtccccaccctcactctgggcacccctccagttgcactaaagtagctgttgtgccagtcttacccacgccaggtgccagggtggggtctctgcttccagtccttcctcccgcctctgctcccatcctggacaatcttgttcactcgtattcctggatagctcagctttgtgtgtgtgtgtgtgtgtgtttcgggggtgggggtgggtttggctggagtgggtctggcaggggtttgggaagggctaggggaaagatggaggatagtatctcctacccccttccccaacttcaagccacagaagcctgggagggagggtgcctactctcgctgccgtgtgtcttgcagatgtgccaaaataggggtgggtgggaggggagggtgcctggcagagcagccccagggtggctctctcaaagcaatacagttctcctgctggggaacagcaagacaggggagagggttgggtggggacctggg

SEQ ID NO: 19424 - DNA, 1103 bp, Mus musculus
accagcacatgggggacgacatggtgcaggagccagggctcgtcatgatatttgcgcatggtgtggaggagatataagagcgtaactggctgtcaggaagaggtagagttggaaaacccattgctccagcagctgagccctgacttctcccacagcccttatgccgcggcttgtacctgagccacgtactccctgcttctggcatgaaggactttggggcacttagctcagcctttcagcggagaacccagattcctgccttttgctatattctttcccccacaatgtctgtaaattttcagtcagggtggagaaatccccacttctgtattttcctgactaagatcccctggttcccaaatattttcagaaagcacaaagaaatttgttttccctagaggatcagggtagagtgaggcatttctaattgtctatctcttccaaaaccagggagtcccagcaggcaggagtcccagcaggcaggcttgctgaagtcacgcagcattgagagctgctctgaggagccagcacctggcagaagggctgagggtgtggcccaaaccctctaaccagtgaggccaaagcctggtcctcacgcgcatccctgtccaggccgctgtgaaggtgcaggccttgatgggtgcgcagggtggcccctgtgagggtgcacagggtgggttgttgaaatgttgctgaactctttcctacacgtttcataattaggaagggaaggaaggggtgggcgtgagagcactggtgttcgtacactcagcaggaagctgctgtctggctctgctgatccagaacggcactgcctcaagagggtgtctgtgttgcctcggtggcccctcttcagccctgtgattgcagttagcttgatttcctttggtgttgtttgtttatatttccaagtcacaaaccccatctgttacccagtcttgttttcataggatggactggctgtgtctctctgatctagcccagccacattgttggcaatttaatttatttactttttttttttttaagaaaggagaaaagaaaaaacatcaagaaaacttaaaacctttcttatgccctttctttggctgttcctattgtgg

SEQ ID NO: 19425 - DNA, 1189 bp, Mus musculus
actgtatgttgaatttgttgacctttatcgtgcaccgaatgtaaatataatggaactctcctgacacttaagttgagggaaaggacattcttgtctctctgagtcttccctttcatgcacagtcactgatcgcacagcggaagccacctgctgtgatgcacactgtagttctggcactctggggattgttgagtcagaggccatttgttctgtgtagtgagttccagaccagtctgggcttcgtactgaaggcagggggttggggggagggtatgagaatgattggcagtcacagtgtggagcactgggaagtgagacacgagcctgtcagaaatgctggggccctcctttccccttgaatcagttttctgttttttaatttttatgtgtttaagtattttgcctgtatatatgtttgtgtaccacatgcgtacatgcctggtgttgagctggtgttacaggctgtggtccagcgagtccaacgacagctgtctaccagtggaaattccaagagtccagctcagttcatccatgttcatccatgagactggatgtctcagatggttttcagtgtgtggtgggatcctgaaggcataggctgtaatggcagtgaaggaatgaacttgctggcaagagcaagcaggcaaagagtgagagcttcctttttccatatcatttatataggctacctccaggagatatggcccagattaaaggtggttcttcccacgtcaaatgatttaagaaaaaaatcccccacaggtgtgtccggcctctaattccagatagagtcaagttgacaaccaagactaagcattgtaagtcagatcaatacacaatcatgttttgcttaatttccaaatgaaaacaataaccagctcattattacgcctaacatgatagaattatttttcatacaacacattataagttctaggtctgaagagatggcttagcagttaagagcactgactgctcttccaggggtcctgagttcaattcccagcaaccacatggtgactcacggccatctataatgggatctgatgccctcttctggtgtgtctgaagagaacaatggtgtactcatatacattaaacaaacaaacaaacaaacaagattctagataagtgcagtgtcccttgagggacatttctcatagaaactcaaataggagaaccactgatc

SEQ ID NO: 19426 - DNA, 1115 bp, Mus musculus
acatcagcaaagttgaaaatacttaaatctagccaggtggtggcggcggtggcgcacgcctttaatcctagcacttgggaggcagaggcagtcgggtttctgagtttgaggccagcctggttctacaaaatgagttccagaacagccagggctatacagagaaaccctgtctcaaaaaacaaacaacagacaaacaaaaatacttaaatcttttactgaatgtaaaggtgggagaacaagaaaggaagggaatagggttggtggttttaaatttttaatccagtgaggtggtcctgcaggtgtctgccactgaccctggtttgggtttgatccccagaagcgtaaaggagaaaaacagccccataaagttgtcctctgacctacaggtcatacacacatataataataaaacatccacttcagtgtattatctgaaaaatcacaacacttttgtattatccaaataaatccatatctaatttacatttccctcattttcccaagaaaattattttacaaaaaggatttgtggggggctggtgagatggctcagcgggtaagaacaccaactgctcttccgaaggtcctgagttcaaatcccacaaccatatggtggctcacaaccatccgtaacaagatctgacgccctcttctggagtgtctgaagacagctacagtgtacttacatataataaataaatcttagaaaaggatttgtgtataggtgtttgtgtgtgggtctccgtgtgagtggtgggtctgtacacaagtacatgtgtgtgtgtggggtctgtacacagctttaggtgtctatgtgtgggtctctgcataggtgtaggtatctgggtgttggtctgtgcacaggtgcaggtgtctgtgagtgtgggtctctatgtgagtatctgggtgggtctgttcacaagtgctggtgtgtgttggtctgtacacaggtgcaggtgtgtgtgtgtgggtggacagataaaggtgtctcctagctaatttacatctaaacctggattcaacccaagaaccgcattgttattgtttctcccttcctcatttggattcctaaagggtaaactttgagattttgttggttagctttctctccatgc

SEQ ID NO: 19427 - DNA, 1123 bp, Mus musculus
tcctctgcaagccagccagcctggcattgctttgggtttgaggtccagaggctcggataagcttcatatcgctagtccccacccccaccctgtaactggaaataaggatggggaacaaaagggttcaagaagccctatctatctttttttttttttttaaccaatttttattcttgtgtcttcatggtgtctgggctttttttcgtttttcttttttgtcttcgatatgggctgcttcctcaccaaccccggctaagggttcttttcccttgctttgttttacagcccccaactcttgctactccagccttgcagccagcctgtcagagtacagtggacagcttcagaaagctccactaattctggtttgagtttagccctgaaaccatttggggtctctctgttgggtgtcagactcttgacaaacagctgttgggtctgtgacttgtgtgcaccctcagcgtgaggctctggttcccagttttctgcctttgaccttttaaagggagatcggtctagggtcttggtgtgaagccccgaaggctttgacagctgtgacctgcttcagctttcaagtgcttaactctttgtcatttacttctcccttcacggatctctttatacctcccaccgagaggtgctgactctaattagggtagaggaaataagggtcaaaaggtaaagagaaagtagcttcctggctcagtgaacagaacagaaaggtaggatcccaggtagcaaggtaggtatggtacggaagtgtttgagttcacggattcccggcggttgtcttactacttatttatcaagctgggtgggtggtctgagatccttgctagagaggagaccctacaatgccaaccatgcctggcttcagtagaagcaaaatgtgcaggctttagtttttaagtgagcatgtcctgcctcactcccttgctctcttaacacaccattatggacggaagcctagtctttatcatgtttcccccaagaaatacattgttgtatcacttagagactcaaaggggtttttgtttcccttgagctccatcaaccttcagaatttttacagttggttggaggtgaggtgccgagatagcggtgtcctgccattccaacgtca

SEQ ID NO: 19428 - DNA, 1596 bp, Mus musculus
aaggaaagctcctcctgccccctcaccacccccaccatgcccagcagaggtgtgcagttttatatccaattattatccacggacttctgactaaaagatgtttctaatgcctgggagagagaataggagggaaagatgtttatacgaggttctactaactggttctgagggtctaccccttcagaattactgcatttttgaagtgataacatgaaaatgaaaccctttaaaagggaggttttaaaaaaagacacttcggagcccacaaaaaaagaacttttttaattattattattattattttgaggggaaagggcaggttttaagaggaattaaatttctggggcaaggtgtgaggtggaatagggcaccgagcctgtctccctgagcccttggcagtgctgagtcagctcccctcacccattccagtttattcatacaaatccctcctgctgctcgtcatggttgctgttttaggcccagttcagccaatgaccttttcctccagtcagctttgtgtttgtgtttaagtcacctgcttactcgtcagcgtctgtgtacttgtgggaaatgtagttttcggggattctgtggtaggaaatagaggaagaaggggcctcagttgggctcttcttcctgctttcctagttgtatctgtgagtgcccaacaggcatcagagggggagctctaagaggatggggggcctgcagaccctcaagtttgaaaagcacttaagcacctacttttgacagtgggacagtctgctaacttctgcccccaccaaccaagcctgacagaacccagtgatagctaggagttccccaaatgaggacaaagatttgggagcagtgcagcgtgcctctgcactccaggtcttcctcttcaccccctacttggaggcagacacaattccaggccgcaccagagcctggcccctcccaccaggcgctttgctccttctgtcccagcgtctccttcctctgcatctccacacctttcttctgttcaaagtcttctgtaaaattttctttccttctttgttcttttctttttccttttttttttataaattaatttgctttcagttccatcttgtgggtgcctctgtgttctcttagctgtggctgctaggcagggagcagattgggctggggcagccttcctggagtccctcactggacattcaccagggttgcagaggcccacagccatcagcctcttgccacaagaggccacacagcagtcaggaaggcagcagcggcagcagcagcaggagcagcagctgtcacctactcaagattgagctccgggaagcacatccctacagcgtggacctgaatccttttaaacatggctgcattccttcccttattagggaggaggcaggcctacacctacttctgttgctattggcccctagccctgcagcagacaagacaggctctggcagcactaatatgtcctggcattttagcttcagtaaacattcacaggctttcccacaaaaggcgttcggtacttgggtgagtgggggccaagaatttaacctgaaaaggaatagataccccacacacaaacacacatagctaccttga

SEQ ID NO: 19429 - DNA, 1207 bp, Mus musculus
agggtacctccacgctgtccagtagagggatggaaaaaggacttttgttttagcagcagaatggggcagttagctcaaccctgcccccgccaactctagaatcaccatcagaccagccttccctacaagctggtgagcgttcccagacaccagcaccaagacccctgtaagtcaaatctcagagaccattctaggagaggaggtaccacacccccaaactgcattcctcattgaggaatttctcccctcccaagccagctccatgcagagtcatgccaggagtaaggcagatggtagtagggtatggccagaggctagagcacaggttgggaaggaaaaaaaaacactagggagataactagaggagaggctgggaggagccgtacccgccccatgggcccgtcaccccgacaggatatgcctcacaaatgctgcaggaaggaagagacattaatggtgaagacaagacacagacatggggtgaaggggtcaggcagtggaacagacattctgtttacgtcccattcctagcccaccctccgtcctccatcacccccccctttactgctgtctccccaacagttccctcccaggctggactgagccttgcttgcccctttgactcccgactcccttctggaaccaagtctaggaatacaatgcctctttaacatctcctgaacgaccatttcctcacaggccccagtttatggtctgcccctcaccttcatagttgatgcaaccattgctgtcctcatgccccgccactagcatctctacttcttcctctgtcatcttctcgcctgcagaggaaggaacattcttagaactgagtgactgacgggtgaaatatatcaggtggcagctcagctccagaaaggtcacagacccttacccagtgtgactaggacatgacggatttcagcacccatgacggtgccatttccttccttgtcaaacacacgaaggccttcaacataatcctcgtaggttccctggtccttgttcttggccacggtctgcagcatgggcaggaagtgctcaaagtccagcaccttcacattcatctctgtcatgtgggaggtggaggtgtcagacaagagaagtcacacatgttctcaggacatgacggtagggaacacaaggacggccagaagagggaatcagaactggatgagacaaaacttgctcaagtttggcacctatg

SEQ ID NO: 19430 - DNA, 1185 bp, Mus musculus
tcaccaaaaccacccgagcctttgaatgccaagcttcaatactttatcactgcatttgccccacaggttcggggtgaagggaccggcaccctgggctctgtatcccttcctctctctgagctcctccaggaggaccagctctgcctggaccactggtttgcactcagtggtcagggccaggtgctgatgagagcgcagcttggggtgagtaccagggcaggaaggcttaggctccagagggtgggagatgtcaggagcagccctcgggcactgggaaccatgctgcccggctcaaacctctcctgcccccagatcctggtatctcagcactcgggagtggaagcccacagccacagctacagccacagtcacagctcctcctcgctcaatgacgaacctgaggccttagggggacccactcaccctgcctccccggtcctagaggtcaggcatcgcctaacacatggtgacaggtaaggggctggaaggggaggtaatgtgcaggcaggaggatggagatgagtcacggggttcttagatgcttggtctccctcttcctacagtccctctgaggctcccgttgggcccctgggccaggtgaagctgacagtgtggtaccacagcgacgaacaaaagctgatcagcattattcacagctgccggtgagaccctggccacctgtcctctatggtcccctccgtcctttgccttgaatgctccaatgcccacatccttctgttgcagggcccttcgacaaaatggacgtgatctcccagacccctatgtgtcagtgttgctgctcccagacaagaaccgaagcaccaagaggaagaccccgcagaagaagaggaccctcaatcctgagttcaatgagcggtcagtaaacgggcgtggggtggtgggagtcgggggaaggcttccggtgggaccctggctctaagatctagtgctttccccaggtttgagtgggatctgcccctggatgggactctcaggcggaagctcgatgtctctgtgaagtcaaactcctccttcatgtcacgagagcgtgagcttctggggaaggtgagaaggccaggactaaagctgctggtgccatctggggcatgaccgtgaccctatcctcacacagtggttcacctggggtgtgaccgtaacctcccacagtggtttgaaatgataaaa

SEQ ID NO: 19431 - DNA, 1180 bp, Mus musculus
gggctgctgggctaagggaggaggaggttctgggaagagggtagtgcggcagctgtagttcccgctgctcctttttactcgtacccagggcggccccacccttttccggactgtgagcagccttcgctcgctcgtttgctcagccgacccaggccctcattactataccctgtctcctgggctgaaaagatgcctccctctgaccttgctaagctgagcgggttaccaacccctttggggtaccctccctactcttctcacttagaggtgacaggtagagagaggcagacaccagtcacacttgccattccctggagagaaaagaagaagaaacggtttcatgtgccctaagtagcaactgttattgctactctttatccttggaattaacccaacacctccctacctccgtgtacagcacaggtgtcctttcccactcaggaagaaagagaaaggagctagggaggaaaggaatgagggagagagtgcggaggcttgcgcaggcactagcgcaccagcgcaccaggcctaagacttcctgccagtctctaggttatcagggtttggtttcttcttcaccttcttatactggagcccacgcccggtcccaggggagcagggaaggctggacaaaggaactaggacttcttcatcccaggattccccggagttctgatttgacaggatctcctcctgaaagaatgtacccttctcttcaagactcctccccctccccctccttggccccagaagctgccatttcgcatctctgagctagctgaagcatctctatgtggccccacatcctacccactccccttattaaagaagcctcagtgtccccaagttctaaggaaagaattctcccacccccgggattgtatgcttggatctgtgttgaaacttttttcttactgggcgtggtgacacgcctttaatcctagcacttgggaggcagaagcaggtggatttttgtgaactggaggacatcttggtctttatagtgagttcctggtcagccagggctacatattgaaaccctatctacaaacaaacagaaaaacaacttttttccccctttgtttaactcatagtctcatatagcccagactggttttgaactccctgccctcttgcatttaccttccaagtgttggcaatatatgttcgtgtccccgta

SEQ ID NO: 19432 - DNA, 1323 bp, Mus musculus
gcgccatgagagcgaaggtgagcggctcttaggtggtgaatcgggcacctagtccccgccatggttcctctgcgggcttccagacggtttgcctcgggtgttcgcagtcagggagaggcttaaaattcttgctgaagaaaagatggggtgggaaaatgagggattcggctctaaaactgaaccggtgtcctttgtcaagccctgtgttctgagcagtttcatggccttgcacaagcctgtctctaacattcttttttgtctcctcacatgatcgggtttttttagtggcggaagaagagaatgcgcaggtacgtttaatttttcaagactaccttggggcagtgggggcaagctcggtgtgggatatttggttggaagaaaatatctggcgggaaggaagcaggagtcgccgcccagtacagcagagctggtgcttgttaatctcatcgtctcttgtactcgtgcactaagtgtacgtattgatagatgtgcaaaggaaaaaaaaaaaactcaggtttgtgtgccttccattccaggctgaagcgcaagagaagaaagatgaggcagaggtccaagtaagccagcccgtgcacctacgacgcctgcaggagcagaagtgagggatgctgagggccgggacaagctatcggactgtgtgctgccatcggtaatgagtctcagtagacctggaacgtcacctcgccgcgatcgcctggagaaatgaccgcctttcttacaaccaaaacagtccctctgccctggacccccggcactctggactagctctgttctcttgtggccaagtgtagctcgtgtacaataaaccctcttgcagtcagctgaagaatcaaactgctgttacgtgtttttttgcggttccttggggtggggactcgagtgtgtttctgtataggcgacatagtttgggtgtttgatctggctggagccggttgagtgtgcgcccgaggttaagttacagagttggtgcgttcacagcgccactcctacgttttgggggtaccactgcgtagaacctgacgctgagcggagttccgggtccggcggagtcctgttaccatggtgatgcgcaaggcttgttgggagcttcctgcgcctactagcacgcaagttggaccatagagtgtgtttccgggtctggtagctagagcgtctctttcttccgcaggaagcggaagaaccgtagggtgggcggctctttgtcgaagctagaggaccggcaggcggcagcagcaactacggcggcggcggcaggtgagggaggcgggagacttaggtggaggccgcgcccggaggggaggagtc

SEQ ID NO: 19433 - DNA, 1323 bp, Mus musculus; identical to SEQ ID NO: 19432

SEQ ID NO: 19434 - DNA, 1998 bp, Mus musculus
accagtggtccctttgagcctgacctgtacaagtctgagatggaggttcaagatgcagagctgaaggttagtgttgaatggaatatgaacatgggacatttgtggacgtcctggaaagatttccaaagtactgcactttatgatcccacattgctcaggacgcctgcttctgttttccaggctcttctccagagttctgcaagtagaaaaacccagaaaaagaagaaaaagaaggtgtgtgatgttaataatgggtgggttgcaagctcacctcctgctctgagacaccagcatacaaattacttgtctttctcctgtctgtaggcctccaagactgtagagaatgccaccagtggagaaaccttagaagagaatggagctggggactgaggtgggtcccctccccagcttgtcattcctgcctcaccccctcccaccgcaccccaggctctgtcaagtgcagttcgtcttctccacccaagactaccagcagagcggggggtcttcagccctcatcccggtccccaacccacccacccactcctttcaacaaaaaaccagctccgactgactctggtgttgggaggccaggcttcccagccaccgaagactacttttagtagaaaagaaattgaataataaaatcaggagtcaaaatccaccgtcgtcaagcccctctttctagccttttctactccgcttggtcaaggtttgtggcccaactacaaaacagaaaggaggtgaggttatccaccagcatggaggcctggactggggattttttgtcactgacagcatttctcactcctgggggggtttgtttttcttttctgtttccccctatctgtcatcaagtatttaatctgccctcaaagagggctggctgtggtggcagattccttgtgacctgcttaggcagggtgtctgtttaggcccttcctatttctagaagctgaattctccattaagaagagatttttttaatctattgaatggatcctcatttgtaaaaatttttagccatttttgttctgaacagtccctcaatccttccacccattttcacaaaattgtaagtaagtcataccttgtttcccgccatctgggtccagtgcattttccctcacttgattttaggccctacattgaacatcccagtgggttttttcccctgtttaaattgtttggtgtgtaaggtggggtggagttggtttgaaacagggtctcgctaattccagctggcttcaaactatgtcaaccaggctagccctcacagagagcctcctcagtgctagagttaaggtgtgcaccaccacacctagctacctacttttgagtttcctctcttgaaagaaaaaccaggaagcagaggagtagactgaagagaactggctttctgaagctgtggacttggatgcttgctggggggttgtagagaagttacaatttgtacctctggcatgctgtcccagggaactaaggctgaggtttttgaaatgacatggcattaaaataaatttggatttgctcactgttgtgtgttctctttgtggtggggatggtatagtttatctaagacaggatttctctttgtagcctagctgtaggccaggctggccttggactcagacacacacaccacacacacacttgcttcctgagtgctgggtctaaatcactttaagcatcactgtcccctgggctgtcttagcttttccagttctttgatagaggttggaagcattgtcactcaaggaagtgatgatcaactgaagggctatctgggcttacaagtgggtttggtttggttttgtttttttgagacagggtttctctgtgtagccctggctttcctggaattcactctgtagaccggtctggcctagaactcagaaatcaatctgccttttcctggggtccttgtatagaccaggctggccctgaactctccggtctttctgcctctgccaggctcccaagtgctacaattaaaaccag

SEQ ID NO: 19435 - DNA, 1180 bp, Mus musculus
tatccctgtagctggtaccataggttttatcctgtctgcaggtatgctgtcacaccaattgaagcagcatgtgattgatggagagaagacgattatccagaaccctacagaccagcagaagtaagcccagccccgtttgtcttttgctgtcacatgttgtctgtctaggcccctactttgatcaagatgacctccaaactgctacaggtcactgtggatcttccttgttttctttaaggatcttaattattatgtctgtgtgtctgtctattcctggagcaagtggcacacctacctacctggtttgggtgatgagaactgaactcaggtcctgtaagaggagtgtttgaggggcagttgtcattgtgtgtgtgactggcctagaacttgtagcaatgcccctgccttctaatgctaaggtcacaggcttgctcccctatatctggcttttgtactcttagggttccttctctgttccttttaggaaggaccatgaaaaggcagaatttgaggtgcatgaggtttatgctgtagatgtcctcgtcagctcaggagaaggcaaggccaaagatgcaggacagagaaccaccatctacaagcgagacccctctaaacaatatggcctgaaaatgaaaacttcacgtgcctttttcagtgaggtggaacggcgttttgatgccatgccgtttactttaaggtactacgtgtggcaagagcagtactgggaaaccagtctgacactgtttgtacacccaggaatggtttcccatcccttggccctccctccttccctcccttgctctcctgcccagacttgtagctcctgaatgaatgcacgtcccctgttccacccatctccttgttgaatataatatggaacaaccccaaacataatttctgcacaaggatggcagtgatttaagaacatgctgagtgtggtggcagatgcttgtgatgtcagcactccaggggcggaagatcaagagttttaagacagcctgagctacattgagcaaaaccctgtcttgaacagcagggccattcaatgtgcagttgcagcccaagaactgtgtaagactgccaacctaagttcaacccctgaaactcatttaagagtagaagggaaccagcttcacacggttgccccctgacccccatctccagtcatacatggtaatcc

SEQ ID NO: 19436 - DNA, 1165 bp, Mus musculus
aaaacgtacacacacacccactgaccctagtcctatggctccaggctccaccctgttccaccctgcccagcggcctctcaacccttttctccctgtagctccacccctccccgcttggcccgcccctcgctgttacgagctcagggtcggcgtgaatgagaggtttttcccggagagaccacgctttccctcaagctccccaacggctccgccttcccgccggggccagactcttcccagcgtgcccggcgattccggcgtgcgcagacttgggaaggcaagtcctcccagggcctggcggacgggcgcgaggagcaggctgggaattgtagttctagagcccgcgagggcggctgggaactggccgacagcaggactcattgtcccagtgtgccctgcgcctcagcccgcgcgctcgcagcttctcgctctctctgcccgccctcccgctcccttgcttgctcgcgctttcctcgcggatcgaagagactctagctacagcctgtggctgggaagggagacggaggccgcagctcagggaaagtgaagctgcagtagtagcagtaggaagatgtcgggcgaagacgagcagcaggagcaaactatcgccgaggacctggtcgtgaccaagtataagatggggggcgacatcgccaaccgtgagtgcggcctcgggggtcttggagtcgaggctgagagggagaggtttggggctctctccggagggctgtggcgtctgggtcttgccgagtgagccaccgaggggcgcgtgccgactgccgggggcgacgtggtggggagatctggtgtcgccctggggactgagcagccatgcctgggctggagagtggaggtgcgggccggcgaccgcgaggagtacagagaggggcccaggcatgctccgaccctgggcggttggtaaggaggcaaggcgcgtcgtcttctgcccatacccttcggtctgtccggatctatgctcccgactggcagcagtgaggccacctcgaaaaggaagcggccagctgttggcgacggaagcgcccctctgccagtcgcggctcttgacccgcgggagctgagccggcacgtgttgccaggtccctgtgtgcggatcgatggctccccacttcctctcctaccgtgcttccccaccacgtgctttgct

SEQ ID NO: 19437 - DNA, 2283 bp, Mus musculus
tctccaagctccccttaattttttttatcttctctgatgactcgctcgctcccattccttctggttatttctatgaagttctatatatacttaagagtttctctcaaccataggtacatcctcttcccgggaaggcaccctttcgtcagtaggtctcagttctgtgctgggtaccgaagaggaagatgaagatgaggagtatgaatacatgaaccggaagaggaggggtagcccggctcggccccccagacctggttccctggaagagctgggctatgagtacatggatgtgggttcagacctcagtgcttctctgggcagtacgcagagttgcccactccatcccatggccatcgtgccctctgctggcacgactccagatgaggactatgaatacatgaaccgcaggcgtggtgcgggcggttccggaggggattatgcagctatgggggcctgcccagcagctgaacaagggtatgaggaaatgcgagctttccaggggcctggacatcaagccccccatgttcgttatgcccgcctcaaaactctgcgtagtttagaagccactgactccgcctttgacaaccccgattactggcatagcaggcttttccctaaggctaacgcccagagaatttgacctcggttccttgagactcttggggaacatttgatggcagctagtgcctctttgagggtaacccttcctcacccctttctctgaggtcccacctccatttctccaagaatgccatctagttcttggagatttgtcaacatatcgtcacaaactttttgcggtacatagccggctgtgcactctcttctcttcccaagcctaggaaagagaagtttccctgtgtctctcccttcctgatcccgttcctcagggagactccctggagatatgaaggattactctccagaccctttctctcaggctcttactcattgggattagactcttaaactttgcctttcttccccaatcagactctaaagaaggggagatgaaagagaagagaaaaagtaagacttttgtttatgagacttttaatcccagaggaagattgagaagctcaaagctttgaggagtgaagttaggagtaggtaccagtgactacgaactgaacatgcactgtgagccaggcatcctcatactgaaccccacctacattgtctcagttataatctttccagttttgtgaggtagaactgatcctgtttcaccaatatggaatctgagtgttccaagatagccaacaggtcccggaatctttgaatagtactgaatcctgtagggttttttttttcttttaatatttttaatatttttttaatattcagtaaacaaaactgaattctgtgattagtgacttttccatcttaactaagaacttattgttctttttagtttgaggtgacacagcagaggttgtactgatttttctatttttctaatttaatggatttgttattatagacattacaacccccccccccgtgaagtcaagaatttccaccttttctcaaacaaaaaaccatttctttgacacatttgaattaatagcaggacttgccctttgggcccattcttaggtaagatgagggtctttgagcacaagtactatgagatctgtcagtcaatctaataaccaggcaggtaattaagtggctcaagagcaaataggttattcagtgcgggtgtaccaggcagagatgattcatctaccaagtggaacaggagaggccggctgtgatttcatcgtgctattcagaatgggtactatgtaaactgtaaggattatttatttcaggaacttgtcactcagcatgtttcagatgacagttgaccacaggttactaaaactgtggacagcaaaacctcagaaaatggggaattgagccttgaagaagcaaagccacaggtccaggattcaaaatcctcccaattcccatgcctgtgatttaactataaagtgtatgtgtgtgtgtgtaaagccgggcctggcgactggcctgcaactgtgtagcccaggatggccttcaactccacacacagcaatcccatcttcacctctcaaaggctgtggctacatgtgtgagcttccagactccgtttgttggtgcactgaatcaagcaaatgcagccagccacgttttcctccagcacccaggcctctcatctcaggaaggagtggagatgacacaggacaagtaactagacatttttgtgtaagctgcaggccatttacgttgcagatacacactcattacaagcca

SEQ ID NO: 19438 - DNA, 1841 bp, Mus musculus
ataattctttagttattgaaaaaaattgaacagcttttaaaacgggcaaagactggtttgggcagtttgtgacttggtttttggcgtctcagaactcactgtgtagacctactcaagagatcttccctagtgctgggattaaaggcgtgcaccacagcacctggctggcttttgtctgtttgttcattgttttgtttttttcttgacctaacagtagtaaccatgaggcctgccagcagagtgagactccctaacttgagctattctcatattgtgtggcccactttggctttgaggatgccttggccttttgagtggcaacctctagcccaagagttgaactcttggtgtatgttgggtgtggtgttggtttctctggttttcattgggtgtcatttatcagtaaaacttggaggttagggtaatcctgaccaatagaataagagaatcacaggaaagggcgtctgtctaatctgcttctcgatttctcagcctacgtgcttcccaagctctatgtcaagctgcattattgcgtgagctgtgccatccatagcaaggttgttaggaatcgatcccgcgaggcccggaaggaccgaacacccccaccacgattcagacctgctgtaagtaaattattttaacttgggacatacatagtcttacccagagaagtatccattaaggtcttatttagtctgtgtggcagctacgacctacatttaaattttaaaaatgcttgtctgttttgcataacctgaaacacttttagtgatgctaggtgggtggtggttggtttctttggtttgaggtgctgggtcctcaacttaatgctggtaagtgctctactgtgaactacatgggtgggtgggtttggttttttttgttttgttttgttttaagaagtctcgctggaagccaggcgtggtggcgcacgcctttaatcccagcactcgggaggcagagacaggcaaatttctgagttcgaggccagtctggtctacaaagtgagttccaggacagccagggctatacagagaaaccctgtctcggaaagaaaaaaaaaaagaggtttcactggccttcgctcacctaggactcttgattcttctgcctctagaatgctggggttaagtaggcaaccgcagcagatccgagtacctcatttctaatttagctcatctcttgtttttcagggcgctgcacctcgacctccaccaaagcccatgtaaagaggccgttttgtaaggacggaaggaaaattaccctggaaaaataaaatggaagttgtactttacatggcatcggagtgtgtttatgtcgagactcttgtgtgcgtttcagggggtccatagtgcagaacttggtgctttgggctctgtacaccttattttctaaggcattctctgcaggctggccagcagtgagctccatggatcccgtttatgctgcctggactcccagcaagccatgggattacaagtgtgttcactgggctcagcttatggacagggttctgtggatcacctggatccttgtaagacttaacaagccagggtttctgtttttatggtgcagggcactcactggtccccggccctacagactttaatgtgaccataggatgttaaagttttaagccagtttaatttgttttgaggcatggtctcatgccttcatgtcttgctggctttgaacctagatgcctcagtacctgtgagtcaaccatctctggctaagttgaccacttaacctttatctgaaaggaggccaagctttgactgtagagcacagactggccttcaccctctcccctcagcctcctaaacactggcatttgcagg

SEQ ID NO: 19439 - DNA, 1057 bp, Mus musculus
aacctctccaagtcgtactacaactcccacaatgcatctcttttgtcctcccacactagggagtgtgcgtccgaattctggataacttccgctctggaactatcgtaaaccggatgttatagagccttgtaatcacttcctggtttgggaatgtaacattttaatcttccgccggaaggttaaatagttccactgatatttttcgtcatagaccatttctagggacttatcacaaccctacatttcacaggaaactctaagtaattaggtaaattcgagcataatagctgctagggagtaaatagaattacaggtcgctgagggttttttttttcagcgtgagcgtaggaatctcgtactatataagcgggtcgggcaagccgccggatcctctttcgagtcttggctccaagatggtgagtgtcgccgcgtggtgagcgcgcgggcctgggtactggggtagaagtagatctatggacggtagggacctgaaagtcagagtcttggaggagaaagtgacaaagggtccgtccagcccggacttggcgtgctcgggacttgtacgggtctctgtcggggctgcgggcggcggccggccaggaagggctgaattctcgccccctttccaatagcgtctctttccattctcagaccaaaaaaagaagaaacaacggtcgcgccaaaaagggccgcggccatgtgcagcccattcgctgcacgaactgcgcccggtgcgtgcccaaggataaggccatcaagaagtttgtcattcggaacattgtagaagccgctgctgtcagggacatatctgaagcaagcgtcttcgacggtaagtgagccacagccgtgatttgtacagggacgaagagtgaggagggtgtgtatggctcgttgtcttcagcttggggagaaggtgccttttgtggcacagtaagcaggcctaatgatggggttttaacttggtttttctcttggggtggagattgaggctcatgcatggtagccaaacccctgcatcccatccctgtgagagactgcctatttaggagaatctgaa

SEQ ID NO: 19440 - DNA, 1197 bp, Mus musculus
atatctgaactgttgggaccagtatgcaatatttttgcatttttctagggctcacttgtatattagtttctgaattggatccataactttaagattaaacagagaaaagataactggggcttttcggctttcggcttggaggaggcaacggtgcaactttcttcggtcgtcccgaatccaggttcatccgacaccagccgcctccaccatgccgcccaagttcgaccccaatgaggtcaaagtcgtgtacctgaggtgcaccggaggcgaggtcggtgccacatccgccttggccctgaagatcggtcctctgggtctgtctccgaagaaagttgttgatgacattgccaaggctaccagtgactggaaaggtctcagaattacagtgaaactgaccatccacaacagacaggcccagattgaggtggtgccctctgcctctgccctgatcatcaaagccctcaaagagccaccaagagaccggaagaagcagaacattaaacacagtgggaacattacttttgatgagattgtcaacattgcccagcagatgagacaccggtctttggctagagaactttctgggactatcaaggagatcctgggtactgcacagtctgtgggctgcaatgtggatggccaccaccctcatgacatcatagatgacatcaacagtggtgcagtggagtgcccagctagttaagaagcaacaagaaaatatttcaataaaagactatctgataaccaacaacaacaacaaaaaaagatagctggggagatggctcagtggtctaaagcacttgtcgcatttgtagagatgtggattcaatactagcacccacatggcagctcacagccatcaataactccagacccagggtagctgatatcttccggcctccataggtgccaggtacacacatggtacatatacatgactcatacatacaaaataaatcttaaaaaagaaacagctggatatggtgacacttgtcggctatttaggaaggctgaagctgtaagacttgtttaaaggcatcctaaatagtagtttagcaagaccatatttccaaaaaaaaaaaaattattaaattaactttgattgatcaagtagcttctatcccaaaaagaaacatttctgcccagacctgtttcttatttctgcttgaagccctccaatctgtcatagtctaaagg

SEQ ID NO: 19441 - DNA, 2521 bp, Mus musculus
tccatccccacccctcagcacacagtccctacggtaacagcacactgagccctggctcccaagggctgcctcctgacagctccgtcatggcactttttaatgcttcagcaaccaacaccaggcagctgttgccactactatgccctacctggggcttggggtcacatctccccaggaccttccttccaaaacaaacttcttcacttcgtgttctaggtgcaagacagtgaccttctcattgtcccccacccccgtgtttttccagtgtttcagagaagacttctgtctcctgcctcacatcccacctttcatcattactccctcttcttgatcctgtttctcctctttacaagatgatgaagggtaatcccagggactgagaagggagggatatacttttagttacattaaagaccttgtggggagagtaaggctcgcagcaggagggagtgaggaaacattgctttcccattttatttatctggtaagagtttcttgtctatgaaacactgcggcaccaatgagtaggacttgtggagggcgttcctaggtaggagtgagaacagggagtcaagctcgcaggcactgaatgggagtttattagtaggacaaaggttgaggtgcagtgtcatccgtggctctggaacttgccccgaggctggtttcccttttgtccccatccactcaccccactcgagtgtggggattggacctcagagtgctccaaagaatcttcactggttgcctgcacctttagctctgctgtgatctaattggaggaggtactctgataccgtcctctgaggcctatgtatacataggcatttcccctaccctggccttgagatggccttaaccccagacaccatgcccctgcagtttgcactttaattgatggtagttcagtcaagatacaggtttttttgtgtgtgggggggggggggttgattgatttacctatccttcaaccgttttaattaaatggaatctacaatgaatgaggtttggccctatagaagacagtagcagtggcagctactcacacccagtctccactgctagcttcctgactgattcatacctctattcttgggtataggtttgtctgagcaactggggagtggcctcagaatagcatgggccatggtagtggagtaaagaaaggtcaggcaaaaggagtgttctatcttcccagggttcacattcagtttgctatgtcttaccatgtcttttctacttccctgtaaatacgtataagtctttattctctgtacagtctgctctgcctcctggctcccattagccttcttttcttctccttttgttaatatcttgggtttagttcctccttcattcccccacttactcttacttaatccgtgtaccactaggggctcctaccacaaaggctgcttgtccaatgacagggcagctagaactgaaggtgcctcacaactgccttgtatcatcagagggctttggtccttcctaagtctctggcctctctacgtcctatattaggtgtttgagggtgtctgtgggaagccatcaaagcaagaggaaacttggtattttagccagagtttgggagaaacatgcagaagaaaggaaaagaccacggtaacctcgagttgagcctttctgccccttgggctcagagactgacttgtgttccagagcagctgaggaatccatgaggccaagattctcaaggacccaacttaggttcctccacttaggactcaattctcttccttttccaggggcagccttagttctcatggccctgaaacatatatttactttcctagaacctgttcatctgcaaaatatccaggcacatcctttttacaagtggagactcgagggaagctctccaagtctcttagaaacttaattccttctctgcaaaagtgaagatgttttattgccttggggctgggaaaccatttccctaggctttccctccctccctccttccctccctccccccctctcttaggaacagtattggccttagttcctggcctacctgctgccttccctctcctcctgccagctctcctgccttcgctggagctctgttgggcttgaggggttttgttctctccctcccctcccccgttaccttttttcttttgatcagtttttagggggagggctcaacatttttgcctttatatttctttcctaaggaagcatttgcctttctttcactctcctaacataacaatcgtggtaacagaatgcaactgctgatttatcgatgtatttaatgtaagtaaaaaaggaaaaaagaaagtgcactggactgttgttttgtttgtctgcctgaaactaaaaaatgggaagaaagggcccagagaaataaatccatgatacctcaagcatcctttccctccaccttggcacctctaactagtcgaagaaccaatttggaaaataaccctttttatttctttgattttgtttttatttttatttgtgtgtgtgtgagagagagagagagagcgcttatgtt

SEQ ID NO: 19442 - DNA, 1185 bp, Mus musculus
tcttcttcagtaggttggttcagatttgggaggagggaaatgagaactgggtaaggagaatactggttcccaagtttctgagtacacctgctgtccttctggcccgctgccacatcactgaagttagaatatatttctctttccagcaaatgctgcactatgaccccaacaagcggatttcagccaaagcagccctggctcaccctttcttccaggatgtaactaaaccagtgccccaccttcggctctgatgcccttcccaaagcccttttcacccgtggtctgacttgaccctgggccttttggacacaggtcagccttctgatgttttctggctgtcttagcattcgccttttctcttgccagccagttctggggattcagaggtgcagggaagggttagggaaaagggggcaaggttttggcattagatgcacttaacccggcttccaccagcttcttcccctcttctcagtcattactgagaaggattggtattcaaagcaaaactgacagttttcccctgtgtcaggttttgccatcccaatcttaagactgtctcataattaccatgttgagggaaacgcccccagactcctgctgccactgttttgtgaactaatgaacatgagcagaagcctaagttgggacagctcagaaccaagcaagagggggccgttttaatgaattagattgaaaaataggcctaagccgtttgtaccttagttttagcgttcggcctcacctagcaatcaagggcccgtttggagaagcagaaatgattccctccagtgccctgtctaccttccccaggcaagaagagccaggagggcacagggcttgcacgtcactctggtctgttcatcgtggttcacagggcaaggtgaaagacacttgaatttctctttttagcaatcttactgttttctggtgctgactgctacacccaggactttgccctcactaagcaaatgtaccaccaatgagccaggttcctagccttccttttggaagctcagttcttgagttgtcagagggcctcattgccgtcctcctctgagagcagtgatgcaggccaggagacatcatttgagaatgctgatgcttttgtaaggctttgacctggttaggtcattgggggaaattttctataaaagagtgaacaattatatttatatttcaagt

SEQ ID NO: 19443 - DNA, 1243 bp, Mus musculus
aacccagagcattgcccatattagacaagtgttctgaactacaacccattcccaaaaacctgttttgtttgggttttgttttttggtttgtttttggttttgtttggttagattggggttttggtctctcaagacagggcttctttgtgtagccctggctgtcctgcaactcactttgtagcccaggctggccttgaactcacagggatctgcttgcctgtgcctccccagtaccgggactaaaggcatgcaccaccatacccagtgatagttttttggcaggaggaatggcacagaagttccccggctccttactcgggggtgattgggcttctggttggcctttcttcctggaccctacactcgtgaatcctgctacctctgcggggggctccatcttccatgctgctttccccctctcctcagtggaggaggaccacagcatctgcctcagctcccctctctccaaaagctggctccttgacctttttctcagaggagcctggtctttggggctgcactgtagccaagtgccttctgtcttttaaagtagctttcctcctaaaccagaattcgggcccagctactgaccattctaactctccctcctctgattctcctgaccaagatctatttcctggtttcccagacatagtaaagaaaatatatctttcccctgagcagcagatctgtaataagagggaggaagaacaaggaatttgggaataaaatggcattgaaaattcacctggggagatgcgcctctactgttgctgctttttactttctttgcaccacgaaacaaagctaatctactcccccaaccccaccccaccccgccacaaagatctgctatggcacctatatggcatacactaccatatataatgcacacatacatatcatacatatacatgaatatacccagataactcagttctcttccaggaacatgaagctagcctttacctaaacacaaatgttccagagtctgtcagatatttcacatacagtattttcatctaatataacaatcctgtaacattgatattagccttactttgttaatagggaatccaaggtttgacagggttaattagctagccaaagccacacatagtcaggtggctcaaggactccaaatcccaagctcagtttactggccatgatatttttttgcactttatgttggaagaattcaatacccagctgttagctgcttcctcctgtcagctaaagcccc

SEQ ID NO: 19444 - DNA, 1485 bp, Mus musculus
gctctcgccctctttttgggatgtctacaattgggctggaggttttcggtgggactgggcaaccggttaggctggagggataagaccgcttggctgttctcttggctgggttctccagccttgcatcattgcttgactctgctgaaagatagcaggccatggcagcagctggtaaggttaatacagtggggctggcaggagctgccctgggtcaaacagaggactaagaaacagggcaatgcacctgtagctagcgggcgatactgccagcctgaagaggaagtgacccgactcttgaccatggctggggttcctgaagatgaactaaacccttttcatgtgctgggggttgaagctacagcatccgacactgaactaaagaaggcctataggcagctagcagtaatggtgagtatcctttgctgcttcctgttgctctttccccatattttctgttccagtttttagggagtgtagagtcaagggaaggtgaaggatttcctttctttgttttgtttttgagttagggtttcaccttgtagacagactaacctggaactcatgatttctcctggctccatctgtgagtgctgtgacttacaggttttgccactatacctagctaagggtagcattcttgggaaagagttataaaggcgtttctctgactaggaatttgacttttctccatcttaagtcttttgtcgtaaggtcttttttggggggagggggtgtaatataaaaggaagggttggacttactctgcagcagctaagtgcagctcctttccttagggtcgggaagagcctagtcagacagccccttagttgctatcacctgaacaaagggatatttgttttgttttgggacatggttttgcagactagctccagctagctttgaatttgtgatcttcctgcttttgattgggaaaggctgggctcacacatacagcaccatgaatggtaagggaggaatttaaagaaaatatctttttttcccctttttttaaagatttattttgttgatatgagtacactgtcgttgtcttcagacacaccagaagaggtcatcggatcccattacaggtggatgtgagccaccatgtggttgctgggaattgaactcagggcctctggaagagcagtcaatgctctcaaccactgagccatctctccagcccccaagaaactttttattgattctttgtgagtttcacattctgtgccccagtcccactcatatccctgtgtgctcttgaagcttctcacctaaaacacaccacatgcgcgcgcgcacacacacacacacacacacacacacacacacacacacgcacacgcacgcacgcacgcacgcacgcaagcacgcacgcatatgcacgcacacgcaccctaaacaaaacaaagcatggaaaatgtcttgtcatggaagttgtagtgtgttgttcacagtgtcccacactatacacctccaatcacacat

SEQ ID NO: 19445 - DNA, 1123 bp, Mus musculus
acccaaactgatcaaaagagtgtggatcccttggagctggagttaccgatggttgtgagctactgtgtagggactgggactgaacctgggtcttttgtaagagcatcaagtgttttcagccactgagccacctctccagccccaaagggagatttttttaccatggagaaaatctgcctcttcctagagaggcaggtgtggacctagtatgggagtgttcaggatgtgcgtttgggtggttattccaggaccaggaagaaaacagcttctgtttccttttggtattggatggcatccagagccttgtggatgctaggcaggtgctttcccactgaggtacatacactttaacctgaaaacaggaattttaagaacaagagtatgagcaggaagaaaaaaggagcataaatcaatagagagatatgtgtatcacgcatgtgtgtaagaagatacgattggttttgttaactctgtaggtgggagttttgatccactatataccactttttggcagtgctggggatcagacccagagctttgctcattctaggcatgtactctaaagatttatttatttatttatttattataggtaagtatactgtagctgtcttcagacaccccagaagagggcatcagatctcattacagatggttgtgagccaccatgtggttgctgggatttgaactcaggaccttaggaagagcagtcagtgctcttaaccactgagccatctctccagcccggcatgcactctataatcgagctaaatctccagctctgctattgctgtttctgtatgtacaagtaaaactacattatgaatataatatgtgtaaaactacatctgaggccaacttgtactgaatctatgggtccgaatcattaaaacattacgattttcaaattactatagtggctgtattatataaagaggaatggacacccaaggctttccctgacaaaggttcaggaagaccctagactgataattagcaaggaactaagtttagtgggaaatgcatttcttggtggatggcttggtatcttcttagagtggtcaacaattacttcccccctcagattgttactaagagtagtagaaccccctttgtttcacct

SEQ ID NO: 19446 - DNA, 1511 bp, Mus musculus
agtgggctggatgccagcgtgtgggtatctccccagatactcacagagttccttaccacatctcatttggttctcgggtacccggcaccagtggccggcagaggtaggtgatactttcacacctactatgtcagttgtatggtttcagatgccttgttttctaggaagtttgggcactgactctcggtgtgtagttaattttggaagccgactataatgtcttctgcctcttttctccctcagggccactccagagtcccctcctgctgacctgcaggatttcttgagccggatctttcaagtacctccggggccgatgtccaatgggaacttctttgccgcacctcaccctggccctgggaccacttcgacctctaggcccaacagttcagtacccaagggagaagccaaacctaaacggcggaagaaagtgaggcggccctttcaacgatgacaccccttctcttccttcctcaaatcaatgtcagggagtcaaaagggctgtgtacagcacaggatggaatttgatttattttaaaatactttaaaaagggaaacattttaaattgttcactcagtacttagaggaagcccatgacctcttctccctcttccccaacacccaggaactgaatcttgttttctgacaataccaaagaaataggaggtggtcagagcaaagaacttaggggctggacctagtccagacagtatgcttctgaggtgtgggaactggggatttctctggggtctgtatgcctttatcttatcatctgctcttaagagcagatgaaacacacccccttttaaatgagtgtatcttatttcttaaacccatatcaggggttcccctcccccctttaccctgatatactagctaaaagaaaaagcatgtagccctaattttggagacacagaactcaagagtggaaactgatttttttcctctgactttcactttattggtaagacacctaacttcaggcttgttgttgcaaggatggccaaaattaattaatttttaaaaagcagatttatgccctgtgcccttgggtgagggggaaggatagaggggttcccagaggcccccttgttagccaagggtttgtatttttttaagtttgttcatatttgtatgtacatatctatttaaagccaggagattatctttctataaatatataactggcaacttacatcttccttctcttctttacccatgtagctgggagtccttttctattttcttttggagataagagtcttactgtgtagaccaggctggactccagattgcagtgattctcctgcctctgcctccacttcctgagggctagctagtattataggcatgtgcctccactactcacttgtgagctcttttttcttatttgagaattctttccttgctgttagctgtgagtgaaaggtattggaccaaaggagtagagacaaaattttgcttaaaagttttttttatagtaagtcagcattttgcattttctccccag

SEQ ID NO: 19447 - DNA, 1142 bp, Mus musculus
ataaatggagagacattccgtaagttctgtgactctagagaactctaatacacctggactgaggatttgaaatctcaaagccctcctttcctccaacaaggcacagctaataatgccactcccttgtgaccaaacattgaaatctgtgagcctgtgggggactttcaacaaggccataccatctaatcccacttggggcctacttgtagaatttgtagctgttactgttcaaaccacagttactttccagaacattttttttttgttttaatttaattttccccactcccacttttatcctcagattaaactgaggacctcatgtatactaagtatacagtctatactcagcctgcaatatagctttataattagatatagtacctagagaaaatgatttagtgaaatagttttaaagtagtttggggatttctggtacaggaataaagagcaaatgaatgtagcggtaattagcttgtttgggttaaaagtaaagaggttttttgaaaatgggtcatattagaatatgtaaagtaggggctggtgagatggctcagtgggtaagagcacccgactgctcttccgaaggtccgaagttcaaatcccagcaaccacatggtggctcacaaccatccgtaacgagatctgacgccctcttctggagtgtctgaagacagctacagtgtacttacatataataaataaataaataaatctttaaaaaaaaaaaaaaaagaatatgtaaagtataaatctcttttaatggctttaatccttttaatggattttgcaagaaagacattaaaaactgtcctggaattaagtatatagaccagtcttgccttgaactcacagaattataccaacagaattggatatagtaatactgctttgcagagaaatagttatggttttaggcaaaattatatggaaagattttgagtccttatatttagggaaataattttgtatgtgactgaatagagaaattagccaattaagaatagaaatttcccatgaatcctgtgagggtgtgatgtgcatttattgcttgggtttaatgtgtctaagggaattggaatataatatgagaagttccctctcaggttctctttttactctgaggtttactgtaatgattg

SEQ ID NO: 19448 - DNA, 1208 bp, Mus musculus
gccatttgaaatccagcctcagctatatattaaaaactatctcaaaacaagagctaggatggtggtggtgcacacctttaattccagcacttgggaggcagaggcaggctcaaggccagcctggtctacagagtgagttccaggacagccagggctatacagagaaaccctgtcttgaggaagaggaaaaaaaaagggcctagtggctggatctgtacctcagtttatagtgttcttgcctagcatgcaagagaaatgaacaaaggatttggggttcaaggtcatcctccgatgcgcgcatgctatattagttactttgttattgacctgataaaatacatgacggaaggcaactggagtcagagagaatttattttggcttatggttccagagggttgagagtttatggtggtggagcagaggcagggcaccaggcaccaggcatggtggcaggaacagaaagctgtgagctcgtatcttgaaacataggcatggagctcagagagtgaactggaggtagactgggctttctttttctccaagcccacactcagtgatacttctgtagtaaggccacatttctgaacctcttaaaacaccaacgacttgggcatgcccaagattatgggggacatttttcattcaagctgatgtttgtctccatttatgacttagcttcacacaaatggaagcatgtgtgtgatctgttatcttttgtaattagcttttcacttagtgtaaaatttcaccttgaaccacagggtgacctcagacttgctgtgcaacgttttttggccggttcctcagatttacaatcttcccaaatgctaaaataacaggcctgcacctccaggcctgctctgtggtcacgtctgtttgtgtattagtgctgtgtcactgagcatgatcctcagcctagcatgtttccagcattgataataaagtcccattcatcttattgcttatactatatattccactttaagcatgtcacattttacttattcagttatcagttggtacttgttcatgatgaggtaaaaagaaagctggtgattgttgcattttatctgatacagttaatgatgctgtgaagagttgtttttaagtttttgtatagatgaatgttttcctcattttttgaaccaatgtctagaagataacctatgtggagttgattctcctcttctacctttacttgggctct

SEQ ID NO: 19449 - DNA, 1114 bp, Mus musculus
gtagaagcaacttagtaagttctatttgtagatattgttctttttttcttttttaaaatcaataagttaatttaatttttgaggcagggtcttatgattcctgggccagcctggatcttgcttttagctgagaatggccttgaacttctgattctcttgcttctacctgcagaattctgggattgcaagcatgcaccactctgcctgattcatgtggtactagggatcaagctcaggttagtcaggcactttaccaacatgtccagcctattgcctcttaatattgtctataaatttaagagaagtcaggtatggtggtacattcctgtaatcctagcacttgggaggcagaggcaggtagatctttatgcagtttgaggtcagcctggtctacatagtgaattctaagcaagccaaggctacatggtcagatgtcagaaaaaacccaaaccaaaacaatatatgtatatacttatatatgttatacacatatatttgagagtaaagagtgaagaatggagagtggtgttttctaggccattgtgactagtcagtgggttttcaaaatagtgttgtgataaaatatattcaactctgaactcctgccacagtcagtattgtaactgaaattgaaatattttattgttatttaatatgttctaaatgattgtaccaaggcttctaagaaaagaggaaagagaattgagtcgtgtcatttataaagtcttataaagttcaaaagtttacctttgcttaaagttacatcacttagcagagtttggtgtgacatgcttgtaatctaagcattcaggagactgaggcaggaggactattgcaagtttgagattacatagtgatttgaaggctatcttgggcttcatagaagaagaacctgtcttagaaaactaaaactagtcgacttttagagattgtatagtgggaattaatgaatttggactttgaatggtggacttgtttgtagtggtgaagatttttataggtggtgtttttcgagcagtgtttagcttgctttgatcttgagctcttttaggctcttgctgcctttgatgagtaagggttagctgaatcctctgctgtctacttcagaaaaggc

SEQ ID NO: 19450 - DNA, 1105 bp, Mus musculus
tcccgagtgctgggattaaaggcgtgcgccaccacgcccggcccgaaaggggccactcttaccccctcctccgccctagcctagctggccctaggacctgagtcactggagtgagggggtagttctgggagagactctagctgggagtccatagaaagtaacccatatcctgtgccgaagcgctgtttaaaggcagcatgacacctcccgattcccttctccttgtgtgccttaaacaacttcccagccttcattgtggggcaaggatgggcagaccttgtctacagccagtgtttcctggaggtgtaggatctatcttctgggtgggggtcgggtgcgagggctactggactgaggatctgacctaactctcgcctttttcctcaggcctgtgcagtgggattgatcgccattggtgtagcggttcaggttgtcttgaagcaggccattacccatgagactactgctggctcgctgttgcctgtggtcatcattgcagtgggtgccttcctcttcctggtggcctttgtgggctgctgtggggcctgcaaggagaactactgtctcatgattacagtgagtggggtgtgggagctcttgggggctaccggaagccttttctgtggtgaaggtgggtggatggagaacaccaggaaagtctcagtaattgaccgggtcagagcaagccctttaaatccagacttcaaacccaactcctgtcctcccacagtttgccatcttcctgtctcttatcatgcttgtggaggtggctgtggccattgctggctatgtgtttagagaccaggtaagcagggaatggggggggggggacccatctcaggttgctctgggaatctggggccggaagtctgttctctacagcacccacttctctgctcttaggtgaagtcagagtttaataaaagcttccagcagcagatgcagaattaccttaaagacaacaaaacagccactattttggacaaattgcagaaagaagtgagtgggatggccgggaggagggttagccgggatagaagattctcaactctgaattaaagtggaggtttccctcccatccctcttcccttcctagaataactgc

SEQ ID NO: 19451 - DNA, 1192 bp, Mus musculus
acaaaaggacagagatagatctgcgcattcaccactcactgcccgcaacattagcaaagctccctagaaggctgcttgaggtgcctaaaatgctgctctacagtgatcacccagagctgagagaacctcggtggagaggtgagaagacaagagggctgggaaataagagaaagcattctcttctagggagaggaagctgggaatccactgagaatcggccggcattgccaggaggtaaggtgagggaaggagaagaatttcaatgagttcagagagcttctgctaccctagtaacagaagtgtagtggacagcatcaggacaccaatcctctcaaaacccgacagccagagcatgtgaaaactgactcttcagcatgactaaatgcgaaaagtgttcctgactccagaaactgagcctcattagcgaacagctcacccaccaagcaaccaaccctccacttcgctcctttagctcctcaataccaaccaccagatgccaaaagcagagggaggctcttgcgtcacgtgatactgcgatcacgtgacgccttccgggtgagccaaggcatagtccagttcctgcagccttagggaggggtccgccgtgcccacacccagccagactcgaccatgctgtcccgcctgctcaaagaacaccaagccaagcagaacgaacgcaaggagctgcagggtgagctcagcgtccggtcggtcggcagctcccggccgcggcctagcttcttccagaggcctggacctcgggtaacctcccagatcaaggagagggcgccggctagcgggcgacccgagtgccgggcagggaattgggggcggcacttctggaaactccgtccccttgccaaccagccctggtccccttggcaccactcgggtccctgcgccacctccctcaatcccgcccaggcggcgcctgagtcccgcccctggagcgcgaaacgcgttgccaattggcccagccagcttctcaccccggaagtgggaggaattggggactgcccagtctgccacacagctaaggcacaactttccccaggcctagactgggaatcctggagttgccaatccattgcccaaagtagtggaaaaaggatgtctaggaagagtcctgggcgtacctgatggagtgtccattcccttctcagggccccagtttctttgcctccaaaataaa

SEQ ID NO: 19452 - DNA, 1191 bp, Mus musculus
agcacaattagtaagtgtttaagacttttgtctcttcttagtcatgagcttacaattttctaggaatttcatttattataaggaaaggaaatatgataaataccatgtggaacctaagtgccttctggttttatttaatcagattacaaagtatccaaggcatctcctgagttatttcatacatcattcttagcaggagcacttgggtatttcttagaagtcttttgagatgagctctgaacatcatcagtgctaacccaacgctggttctgcttgggtcagcagcatgttaatcggaactagaaacggaaacaggcaggttggccgcagctttttaggaagctgcttaggtggaagaagaaagggtttaaagtcatggatcaggcagttgcccttagttttcaggagttgtttcaggcaagaggagtaaggcttgaagtacaattagtaaaaaatattttaggtaagatagatagctgttgcccatggttcaaggaagaagaaacagcctcttagtttcagagtgaaaaagctgataaatgggtcatgattaatgtgtttgacaatggtaaagtgttttttattctatgattgtagctacaaaaattattattctctgattggtttaaatgtaactgcttcatttggttcttttttattgataatgtgctctgcatgtcttcacattcagctcataagttgttggttaagattaataattgttacattgctacagatggttagtgttaaatttgataactcaagtttagagtccttccgacacatggcataaggcagcccaagaggctgggtctctaaagatatttctagtttagataataattaatgtggttcgtatcctaaatagtaaaatttaaaataagatttaaaacaatgtctctttattaaagcattaaagcttgctttaataggtattcataggtattaattgacatccaaacttcgtaatatgatagtaatgcttctaataatgattttaaagataataaattgttttaaacttgggttttgctttcccaagtttgtaggtattatcctaaccttgcacaagaaacttaaaaattatggttaaaactgccattgttccattgactgcagcttgtagtttgatttcaaatttaagatctttaactcacctgtatactgtaattaagataattacaagagtaa

SEQ ID NO: 19453 - DNA, 1583 bp, Mus musculus
agtgtaagggggatggggtgaagaattctgagaaaggggccaggaaggaaggcaacatttggaatttaaataaataaaatactttaaatgaaaacagttcactctggggtcataccccacaggttgacaattggtatttacagcttcttgccaaaatcttcaatctaatttgacattatagaagaggattataaactgaggagcccggagctgccaccgggggatcggggctgggggcaccggggaagccgccgcctggcccgcccgccctctgtgcaggccgcctcccttcccggcccggggaggaaacgcgagggggatgtgaacagctgcgggagtcggagtctcgggagccggagcccgacgggcccccgcccaggccccccagcccagcccgcccgcgcgtcttcccgcccagccagcccgggcccgcgggattgttagatggaacacggctccatcatcacccaggcgcggagggaagacgccctggtgctcaccaagcaaggcctagtctccaagtcctcgcctaagaagccccgtggccgcagcatcttcaaggccctcttgtgctgtttccacacacagcatgttgtccagtccagctcttccactgagctcacacacaaggaggaggccaacaccatcgccaagtccgatctgctccagtgtctccagtaccagttttatcagatccctgggacctgcctgctccccgaggtgacagagcaagatcaaggcaggatctgcgtggtcattgacctggatgagacccttgtgcacagttcctttaagccgatcaacaatgctgacttcatagtgcctgtagagattgaggggaccacgcaccaggtgtatgtgctcaagaggccttacgtcggatgagttcctgagacggatgggggagctcttcgaatgtgttctcttcactgccagcttggccaagtatgctgaccctgtgactgatctcctggaccggtgcggggtgttccgggcccgcctgttccgagaggcttgtgtgttccaccagggctgctatgtcaaggacctcagccgcctgggaagggacctgaggaaaactgtcatcctggacaactcccctgcatcttacatcttccacccagaaaatgcagtgcctgtgcagtcctggtttgatgacatggcagatacagagttgctgaacctgattccagtcttcgaggagctaagtggaactgatgatgtctacaccagccttgggcagctgcgggccccttagccttcctgctccaagaaacggccatcccaacaggggactctgctacactgtgcctttgtggtcagcctcactgacagggtctgcaagtagccagggcgtgtgggacaaaagcaggtcacacgcagagcaggaaatcagaccaagacccagagctctctgcaccccgtgctcagttcccaggtggttgtgtgggtgtgtgtgcgtgcatgtgcccgtccggtaaactatggtcctgggtgcccagttgtgcagtagggggagaagctgaaagataaggactcaacccaagtcatttgtcttctttcctgctatgctgtgagctact

SEQ ID NO: 19454 - DNA, 1208 bp, Mus musculus
catgtggttgctgggatttgaattcaggacctttggaaaagcagtcagtgctcttacccactgagccatctcgccagtcccccatcttatctcttaattagcctgttctatgacaagagctatccagagaaaaaagaaggcagagcccagagataataaccgtcattgatctctgctttttaacttctttctgaagatatctgttgggaggccatctacaagaagtacattaaacagcatctaacataaacctgaccaatctatccccttctgtgcacagcaagtacccattacacacaggcacaatagtacttttcaagggaggacacaggaagaaacatgggatccacttctgcttgtctatttgtggtctgatggagcaagatatttttttctgttcaaagcaataaaacatctattgctgtgtgctaagaatcacacagtatgtgtgagagttttgctcagtgttttcttttttaaaagattttatttactttatatatgctagtacagtcactgtcttcagacatattagaagaaggcatcagatcacattacagatgtttgtgagccactatgtgttgctgggaattgaactcaggacctctggaagaacagtcagtgctcttaacttgcaagctgtctctccagcccttgctcagtcttttcaatatctgccctgtaacttgagtttagatatgatcatgaatagaatccctatgatggcacatgtagctttataaggacaaatggagaaacctcatcacatttgctctgtctcactaggtgatgccctcaccatgttatgatgtagcaagagggccttaacagataccattgctgtgttcttgaaattcccagtctccagagtcatgagaccaaaaattctattttctttaaaaaaaaaattacccaggctgtggcatgtggttataattacagaaaacaaactaaatatcttttattttagtcaacttgagtatagaaactttgagggatataactatagatttaaagaatttatttagggccagtgagatgtctcagtgggttgatgatctgagttttagccccagaatagatatggtggaaggagagaactaacttctgaatgttgtcctcttgtctctacatgtacactgtggtactcacatgtttaaaagtaggtacatccacccacacaagtaaataaatattttaaaattatt

SEQ ID NO: 19455 - DNA, 1050 bp, Mus musculus
gctatacagcccagtctccacctctgggattaaggcagctgctctttgacctttgtgtgctatagcaaaaatgatacaggctacatgtatatccagccttgttttgagtatttggtgagcagtctggttccttctgagaaacagccacctcacaaaccagcctgaacacttgggccttcgtggtggcgtctgtagagtttctttctctctcactcatgtggggatggggggttggagtatatgaaagtactcaaatttgtgaccaactcagcctcctgcactgtggtctacaggtgttcctgtataaaactgtgccaacgagtttgctgtcatgtgcctgtggtcgcctcaacaaagtagaacttccttactggctctggaggccagtctacagcctgtatatctggacctttggggtgaacatgactgaggctgcagtggaggacctgcaccactaccgcaacctcagcgagtttttccggcgtaagctgaagcctcaggcacagcctgtctgagatttgtactgtgtggtaatgcctggcccttgtctccattcttcattaggaaatgaaacccttgtctgcctttaagccaggcttagcagcaccgcatggccgtggcactccgggaggctccctcctgacctggactggagctccctgaggacttggcagatggtagagtttggggagccactgaaggtgagcactaccccctccttaccttcaaaactctgtctcctccagaccagcccatcagatggcaagatcctcacctttgggcaggtgaagaactctgaggtggagcaggtaaagggcgaaacctactccttggagtccttcctgggccctcgaaccagtacagaagacctgcccttccctccaggtgggtcattgcttagtcaggattggagctggggtagacagcaaagggtagtaacaaaaggcatagtgggctgagggaataaaggctgggcaagctttggggcagcaggctgctatgtagcccaaagtcattattggaaccccaagctaggctacatgcaggtca

SEQ ID NO: 19456 - DNA, 1050 bp, Mus musculus; identical to SEQ ID NO: 19455

SEQ ID NO: 19457 - DNA, 1157 bp, Mus musculus
accttcttgttcctaggacttgcacacaaacagccccaggtacagcaaggtactacaatgacctgagctttgtaacaaggagggcattcccatgcacaagggtgagcccctgggcgagttcaacctgagctccacatcatgctcatcttcgaggcacccaaggacttcaacttgaggctgaaggcagaacagaagatctgctttgcaggagcactgggctccctctagtcctctcggttgtggctgccaaaggatctttccacacaggagcatgagggtctttagcggagccccaggatgtctaggtgaggggcactgtggggctgaccttataagacctgaatgatgtgttcctgcctgtccatgggtgcagaggagaggttctgggtctctcaggacctaggccccttttctgagtatgggtgggtgtgatttgaccccaaagtcactttaaggggtgttttaaatttttgtacaagccagagcctcccacccctaactcctggctgtgtactaccacaccctctagctgcgccccgacccgtcacagggctctctcactgtgcacagggtgacgtgcctgctgggcagagactgtggatccactgtcttcctagagcaggccacatggccttcataactgctttctgctcccaaatttcacctatctgcatgctggaaaagtaaaatcatttatatattgctggatgtgttgtcctgggctctgtcagtgtcttctgaagacaatgactaatgatgtatgtagacctttgtaggctctaagaagctggctgaatccttttgctggtaggcaagaccaattaattactggcttgtctggtagagtctggagtgaaagggcaggttgaggccttgccctgcagaagtaggggacatgctgctattggtctaggtctgtgttggaagcagagggtatggaggtcagtacctagaaaacaggtatgcaggccatggggaacccagtggtagggacaagaccagagttcatgtcgatcttgggaatgccatgaatttcccctgcagaagaaatcacttaacttttcaaccctatcagtagtaccgtattttgtatgaaaagtaggagacttctgaacagtaattcatttcattgcaagacattttgaaattaaaaaaca

SEQ ID NO: 19458 - DNA, 1157 bp, Mus musculus; identical to SEQ ID NO: 19457

SEQ ID NO: 19459 - DNA, 1732 bp, Mus musculus
gcactcaggaggtagaaacagaagataagaagttcaaggttgtcttcagatgcacagcagattccaggccagcctgggctacacaataccttgtctcatacaaaacaaaacaaaacaaaacaaaacaaaaatgtagtttgaaaaagggagcttgcctgcctatcattttagtgcctgtgaggtggagatgtgaggatcagtaagtagttcaaggttattcttggctgtttagtgagtgttggctatcctaggctacataagtccctgtttcaagaaaacaaaccaggccactgtaggcgcgcttccctgttcacctctgactctgagaatctgtcgccatccaccaccatggtgaacttcacagtagttcagatccgtgccatcatggacaggaaagccaacatccagaacatgtcagtcatctccatgtggaccacggcaagtccacgctgaacaactcccttgtgtgcaaggctggcatcattgcctccgccggagctggggagacacgtttcactgacacgcgcaaagatgagctggagcgctgcatcacaatcaagtccaccgccatctccctcttctatgagctctctgagaacgatctgaacctcattaagcagagcaaggatggctcgggcttcctcatcaacctcattgactcccggccatgtggacttctcttcagaggtgacagctgccttgcgtgtcaccgatggagctctggtggtggtggactgtgtgtttggcgtgtgtgtgtgtgtgtgtgcagacagaaacggttctgcgccaggccgttgctgagcgcatcaagcccatgctgatgatgaacaagatggaccaggccctgctggagctgcagctggaacccgaggagctctaccagaccttccagcgcatcgtggaaaacgtcaacgtcatcatctctaccgatggcgagggtgagagtgggcccatgggcaatatcatgattgaccccgtcctgggcgctgtaggctttggttctggcctgcatggctgggcttcaccctgaagcagtttgcggagatgtacgtggccaagtttgcagccaagggcgagggccagctgggtgcaactgagcgtgccaagaaagtagaggacatgatgaagaagctgtggggagaccagtactttgatctggcctcatggagcctatctatctggtggagatccagtgtcctgagcaagtggtgggtggcatctatggtgtcctgaacaggaagcgtggccatatatcccaggtggccggtacccccatgtttgtggtcaaggcatacctgcctgtcaatgaatcctttggcttcactgctgatctgcgatccaacaccggcggccaggccttcccccagtgtgagtttgaccactggcagatcctgcctggggatccttttgtcaacagcagccgccccagccaagtggtagctgagacctgcaagcacaagggcctgaaagagggctggacaacttcctggacaaactgtaggcagcctgatactgccacatgttgcacagtgcccgcccatcagaagacaccttgagactgtccccacagtgctcctctggaggctgttggggccaccctgacatcactcagcactcacttggctaccaattctatttatttcagaattacaaggcagctggaatctctctgcaggctggactggcaggccgtggggtgggcggacatggctcttaacattttcagagggaa

SEQ ID NO: 19460 - DNA, 1099 bp, Mus musculus
atgtatcaccatgcccagccaacattcaacctcttagaattctttttcatatgggtcaagggaagtcccccagttagaggcaacgctgtgttttttgtgtgaaggcagtgttactgagcctgctgggtaagctagtttctattaggaacttggtagcaaaactgcagagaactggagcagtcccgaaccacagtggcttccagtgatgctttccttgttcacacttccacagctcctaatgcacctttataacccctcttgtcatgtctctgggtagtattcttgctttagagccttcaaagacaacgtgacccaggcccgactacagcaaacaagaaagaagcttgctcagcagctgcgtgacactacagtaagactctcctggccccaaccccagacagggctctgctgtatgggtagctccgggtggcctcaagctcactgtatagtctgtgctggtctagaattcacagtcctcctgagtcctgaaattacaggtgtactgtgcacagtacttgatttcctttagactccataatcatactgcctgtttccattgttagtctgtacctgctgatagagaaatttgttttagcctctttagtgttccctacccaccccgtcctactactggagtttgctaagaaaaccagggcttgatttggatgttaaggactggcttttctcttgacctagggtattgttagacagtatagaccccacggagtcctgtacttgaaaggctgttggtatgtttcccccataggcagttcccttcaatggtttgttgagcaggggcaacaattctcttcattggttttatttctgagtgtagatttttttaaaatgattaagcacatgatctacatactatgtagcctcaacattcattagtattttgcctcaaaattttccctaaatgacttcaaagtaaattataaacactttggtatgcatcacccccaaacaagtagttttacatcgcaggaccatccaggccattttcggattttcacagttgtccttgaaaacatcttctcaagcagtgttacacttcattgttattcctcctttgcctgtctgaagacagtcttgctgt

SEQ ID NO: 19461 - DNA, 1195 bp, Mus musculus
agattaatcatagaaagtcattattatgaaatacatttgtttctctgaagaaaaaaaatattttaaattttaatgtgaaaaattaattataaggcgctatctcattggtaaaggcacttgttgccaagcctgacaacttgagtttagtctttaaagactgacaacatggaggaaggaaagagcctgtccccacagatatcctccacacatacacacactataaataaggtattttaccctgaatctgttgatgagcccagttgctgaggacatggtatctaagatgttggtttgcttacctttctctttctggcatcttttcagatccacgagagcgagtgaaagaagatgacttagatgttgttctcagcccacagagacgaagctttggaggtggctgccatgtgacagctgctgttagctcccgacgatctggcagtccattggagaaagacagtgatggacttcgcctgcttggtggacgaagaattggcagtggaaggataatttctgcccgggcctttgaaaaggatcaccgtctcagtgataaggacctgcgagacttgagagaccgagacagagagagggactacaaggacaaacgtttcagggtttgtcctctaaccccctttgttctcaagtgcttgtattttttttttaaggtttatttatttagtatatatacagtactctgtctgtctaaagaggccatcaaatcccattactgatagttatgagccaccatgtggttcctgggaattgaactcaggacttggaagagcagccactgctcttaactgctgagccatctctccagtcccaagtgcttggaaatttgatactcacctcctttgtactgcatttctctgttgttgctctcacgatggttcaaaaccaggactgcacacttgttggcaagtgcccgagcctagtctgcattacatcctcctaacaccctcccacccccaacccccagtcactttgagaagctggggatcacagaccactcacagtaaacatggagaactcagatggcagtgcaagagtggggctgcacttgagatgcaccgcacagcttctgcatttcagctgctgtcatcagttcattacaccagctacagtgttgcattaaaacttcacagtctttcagtcttgctctttgtactttttcagagggagtttggagatagtaaac

SEQ ID NO: 19462 - DNA, 1182 bp, Mus musculus
cctaatgtggctgctgggaattgaactcaggtcctccatagaaacaatttgggctcttaatcactgagtcattcttcaggcatgggtcactcttcccctctactaccaacccccgttttgtttttgagactgggtctctttagtcctagctgccctggacctcactgtgtatagctggcctgtgccctcttgagccctgggataaaaggtgtgcaccgcggtgctcagccatctctttcagtgtatgtaatttcagccttattcctacctgatcttaagtgttcaggttacctattttagtgttagcccttttgacagcctcacttcagttacaaaatagttgtcattggcagccaatgagaattctttctaaacaccctttgcttggtgtaacaagaactttctcaacttctcagcacattcaggggttgtactttcagtggaagaggtagaagcagggctgaagggcttgaaagtggaccagcaaatgaagaattcaactcccttcatggcagaacatttagaggagaccctgagtgctgcgagtagcaatagacagctcaagaaagatggagatatgactgcattcaacaagctagtgaacaccatgaaggcaagtggaactttgcctacccagcccaaagtcagtgtaagtattcagtacacctcacccagcctctttccctgtttctgtatcacctcccactgcaataataaatgggtttaatgaaggtattctgagcaatttggaaatttctttagaagttgtttggtcttttagaaatttctgtagaagttgtttggtctttggtgtgtgtttgttttttaattctcaatattgatttgttattagaaaaagcacatctgtgaataatgtgtatgtttggggcgtacattcaattataggatgattgaataattcacgtgttacatcagttaatacaataccttcatgaagttctttcctaagaaaggaaagtaattgagttgtaaatttttttcacccagtttggagaaaagcatacttagtatgtgaggttatcgatgcaaaagggagaaaaaagtaagaaattgatcgtttgtgctgaactgagcatagtgatgtgtgcctataaccctagtgtctgagaggatcaggaagtcaggaccaggtagggccacctgattaatacccaattgttt

SEQ ID NO: 19463 - DNA, 1195 bp, Mus musculus
agcactggttaagagcactgactgctcttctgaaggtcctgagttaaaatcccagcaaccacaaggtagctcacagccatccgtcatgagatctgggatgtctgaagacagctacagtgtacttacttataaataaataaatggttaaaaaaaaaaagaattggcttatcagaactgtggaatttccagctaggtttcttctccagtgagagcctagatttttggaagtcctcaggccaagcaaaaatttactttgctttagctttgtacttcaggatgctgaaaagagaaggaagttcaaatcctgtacaaggcctcagtggttttgaagaggccttgagtccattttttagtacccctctacactcctcccacccagttgctagcccaacaggatttgagaagctggtgtgacaaatacctatattggcatttggaaggtagaggcaagagtgttaggagttcaaggctcaccttgacttgaaatgctttctccagccaaacatacatgaatttacctttgctcttggggcttagacttgatggttctgaatgaagatagagtttgtatcagatacactagctgggaatgtgctgcccgttgttgggatctgcggcaagtgttctggcctcttcccccccaaattgaaacgaagacctcacatggatttgtactagaagtaaggtttggagcaaaacagtagtgtagcttatggcaggaaacactatcagagattgactgcaggctgagtgagtgggggtacgtaaggacccaaagctatgtagcctagcttctcaaggtgtctaaagaaaggaagggtagattaccaatgagcagagtttgggcttctctatttttaaagttttaaaatgtttatatcaaggcaaggtttctgttgtccttgctggtctggaactagattggccttgacctaagagatgatgcgacttctgcctcccaagtgctaattaaaggtgtgagtcaccacgcttgccttggtgttttctatttataggttatatattcatttttcctattgcatgtcacttcccaaattacatctcatctagtcatctgtgcacccaatcacaaataggcataacctggtagatttccactaaaagttacttagaggaagtttgtgaatttattattacaggcaagccatggaaatgtgtgtagctgttgcagttg

SEQ ID NO: 19464 - DNA, 1172 bp, Mus musculus
gtcctggaactcacaaagattacctgcccctgcttcctgagtgctgggattaaaagcatcttccactcctggctcagttggtttaaactaattggctgttgaatgacagcgatcccatgactcagtgtgcaacactgctttagcaagtggctttgactgtttgtttattctgatgtatttagaagagggcttttatctgttgtagttctgtgccttttaagatccaggatgctaaatttgataagctggcacctgggcagttagggaagcagctgcttgctacagccactgactctttattcctctccatacagtgctttggtctggggtctgtctgtgaaacataatcctcagaaagtgggtaaagaccacacattggaagatgaagacgtcattcagattgtgaagaagtgaagtcctcttgccatctgctggctggccacagcagtgttccttatgactaagtaccttcctcagcccctctgtctttggcagcctctggattgggatacagggattgatatggagacttatcaaactgaaacaccacaatttttttctttccggagatagggtgttatgtatttcaggctggctttgaactcttgcagctgaggctggcctagaatccctttcatcagcctccatctcctcagtgctgggcttaccactgtgcacctttagctcctcagcaacaccactttccctactttgctgtcacttctattgaactgtataaagaagctggtgggcccgctggccatgtgtcgttattcatgtgaggtttgctgtgtgatgaggtgaatgaggcaacgcctgcttggtcataggaaatgggacagagaatgggacctgtgtccgtttgtccattggtagtgtgctgtaatgataggctttcacctgggcttggctttctgtcctttcaagtggtccttctcaggacattggagagaggaaggtataataggtaaagttaactgcagatttttctccagcgcaatagtctctggattctgagctgagcggactgctgtgatgaggaggtattttcttcatttatatttccaatgctactctgaaagtctcccaacccccctcccctcgctttcttggccctggtgttcccttgtactgaggcacataaagtttgtaagaccaatgggcctctcttt

SEQ ID NO: 19465 - DNA, 1176 bp, Mus musculus
ttatgttgagtgagggctggagagatagcttagtggttgaggacaatggctggtcttacagaaagggtccaggtttgattctcagcatctctatggcagcttgccaccctttgtctccagtgtgggaggagttcaagcaaacactaatacacattaaaaatactgtaattattttagggtttgtacttataaaacatgtttctaaacttatttatagtttattatttaatatatatctttcttttgattgtcttaatcatatataaaagatgggccagttttctgttccagatggttgtctgatgactttaaaacataactgcaaattaatagctaatataaatattggaaatcttaatcattttatatgtacataacaaggaaaaaccatctctgccaaggggctacaaacacttctgtttgagttttagattttatttgacgctgtttgtattcaacttagggtatcatttttaccctcagtggcccgaacgtgtaatttgattttgattgttctggatgtcctaaaacccttgggacataagaagataattgaaaatgagttggaaggctttgggattcgcttgaacagcaaaccccccaacattggctttaagaagaaagacaagggaggcattaacctcacagccactgtaagtggggaaggtgacatggggcagatctattttctgtaagtggggaggtgacatggggtagatctgttgactgtaagtggggaaggtgacagtggccagatctattgactgtaagtggggaggtgatatggggtagatctgttgactgtaagtggggaaggtgacatggggcagatctattgactttaagtggggaggtgacatggggcagatctattgactgtaagtggggaggtgacatggggcagatctattgactgtaagtggggaggtgacatggggcagatctattgactgtaagtggggaggtgacatggggcagatctattgactgtaagtggggaggtgacatggggcagatctattgactgtaagtggggaggtgacatggggcaggtctattgactgtaagtggggaggtgacatggggcagatctattgactgtaagtggggaggtgacatggggcaggcctattgactgtaagtggggaggtgacatggggcagatctattggctga

SEQ ID NO: 19466 - DNA, 1167 bp, Mus musculus
actcactctgtagaccaggctagcctccaactcagatctgcctgcctctgcctcctaagtgctgggattaaaggcgtgcgccaccacattaggtgtaattaatgttttgagttgggtggtggtggctggtagtgagaactagagggtagaggaagaagcctgatatcaacttccagtttatgcatgcccactcaaacacacaatctcaaaagctatgcacatacagtactccggaatgaggctggcggattgcaaattccagtcttccaaactagcctaggctatgtaagtatatcccatttcaaaaaatctggtcacaccattcccagggatcggataaaatccaaaccagagataaacacagagcctcaaatctgtatcttgttttttgtggttctgttttgtttgagacactctcactgtatagactaggctgaccttaaactctcacagtgccatctgcctctgcctacagaatgctgggattaaaggtgtatacctctaattctggctttatttttttgatattgttaatattttaaatttatgtgtgggccagggatagtggtatatgcctttgatcccagcatgtagggggcaggacagccagagctacatagctaccctaactcaaaagaaataattaaaacaaaacaaaacaaaacaaaataaaataaatgtgtgaatatgtggttactaattgtatgtgcaccagtgctttcagagcccagaaggagtaaaatcccttggaactgcatgtgtagctgcgcatgctaagaaataagcatgcatgctttgtgaagagccatctccaacccctatgctattttgtgtatgtgttttgcctgtgtgtatctttgtatcacctatgaagcacccctggaggccagaagagcatactgtatccctcagggaccctgagactgcagttagagaagcttgctagctgtgatgtgagtgctagggattgagtctcgtcctctgcaagagcaatcagtgctccagccccagggttttatgtttttgagaaaggatcttagtccaagctggcccctaaatttctgcttcctctgctttttaccttccaagtgctgtgactacaggcttgctctactatgcctcataaccttcagcccctcctctttctcctccttacttctctttcct

SEQ ID NO: 19467 - DNA, 1105 bp, Mus musculus
ctgccgcagccccgtccccatgcagccccttccctcagttcctcgggcctgggcttctcagctcccatccgccagctccgtctctgcgcaacctcccacatcccacacccagcacttgctccggttttcggcgcatgtctcgacattatttctgtttttcttgcttttttctctgagccacacgacttctatatcccagactccgtgatccgatcacgggctttgaggtcttgtcccgttattccttgcccacttgccactcactggtggtccccttttacacgccgttggttgtgacggtaagatctgggagtaagtagattgtacctggatggcgcgtcatccctgagaccttcagggctttttaaagtccgtaatgtgacacccttcttttagattgggtaccgtagaaacgaatcagcagatgcattttaattccctctgtggatagaaattcgaatgaccgtgggtcctttcacgttgggtctcgtttgtttcttttgtggtgaagagaatgaactggagaggggagagggaattcagtttatttttatgtttctgtgtgtgtgtgttcagcattacttaggggaatcgttctgttcagtcatggtttctgggattgagtttaggtcttccaagtttggcagcaagtgcacttgagtgtgtctatctggccctggattttttccctctctccctccctctacctctctcctttgtttggagacagggtcttgctacatacttctggatgtcagggatcccattgtgtagatcacgctggccttgaactcagacagatctgcctctgcctccagagtgctgacattagccaggcttggtttttctttttaaaaaatacttagttgcctgtatcctcttcagtctgcagtttgctggatgctcgtgaatatgagccatttggtcttcccctgaagcagtatttcaatagacagtttgttcaccttcacctctattgtgggcgtctaaggataaaaaataattcttaggtggagctcaggaggccgaggccagtggtacactaatgaattcaatgccaacctggtttacataataagttgtagtacagttaggaccacataaa

SEQ ID NO: 19468 - DNA, 1868 bp, Mus musculus
aatggggccatgggttcagttctcagctctggatgctcacgtctgtgtgtcccttctctctgcagaccggcattctcaaagctggaggactcgttcgaggcgctctccctgttcttgggggagctggccatcccactgccagcagagctggaagacctggaccacactgtgagcatggagtatggcctaacccgggactcgccaccctagccctggtccctccccctgcagggggacattccacagccagcattgccccctctgcacgctgtccttgctgtgagcaggactgcctaggtttcctgtggattgaaggcttgcttagaggcacaacaagccatccctactacctccccaggaggcacttgggtgcagggaaaaaaattctccgcaagttttgggggcctagtttctatctgtaaatccaacactcacctgaaagctgtgaagaggataaaagagcctggattatagaccaagagtctgttactcgggactacttgggacctctgtggattgagattctgggaggctgtagctttacactaatcaacatgatctgggcctgctgggcaagatgacggagtgaactggcctgagggctctggagtctggctcagcaaggtgcaggacttgaagcggtagtatgagttacagaaacggggaaccttcaaagcatgtgaaatgacagtagcgatttctcctccatcccaggccatgccctttggagcaggttttaaagagtcttagtatgtggtaaaacctacagaatccaacaaaggactggtctctgctcacagcccagggaccacatcagtgcatggggagtttccacttcagcatcctgtctcaacaagcagtcactcacaaaaacaccaaagaaactggggctgcaaacaggccctgccctctaaaagccctgtatccaggctggtgggctcagtcaaaagctcagcatgttgcctaacagtacatgggttctggatgccagcctggtttgcctcagactttgggtctaagcagagagaagggggtcccatcaatttctttgcacccttgtggcagctactgcacatcctctagaatgtctgggccaggcagcaatgtgggacaggcattggtggctgctgagtccccaaactgagataggaaaagaacaccctgagctgggccttgtagattctacctctttttgttgctggtccagcttgcttcctgagccacactcgagggccatgggcatgggcaactatgggggcactttctacccctggctgccaggtgtccagggactctgtagctcaccaaggtttgtcatctaagcgggagctcacgccatgtttaacaaattgggaatgggtttggttataaatacatgtgatgggttgtactggtggggggattcaggaagagtggttgctgttattagcttttatctctggggtgatatgtgagatattttgtacatagacgaaatgaattatgggatgggaagtctttggccacttttcttgctgtgtagactgtacttgcgtgtggagtttgcacacttgctgcagagggaatcctgaactcccgatgggcatggttcagcgtccttgactgagtatgcttgcactgtccccagcaagtgtgggagtggggcctgcactaggccatgaagcagactaaataaattaagcagttaacatagagatgacagagagtgccaaagtgacttagggcctgacttaaacacggaggacaggatggataatcacggtctgaccagggtttggttcccagcacccacgtggtggctctctaacatctgtacgtccagttctaggggtactctacctcatctcacctctgtgggctcctgcaca

SEQ ID NO: 19469 - DNA, 1193 bp, Mus musculus
agctgccctactctgtcacgctcatctccatgcctgctaccaccgagtgtagacgcggcttctcggtgactgtggaaagtgcctcttctaactatgccaccaccgttcaagtgaaagagtaagtgttttgagagccttgcagcagaggttcatggaccaagcctcccagggctcagctcacagcgcttcctccatcctcaccatcacctttctcctgaccttggctcttcacatttcttctgcccaagttgcttcggctgccttcccaacttttcaggtgtcaggtttcgtgtctactcctggaaattacctggcctgatcaatgtgtgtcagcttgattgtcatctttcctccccacctgtggtggcttgaataagattgacccccagaggctcctatctgaatatatagtgaatatatttgaatgcttagggaatggccttaggaggtgtggccctgttggaggaagtgtctcactgaggatgggcttaagggcttcagatgctcaagccagacccagtgagctctcttcctgctacctgtagatccagatgtagaattctcatctacccctctctagcaccatgtctacctgtgtgtcaccatgcttcctgtcatgatgataataaactaaacctctgaactataagtcagccccacttaaatgtttttctttataagaattgatgtggtcgggctggcgagatggctcagtggttaagagcgccgactgttcttccgaaggtcctgagttcaaatcccagcaaccacatggtggctcacaaccatctgtaacgaaatctgatgccctcttctggagtgtctgaagacagctacagtgtacttacatataataaataaataaatcttaaaaaaaaaaaaaaaagaattgatgtggtcataggatcttctcacaacagtagaagccctaagacaccactccaacatacactccagaagagcctccctttgtcttgttcagtactatatacctactgaactaccattaataggaagttattggggttttttgggttttgtttgtttgttttgttttttgtttgttgctttttgagacagggtttctctgtatagctctggctgtcctggaaatcactctgtagaccaggctggcctcaaactcagacatctacctgcctctgcctctggagtgctgggattagaggcgtgtg

SEQ ID NO: 19470 - DNA, 1594 bp, Mus musculus
tgtttaatcctgacccagggatcaagggtcagagacacaccaaggagttggaactcaaaaccaaaggaacccccaatttcaccactgctgtaaacactcttgtataacctcaggtcttgtgctgaatctcctctcatgggtggcagtgtgaagtcctgctccagccttctcagcaggtcccagctctacacagggaagagatgggaagaaagaaacagtttctttaacaagaactttaaattacaaaaatgaagggatgaaccaaatggtatttacagaaacttactttcatctttttacatactccttggtaagtggcctccactccctatcctgagagactcccttccacatcccagtactgctcctcccacctcccgcttcctcagcaaagacataagaaggtcggtcggttgcagcagcagaaactgaaaatgctgatgaccttaccagagactctggtttttgattggctctgggccttgttcagtgtcttgaccctagaaagcagcttagatgacctgctggcttcctggtatagattgtccctgatgtcactgggctcaaatttcccatcagccttctctagacttctgctgaattcaagactgactgttatgctttagggctgatacaagaataacaggacaggttgccctgccctaggctacagaagcctgagtcattctctcacagaacttgcccagagaaactggaggctttctcaggtcagcccagctgcatgtagaacactactaccctcagaagccattgtcctttttaaaaaaggttacgacgctgactccatctgatggtgaaaactccttgaatgtgtgctgagcccagggatacatgaggctcctgagcaagcaacccctctctggtgacataacacaaggacctcagagatacagtgtggtcgacattccttagtcttcctcgtgttgatttgttcttgaacttataagctgtttcctctgaatctgattgtgggattgtgttgacaggcaggagaatagtcacctgctgagacggttcttgctctgcccatcaggcctcatcttagaaatgtcacctctccctggagacctcagcagggcagcaagataagcgtctactggacccttttgttcacttctccaacacccactgccccagcaataacaaactgggagaaagccttgcctggtgatttttctagatgtgactctatataatctctggaaccctagaccttgaggatggtgaaagagccctcctcctcacagcacaatccttacctgccaacgccagtgttagtgttgaaatgaatacagtatgagtattgtgtaggagggtggtttggcaactctagctgttaagaataagccaccaaatttatggtatgcctgacagattttaaatattctttggcgcttggaaatccctggtcacggggcccctggagtgtctctgttctagagagaattggtaggatccctcagtgtagcatagccctaagtagtagagggaaaacttaagccaatgaacacaaaggagatgagagagggattgtgagtagtggagtaaaccatttggaatctggtgaaatgga

SEQ ID NO: 19471 - DNA, 1191 bp, Mus musculus
actcccctaggaggaagtgggtcactggggaatcctgatggtagaataacactagccaaaggggaaggctcccaggggttgaatggcccagctgagactctaccaacaaggatacacctgtgcatgaacaggaggtgggctctccagagagcggttgggttctagagccagaacctgcctgtctagggtgaggcatggctcactccccaacccctcaaattctacctgcttagcctatgggcaggatggcccctgggtttggttgtgggtttcccttcctggaaagcctttccgatcgatggacagacagtctggagtttgtgaaaagacgagcaggctgcgataacgacctcggggtagagggacacagcgagaagcaggctggcactgacaactcctgttgccccccccccccacacttgcaggatgctggtggactgtgtacccttggtggaggtggaggacatgatgatcatgggcaaaaagcccgaccccaagtgcgtcttcacctatgtgcaatcgctgtacaaccacctgcggcgccatgagctgcgtttgcgcggcaagaatgtctagccactctgctcacaccgcctgcgctgcgggctgctgtccccacgcccccagcaccggcacctcccagtgcgcctgcccactgctgccccgtctgtcaaaacacctctcccctttgtacacacgcagcgttttgataaattattggttttcaacgatcctgacttttctctgctgtcttggggagatggcattagactgtgaattatccccaagtgtcccccccattcctgtagctaggtagtgggaggagtcacccgaggatgtcaggaactcctatttgatctcccacaccatctactcgctgcaaataagaagagactccgcgtgaaggaagaagatttagtagagctggggagaggaaagggaggattgagattccccccacacaccccatttccgttgctttggagactggcgtcggccctcagcaagggagatgctcccgggatactgagcgcttcattctgtctccggggcgctggcaggggggggtcccagctccactgtggctcggggctacaggtcgtcgtgttctgaagcttcctcggggggcttagcgggcgcccacaggtactcggggggcacctgagcttccggcgccgacttgcggtagaa

SEQ ID NO: 19472 - DNA, 1210 bp, Mus musculus
gatccaaatttccaaatggagacactgaggtacccaggggttgtagaaatggccaagttcctatcttgtattttttttcctgggggttggaaatgaggacccatgagacaaagtcattgtatctctggatcttgaccctccggaccagtctggaccagctgtctcctcaggccaccgatctccacatgttctgtgagaagtgagcatagatctcttggttgtaataaggtttcctttgactttgacatttctagagcaggctaaagggggctctggtacaggacctcaaagttccccaccatgacagagagccctcaacaccacagctatcttgtctcaggcaagccataaacaagacactcaattccctcttatcagataaaaatgatgtatcaaagtaatgtatcaagagtaggtctggatgggaccatcagttaattaagagccttagctcctcttccgaaagtcccagcacttggtaactctggctccagagacctgatgccctcttctggcctccacagtcacccatgtgcacatggcatccactcatacagatacatgcaaacacatgaataaaactaaaccttgaagggaggacggtagaagctggctgagatggtgtgtccgtcccttaactccaagcatttggaaggcagaggcaggcaggtctctgggttctaggccagcatggtctacagagcaagttccagaacagcctgggctacacagagaaaccctgtctcaaaaaaccaagcaagtggcaaatgggatttagtgctgggtctgacactttgggtcactcactaggggtctagcccttcccaccctaggtcttgacttcttccatggtggctaggactaggccatagtcagtaaaaggggaaaggtaactcactgccaagcagggagctaggctactgcctcagattccctgtctcacatctttcccggcagggccctgctactctgactaggtagatcacctagtcagacttcagctacctgaatcacccttctcgttccttggactcttgtcggtagctcagagaagaagggtgactacactcttcctgctgtggctccctggtctaaagggttaatgaaagcccccggagagcagatgtcaagtcccacaaaggagtgcctggctgcttggcacctggcttgggtcggtggctacaggctgtgcactcacagaagggggccc

SEQ ID NO: 19473 - DNA, 1080 bp, Mus musculus
aattagtgttatagctcactgagatcttactgcttaagtcatccaaccatggacttctcaagtaatatttgcaaagaaatggatacattttccagtgctattacaacttaaaaccaacaatcttgttccctgatagtcatttttaatatttttatcctttttggggggatttcatgcaatgtattttgatcatattcccctaacttccccaaaactattccctaccctctttcaatttcatgtctttttaatcccccagtttgtgctgctcagatacttaatgagacacccactagagcatggttgacccttttagtcaattttaaacccaactttaatcaaaatttataataaaacttaaattctatcgatctgtaagatggtccacattagagaaagaatagaaaaactttgtctactttgtctgctttgtcttaacattgagcttgcttaccatattctggtttccattacctattttttgtatttcagcattttgtgaacaacttatcactgattttccaaaggctttgtgctcttgaagttctttgaaggaaagctgtgtggaagtccagagtaaagtgaagctgctctggatgaagtagtgaagtgggagttgaggtctacaacctgccacaaccatcttcctttaccaccatggtgatgccaaaagggacttccttaaagctcttcagaaaatcctgcttgaaaccactaccctagacaacatgtttgacctggatggcattctcttcaaaacaattcatattcagttgatgctcaacatgtttggagatgctttattcagagaatgatgataattacagcattgtctaatgaagttttattaatagcattccatccaaggtggacttcctggagttggatataaccagagagcaattcatatgtatcctacactgaagaacaccattaactttcagcaacctatagctagtggtactagaagtacgtgtcttggaagtctatgagagctggtattgaagctgatgcctccttaaggccatcttagaccaagttgtttgtttgacctctcctcattaactatggagcagaatt

SEQ ID NO: 19474 - DNA, 1111 bp, Mus musculus
cagcaaacactattaaaatgtttgaacagttgggtttcaaacatttttgttttgtggagtggtgcttattaagtggtacagctctctaagcaagtgaacacaaacatatttaagtgtattttgtatgattagatgttaccaattctgatattttattcaaatgtctaaaaaaataagttgacttattccctttaccaaagggccagagacaaatggtttcctttcaagagaaatgactgttttgaagaaaaactctgttggtcttagctcttttgtaattaaatctggatgtacctcaaaagactctttaagactgtggtgttaaaaggctttcctctggagaaggagaaaaaataaaatcaactggaacttaaaagcttgaaattccatgacaaaacacagatgtccaggattggaggttcataaagtacatgcagtagttggagtggattccattttcagtgtagctgccaccatggactccaggctcccagattttcaagaactggacctgtgacccagaagagcttgtcaagatatgacaggaactctggaggtggacgttttgtattcaattttggaactgttgatcttgccgtgagaaaagagagacacgactcaccaagcactgccaccagcactgtcactgggaacttgaagatccaagtttctgtccagaacctcagtgcaaactgacaacactccatccaaagtgaactacggtacttgccattttccaaaatgccttttcatttctgcacttttgctattcatactctctaccctggaaatgcacttctgtgattcttcacctggcagatctctgcaatttcataaaactaagatgctctctaaccctgtaactctcttaatattaaaaagaacatctttaggataactttaatctcttatatgcagagtctggttcatcacatgcatttggttatttgtttgtttgttttccatatagcaaacactgaaagagtcttggttttatgtatctttgcccaaaaataccatcatttctagtgaagccttttgaaaagcagggacccttaatcctcagtgtatgtataattgctacattataattaacattactctagatata

SEQ ID NO: 19475 - DNA, 2075 bp, Mus musculus
gagagatggaatcctgggggaagctacttgcctagggttctcagggtagagatacttgtactgagactgggagctcactaagctgtaataggaagttgtaggcagtaggagaggttagagacctctacatatgtggtttgatgtggcattgtccaacttttagtataagacactaatcagtttgaagatgtacgggttagaaccaggaaacctataagaaagctcccatccttttttgggcatgcagatttaactgaaatttggaagtagggcaggagcaagaaacagaagctgacagctggctcaggcccattctccagcctgtgttcctgccccatctgactcccacccactctgttccaggacatagacatcaacacagatgatgagctggatgcttacattgaggacctcatcaccaaaggggactgaggagccgggaggctaactcctgctcatacctgccctcaacacagcagcttcggggaggggagttcatttgtgacttggtggacttgatcttggtttgagtcatgtgagacatttgtgctttgggaaggagattctttgaatcttcttccctaagtttacataaatatttattttttaaaagagaagatgttaatgcctgctgtgagaccgtacttttttttgtgtgactcttgaaagggcacagagtctgaaccattcagctcctggcacctcaacataggatgaagaaagcaccatcctgaagttggagaggctctaaggacatcaacaatgggatatgaaagatacatggccccagggactcagctctgcaagaccctcaaggggtgatcaaaacaggcccagtatcagaaagacactccctgtaacagatctcctggtgtccagacagggctgtgaaggtctgtaggctgcctgagcagctgtcagtcatcttggatgtgacagtatccagacagcttggagatgtttcttaaggctcaaatttcccaatatgccacctactttgttactggaggagccatttcctgagtcaaccacactatccaagctcaagcatagacagctctgaccggtcagatccctgggctggatagcactctgaatgttgaactccaaagattctcagggtgtgcaggtgtgaaagctctctggaggagaaggcttccacagtggtgctagttcctggagagcctttgctgctgcttttctactatgtactctctgggctccagagagccctgcacctcccatgctctggaggtgaggaggacagaccatgtgcttcagacaaccactcagagccagaaaggcacgagcttcatctgatggctgtcggaagaattctggttccagtcccaactcttcacactcctgttcaagactgattttgtactcttgatccaaaccaccttgggatttgtatccatcaaggcaaggctgccaccttgtgtcctggggtctctgcagaagatggggaagtgttggtgagggaactgtgcacatatggctggaagtgcctgcttgagttctgccatcaggttgtttaggggggatagcattcagaagttcttctctggaacattctccaatagatgggttttaagttggtgcacttacccccacggctgcccccatccaactttctgttgaccctatccaggcagagtatgatccatttttttccataaacccactgtttaaaaggaatttggccctgcatttttattggcaggtaatactcattttgatttttttttttttttacttacacatgtaatcaaaatgtgttactataaatttctactggtgagactcctgcgttcagtacattcttacgtgaatcacaagacttttctcttcattctgttacagctccaccgttcgttttagctttaacttttccagatttaactaatccagcctcaacttttctgagtgttgggtctttcctgggaacatcatggaatagctgacctggaacattttgatgataaggcattcactggctctaagggagaagtgtggggtttaagatgctaagtaacagtgggtggacgtggtaagaatttaaatactacaaa

SEQ ID NO: 19476 - DNA, 1204 bp, Mus musculus
tgccctggttcccatccctgttatacagccgttagtcccatgtcaacccactggggtcgccctctctgctgtatgagcctgtgacctgagggagcctaccaagcctcgttctgactctctggctggctccggacagctcccaccaccaaaccctgagtgggtctcatagatgtgacttcagggtgatggtcacatgatgtggtcagggtgggatattgccttgctaaccccctttacttcgttgttttctgcaggcattgctgactacaaaccccaggacggggaaaccattgagctgcggctagttagatggtagtcctacgatccctcctgatgtcttcacaccctgctgccacctcaagtgcacttggaacaatgccccccagatcacctcagctaccttcccaaagaggatctaagccactccccacctgggagcaggaagggaaaaaaaacctcccctagggaggctgctagtttgagtttggccctgcctgatcccacaggtctttcatgaagactgccccatagcctgaggaacaggctgctcttgacttcctctacataaagaagtctgctggctatgggtgttgtgagtaccactgctctgggaccagggtcccacaagaaggacctccatggcctgctgtggctctgacctgcacacccaacccctgctctctgttatgagagtggtggtcccagtggtcataaggcagcctttggtcatcggcagggccatccaatacaattaaagccttgatttacctgacatggacgtagagtcctggtgcctcgtgttcatgcatggggggagggggagcagagatctctggggagttacttgtggttactctcctgtgtatcacatggacagttggcataaacagagttgactccatctttcttaaacagtgtgtgaaacagccctgtggggcgtgagcatttgcatctctcgctataaatatggggaaaacagggattcatccaaggtctcaagatgaacagtgctgctataggaagtgatgtcaggcaggagacatgacacagatatggctgctgatcctgatggaccaagagagatttgctggggactgaggctgtactgagtagcagaacacttgcctggtatgcacaaagccttgggttgtgttcccagatgcacaaagcaagaactaaacactatttgatggactagggatgt

SEQ ID NO: 19477 - DNA, 1195 bp, Mus musculus
cttaaactcactggcctagcattacaaaaactagtagctttaggtttagtgagcatttctgtttttgtttgtttgtttggttggtttggtttttaaagaaaacatcagccaggcgtggtgacacacatctttaatcccagtactctggaggcagaggcaggcggatctctggattagaggccaaactacagagctctctgaatcccagaaggctccgggctgtctgtctcccatcccttcagtcctgctgtatcccaaaatgcactggggctcgcgtgctcaaacaaccgtgtctagggtgcttataaaactgcctaaatttccatgttgctttaaagcttgtctatagattttggtaactaagaaaagaactgaaagaactaccacaattgttgagctttagagaatttggttgtaaataacgaggtcgccaaaagcacaactttctctggatttgtacaggcatattttcagacagccctcagctggcggcgtggggtccttcagggccctaggcagggcacgtgcgggaggaagtagctctggtgttctggctgccttgaatttctcaacgtggagctatgggaggtctggagaagaagaaggtgagtgagttccagcggaggtcggagctccggctttatcactttccctggcctctggggaccgagaagtcttgagacggccgccggagcgaaccttctgcacgtaggcccctggaagccgggaagaactgtgacgggctttctgtggaaggagttgtggagacaggcggagccgccaaaagagtgatcagtgaccaacgggacgtagaattcattatcaagacttgggactttcttaattgagccaggcccggtcctaggtactgggaattgagaagtaagcagtcagatgcggccccgctttcccagtgtcaacttcagataaagtggctaagggtttttaagtgcgctcctgagaaagggagggagggaggagcagtagagtggagagtatcaacaggcgcttaatccgattagtgttgtcttgtaggtcctcttctgacgtagcattttagtggaaatcagtacttaaagaacactttagtctggggcatgaaaatgttgggaagtgtggatggtccccaaccttcccctaagagaattctcggcactcagagaaaggagagactaatatcagcgtgcagctgtag

SEQ ID NO: 19478 - DNA, 1111 bp, Mus musculus
gacagggtcccagttagagatggatctgtcagatacatgcatcggactgctgagaaacgggaagacaagaccacccaggtgccagtgcgcctggggaaggaagcccactttccctggcctactaggtcgacttcccgtttttcctttttctctgtgggcctttccagtttcaagtagagtcaaagagccatcaacttggtgtcctcgttcacagaaggtaacatggggaaggttcctgaggtcccaagagttcactggaactttctagttttcagtggctacaggattgtttgcagatgcatggccagctgtgggaaagttgttgctatcaccatctgaggaagtagctgtggcagtgcctagcttgggtgtcaaggcctctggatagagggccttggaacccaatggagtgggcatgaatgctgccctctccaccctgcaggtaccccacatttatcgatgctctgcgggacctcgatgatgccctgtcaatgtgcttcctcttctccaccttccctcggactggcaagtgtcatgtgcagaccattcagttgtgccgtaggctcactgtggagttcctgcactatgtcatcactgcccgagccctgcgcaaggtgagctgaggctcttctggggagccctggtcctgccctgtcactccttggctttcatgctgttctccctccctccccaggtcttcctgtccattaaaggcatttattatcaggctgaggtgctgggtcagcccatcgtatggattgcaccctatgctttctcccatgatgtaagtgtgcctgttggcagggctttgtgctgtttcctggaaaggtgttggtggggtgctgtcttggagtctagcccttgcttggttcctgattattggcagctacgcgtgatgagagccagggacagaatagggactatgctctacagcccagtcggtcaataaccctgatcagtcacagttctcagtgtgatatgagcatagacgcataggctaagcctgactgtccactccagcacccctgctagagcagtgcttctcagccttcccgacactgccattctttaacaggcttcctcatgctgtggtgaccccaaccataaagtt

SEQ ID NO: 19479 - DNA, 1327 bp, Mus musculus
tatgacactagtgtgaccaccttctggagacacccagagcagaccctgccgacctctgactggttcttaggagcattacttgtagcccaggaaggagtcttgttccctgtcttgccgtcttccagtaaaggcttgagtggaatttgtctttccctcagagaagctaatggaagagtaggcctggattctccaagctggagatttgtggaccatgaaataacgagctgtatagcagtggtaggagctctgagatttgtggaccatgaagtaacgagctgtacagcagtggtaggagctctgtccttttgccctaaggttcaagttgaaatctttggtagcttttctagaatagaagttctgctagaaacattagccccagtaagggaagagccccctctcgctagctcacctcctccctccccagcctgagatcctctttccttcttacaggccaacaagctggcagagaagaggaaagcccatgatgatgctgtgaggtctgagaaaaaggccaagaggacaaggcccgtgtgagctccagttgtccctcactgagatttggacttggcagaagcaagctagtgaaacacacatacacaccagccagcactctcatactttggtggtatgtggctagccccagccgcctttgtggttcatgccagtgcctgggcaaagagacctcaacccaacgcagttcttaatccaggagtccgtctgacatcctcattttccttggctttctacagcctcctacatagctgtgcccatcctgtgctcaggatgctgttgcggagtgagggtggtgagcttttattattaaatggttggatctttacagccaattggattctgtgttcagaagcctccctgggattggagaggtgtcatcctctccaatccagatgggttcaggcacactaggactcccgagttcaaggaaggtagaaaagacacaggttctgggcttgggtttcagtcacacttgccctggcctggttcctgtttcagctcaggctctactctgaacctccttcctcaagttagggttggaagttctggaaccttcccacaagcagtatgcttgtccaattcagtcatggtccataaacaactgtcttccctcacttcctgctggagttcctgagaaggtgaaaggaggcatctaagttgaggtttcctttgctgtgatgaagcaccataaccaaaaagtaagctggggagaaaagtatgtatggctcacacttccacattgtatgtacaaaagtgtgtatggctcacacttccacattgtatgtacaaaagtgtgtatggctcacacttccac

SEQ ID NO: 19480 - DNA, 1184 bp, Mus musculus
ttatccttggggggaggggtgtaagcatgacttccttaagggaagagaataatcgaatgtatcttgacatggttgctgttggtaccatgcatcgagagtctttcccctagcccttgtgtttcctgcatctcctcatccttggctacctgctcaccaggccttctctctctgtaggtcagtggacttcctcctggactctagcctgcgcaagctgtacccgtcagtggagaagcccagcaccccctgaccctgccctgtgccttgcctggggtcggcccactcacatcaaagaatgtggatacgtggctgtttggggtccatggcactgccatctgggtgggttcacattgatgggagcttagagatgaaggccccgaggagtagtggcagtgagttctgaggtgggacccaattctgtctgcctcagtggccacggttgtgctgagtgggaacgaactctggctgggcctgtcttttgaaatctttttttaaaagtatttattttatgtgtataagtgttttacttgcatgtctgtatgtatgtgcagaacccttagaggttaaaagaggtgattagacccctctgggactggagttagggatgcttgtgaacccccatgcgggtgctgagaactgaatctggttcttctgcaagagcagcaagtgctctgttcactaaagttcctcttagccccgggcccaccttctgatggaaaagttagttcctcccatggaagagaagaatactaaggcccagagagggcagggaatactgagatcatgtgacaagtgagagccagtcttctggctattctaagtcactttgtggtagtgtggctgagcgacttagggaaagatacagaggtacagtatttgggacactcagggcagagtctctggccagcctgttcctgttgcaggagctgctgggcctggtgagaggcaggacaatcacaacccaagtgctaacctaataaaactttcaaaaatggcatctccttttcatttcctcttcctggggataagcagggttgcgaccacagcacagtgcttcctctggaacaggtaaactgagggagaagtgggctggtctcctggctctgcaggaagggctatggggagaacaagggagggatgtgttcaagcctgttcaagagcaatatcagatccaaggaaaagaaaaa

SEQ ID NO: 19481 - DNA, 1099 bp, Mus musculus
ccaatctcaggagtaacccaagtcagcactggaaggaaggctaacagcccccccccccagaacctcattaactcctgggttccactggctgcctgtttaaaccctccacaagcacaagggtaattaatttcagggatcatagataggaaaggaccaaggaggcggtgggtgggccccaagcctctcactaagtaaccctccgcttgagcagccctacacaaagatgacaattggggctgagacagcactgagtgcacttcccagtccagtctcccacagtgcctgagaaccagtctcctgacaggagcaagggcttggtgggcccttctctgtggaggcgtgtaatagcagcagtggcttcctcttgcctggggatgcaggtagccagggtgggcggtttcccgggaaggtagccatagctgggcaaacatttgagccagggtaaagaggggggccaggcacaggtgaccttgcaataaaaagctcttgaccccacacaacttgagagccaggttacaggctgcccagaattcaggaaggatgccccaggcccttgcggggtctgccttttcctctgaacgaggcgttggcccagcctcgtctcaggaagcggagggagctctgggcaggtgcagggatggcaagcagagagggccgaggctacccaggatctagtcacacatctcaggggcacagcctggccttggtttacaatgctgttaggtacattaaccaatgaataaagtgatcaattttcaaagcaaagagcagaattcattgcccatcgccggcttcctagcggtctcttacattagaccccaaattttcagatgccaagtagcaggctaaaattacacacacacacacacatgttctgttcctttcccctctactctcacgacactcggacacaggcacgcacagagagacagtaacgtccctttcctctcctctcgcgacaacgttctccgaagtcctaacaagttgccttccgattggttcagccggtgagcgtcgtccgccatctttgttcaaggcattcggatgctcccgagagccttcacggtgagggcggaggccccgccccattcggtggttc

SEQ ID NO: 19482 - DNA, 1179 bp, Mus musculus
agacctagctgacctaaggcaaagggcagaggtggccagtcctcattggtcctctctggaggtgtcctacaggtcagtaaccagataaaggtctctgctgttgtaggaggcttggggctgcctgtttactactgggtagtgagagatcagggataggggtggctatcctgggtcactgtccacctcccttggtggctttcctagtatgtttcccttttgtggccacctgcaggagctgtctgctccatcatggttgtccacccccctcccttggcttcttttgtagtctttcaaactagctccactatcatttttgaacaaagtcatttgagactaccagcttcctttcctttgttccccattcctttaccaaggcggcaggaaggctgcagaggaaagagcctggatctggactcacatctgcatccagatgttggaagtgttgctgagcctctttgtctttcatctctccatctgtaaaatggggacagcgacacctctaggggctctgggagagatgtaagactctgggagagtgccaagaccagtgctgtacacatgacaggtgcttggcatacagacagcgtttgctgtggcatggccagagtgcctgctatctctcactgttggctgggaacacacccacttgcccatcagattagcagggagatatgctcataagtgaggcagggcagtgtcctcttccctttctgtgccctcctctcctacccagctccccttgcaacacagccagtgtctacaatcgttgtaaaggagggctctggcaaaggccccgatggaggagtgctctgggcagagggagatgggcccgcccactcacccagctgtctctccctatagttccgagaaaatgttcaggacgtgctgcccaccctgcccaatccagatgactacttcctccttcgatggctccgaggtgagggaagaggggctgggacaggggtgtgttctggacaatagaaggatgtcctctggaatccctggcaggctgggacagaaagacagctggcaatccccccaggccccagcccttctacaggatacagacacggaagctcagacaggtgaagggacttgctgggtgagctgcaggcaggaagaagatgcgagtctctgggtctggactgtcagcagccttttcgtttactttgtaagtct

SEQ ID NO: 19483 - DNA, 1211 bp, Mus musculus
actttgcatctgttagaaagaaggaaggaaaaagagatgttctagaagaagccaaagttccatacttcgctgaccttcccttaagcttccatagtagtgaagtctagaatagcagtaagctcagttgtgtgaggctgcatgtggtcaaagacaggtggtgtccattaagacatttgtctgtcttccagggcatcttcatcaaggattccaactccctggcttactacaacatggccagtggtgctgtcatccacttggccctcaaggagagaggcggcaggaagaagtagcaagagatactgcaattgaaaccttgccattgtacctctttgcaccaccaattccaggagtgtccctggggcctcaggcacagcctgggcatttgtttccctcaaagccagtctacggaatgaatatcttgtttcaattctggattggaggtccttcaaggaagtccattagaagttgaatacccagggttgtcccacaggacagtttcacactatcgagtgatgcttagttaatagaatatggttaatgccattcatcattttgtatcatgctttggtttcttgaagccaggcatagtacatgcatgcctgtgatcctgggacttgggatgtgtgggcagaagaattaaatgttcaatgttcacctcggctgtatagcttgaggccagactgggctgtgtgagatactgtgttttggttttttgttgttgttgttgtttttggtgggttttttttttgtttttaattaaaaaccgaacacttcttggaccttcatggaagcagtttgtccctgccatccacagactggcttagaaagctctgccattcttacctatgcagggatagctagtgcacaacaactctcctaaggacaagggtgaaattccaagtcaattaatagggaaacaaatggatcgctgagctttggggtctctgcagtcttgatgcttataatatgtttttgctgccatcgtgcctttcaagtacttctaaagcatcgtggctggggagatgccttggtgagtacagtgcttacggtgcaagaactgatgtaagagccactagaacaagccactgctaccctgtgcactaggagacaagacaggcagagtcatcctagcaggccagtgaatgagaaagacctggaaggcaagggtgaacacctatggctgtcttctggtctccatgtgtttgccgcag

SEQ ID NO: 19484 - DNA, 1159 bp, Mus musculus
atctaaggtaagccacccgtgtctccaaccctcagatgaatgtgggattgtggcccagattgcgggtcccctggcggctgttgacatctctgcttactacatcagcacattcaactttgaccatgcgctggtgaggacctggctgggacggaggttccagcaagcacactgaggtcccttgcggggggagggggggggcagcatcacagctagtttagggggtcgggcatccctggccagagttagcctggcgtttcatgctgtacactccctccaggttcctgaagacgagatcggctgtgtcattgatattctccagcgaaggcaggaaagccaggcttccaaggacccatagggaagcaccagacccccagcattcccgtaaagccccccggggctccagaaacttttctgagcttcagaacaagtccctggtcctgccaagggatcctggttctgctgtctgtctgtcagctgtatggagctgggactcgtggccatgcctggttctgctgtctgtctgtcagctgtatggagctgggactcgtggccatgcctgcccacaaaagataccttggtgcttggggcttagatccccgacccaacattttctatgtgacctcagcaatgcacagagcctgcttgcctgcagctggagccgcctctcccctggctaaggctcacatccccgggccgggctctgacctccagcctgcactgctttcctagccagatgagttcagcagtgcactcccttcgcgggactccgaaggaagaattaaatctcacttttattttcatgactgtttatataaataaaagacttgcggatttgtgccctctggttctgagtgacagctggcgtcatgtcttggtctctcccagacttgtccccccgtccttggcttttcaagcagtttatgtatgtgacaaatgaggaactgaagcctccagcacatttgtgactaagtcatgtggttcatctctaaagtagagcgtctcttaattcgtagttacttacagaacaacctagagagttccccacactgggagaaattcccctgtccctcttacctaagagtcccctggctggatcctggagaacctatccaggaggtctcaaagcacctttctccaaggctgctgtctgcaacccacg

SEQ ID NO: 19485 - DNA, 1131 bp, Mus musculus
acagagtcaccatcatctggtcctttgctgtctctcagagaaactttggaaggcttggttgggatgtgagagagctaaggggactgggatccagaaggaatccttttattttattttattttattttattttattttattttataagttttgtgggtggaagggtaccctggggtggaatgatggaatgtgtcttctcttgagttggatgagagagttcaggcttagagactgtcagatggaagagtctaggtcaccagtgttcaggctcccacagaagcacagcggccagcttccagttgtcaaagcctgacgaactcggttagcttctatgcagttccccccacagcctggcgtggttggggtctgccagctggacctagaggtgaggtgtgtgcaggcaggaagaggcaggctgcaaaggcaggttcccagagtcctcccggggaaggacctctaactgtctaggagtcagggaaggagcaaggcagccagccattgctgaggcagtagccgactgcagctctcatctgcttctcaacccctgagaacaggtgatcttgagcagacagacaggtagcataaagtagaatgtcgggtctgaggccccggaggtcgcaaaggtacttgaaggggaccagagggctgtcttgggtccctggagcatggagaagcagaacttgaggtcagggtctcagggaagatgaggcccagagtgctgtgtttgatccagcacagctgtctatttattactatgtcctatttatattaacttattggtgctttaaatggcaaagttaattccccgaaatggtatgaggctccttccatgggagctggggccgagactctccacctagtggggcctggtctggaggcacatgattgttacaggtgcagctcatgggtcaaatcagagagctggctagctcctctgtctcccactgtgactcacttttagggtgtcagggtcccccagaaaaagctgggccagtttgtctctctgcttctgtctctgtctctccgagtctgtctctgtctgtctctgtgtctctgtctctttgtctctctctgtctctgtctctctctctctctccccgccccccccccttctccctctggtctccaaggg

SEQ ID NO: 19486 - DNA, 1102 bp, Mus musculus
gtctgtccctagtgctgattcctctgccaggagctactcttgcagcgttagcactctcatggcacccgtcctagtcacctctgtctggcccccacacccttagtcttgtttggctctcgtcttggtcagcagcattaccaacatgggtaactttgtccttttgtgttctttgcttcccatccttgtgctgctcccagtgaatagtgaggtcaagttgggcttgagtggaggctgtcattctttcagccttctagcccctcgctgctctgccaggaccttgcagcttctcttgctcctcctcaggcattcctcctttaaagcagtatcattgcttctcagctcagccttccctgcaacccttcacactgctgcccagacatgtgtcttcacaaccctttagctgcacaccgtgttaggacaaagtccacacttgagagatggtattctcagcccgtcgcaccccttcctgttagtctcattgaacacattctcagagtccccaggggtgtggctgtgctgcttcctaccctgtacctgtgctccggctgtctgcaatgtcttctctgcaaccctgtactttttttctgaaatttgtctattatttaaatgcattttatacatcaaacatgttaatgatattgaatattttgagaatcaaataatgcataaaaattttgttcaacttttatattcaatatcctttcataccctaaaaatatcattaatgaatatttaatactatccataactgagaatcctatatctaatattgaatactaaattgtttcaaaacatacaaaatattctttgggaattaagcatagtaaaagagcataaaatattaaaaacgaatcattaaaaaataaattcaaaagcccttatatgataccacctgacacagtgagagagtatttaaaacacattatatatccgtgtacattgtcagtgctcttaaacgctgagccatctctccagccctctgtgtacagtgtctaacaatcagtttacttaaaaaaattatcagtgtttctaggataaaaattattttatcagtaagtatattttaaaaatttcaaaatagcaaaaattctttgaagttaaa

SEQ ID NO: 19487 - DNA, 1206 bp, Mus musculus
atgaccaccacccatctttgatgtccttattaaaaacaatattccatgaaatagtagtttccctgtcttcaccatcatccctcagccctgaaaaccatccgtcatataagaaatgccttacttttaagactcaataatgctgtgtattgtatatataacatctctccatctgtgaatgttgtcctggctagttttatgccaacttgacacaaactggagtcatctgaaagagagactttcaattgagaaaatacctccataagatctaactgtaaggcattttcttcattagtgattgatgggggaaagtccagcccattgtgggtggtgccatccctgggctggtggtcctaggccctataagaaagcagactgagtggatggagagatggttcagtggttaagagcactggctgctcttcagtaggacctctgttcagttcccaacacccacatgacagctcacaactaatattccagagaatctgtcaccctcatacagatatacatgctggtctccgtgttctctgctatcagctaccgcatacaggtttctgcagttttaaattccttacctgacctccttctattatggacagtgattggattaggacgtgtaagccaaatgaccctttcctcccaggttgctttcaggcgtggtgtttcgtcctagcgatagaaactctgactggggtggacatgtacgtggtttccactttggttgttgtgagttatactataaacgttggtgtgtacatattctttatgctagatgctccactactaaactatgccactatacttccttataaattttagaatagcttttgtttttatttatgtaagaaatgttactaggttccttttcactcatttagtaggggaggcggtacatgtgtgtcacagtgcacgtgtagaagttagatgacatctcatctcttcccttctgccttattggttccagggattcaaccaggctcatcaggctttgcagcaaccatctgtacaagctgagctctcattggcctattgttaggattttgaaaggtttcgctttgaatctatagtaatgacagtgattatattaagtcttacagctcatgaatgtgaacatatttccattgtttcactgtttcatatattgcttaagaaactctttctaccagacatagtggtgcatgtctttcatcccaggactgtgagggc

SEQ ID NO: 19488 - DNA, 1228 bp, Mus musculus
ttaatggcacaaaaatccactgattatatgaagtgattcaaatgtattaatttgatcaagaaaaaggtataattgttttaaattttatttcaaaattttattctttttaaaatatttatttattttatgtatatgagcacactgtagctgtcttcagacaccccagaagagggcatcggatcccattacagacggttgtgagccaccatgtggttgctgggaattaaactcagggcctctggaaaagcaatcagtgctcttaaccactgagccatctctccagcccagaaacttaattaaaaaaaaaaaatccagtgttttctttcaatttggggtggtatgtggtttttattttgattttgaaaccaaatctcactacatagcccaagctagccttaaactggctggcaggtctctgcctcctgagagttggggagagagagaaagagagagagagagagagagagagagagagagagagagagagagatctcactgtatatcctactctggcctagagctcaggatgcccctgcctcttttctgagcactgccccatggtgaacccccatgcctggctttcgtttgtgtcgggaactttgatatgatattgagtgtgagtctgaagagctggctcagcacttaagctgctgcagaagacccaggttcaggttccagcaccaacatggtggctcccaatgtgactttagttccaggacatcccataccctcttctggctcccatgggtgctcgtgctcatgcaggcaggcagaacattcatacacataaagtaaaaataaatactttttttcaaaaaaaaaataagtttagggctagtgaggtggctcagcagataaaggtgtttgcaccaagcctaaaacccacgcagtagaagaagagtgtctactcctgcatgctgccctttgacctccacaggagcactttggcatgcctcctcgatcaatacatgtaatttaatattttttaaaaaaatattgtttgggtgcctgctcgtctttcagcacttgtcttcagtgtctgtctctttctctttgaggtagggtctagccatgtagtgctggatgtcctggaactcactgtgtagaccgggttggtctcaaactcacagtgaactttgcctttgcctcatgtgtgctgggatcaaaggattgtagcaccacacccaaccttactctcttattagaagaatcagcaacacgtcagatg

SEQ ID NO: 19489 - DNA, 1183 bp, Mus musculus
gttcttctgtggtctagctttctgtattgctgctttttgggaagtttcagacctttctgattctaagtccttgttcattatctgatcactcctgtctgaaagctttgttcctcaaggttttcaaattttatagcagcttcccttgatgtaggcctatttttatacattatttgttctggttacatagtgacccatttcattgagggagggcactccctcaattctgggaaccttcttgaattatttccttaaggaaaacaatgtctcatcaagttcatttcatgtttcttctttgtggaaccccatatagatatcagatctttcgtataggtattctgtttgttaaaagatttgtaatcagttttgcatatttctactgttcttgtcctggggaaagagaactctcaacacactccggattctttctcatttgtagactatattttcatttccaagacctttgttgtttttctctgaatacagctttctgatagcatcctgttcttgtttgtggttatagatttgtctcctatctttgaaaatattaattacatgtattcagtctaggagggttttttaaagggtgtgtttgtctgtctgtctgtctgtctgtgtatgtctgtctgtctctgtgtgtgttagtctgtcttcaggctcttgtatttgtattatttatttaaatagggctaacctcaaatttggcctcccaagttcagggattacagccatatacctctatgtccagcttacgagtctgtctccctccttcccatccacgtgttagtgtttgtttcttctgttctctatctcatctctctagctcctatgttcacatttaagagttcagagacttaaaaaagttctgaagcttgctgtggccttcattatataatgacttgttcaaatctttgggagaattcccaacatctgtgttttaaagtctttgtttttcttcatcagtgtccacaaaagtatgctatttagctaaacagacatgagatgtaaaggcccctcccgtcgtgtgtgtgtgtgtgtgtgtgtgtgtgtgtgtgtgtgtgtgtgtgtaggctagaagaaggcaatctcttggaactggagatataggcaatcgtgagccacttgaagtaggttctgggagaagaactcaggtccctggaagaacaaccagggcttttaactgctg

SEQ ID NO: 19490 - DNA, 1135 bp, Mus musculus
tcaggaactccaaagctataaatcaactatttcttagtgacaaagagctgactaatgtgtaggctaatttctgataatgctattataaatagcattacaataaataccttgcaagtgtgacacctcctttccttaccttctattggattaacagtagcaggagtgaaatatacatatttttgaaatttgtatagagtttggatgaatattatcaatatatgataatattcagaaacttccagtttttccacctcctaaggatggcatttttgataatgatagctacttgataaaaaggggtagctccccatcaccagctctggttacatctattacatgcatacatagacatatataatatgtacatattatatatacatataaaatacatgcgcacatatgcttttgttcaagatagagtatagatgactgtctttaggatattacaaaaaccaacgattcagggagttggctgagctaaattgatctctgagatctctttcatgctcagatttactgggctgtattaagactggtaccttgaaaacaaacaaacaaaaaccaaaaaataatggtgtcttggccagacaatggtggctcatgcctttaatcccagaacttggaagccatagttaggtggatctgtgaggtcaaaactagcctggtctacatagtgggttccaggacagctagattcatgtggaaagatcttgtctcacaaaacacaaaacaaaaacaaacaaaaaaagatgccttgctgtgaggaaaacgatacagaagatgtagtttttgctctgagaactaactgaagacacagcaagtatatgttatgagaatattagagacgatgtgaatgacagaaagttttcctatttttatggtctcaccatatagctctgtctaccctggaactcactatgtaggttagactattctcaaattacaggatctttctgcctctgcctccaagttgctggaactaaaggtgtgtcccagcatgctcagccttttcctcagtttgttaaggtagaaggttaagctgagattttgggtataacccaggcttgcctggaagtaactcactgtgtgtccaggctggccttgacctgaagatcctgctacctcagttttcagc

SEQ ID NO: 19491 - DNA, 1583 bp, Mus musculus
ctgcagtatggagaatgtcttcaagtgtagacaaaaaaagaaagccagaagactagatgctttagtaacctatgtcggagtgaggaggggatttctttgagagacaatcagatggtagataagcatagagctagagactgatttcatgcttggagagctgcagagataagcttatctcacaaatgggctacctgacctagaatgtgtgcaaatgacttgaccgaggtcatacagctgatattagatgccaggtcacctaattacaaatccattgttctcattactagaacatgtgactatttgaaagtcaaaaatttaaaatgatacttaaaatgcatcaagagtatctgctattcagagattctgtacatatacattgcagaaaatactattattcccttgttatctcttaaaaactgtctaccaaatgtcctcatgtttaatttattagatgacatagctaaaagttgtgttgttttggagtgtactgtgaatgttatacgtgattgaaaggtgccatttttctgtgactacagcagcagcacaagctttgaaagtgggacagacagtgaagatattaagaaagcctgttccctactaatccgtcaattgtatatactgatgcagaatcttggaccccttccgaatgatgttatacttactatgaaactccattattataactcaggtaggtagagaccttggttaaattccctgttaagtgcgcaggtgatgttgtgtatgagtagaaggatttgtgggcatctggaagatgtttttactgtacatgaagtagttatgtcacgtactctattgaaacttaatttgaaatatttttgtcctttctgcagtgaccccacatgattaccaaccccctggctttaaagaagcggtgaattcacacttcctgctgtttgagggggagcctgtgagccttcgaatgggttcagtctcctctggctttcacagcatgaaagtaaaagtcacaacggaggccaccagaatgctcgatggggagaacagtgtcagtcaggacgatggcactactgagatagctcatcaggggctagactgtgacgaggaagaggaggcctgcggcagtcaagtaaggccaacttttagtgacccttcattgttttacttaaacacaggtgacatttccagtttgtatttaggtcatgtcacagtaacagagtccagtggagcatgccagctatgaaaactgaaacaaactagcttgtgacgtcaaggactttttagtaaaaccgtccttctagaaggaaatctatgctgttgtatgagattgtctagcaataagaaaaattcctagagtgtttttatagtacttaaaaatattctaagtatcgggtttgttcatactcaatagaagtatacattagctcttaattagtagtaactggacatgagggctagggaggaacatttttatggattaacctgaatcagagagagagagaaaaaagaaataacaacatctatgacaagcattgcggtttgattgctggggagagctgaggggttgagagcttgcagccagtcccagtgataagtagagcttagag

SEQ ID NO: 19492 - DNA, 1373 bp, Mus musculus
attttaacttcctgtttcactgaacaataggtgatcctaaaatatgtgtttagagactttgtttttattcatttgtttgtgtgtttgtttgtttttgggtttttgagactaaagtttctctgtacagccttggttgttctgtagaccaggctgtccttgaactcacagagatttgcctgcctctgtctcctgagtattgggtttaaacttgacctagagactttttttttttttaaagtttgtctattaaagaccaggtgtgtggcacatacctatagttgcagcactcaggagaggcaggaggatcattactttcaggttagctgcacagcacagaaaaactctatgtcaagagtgaatccttgtaagatgaaattcttcttgaagatgaactctgggtgtttttgttagttttgtatttagcactgtttaccgacataaaggggacagaccaagtctctgacctctagaagcttatatttgtatgaagaagaataaccaatgagtaaatagaacttagtaaaagtcatttaaggtcgtaatgctatgaagaaagtatgaaaggtgttgtgctggtcagaaggagggctgagatgccagttttagattgacaaagccataggaaacatccctgggggctagactgctgttggagctgagatggaataagggcaagccacagtaatgacaggtagaacagcactgagggcaacaccaggttctggagtcagaccgcagctctaccacgtcctctctccatcaatactgacaacaatgatgctacctcagagtgttggtggcataatccggaatatagacacactgagaccccaagtcaggaagtgtttatcggcagaaaagagaccccggatctgtctcataagtgaaaaagggaaatggcagaagagctaagtggaggagaggtgaggaggctttagcacaaggacagtgagaggccggggagcagtgacacgctttgatttgtactcggaacgtttctttttgttgtagtccgaggaattggactcaggccttgcctagatcctccccgacccttgccccccctttttaaaaataacattattgagatgactagctcagtatgctactcaggttggccttcaattgtgatttccctgcttcagcttcctcagtagcacttcctgagtggaagcatatgtaatgtgtacctggcctggtttgtattcaaaaactcgtggctagaggacagagaataaagatcacatggatgtgtgactcactttggagacagacctgagaagtcttttcagtgacttggaatagagagtgagaaacagtttgaagatggtgaacttatcaagaattaacactttaaaatattctttatatct

SEQ ID NO: 19493 - DNA, 1197 bp, Mus musculus
gttctgagcccagctgaacacaagaagacagctcctctttgagggcacaacaaagatgaatgggatacattgttgagggcttaggtgacttataacttaattttcttctgagaatgtgtttatgaatgaataaattattttatgattttattgagttgatgaaatttaatgcagagactttatgccagatttagtaaaagcttatagtgaaaattcaagtggttattaaaatttgctaccaaaattacagttaacttacacagctctcatttggaaaattcaaaataagaatttttctaattcagattcacttttgcaattttgatagggctaagaagaactattttagctctgtttttcctttgtatttacaaaattaggcttggtaaatttttcttgtaacaggacagtctgagaaattgtctatacttaactgtaattgattttaatttttggttttagggttcacttacatctttggaaagacaagatagtaagtattatgttagggaaagtctctaattttttttttaacaggttggaattgttgaaagaatcctgattcattctcacgatggctactgcgcagctctctcacaacaccagaacactgaaggcgtctaaggtatttgttaagaattaaatagaaaaatcaatgaccatttagtgagttacttaatttaaaatttcttcagcagcagttttatcagctaattggcacataacactctgggaaagtatttcttcattttaatgcctaatggatggggatattcagaaaatcaagaccaattataaagttatgcactgggtacttgtttcctgcttactagagtaaaagaaatcagaaacaaaacgacgtttaaagagaaggttctttgttaggcatggacttcctgaagcaattaggaagcttgtagttttcagaaccagagaggagatatctgaaagaagctttgatgctgagagtctggggaagaatgtattagtcacttcctgtggggaggacaaaatatatgagataataaacttaaaaggaaggaggatttattttggctcacagtttcagaagttgcttctattgtttttgactcagtatcaagacagaacatcatggagacatgcagggaaaacatgtggcagagcagagcggcggcacaccacagaggtcaaggccaggagtgggggtggggagga

SEQ ID NO: 19494 - DNA, 2720 bp, Mus musculus
gctgctctctgaagttatttttttctctcacaaaaaccaacagctgaaactaacgttgtttttttttcttcttgtctcaaggaattgtgggaatgtattctgctccagttgttgtaaccagaaggttccggttcctagccagcagctctttgaacccagtcgagtgtgcaagtcttgctatagcagcctccatcctacaagctccagcattgaccttgaactggataagcctattgctgccacttcaaactgaagctcagtgacccggggtggcagaggccatgctgctgttcctttaacaggctcacacacagcctgggcagtccaagaggcccatacattttggaatgggggcatggaataacctgtacagagattgggatgtaccactggattgtaaattgatttttgtttcatctccccttcccttccatcctcttctttgccttctaaaaagaaaaatatcccagttgtcttaattttttttttaatggaagcccagaggttgccaggctcttataactgctgagccgcttgctgtcagtcattctgtgagatcactcagtgcttccctgtgggaggagccagaatgaaggcctgagacagcaggacagaaagtcagcctcccattggtaaccattcttcacatcacagctatgtcagagttgactggtaaaccttgctgctggggaggctggaagcccttttgagagtacgttcctgagagggatagggccatcccacctcacagacaaaaagcagggtggcgttgggaggaaagcacacagtgagctactccccaggcctcactttgaaacgagaggtatgtgctgcttttgagttaactgaggggctagatgttggcccatgtggatcccaactttaacatgaccaagattgggtagggctctctctgcctccttgggcttctagacagaaaggtacagactggccagaaagcagtatcctcctgcagtggtcaaggcctgcactgagcgaggcacctgggagccccctctgggttccacaagcaatctcttcctcagccaacacagggaaatccagactcagggttccacaagtctcctattccaaagcaaaccaatcatgcatctccccttgagggacagagtccccacagttccaaagctctgcacacaatcagccttcctcttctacttctggggcagcaggaaggacccaggagccccttgtcctgcttctggctgcctgagtgggcacatgtctgactcctgttatctatcagtgaagagcccttgatgattgtagggctctaagaaaatgacatggcctggaggagattcggggtacctttcctcagtgagctttgatgtggtccaaaaagagccttcaaccagtagttatctgtggtggaggtgggtatgggaagggtggagagcagttttggtttgtgctttgaattgttggcatctatgtttgtgaccaccccaccccccaagggtgatgcttagctctgctaagagctgcaaactggtaagagagcagattatagtgtgggggctgggagaagttgggagacagctcagttctagcctggcctatatccttgccccgcccctctggacgctgttacctggccatgggccttctgtgtctcaggaaggtggcttctgcatgctcctcagtatgaatgcaagaaagcagaagccttccctagtctgctgaagggaaggctgcagtatcagagtattgctcatccctccagaagcaagtcaggcagggccaagcttggtgaaacagggtgacgtgctccatgctctctgtggtctggagttagggtggggaaaggttggtataattgaagattgtgcagttcctagtgacaggtgccaagaggttatgatacgggtttcttgggtctgttgtacagtgtgaataaatgcttgcagctcttagccctttttgatcaatgaagcacttttttattaatattttctttgtatgtaaaggaggaagcgtaactccatagctgtacatagaaccttttctcctaaagaggagtcagcgctcctatagttttcattttttgtcaaagcaagaagtaaatactttagaattgttaaatatatagataaagtgaataaagttgagtgtccgcacggtggcatctgcgaacgagttctaattctttgccctgtagtttaaactctctttgtcccttttccccttacataggagcagtggtttgaggaactgctgggaatttgacctttagcaaaggaaaactgcacatttcaactctagaccttggcaaagggacttcccaagatgtccaagcactctagtccattttctcaaggatttgcctgtgaggtctgctaagctgagagagagcagagcaccagtcatcgtaaggaccaactgcatatccatggtagtcaatgtacctctagcctgtagagtctcctttcagatgggaacttgtcatttaacacaggctggcacactgtaaagccactgagcctagcagcagctgactgccctggggctctctaagaacctcttcagtgcttacaaccttgggtgtttatacctagctcacagctaagaactggaaagcagccattggaattttttttttaagcatttacttatttttcaacaaccaacgggcagtgagctcctaatcatagtaatgtgtccagtccctaggatgtgattgcaggtattacacgtag

SEQ ID NO: 19495 - DNA, 1144 bp, Mus musculus
cttggaaagattttgtctacttcaggaaaaatgggcttaaaagaacacccacatgcttaggatagtaggtttagacagaactgcttggcgttctggagaaacatctgccctgaaataatcattgttgggttaaatatagaagaacaaaagcataaagtgacataaagtacaaatatttataaaaattgctgctggggaagaatttttacaaatacggctttataaatataacatcaaaggtgaaaattagtaagagagaaatttgggtaggcaggcagcatttgtgtagtaaatgagagtgactgcacaaatagctagctagatagtcagtgtcctttagctggatcctgaatagagttggtaaattgaggcgtttgtataaaaatgtgtgaaccattagggagagagcctttggctctgagcctatgccagagattgactgttggtgacatggagcttaggatgtcacaggtgagacagtattgcacaagtgatctctcctcggtgcctccctgcagggtttccaagtcctggtggagatggaatggctcgattttggccataagtttgctgaccggtgtggtcatggggaggactcagatgatctgaatgagcgctgcccagtgtttctacaatggcttgactgtgttcatcaacttcagaggcagtttccttgctcttttgagttcaacgaagcattccttgtgagtttggacttcatgattctacattttgggacccatatacacctagagggatgctgatacaagtgttagggggtcatttttacctaaaactatgcatttttcaaacttatcaaggagtgactgctttatttaaaagcaacagcatttaactttcactcagtgaatctagccgcaccaggttttcctctgtaaacatagagttggcttctaaagtatatggtctaaaaagtagttagagatagaaattatctgaatctgccgtgctcccctccagtctctactggtgctgtctgccatgttttctgctcccgctagctcctttgatgaaagatgtcctcttcctgtttgagccctccgttactgtgtcctccagcttctatccccttatttctgactggcttagcatttctccactatgcttcttgcattagtatgtc

SEQ ID NO: 19496 - DNA, 1167 bp, Mus musculus
ggatggaggccagaggatggagaggggtggcctctctctctgcatccctctactcgatcttcaatagataagtatgaacagcaaaacacaggaaatcaagagaccctattaaaggttattttaccgaaatcacgcacatttaagctattagaacccaaatgtgctatctctattgtggcatgacccactttgcattatttagtacttcagtaaatgacttgccattaagttttaaatagctacccaatatcaaatattctcttaatttcacagcacattgagtgtttataggtttgggtactgtaagcactcgtactttactctagacaatctgagtaagcatcaggctcacagtgctagggtgaagtacctctgtgacagagcacttttgtagctttcctgctgtgtgcaatcttctactctttagtttttctaaactatatttctttgaagcttacaactaaatgttcaggtaggatttatgaacgcataaaacatgttttgttgtgtaatttgacagactgattcacagtctactgcttctgaaaccctagtgcatggctgagactcaggtgatggctgcttcactgtttggaacaagttggttgtgagtgttgaatacttaccttgcaattgtgtctccactgcatgagtctcttcttttttaccagtgcattgtgttcttgagggaatattttgtgggggtgaagataaagcccacagtttatacataagcaatggaattatgatcttcaaaaatgtagactgaggtactgcaaggtggtttagctggctgctcttccagagttcctgagttcaatcccctgtacccatatgggggctcacaactgtatgtaatggaatctgattccctcttgtgtctaaatgcagtcttgcatttagacagagcactcatatacataaaatacataattttttaagtgtggacagagggctcagcagctgaaggtatttgctggacaagcctgctgacctgaatccctgaaacccacatagaggtggaaggagagaaccaattccttgtagtcttctgagccttgtatgcctgcggtgcatgagtgtatgtgcacagaataataaataaaacttagaaaaggatgtagactgagttttaagcagaaatgatttataaacctttgtttcttg

SEQ ID NO: 19497 - DNA, 1194 bp, Mus musculus
cccataaagcagggcgcgttgaaacttttggagcaagacattgggttctacgcaagcgcagtggcgcgagttcggcagtgaggcaacatgtcgtcgccgacgatcccttcgcgcctgtactccttgctgttccgcagaacttccacctttgccctcaccatcgcagtgggcgccctgttcttcgagcgagccttcgatcagggcgcagacgcgatctacgagcacatcaacgagggggtgagggcctgggccatcctgaccttgggcccgcctgaagggtgactgggagggaggtaggacggaactcaatcaagtcttaccaggtctggggtgaactgtgcccgttaatacatctatttctcttgacatggtgcgaggcctaattggtatgtcctgtcacacagttccacatattcatttgcgaaagctaactcctgactcctgagacatcagaggacttacgggtctgaaccactccattaagtcggtggtgagttggaactccgacccctgccgtccttgctagtttcaagggcagatttcagcaaggcagtcgttaaaagtaggtctccttagaccatgtggctgaccttttaaaattgatgtttcagttccgaaggccgcccacgtaggctctttggattaaacgtgaagactatgaaacctcaagccctaactggcaatactggacttaaagcacttaaccgtggtattgaataaaggtcatagtggatcaaagatcctgggatacagatgaggtgctaccgttcatacttaatgataccactgaaagatagcatcctgggaaaatgtggggatgaatataaagtaggaaatggcgagccctctttgacttaactgtcccacactctgtgcatgttttatgtcaaaggttgtgagagtattggggaaggtatgttactgatggccagcatgttcatcgactggtttctttttctcgagacagggtttctctgtgtagctattgctgtcccggagctagatggtagacaaggcttggccttagactcaccctcctgcctctgccacctgagtgttgggattgtaggcctgagccaccaccgaccagctccttcactgagtggccttccttcttgccttccttcctttcttacctcttttggtttgtttttaaattttgttgttttaattttatttgcttatgttgtgtct

SEQ ID NO: 19498 - DNA, 1136 bp, Mus musculus
tctcattccagctcacctgtcccctgatggaggcaggaggacagaaccaagagcatgagaggcagcaagagagacaggccagccatcaaggacagacttttttataaacattcggatgtttctcacccatcttcttgagaaacgccctgagggatggtgggtggatgggcggccaggctcagaggccccagggagaagggagggaaggcagctctgcttcctcggttaggcaattgtctttactgtgactgatgagacaggttgaagtcaggcagggggaggtgaggaagagctcagccccactggactttggacagtacggaccaccctccaggtgggggtgcccgcagggaggggggcagctcctgcattggcggccagcccactggatactggaagacagtggttctgatgggttcagccctggagaggaaaaaggtagaggattagagcagagcacctcacagattccaccttactcttccaacttcccgactgtcagaaacggtggtcacctgcacggcccttctggaagtagaaccctgataacatgcagaacctctgagcccaaagtgggggctggtcgaggagactcaactaccagaatggccttgggcaatatggaactacccttagcatccacctgtggggactggttaaatatttatgcacgtccacagcagagaatgctatgcagcctgtgtaaaaatcaaggcctatatgcactgatgaagaaagatatactatgtgagtaaggagaaaaagcagcttataaaataatgtatatagcatgatactatttttgtttaaaaatatataacatatataaatgcataaaaacaaccctggaagttacagcgaaatgtcagccctggttctgtctgagtggggtgggtggggttgtttctttaacctctttatacttttccaaagtcttacaagcacacgagcctctggcagcaggaaggccttacttctcatcccgttcacttgcccccttactgattacccctaagctcagggcccctctgaagtggtccttaggaagggagggtccttgggtgcatcctggaacacccagacccgggcagcatgaaggcaggccgccctgcccccacctagaccctgcagagttg

SEQ ID NO: 19499 - DNA, 3072 bp, Mus musculus
tgcatttgaatcctggaataaatctgaaccctcatctgggcttgactgctagtatcttgagcatctactgggcaggtttctctgtcacccaagccaccgttgaggtcattccctgcagcaggatgggccgtgctgtgagacccagtgctctttcagcttcttctcttctttctacagctcactctgcagagcgccaagtcccgagtggccttctttgaagaactctagcaggtgacccggccacctcctgccacatctgctgctcctgacaccaacaggatgggcctgacccaaaaggaaccatcagtagagggctggcttgtttgggaactcttgagttgagggccccgtgccactctgaccctatagagaggtttctcaatgtgttctagttctccttgcctcctgcatacctgcatatctctctctccctccctctctctctctctccttctctctctctctctctctctctctctctctctctctctctctcttatataaatacttgttgtgtgtgggctgccatccttcctgcacccaagcactgtggtgcacgggttgctgtgcttgctgacattgagaatcggctgtgggagtccagtgtgaaagctggctgaaatctaccatgcaggtgctacccactccccaactgggcttctgggatgggcctcccctccaagcatggggtagaagtgtggactggcttagctcagaaccagcaatgggggttggggatttagctcagtgagagcgcttactcgggccctgggttcggtcctcagctctggggggggaaaaaaaaagaaccagcaacgatggctccttagccaggctcacctgaggcagtgtagctgtctgaatggcaggtaacaggcaagacagctgtggctaggaagaggcttaagatagaggctgttgggagacactgcacatgagcctttggtgggccaggagcttcccagtcacattcccatcagtgcctgggaacccagctgtgaccaggacctctgtctcctccccctcagcacatggaaccccagagccctgctacccgtccatcatcctcttcaacacctaggcctcactgtcattgtccttttcttccccaggagcccagcagtgtccttttagtccttcctttcctgagcctgacagagatatcaggctactaacagtcacacaagctaacactatgggttgcctccatgctaggcaacaaatgcttaccatgtgcctcacacactccatgattgggcctatcttctatgtaactggggtcactagtgtagccgaccagaaccctttaagtcctacagagcaggtgatctgcctcagtccacaagcagatgtatattaactgaggacagctgagctgaggggctgagcaaggcgatgttccacagtacggtttgtttttgagaaactgaggcacaccaccttgttcccgggctgttattgggccactttgtcataggcagccacccaatggtcacctcagcatctttgggcacctgtgatagcactctagtctgaaacctaaggctgaggagaaggtctctggacttgacaccccagtatttgccgagtcttccctggctgctctgaagttgagctgtgttctctggcctgaaactgctctctgactttcttcctctctgtacacttgatttaacaatggctgtgggacacgagacaatgatgctggtttataaaaattatgccaggccttccttggctttttcatttaactacgctttatatctcaaatttgggaaataccaagctacataaccacgtgggcgccctggtatttgaggaatggtgggtgtaaccatttcgccatttcttggaaggtgaggtccaaaccccactcagaagtacctcagctccgagagagagagagagagagagagggggcgggggggagagagagagagagctcgaatgggtccccagaatgtctccagcctgctttgagcctgtagctgggttcttactggtagaaaattttagtcaaagagaaacatctgaagtccaaagtgaggcccaaccctggctcttcctagtttcaatggtttctgaagcataggcaggggtaccctgctactgaaacagcaagtcactctcagtgcaggacactgaggccttgctcttgcctgtggctggtcacaaaccctgattgaggcagtacctgagccgccacagcactctgacctgaggtcactgccaacccctgctagacaacaccagtgggcttcacttactgctatatcctcttttagacaggtttctcatgctcccatactttcaaaaagcccagaggctgactcccagcaacagtgactaaccgttcctgccaacagggccagagcctcaaagtccctggtacaagcagccttcacagaggacccagactctcctaggtgccttgaggccacgccagtgcccatgggcttccattcctctgttactcttttcaaacagctcttcatgtgaggctcctgtcactcctatcggggccaggacatgaagctggtttctgggggttggggtgattataatttaagtgattgttttaataaaaactctaagctgctatagtctttcgtcgagtttttttttttttttgagctttattggtttatgtatattttgtatgcgtgtgtacattgtacacgcctgttgcctgcagaggtcagaagtgtcagatctggaactggaaattgtgtcttaccaaaacaatggagctatatagccccagccctccatttgtattaggtaacatagattgctagttctttttttttgttttgtttttttgtttttttttttgtttttcgagacagggtttctctgtgtagtcctggctgtcctggaactcactctatagaccaggctggccttgaactcagaaatccacctgcctctgcctcccaagtgctgggatcaaaagcgagcgccaccaccgcccggctagattgctagttctaacatccagaagtagcctgatttcctggacagtcaaatccgggaaactactctgtataaactggtcattttacactgttg

SEQ ID NO: 19500 - DNA, 1149 bp, Mus musculus
aggagcccgttggatggagcactctgagcaggttcctcgtggcttctagccttcccagaggagcaaggcctgactgtccagatgcctgtgttgcccttgtctggatccagtgtgagttttgaaggtctatgcattgcagagtgtagcaaagtagccattggtcagcatgagctcagctagcttgttcatggattcaggtagggacaccagacataggcaggccccagaattgacccagcatggtacatggggcctggtggcatatccatgtcatgagcacgtcagtctcactgcctgatggaatacaggactctccttgtccagtctaacctcccaggtatcttagtggtgtgagcagagcctgcacccaacattaaaggagtctgcctccacagcctcaggggtaccgcaccccacattcagatgatgcagcttcacagccagaagcacacgtgaacactttgaggttctgcaccccacaattaagggatccacctccataaccaaagggtgcacatgaacaccgtggctgggttcttttagagactgggctctttgggtggttggttttctgagacagggtttctctgtatagccctggctgtcctggaactcactctgtagaccaggctggcctcaaactcagagattcgcctgcctctgcctcccgggtgctggcattaaaggtatgcaccaccatgccccaccccctcagctgaggctggaatcttagtggaattgtctccatagcactccctgcatcttacagaggcgttgctgtgctgtgtgcatagagatccagtcctgtcactgggcaacagggcagcccaagtggtggggctcgtggatataagactctcataagaaacccaggatgtttgttgaagggctcaccatgttccactttctctaagcctgagcctttcctttcatggttatctcctgcttgaagctctaagtgtggaaagcagccttctagaatgatccttgcctatatcaaagacaacaggtggaaatagatctcatgggtcagcttgcccacagagtgcctagccaggagcatggccaacagaaacgagtagcagtgcccaagatgagagcttgggctctgaaacgcctccgttgtggggctcagcgggtaccttgagt

SEQ ID NO: 19501 - DNA, 1143 bp, Mus musculus
gttcactccgaaaagccattcctaacacatatgagtttccaaggctcctgtggctgctgagggctctggttttcttgcttttttctagtagatcaagatagaagggtcagccagccactgtctaagactacagggtgaggaagctttccactgcaaagagtttgctctgggaagtgttgcgcctgtgagccctgccttgtggcctagatgttttatggctatttgaaagtgcctgtggccattattgggccttatttgatgcagtaaaacattccatttggccccttggctctgaagatatgtttcatttcagcgcagctcccagggcacctgatttgttgctgcaacagtgggagggaaaagctgggatgcaaactcattctgcaggctccgggttctgttcttgtgagacttgctgtgatttctctttggagattggcagtttaaaagaagcatcagtatatcggaacctttcttagggctcttgcccagagtgcttggtagatcacatttggcctccacctgcccagcgaggtgaatcaggccgatgagttcatttgttaggtggaagaacggtagcaatccgcccttccagcatcctagggcagcagagactcagcagacatttgcaggcacagtgctgctgcattaggtccctaaggattaatacagatcgattccctgtagacttcctgggcaaatttctccataaaggaattggatttgtttattggcatggagttgccctctcatttcacttctgtttagggatatgcatgtggacagctctctatgcacacatcatgaagacagcatttgggtgcaagacattactaccaagactacagaaagcttaatgtgctcagtttatagtggtgccctccctttgttggcacttccaccttggctccgtggggttttaggaaggggaatgtttattgcaccccaaacaaagatcatgttgaatttgctggtgctggctctaactgtcacctttctgctccagagtctgcttgttccctgcagatcctcgtgccagagaatctgcatgtccttttctctctccaccctcccctgctccttcattttcaatatgtagtggcgaggaggaagtataacatgattttagggcttgcatttcaa

SEQ ID NO: 19502 - DNA, 1189 bp, Mus musculus
tggttttgtggtgccgcaatttcagaagatggttgagtggcattgatctaagggagccatgagattgtgtgttcattgtgcaaaaccgagctgtttggggtagagaagatgaggttgggaagggccttttaatcctccatcttgttggttgtattcgttagacacagagcagcctttggctgcctcctatcttacagccccacttatcatctgtccctggataataaaggctttcccccaaccctgccttccttgtcctttgatgacttctgtgcagtgacggccagtgagtaagcattgctctactgtcagggtggtccctgagatgaacagccccagcagccaaaagggccactcctagcccaggagtgtacttaggctagaggcatcctgcagctctccggttgctgctctagtggaacagtgcttgtttacacacccacctctatgtgtgcctctccctgcatgcagctttttaaaaatagctctgttgttttgtaaaaatgagccataataataaaaatggcaaacaatacccagacttgctttgcatgtgggcttttcttttgctgtcttttggtaggtgataaatctctatcagatgactccggaaatgtgggaggagagaattacggcttggtatgcggagcaccggggcagagccaggtgaggctgcttcatccttggtttatagtccttcatgcctcctcccctacccttaaagaactgtaaaactagggtgtgctcactggacacaatacagtcctgaagtatataaaacaagccagagctggaataatgttgctcttcagttttatgtacatccttattgtagtgtgggcatgtgacagtctggatgtgtggctcagtggtagagagcttgcctagcatgcgtgagaccctgggttgaaacctagggtgtacaaacccggtgcgctcggtggcagtttagctgaacactgtctggagccctttgtttttgcattcaggcatgtgttgatggcacttagaatccctgcatgctttcccctttacagaaagctctgcagtgcacagtctcatcttggtacacaagtccagagggtgagttgtgttttggtaggtgacactaaggaaaattttttaccttttggcacatgtccatcagcagtattagaatgttcctattgccctatgtttttagtcaatc

SEQ ID NO: 19503 - DNA, 1122 bp, Mus musculus
aagcattgccgtgatggatatgtttcacttctagtattcataacatgtaaatgatctgtttaagctgtgttccagtgaaacctattagagtgggcagtaagaaaaaaaagaataaaggtagatgtagttatttcagtcttccataaacgatatgcccaggatcttggagttttagattctagcttgtaaccattttctgtggctttgagaatcctggtgctgtcactgtggctccgctcaccctgtgggttattgattgatttggttcagaacccctgcatgaagtggatattatatcctgctatggatggctctgtgagtgcttccaattgtataacacacacagcctttaggaaatgggaagaatgtaacgggaagggattgtctaccttccctgcaaagcacgctttgaaggtaatagaaggggccagcacagcatgtcttctgctctgcaattctgcaggtgttggatcatgatgtttcgaaggaagaaccagttacctttcacttcctggccaaattttatcctgaaaatgctgaggaggagctagttcaagagatcacgcaacacttatttttcttacaggtacactagcccatgctatctccccctcccaaccacccctaccgtattaagaggaccagtccaggtatggtttcagaagcagaccaggtgaaccccttggagttgaccacaaacacttccacactgcagaaaatgttctgcctccaaatagtcagtcctttggctcagtaatagaaaaaagtcttcagaatagaactttacccaagcagtgagaattggtgtcagatgaaattgcagaggtgtgatgatgaacaatagagtaacccagtataaatccttagtgaagatgcatccctgtttcttctagctaacttaaaagttctctgacagtataaagaaaagcctcagagacttagcaaaaagttcctttaaagttcaagatctgggtcattgaggcaggaattctgaatggcaatgacccttggcatgtcccactcctaaggtgtttcagacaacctgctctgtgctactctgggtatatatttcatttcctcttttattagagtgcaagccccttaaagagaggctcactgaat

SEQ ID NO: 19504 - DNA, 1205 bp, Mus musculus
gccgcccgctccttctcaaccagtcttgctagagtaggagtatactttaggaacaaaagcgctcggagtgaccgcatctacagccactcaacgccgagaacagaccggcggccctcgttcagtgcaactttcaattggtggagtaggcctccaggaggcgggacgaagcggaagtcccgcttcctttggcgttcctgccaatcacagtatcttagagaaaaaagtgttagggtgagtcgctgagtagcgtagtgggagtccggagggcggggcggggcggggatccggcaggtcgctgaggtgggggttggtagaggacgcttcccgagggcgcgcggagcggagctggtgacagacacgcacgcgcgtgtgcgctcccaactactgcgcggccccgcgaccctcgggggtcgctgagaggcccggcgtcggcgccgcagccgtctaggatttctgtccaaaggcgtccctggcgtccccagcccgaagctccaagctcggggctgcgcgtgcttttgccggcatctccccccgacccccccgtcgtcagagactgtcccttaactcatctttccgcacccacagccgggtcctcgcggcccatgctggccgctggggacccaggcagcctaggtctgtctcgggccggccagccggccaccatggtggccctgaggcctgtgcagctactccaggggggctaagagacccagaacgcgggcctaggggtgaggggatccaaggccggtacctcgcgccatggccggagccatcgcttctcgcatgagcttcagctcactcaagaggaagcagcccaagacattcacggtgcggatcgtcaccatggacgccgagatggagttcaactgcgaggtaaccggccgccgaccccgacgggctgtgagtggagagccgcggaatctctgcctgtctggtggcagcgacgcgggtccctacccatggggtgccctcgctgtggtgacagtcgaagtgcaagcttaagggattccgtatatatcattatctggaaccggaagaggctttctagggccagatcacaagttaaagctagttgtttgtttgcttgtttgttaaagtggggttcttggttttggcatttcccgaaggttattttcattcatttgttattgggaaacactggaatcttccgtagaaacgaaccggtgtgcagtgtgtagaactcg

SEQ ID NO: 19505 - DNA, 1126 bp, Mus musculus
cttcctccgcggctgcagggaaggaagatccctctgcctcttgcaactactggttgctagaaacccttgacattctttggcatgtggacacaacagtctgagcgtgttctgtgtttcctgggttacatggtgtcccctttgtgtgtgatctttctcttcttatatgggcaccagatactggattgaagttctatccagtgttatataggcttagctcagttatgtacagagaccatgttttcagactaggtcacacagtgaggctctggcagggtactgaggggctactctttaagctggcagagaacatggggaaatctaataggacaaagggctcttggagagaaagaggctggcttctccctggacctctcctgggcttctgtagtcagtctcttgagtcaccaggaggtcttgtgtacattggcatctctgtatgtatcctcctacccctaaccacacgctgatacattcctggtatctcagtttaatccttagtttgatttttttccccattcccttggtgccttcttccttctgtctgtccctcccttaattcctcctttcgttccttttttttttttttttttttttgacagagtcttatatagcttgggctggctttgaaccttctgatcctcttgtctcctgtgtgtcgccagccagtccagttttatgcagtgtttggggatttgaacccagggctttgttcaggctaccagctgaggtacatccccagcctgcttcctttctttttaaggtggggtttccctctgttacccagacattggctcaatatatcatcctgcgtcagcttcctaagtggctgggaccacaagctccctgtttccatatgtagttacaactgttttttttttttttttttttttttaagatttatttatttattctatttaagtacactgtagctgtcttcagacactccagaagagggcgctagatctcgttacggatggttgtgagccaccatgtggttgctgggatttgaactctggatctttggaagagcagtcgggtgctcttacctgctgagccatctcaccagcccccacaactgtttttatttgcttatttttcttacgttcattgccttggaaggttcctg

SEQ ID NO: 19506 - DNA, 1719 bp, Mus musculus
accacagaaccgcagccctgcccgtaggatcgatcttgttgcttcagccgacctctgtgtccttgttttcatagcattaggctttgtatgtcttgcttgttttggaagcattgacgataggatgcgagggttcatatatgctagggaagtgtactaccactgagctatctcactttcacatacatagaaggtgaataaaaatttccaaaatacttggcttattaccacctaatcctgtctcataacttgggaaccatgggcctctctcagatgatagtagggagccctccctgtcacaggcttttgtgagttttgggtcagtgaccaagggtacctcccttgccccgggcaccctgtaacctctgctttcctccctgtagtccccttggttcgacacatggagtcacgaatcatgattcctctgaagatttctcctctccagtgaagctggcactgcctccacctccttccctttctcctgtggactagcctggaaaggaggcgcttctaggccacctggcacagttttctctgaactctggaagacttctgatgggtggtgttcagcttcgacaaagatgacgttttctgagaacttagtccgtccgtacccagctaacctctctcccatgctggatgaagaagttcttaacttcccaagctgcagaatagcaaccttttaagctttcacacactttcctcttaagatccgtcatctccaggacataagtccccagctcccaactgtggccatggcttagttgcataaaagcaggcatgactggctgttaggaggtatggtgtgaaagggtatcagtccaggtatggcccgggaactctctggtgtctacttgttaaaaaagcaagcctgagtctttaaaaaaaaataaataaaaatcctggaactgccataaagtctgaagtcgtgacagtcaggaggaaatccagaagttatcagtgtcagtaggtggtccagaagtctacttaaagggctaggaaaagggtgggagtgggaaggatctgggtacatgagacagccttgaagcaggaacccttcacaagtgggcacataggattcagaatttaaaatacagaattgggaagacaggacagaggtgacagaggatcttaagggagcaccctgttcctagacagatggagaggcgtatccatgttttcctacataatgtggttaaaacttgaatttgtgcttcagctcttctgtacttcttccttcctacaggcaaaaacacaggctgagacctatagttccatcaaattctttctttcccttcttgacattgtcccccaaaccctcattttgcagaaacactaggtctgtggagtaggttgtgattctggggtctcttcaatgaccccggtacctcatgaacccctgcttagcatggttgtgctaccatccaggagaatgttgatggaaccaaattaaatatttactgtacgttgtggtgttgtcttcatctacaaggaatctcagtagttgtctaaggcagggcagcttccagttggctgagggttacactggctttgatctcttagggagaccgtcttcatcttcgtcccagagcaagaaaaggagctgtttcggcgccacaaggtattcaatgttcatgtttgcagacaaccagaatttactccagaaatgccaggcataggaaacatctgaagcttacaggtactgcactagagtcttggggg

SEQ ID NO: 19507 - DNA, 1197 bp, Mus musculus
tagggtgtgtttctattgcggtgataaaacaccgtgatcaaaagcaacttagggaagaaaaggtttatttcagcttagaaccctcagctcacaatccaccactgaggaaagccaggcaggaagctggggtccttacctggagcagaggcagtgaagggatgctgtgtactggctccttccccttggcttgctatcatcctagctacaacttgactttgatccctggaaaccaggtcgtaggagagaactgactagcgtaagttgttttctgatctccacacgtgccataacacaagaatcctctccctgccccacccccacaaaaatataataaatgttaaaaactagttttaagtcaatgtatttgaggatttatgtaattactaagaataatagtgcttgtatggagcttactaaaggacttggcacatagtcagtgctggaacaggtgtgtgcgctatccctgcaaggcatgcctgacagtgccctatgtgcccctttaggctggcagaaaagtaccgagaatgtctgtctaacaaggagaagatcctgaaggagattgaggtgaagagggactatctgagcagcctccagcctcgcctcaacagcatcatgcaggtgagtgtggctccgcttcaccacagaccagccagagtccaccacacatgtgtgtgagtatgtggcctgattttttattgtttgtgatgccagatttggtctaaattcttatagttttatgaagcaagataaatggctaatgaggaggaactttgtaaaaggaatggagagaagtttaaatctgtttttctaggacttggcaaggtcttcacttcttcctctcagctctggacatggaattagagttgtcagcaaaaacacatttttctagtaggacttcataatagaagagaagagaacctggggctgggctgctgatgggcctgggaagctgcagcaggaaggttgtggatctgaggcagcctgcgctgagtgaagggtagactctgtcctacccaggctacataactacggctgtaattgctggtacatacttaccttgaggctagcctagacctcataggagttccaaactagtcaggtcttcagagtgggatcccatctcataatcacacaggggggagagagggagatgaagggagagcagagacgagggactgggagtgggactaggcagtc

SEQ ID NO: 19508 - DNA, 1167 bp, Mus musculus
aagaaagccgtggcctcagaggaggagactcctgccaagttgggtgtgaaggaagaagctaaacccaaagagaagacagagacaaccaagacagaagcagaagacaccaaggccaaagaacctagcaaacccacagagacggaaaagccaaagaaagaggagatgccagcggcaccagagaagaaagacaccaaggaggagaagaccacagagtccaggaagcctgaggagaagcccaaaatggaggccaaggtcaaggaggatgacaagagcctttccaaagagcctagcaaacccaagacagaaaaggctgaaaaatcctctagcacagaccagaaagaaagccagcccccagagaagaccacagaggacaaggccaccaagggagagaagtaagagaacaagagaaacacccagaatagccaaagaaactcaggacggtcccagtactcaggggtcggcgtaataaattttatttcttcctttccctccgtaagaagaaacactgcttagatggtgggcctgccctcaccaaacaggaatttctattaagattaagttagcaagagaagataaccctgagccttgtcccccacgccgaaaaccctccccaggtgatggacaattatgatagcttcttgtagccgaacgtgatgtatgctgaacgctacgcgtaaaacacgcgtctaaaaactgccccctcctttccaagtaagtgcatttatttcctgtatgtccaactgacagatgaccgcaataatgaatgagcagttagaaacgcattatgcttgaaatgttgtaacctattcctgaatgccttcttgttttccaaaggagtggtcaggcccttgcccagtacacgctcctggaagagctgcagcaggtgaggcagggcgctggccactgaaccacgccagggtgtactctccactgaagtccactttcaattgcttccatgcaataaaaccaagtgcttctgaaataaaactgtggttgtttttacttgttctcttcctctgggaaggcaagggatggcggtctagacgtcacatcagatctgtgctggtggcctagggcatcttcatcagcatcacctgggagccttataaactcacatacggggctggtgagaaggctcagtggttaagagcattggctgtgcttcca

SEQ ID NO: 19509 - DNA, 1149 bp, Mus musculus
aggctgtgtaacctgctcaagtcacagcttgtaggtggctgaatggaatcctagttctccctgagctcgaggtgtatgctctcttgaaggaattcttccccataggagagggaggacagggctctgaccatatttgcatggctagagcttttccctgcagagccatcttgcctgtgtccctcccacttccctttactctcttagctgttgatcaagagagctgttgagcacagagtagaggctcagtaaatgcttgctacatgatcatgggagcttcagtactttctctgactccctgacttctacagtgctttgcactacaagttctatgctggatattatttttaaaaaaaaaacaaaaacttgaccagacagatgtgagaagcgctgttgtcacagtgtgccagactccagcctttgagagataatagtagatgtttagaaacttgatgggagttgtgggaagaagacacccccccccatttcttgagatttatttagggggctggagaaatgactcagcagttaaaaacaccagctgctcttctggaggaccctagtttgattctcagcactcacatggtgactcacaactatctgcaattccagttccaagggacctgatgccctcttgcctccacaggcaccagggacttctgcagtacagaatgtacagatgtacatgcaggcacaacactagcacacacacatacaaattttaaatagttaagtatttattttagggatataaaatatcctgagtgaatgcatgtgtccttggaggcaggaaaagtgtgtttgggtcccatgtaattagaggtggttgtcagccgccatgtgggtgctaagaaacaaatctggtgtcctctgcaagagcatccagtgctcttgactactgaaacatctttccagccccctccctcactcttaaacttttcatttctcacggaaatttgcatccctgaggtgaggatggcccctgagctttggtgagctgagcccacagctgaagtggagatttagaacattctaaacacaatgaattctacagagggcggagctaagactgcctggcaagagatgtgtatttctaatctatgttttcgtctatagttatctgtgactgtgtgtttactgatagtcaggaag

SEQ ID NO: 19510 - DNA, 1118 bp, Mus musculus
acacacacacaccaataaaaaaatagatctttttttaaaaactgagtttggtggtgtgcctttataatcccaactcttgagaggtagagacaggtaaattcctggggctggctagccagctagcctagcttcatccacaagctctgggccagtgagagactgtctcaaagcccccaaaagcagtagttgaggctgggagtgtaggtgggtggttagagcatctacttagagcccccgatgaatccccagtaccacacacacacaataatgcacttggatatagtagctgctaatataaagcaagggttgttgtcccttgctacacagtcatcctctacctttcaggttcctttgaggaacctaatgatacccaccctacccctgggggaggctgtcatgtgagcaggcagcagaatcatgtccctttgggcgtttgtgcattcctattacccaggagttgtaacaggttgtttcatcagacccatccaacctattttttgtttggaccacaggtattggcagaactcaaagagtatgctacagaagtagacgtggatttcgtacggaaggcagtgcgtgccattggccgctgtgccatcaaggtggaggtgagtaggttctgagaatccattcttacccaggcagggagaaggttgttaaaaacagaaagcaggctgatcttagcagttattcatgatacacttctgaagtcccagatacttgggctcctgaagcaggagaatcactagtcctgagatcaagactatcctgggcaacgtgtagacttcctacatttactcaaaaaattcacatattctccctatggcctgtcacttactcactaaagagtgataattggacacctagggatggatatcgctcagtcagtaaagcacttactagggccagttatgaaaacttgaaagtggtgtcctaagggagctgaagagatgactctgtagttaagagtaatccaagggttaccaacagagcctccaaggtgcctactatgcagattaaattggctctttctcactttaggtctgtgtgcaacaggtaatgatggttctacagcattgcttacggccatagagcagccagcagctcgtggacttcct

SEQ ID NO: 19511 - DNA, 1196 bp, Mus musculus
ctcctcgtcttcatcactcagtgtcctgggtggcaaatgtggccaacctggggagtcaggccgcacagccaatgggctgcctgggccccgcagccaagctctgtccagttcttccgatgagggcagcccctaccttgctgtaggaggggcactggatgcaaccaggagctctttggctggcccagaaccctcactgacctgggcaagggggcggatggacacacaaccagaccgtaaaccctcacgcataccgacacctcggggaccccgccgcccatcgggacccatagaactcggggcttggcatgcccagcattcggtcaccccaaggaccgagccagattcttcgatgtgatggaccggcttagctacacccacaccccattccattttctttgtggccttaacctaccctttgcatcagggaccccccttccatctcgagcaccagacctcatgggaccagaccccacgggactacatggcacaatgggacacctgttgtacattccggtttgggggatgagcattgctatttaattactaatattattgaatgccttagaggagaccgggccagcccggtgtccagaggacctgtggtccagtaagcagaacctctgacagtaaagtcttgctccagctcctgttttttggggactgagccttcattatatgttgggattctagagttaactgcctagaagccagacctcaatgctctgaacctgcatataccagaacaagaaacccttaaattgtgcatttacagtttttgcatttgtttttattacctggttaggcatggctttaaaagtgtctccagtagccagtccagccgtggagaggtagaggcaggcgggtctatgtagttcaatatgagtgctagaagctgttcaaatgcctctgatcacattcatagtcaagtcctttccatctgtgcttatgacccaataaggtctcaggtaaaactgacctgtccaatgattgggagttagctgggtccaatcaagatcaaagaaaagtccgatggccaggagtctgggtgggagcctgctttcaagagatttccctgtccaatcacatgaggctgcagcgcgctgggtgcagcgccccctgcaggcggagggtcggatgtgcaggacgtgtgcgcaccaaagcacaacgcagaagctctcggaagagacgcagcacgt

SEQ ID NO: 19512 - DNA, 1148 bp, Mus musculus
gggcactcaccctctctggaccaggcctcgagcactgcggaggctcgcgggggccgttcggagtcccggcctttcaggcaccagctcgggcggcttttcgcagcaggaatccggcctgcctgggtgacccgattcctccacccactgctctgcgaccttcggcgaatgcctgcccttactgcgcctcagtttcctcatctgtagaatggagacgcggtcgccgctcagcctgtggcgcggcccttagcggagaggagaagggaaaggcgggacttcgtgcaggttatgggctgagcaatggaaacagtctctccgtggttctgggcgaggctcctctcctgtccctccctacccacatgtcttcatgtttttaaatggcatttcttcctcgtgggtgccaacttgtccccagccaccctctcccgaccagccagacagcaaacataaacactacaatggtgtaaatgttactgagtcccttaaagcaggtcatggcaccgtgagaacaatgtggtgctacgtttgcttgttcacagcttgctcttaaacttagcgtctcccctgagtggcgggctggtagaggtggaccattctgaaccctttcgagtcttcacagcaatcctgacctatgtccccacagtgactccactggctctgggcatggcgaacccagtggcgggcatcgcaggctctgccgccaagagtgtgcgacccttccgatccagtgaggcctatgtggaagccatgaaggaagacctggccgattggctcaatgctttgtacagtctaggtctccccggcagtggcgatggcttcctcacggggctggccacaggcacaaccctgtgccaacatgccaacgctgtcaccgaggctgcccgggctctggctgctgcccgtccaacccgaggtgtggccttccaggcacacagtgtggcgcctggctccttcatggcccgagacaacgtggcctctttcatcggctggtgccgggctgagctgggcgtgcctgaagtgctcatgtttgagacagaggacctggtgctacgcaagaacgagaagagtgtggtgctctgcctgctggaggtcgcccggcgtggggcgcgccttggcctgcttgccccgaggctggtacagttcgagcagga

SEQ ID NO: 19513 - DNA, 1098 bp, Mus musculus
attttgaattaatgagtccccatcaaatggtggtgtagtagatagctgtgtgtgtttgtaaggtttgtagcttgcaaggcttgcactaataatattttatatgatctttcctggttggcaggacccatggatgaaggaccagatcttgatctaggtaactttttaagttcttgaactttgtactgtgctgttttgaataaatgctatagaagcaagggttcagcagctcagcggactgattccagcacactgaccccttcttatatcagtataatgggtggttggttctcttgcctttgtgatgaatacagtttgataataatgtccgattggttaagaagcccctattattatctaggcctgatgggacatgtctgagaggttgaaaagaggatgaggagtttgaggccagcctatctccaaagaagaagccactattaattcggggcagtaattctgttttatctaattttctctggaaggccttcctatagatcccgatgaagactctgacaacagtgcaatttatgtgcaaggattaaatgacaatgtgactctggatgatctggcagacttctttaagcagtgtggggttgtcaaggtgagtgatagtggtcaggtgatcccacagaacgtatctgagaactgtatgactgttttgttgaccagtgatggagggcgcacttgcctagtatgcataaggtcagtaaggctgcaaaaataaagagttcctccccttgttaattgggttgttattgttgtttatttttttgagacaagatctcatgcattctggcttgactcaaccatatagcagaaaatgacccctccccacccccaaacactgcttttacagtctcgcgctaccacacccaattttagccaggttttgtaggtgaaaaatgctaagcagctgatgattgtgttactgagtctactgttctctgtacttgtaaatgaacttacctgctgtgaaggaaagaaacgtaggtttttcttaatattcccctgaatacttaggaacttggagactttttttccaaattatcacttacggatttatttctcaggataagggttgaggctttgccaggggtg

SEQ ID NO: 19514 - DNA, 1631 bp, Mus musculus
aaagaagggactgaaagacataagaaatttatcccacatttccatggacaatctattgcggtcaagctatctcctaaaacatggaaatgtcatttaagtggcagtttgcttttttccctgccagtaaccattgttgggctggggtgaacaaagaatggctttgaaactagagctttcagtccccttcatggttttcagaggtgagagcctctttgggtaatagatttgggatggaacacacacaacccttctaataaccctagcttttaactaatgtcctgaacggttgtcttgaaatacctggtgtatgtactgcagaaaaggaatgcagctgttttccaatgtttgtacccagatttgttgatcatgatgaagactgactgacctcatgacccttaaaccatggcctgaggcgccccgatgtgtagttaagttagagctgagaacaaccgtaatagccttgttacagagtaatgtatatgaatatagcatcgctcgctattggagattttaaaagtctaaattggtttgaccattgtgattgatggaacaatctggtttagaaaactgtttagatcagaaccatgaccccgctgcctctgcctccccttccctcccctccacccctcttccctttctggtgtctgtactttgatgaaggtgaagtatgatgttggtggttaacataatcagatttagtcaatgtgtgtgttctgtccctatataaactagtaaaacaaagttatgcagaatgttgtagtgagtatacatttgattaactgttaaagaaaaactagcaattcttttttatagaacaaacttcaacacagattaagttgacctattcatttattagtaaatttctgtactactgaaagttagtattttgtttattctgcataactttaataaagtctccagtgaaatctttattggaaaaaagtgtttataaaaatacatgcaaatttttatgaataatttttgacaatgtaaaattggtcttcagatttggagaatatcattccattaataaaggtttcacgtctttatggatttttaaaaatagacatagacacttgaaattactatcatcacgtctcaaatcacctagaattcttagtatttttcaattgcaaaagcaatttgaagtttattcatcttaatactccagaagtgatgattctaccgactttgttagattgctattagaggggcccttgtttgtggatgagaagtctctcctggagccatagaagagaccatggcctaccccataggattttaacagaactgtgaagcagtctgttggatcctgtgaggacaggacactgggcagtcccctttccctttttttattgtggtgatggttttcagtgtctgctgcaggtaaggcgctcaatgttgttaacatgccctttttcattgcctcagtgtttgatatttttcattggctgttaaacgtggaaactttttaacatgctttgtcgcatttatatgctacaggttacaaagtgagagccttgtatacacttcaatacttaaaaagtacccgtactcagtactcagccggcagcataatgaaaagtgggactagacacggtgtccatatggagaggaaaaatatacataga

SEQ ID NO: 19515 - DNA, 1183 bp, Mus musculus
attgcaagcaaacctgggcgatttaatgtctctgtctctcttactctttatgatactaagtttggttagtcctaaatgtaagctaaattaagtagtcttggttcaggttatgttttaaatattaaagctctttttttgttaatgttgggggttttggggttggtgggtggggggaaatggcaccttccatggccaacacaacacttgatcatgtcccagaagcattggtgttctccaggagctggagtaccaggtgtccaccttggtaggatgtgtggggaattacaataggtgaacgggttcgagccttctctgggcttcatgaaacatggcctccagctaagggttccttcgaggagttttattttattttatttgagttttatttttagttaattgaaaaagatgtgtctctaatcaccaaaaagccatccctgtctcctattcacacaggggcaaaagcctgttttccatagcaactttgttttttgtttgggttttgtttttttaatagaatattctttcttgaggtagggaatatatcttagttggtagagtgcttgcctgacattcatggagtcctgcaccacaccaacaatgtatggtgtggtgccggtaatctcaaggctggagacttgaagcaggaatcaaaagttgaaagttatcttctgctaactaaggaatttgaggtcagcctcagatgcatgagacccctgtcaaaacaacaataaacaacacttcacctttctcatgaatatattttgaaaacagaaatagtgctctagactttaaaaattttggagtcagtgggatggctcaacagataaaggcacttgataaccagaaagtagtgggaagagagaaccagcacacatgccatggtgagctcccatgtgcacatgtttaataaaaagtacataattcaatgtaataaaacaacttaaacactcctttgttgctacttttcctgcaagaatgtaggaattcaatcttgtgatgctttaaagttgagcagtttacaagttgttttggtaataaatgcaaatctggcagagaggacagaacatctgaaatagttctcttttgttgtaggttatagcactccaactgccccgcaggcgtacagccagcctgtgcagggatatggcactgggacttatgacagcaccactgctacagtcac

SEQ ID NO: 19516 - DNA, 1132 bp, Mus musculus
cacactgcttacaaagcagagacagagtaggaaagaggtcttcatcctctcccacatcagcaaggatagggctgcggctgcctaaagtgagcaaggagaacagagctctggacttctctaaatgtgggctctggcttcagactcctcagccaaaagctcttgaagatcaaagctctggcgggtacagctgtcctggcctgtgggccagcccatgggatgtgcctgggccaggtgccaccccacggctcactgtcatcccaggagggaccccacctgatgctcctcatcatccgctggcctgacactatcagagctcgcgccggctgttgccagggacagactgactacacttgaccttcaagagcacttagaagtggatggcctccagactctgtcagcctctgcaggggccacacaagtctcccgagccaagtccacaagcctccatggttccctggctcctctcctgtggagtgtcctgtttgatgtctgaggtctgctttgggtaccgccctgggaactgctaacctccgattggtccctttgtgtctctgtttactgtcctcttctacctccaggtcacttagctctggctgctctggctgggagtggggggtggggatgctggctgcacccccaccctggtctgccaacagaacctgggggcctcacacgggctcctgtcttgccaagctggagctgagcacactggcccaggctgagtggggcagagcaaacaagtggaaggggatctctcaccttagagggaggtggccgaaggtgtagatccagcgagggagctgccatccccgccaccttcatagcagcaagaccttcccatttccaatctcaccctccagcagggatatgactttggacaacaaggctttatttgtaaatatgctcttaatatgcaactttgagaataagatagaaacatcatgtattttaaaatataaaatgaagtgtgacacactgtatacaatttaatatatatttttaggattttgttatttaagaaaatggaatgtgatggtacttaacttttacaaaagagagaaaatgttatttttactgtttgaagaaaataaatattctcattgttgtagaaaccgtggtgaggccaggctgt

SEQ ID NO: 19517 - DNA, 1131 bp, Mus musculus
cattcaccaccatctcttttgggagcaccctgctttagaggcagcccagcctgggatcctccatcacatgtaccagcctggctgctctgctggggatggtaagacaggcccaggctgacaggacacagctggacctgactccagaagactcttgggtggtggggaggtatagtgtaggatgagttttcttgcttcttctctgttttgtccacatacagatcggtttcccctgtctttacagtttgcaatagagccagactgaaagaactgtcaggttttctaggctggcctggttccccactaagagtggcattggcgccctagaggcccagaggcccagtgtaggcttggagctttctctgctgccaactaccatgtgtcatctagtccgaggggactgagagcagggccacaccagatgtcatctttctagagggttctttttagtacccactgaccaatggggcaagcctgaggattggtccatctgtttgtccatggaacagacacagtgaacttcctggatactagacttaactagcctagccctcaagtagttgccaatcctgtggaatcagaattcagcctgtcttcctgtcctcagcccaagcctgtagcctagagctggggctgtagcctagagctggggctgtagcctagagctggggctgtagcacagagctggggctgtagcctagagctggggctgtagcacagagctggggctgtagcctagagctggggctgtagcacagagctggggctgtagcacagagctggggctgtagcctagagctggggctgtagcacagagctggggctgtaactcagcgatcaagagcttgctttgtatacatcggaccctaggttctatcccagcactatcagaaggtgggagagaaaaagactgcaccatagcatgcgggcagcatctgtggttcctacgtgaggtgtcatcattttaaaagcagatcaaaactaccgcgagttttgtcctttgtcccttatcatgggagcagagtaggagtaagggctctggtcttgctcattgtcccccagacagggaggcaggaaaaggtcaggcttgggaactggagatcctcccaggaaaagctgcaagattgagagacc

SEQ ID NO: 19518 - DNA, 1157 bp, Mus musculus
gtgccaaaggtacggccagggacagcaatccacccacccatttaattatccattcatcaggattcacaaggatatgccatgtgatgccagccatggctctcagcccctgggactgaagtacagaacaggccgactcagacctgccctctagaagggacaacagtgtttagtagtctgtacttacgtgtagggctgagtgtcttggctactgcaggtgtctctgctggacacactataccgtgccagcagagcagtgatccagggggacaagaggcagtgtaaagtgtaagatgtggctaccctgaaactctttgtaaagtacatgtgatatcatccataaagatgggttccatagatagactacaggtaacaccttctacaaagacaggctctatagattgacaagctcctgataaaaagtaaggatctgccatgtcctcggccacacagcgcatagggcatggctgctgaccacacccattcccatcctctgggcagacaccagggtatgcatccctccctttgagtggacagcctttgtgactttaacactgttccctctgtgttcccacaggctgtctcagggccactttgacaagtagaaagataaggctttccgcttagagcacgcactggtgttggtgtagtgtctgctgtcttgtgttctcgctctgatacagccccatttgtgagtttgtaggcagtggggctttgtggctcaccaaggtgcatctgagacagtaacattgcaaacacttcaagtcattgagtttgccgtaagccaccacatgtgtgaggtgccagcaagaggcagaggtggtgactggtgtggattctgagccttacctctccctatctgtgctctcttgtcccttgccataatacacagtagtggtgagacctcatgagagttatgacactctacaaagggaagtctcaggcagaaggcagaagagagacctcgagcttacagaggatgttagcacatctgaggatctctgatggccgagggaccagacatgcactcctgacatcagctaggtggggagctccattggagcaataccgtcgcaagatttgtttcctagagctgccgtaatgcagtatcacaaattacaatgcttaaatgagtgggaacttaccctctcaccaggaat

SEQ ID NO: 19519 - DNA, 1141 bp, Mus musculus
aggatgggaccttgcgcttcagctacatcctcagcccaggctgtttctgcactaacttagctgcactgaagatcctaacatacacagagattaaacaagccttactttaagaagggcagttagaagtaggctgctctgcagagccctaacacatttcattaacaaagctccttgagggacttaactgtcaaaaccaagaggatttattctgtcatggttctctgatgacacggtacattcacttacccatgttacatggaagcaacagtgtcctgcgtgggcctgactgatggcatgaaccatttaattatccatgtaatatatgagcaccatggtatactattacttgaggtatttatctataaaaagcctgtcctatattaacatcggatttcacacgaaaaaagttttcacataaggaaacagtaaacataacattttcaagctccgaattctgctttctagacagtatctcagtttactattaaaaaacaaaacagtgttcgctttggcagcacatatactaaaatcggaacgatacagagaagattagcatggcccctgcacaaggatgacacgcaaatttgtgaagcattccatatttaaaaaaacaaaacaaaacccaaccctcagaaagtcagaaggtgagctgcggcagggctggaccacgacagacagtggtatcctcctgtcagaagcgtaaacgggtcacaggttccagtgcacggacactggaccagtcaggccagcgagcttcctgagcattttaccttctgttttgcttttggagatgcagctcagcttactccactgttgtgatgcactgtcctctgagtatgatatgactgctatgaccttaatcagagcagctgtgactacctgcaagagaccctcacacagtcgggcctgttgacatccttggcagaagaactacacataattccagccctgatagacttgctctgggggaaacacaggaatatataagaggtagaaggttaactgtacagctttgagaggggacatggctggaatggactgtcctgtagctcagatcttttggggtcaccatactcctgtatatgcccaataaactcactcgttctccaagctgggcttgacaaagctgttcctggtgtcc

SEQ ID NO: 19520 - DNA, 1095 bp, Mus musculus
tggttcaggcctttccctatgtgcttctgctctcaaagtccacacaggactgatgcttttaaaatgtggtctgtaaaagaatttgaaagtatcatcttttaaactgacctgcatttttctattccttacataaactttttgtatcgtgttggtctaatgacactattttaattttttttttatttctcccatagcacttaatattttgtaaagatttttttgtgataaaatggtctaagggctctttttccacattaccattttaaaaacttttaaaagctagaaaacaacttatgtatattctgtatatgtatagcagcacatttcatttatggaaatatgttctcagaatatttatttactaatatatttatcttaagccatgtcttatgttgagagtgtgacattgttgaaataatcattgaaaatgactaacaaggccctgtaaatacatgataattgcacacagattttacatatttgcagaccaaaaatgatttaaagcaagttgtagtcgtctatgattttgtaacaaattgtacaaatgactgtaaaaaaaaatacaattttatcaagtatgtgtcacatgtggtcattgctgtggctcctaacgtctagagcctgggccagtgctctgatttccatcgtatccagagatgcctgtgaccttctgctcctattaacagattccaagtcatcagagtattggctggaacctgtgggttatatccttgagtaacagtgtgtggcaggaccctgaagcaggaagatcacatctttcagaccattctggactacagagtgcatccaaagctagcccgtgcaatgtaatgaaaccctgtctcaaaaaagtaaaagatgtgctggagcctgggcacctgccagcagtcaaggctgtaggttcgatccccccacacctcccttcccctgccctgtgccatccacagaaaaccagttgggcatggtggctttgcttaggaggcaaaagcaggtggatccctgggttcaagttcaatttagtctacatggtgagttctaggacagccagctctgtgtagagagcctgtctcctgacccccactctacccccatttt

SEQ ID NO: 19521 - DNA, 2003 bp, Mus musculus
gcttctgtctcctgagtactactgggattaaaggcatgcactaacactgcccagcataagatatcttctaactggagatgctccttttgatccagcctgtgtcttgttcctgcagcatgtcaggttcatttccatctccatcgagatccttcgatctcagctccacagccttcctttccccatcagtgtcactcccactgctatctcctaatcacctcaagccaggcacctcgtgggaagatctgtgatctgtgaggagtctcccctggccccctgggaactaattcacttaacttcagttctacctatgcttctgtgatatcttaggagattcagtataggcatcaagggagacctgctcaccctctgccccaacagctgttctcagtgtagacttgagctcctcaggaaaggagccattgctgccccctttatcacacagagccaaatcaccattgtgaactatcacatccaagggccctatggatgggctagggatgctcaaggaccttacctgatacgtactacccaaagcctgctgtgctggctctctccagacccttgatgactgttctccctctttctcccaggaccaggatctggcccaggcatcggtacgggagcttgagctcaaaaggaactcttatgtagaaatcgtgaactgtacggagacttcaaagtctggcttccttcaaaactactatacacacacacacacacacacacacacacacacacacacacacacacacacatatatatattttagctttgacaaacacaaaagtggtaataaagagagccctcctcaacccaaaatgtgagccacctgtggcatcccttcctctttaacaaaccaacagacaaaaatctcttgagtcctttgcctctttaataatgtgttgttctgttttgtaatgtgtgcttgggtttctgaggtgtgtgggattgagttctctgctttttttctaaaatattatatgtaaatgtaaaaagttatttaaatatatattttaaagaaccctaactaccaacttctgttgaaaaaaaaaatcactgctgcattaaatgaaccacatcatgtgtcaatactgttgtctccctggagggacctcaggcctttgaaaagctcagggttacacctgccttattgaaaatgaaccagaaacttgaagtaaaaagctccaaggaacaatacaaagctgcctcatcctttttcccttttttgaggcaaatctgaacttctgggcttctgggaagccacacctctcctgcccacacctgtaggcagcaatggaacaggagggaagtgggggcagtgtcaagctattactgcctaggccaactttattggagacagttctgcccattctcttctgttcctttggtaggtctttatcccagcagaggctgtggctgtgaccagccctgttactagggtctctcctgcactctgaccaccagtcaagggaagagacgctctcaccctgtggccttggagtcttttgtaaaatcattttgggcttcatgccatcaattgcaggggtaatttaaatggggtgtgcagggtggacacccaggaggaatgttgatttatggccttggtgtcctgtgggactagaggaacaagctctcctctcagtagcagtgcaccgctccttgaaaggcatgctgaggcacacttgtgcccatgggtctagggcagccacacccctcagctgttgcccccttaggttgccttcttgggggacatatgcttgaaccacaagagtgtactaagctccaattggaccagtcccccatccccagaaacaggcctctgcctggtggctgcagcggttcaccttgccagcagatgtctgctagcctgtctgcctgatgcactattatgtactgattctccacgagacagactatcagatagttcagacccaaagggtaggcttttgtatattttttccagcctctttttttttaaggggaagagttttttaaacccaaac

SEQ ID NO: 19522 - DNA, 1185 bp, Mus musculus
agccacaatatttgcccttagagtccgtgcattagtgaattgtgctgtagatggaattcaagcagtttattctctacctgcctgcctcaccaaagaaagcaagtatgctttaaagcatcttctgtaaggctgcaagtggagcccagtgtagagcacatacctggcatggatgaggcccagggctcacccccagctctgtggtgtctgtcctgaatggaccgtgcctctggaacgaatgaacatccatgttcctatggaacaagaaatgctgggaagcccaggaggccctctggctgtgagtttccctgaggcacattccaggaaggcattccctacccaggtgctgcagtcactgccaacctctccaggtgcaccagcatcaaagctggaggaacaagcactcccagtcaggacatccctgaactcacactcccacagggactctctgatatgctggagccctggctgaaagcaaggttaaaaacatcagaggctctctttatttcgtcctctaggaatggaatttgtgaagaagcctagggtaccactggggcagaaacactagtacctgctcagaaagtctctgagctactgccctagggagcttaatggaagagaacaaacttgccacctaggcttctgcagggccatggctgttctgaggttgggactacagagattcagtgacttatgtacgatgcagtgatagagcacttgcttggcataaacaaagcctgggcttgacccccccacacacacacagcccgcgctatctagaagaaaaagagacactgaacctcactggtcacttgggatcactgactgtaaaacaatgaggtggtcctcaggcaactttctgattgttcagcctcagttagtttttaaggaagctgcccatagggcaaggacaaattctatagcaccgtacccaggattccagggtttcttaaactaccaaggaaaatactttatccccaatatcaccgaattttgacttgctggtcctaagttcagggaattggcttaaaaagcaacggggtgacactgccctctagtggtccagtaaagtatttgcccgttgggtttgtgcacctgtcagcacaggttatttctgtggaaagcatttggatttattctcatactcttgggcccatggtgatgtgacttctgagcactggctgaaat

SEQ ID NO: 19523 - DNA, 1161 bp, Mus musculus
aaataaggtgaagggaggttgagaagacatctgacatcaacccctgggctccatgtgcatacacatgaatatatgtgtatatagtatatacatatttttatttcatcttattttatgggtatggatgttacgtttgaatgtatctgtatagcagcatatgcagggctggtgcttatgggtgccagaaaagggcatcagattctttggaactggattcatagacagttgtgagccatcatgtgcatgcttggaattgaacctgggtcctttggaagagcagtcagtgctcttacctgttgagtcatttctccaccccttataatatctatttctaggggtttttttgtgttctcttcagtgctcagctcacagtaattacttgaaattccccgtggattaaaaacctgttccctgccataaagtttgaagttttgaagtgacttagtatacaataacaaatgcatgaagtgggtcaaaccagtctgtaaggcagcctgttgatatcttctttccattttgtctcttagatgcacccactaggcctatgtaataacaatgacgaagaggacttgtatgaatatggctgggtaggagtggtgaagcttgaacagccagaattggaccccaaaccatgtctcactgtcctgggcaaggtaagcaccaggccttctgtgtcactgccgttgtggttgatgttttccacataagcattttcctgagtttcaaatatcaggttctgaagaagagccatgctggcatagtactccttctgaagctgtgtgaggagacatagcaccatagaacgcatgtgctttggcgcttcagagtctgctgtaaccctgcctactatgtggtcttgggcaagttgctttccctgggagtctcaatacttatctgtgaaatgggttaatgttagaaatccataatactgtaccttacatctttggggccagaggttttagacctgagatttgggggtgggggcttcaggaagtattatggtatatatatatattttttttctataagtaaccctggggccatactcaataatcatacacattcatatatgtgtagcatatgcttatggatattcacatcaaatgggataactaaagcctaaatagcctcctcttagaccacaactgctttacttccaaa

SEQ ID NO: 19524 - DNA, 1150 bp, Mus musculus
tgctgccaagcttgacaaaccacaaggtgaaagaatctaaccaactcctaaggttccccccacccacccccgctgtgtgtgtgtgtctgtctatatgtaaatgtgaaacatttttagaagtcagagattatacccatttattcacaaatctttttcttcctacaaagtgatattctcatttggtaaatttgattttctattgctgcatctcagcatttggctgaaaatattttacattcttaaatttggacctttgacctatggccacttagggattttggagttagtttttccttacctgtgaagcagttacttacccattgctcatcagtgcagaagccttctccagtcagtgcttgtctttgctttatatttgctttttactcaagctcaacctaataactaagaatatgtgaagtcaagaactgtttttagattagactgaataaaatgcagcagcagtgagtcatggcaagattttaatgtcagctatggcagttggtgaagagcccaggttcagaggctgcctgggtttaaatcccaaacttgtagcatccttatgtatgacactgaacttgtcttcctcatccataagacaatagtgtatgttccagaagtgattgtgagggccagatgagtcagtgtctgtatcatagtggagtgatgcctatgacctggcaagtgtgcaacagatgtcaccagacattactatctctggtgtcttggtagttgtgtcaggcactgctctagacaaggtataggtgtttttttctaatcttaacaacagctttagaattccagcattgatcttttcatgtggacaatgaaacagataggaaggattctggctgtgggaggggctgatccaggagtttctaaatttgttcactgtcctgggtcctgtcctgctattccattgtgacagatcctgggaagcagtcttgatccaatcagggtgagtgtagggtaatcttgttaagacaaaggggcaaggcctttttgatgggctgatacctgtacacaaaaaaagctacaccatgacacatattttttttttttttttgggtttttggttttttgagacagggtttctctgtgtagccctggctttcctggaactcactgtatagaccaggctagcctcgaactc

SEQ ID NO: 19525 - DNA, 1133 bp, Mus musculus
tgaatttgtttggatttgacatttaattcaaatctaatttctcataatttgtattgaagttcttgaaggcctgtgccaacccctcccacccccccatgaaattattcacacattcttgtgaatgggtgtgttcactttcctgatagtttcccaagaggaaaagaagtttccacctagtacttgtctttgactggtccagcactaagaatttaagtagaaggcccagaagataactcaatggattaaggtgcttgctgtcaaggggactaaatttgatccttgacatccatattgtagaagagaaccaactcctgacagttgtcttgtgacctctgcctagactctgtggcacacatgcccttcctataaatgtaagaaaaaaaaagttgagtgaggtaataggtctcttgggctggccagggttggagggaagcctgcagcagctttgcaaaccttcattgagcgtatttattggatggatgtctaccaaaaacctattctgtacagaacaatgctgcagtgctgtagtcctctgagatagactggtccacagataatcatccttaccaactgagtttttttcacagtatttcaccctcatgcccataggcatctgcatctcaactgagtttgtgcatctatgtcctgctagttctgtatcatccttgggagagagaaaaaagaaaccaacactcaaggaattttctacatttagtagtggaggaagtggaagtacaatgacttggaggaagaagagatggaaatgaaagaattgaaatagaaaaagggttagatgtgtccctttctaccattcactgcacagtgaagtggaacagctgctggtgttggaaggctgcaagagtagcccctgccttctggtgaacccaaatttcagggagacatgtcttcatagtcaaaagaatcaaatgtgtgggctgagacctagctcaggggtgcagagcacttgcctagcatgattgaagccctgagtttcatcccctgcaatggaaaaaaacaaaagtaccaaatttaatgaaatagatttaatgcaaggctagaaaggtgaagtgccttgtttgggccgtatgtgtgtggtaaaggtagggacaactacaattaacatttaattcctc

SEQ ID NO: 19526 - DNA, 1914 bp, Mus musculus
ccgcagcactcagactatgtgcacctctgcagcaggtgcaggcccagttgtcacctccccagaacatcttcccatggactctgacactgttgcctcttcagattctgaggtagagcttattctgtagcctaagtggcgtgtgacacgcttagccaggcaaacggagaagttagtattggtggggttaggattaagcactttcctagtctgcttaagtggatggagtagggggaaactgttccgtgggtgggtcctatgatctgagagcataagtctggtggatggctgggtcctgtgatctgagagtgtaagccctaagtaacattgtggaacccagtactaaaagtatttctggtagactgtcacattcattctaatagtgaactcttttgtgttttgcctcttgtagtctgatatccttttgggcattctggacaagttggaccctgtcatgtttttcaaatgtccttccccagagtctgctagtctggaggaactcccagaggtctacccagaaggacctagttccttaccagcctccctttctctgtcagtggggacctcatcagccaagctggaagccattaatgaactcattcgttttgaccatgtatacaccaagcctctagttttagagatcccctctgagacagagagtcaaactaacgtggtagtgaaaattgaggaagcacctctaagctcttcagaagaggatcaccctgaattcattgtctcagtgaagaaagagcctttggaagatgacttcatcccagagctgggcatctcaaacctgctttcatccagccattgtctgagaccaccttcttgcctgctggacgctcacagtgactgtggatatgagggctccccttctcccttcagtgacatgtcttctccacttggtacagaccactcctgggaggatacttttgccaatgaacttttcccccagctgattagtgtctaaagagccacataacactgggcccctttccctgaccatcacattgcctagaggatagcataggcctgtctctttcgttaaaagccaaagtagaggctgtctggccttagaagaattcctctaaagtatttcaaatctcatagatgacttccaagtattgtcgtttgacactcagctgtctaaggtattcaaaggtattccagtactacagcttttgagattctagtttatcttaaaggtggtagtatactctaaatcgcagggagggtcatttgacagttttttcccagcctggcttcaaactatgtagccgaggctaggcagaaacttctgaccctcttgaccccacctcccaagtgctgggcttcaccaggtgtgcacctccacacctgcccccccgacatgtcaggtggacatgggattcatgaatggcccttagcatttctttctccactctctgcttcccaggtttcgtaacctgagggggcttgttttcccttatgtgcattttaaatgaagatcaagaatctttgtaaaatgatgaaaatttactatgtaaatgcttgatggatcttcttgctagtgtagcttctagaaggtgctttctccatttatttaaaactacccttgcaattaaaaaaaaagcaacacagcgtcctgttctgtgatttctagggctgttgtaatttctctttattgttggctaaaggagtaatttatccaactaaagtgagcataccactttttaaagtcactgaaagctttttcttcaggccagttggccaatatcagttactaagtggcagagatagaacctaaccaccttttgggggtggggtggggattaaacctaagatgtgcataatgggcaagttacataagttgtaccactgagtctcagctctttaaattactgttttgctatgataggaagtatcagacttcaccct

SEQ ID NO: 19527 - DNA, 2648 bp, Mus musculus
ctccctgaactccttcctgagaagccaaagccatcatctagccctaagaactacaggagagagagccaagcaaagcacgcagctccgggcactgcgttcccacagaggactgaagggttgctggaacctcagtgcgcagacgcgccgctttaccgtagtctggaggcagctactagcacagaggaggagatggagctctagacacccgttctgctctaacttgacaagtcggagaaggctcctgcgttcagaaatgagcctgcctgcagagtataggggcctgaaagttttatgaaacgggtgtaatatctcctctgcctgtgacttgggtgggactgtcattgtgggtagccatttattgaattcaactttttgccaaggaagcttatctcaagggaaatgcagttttttaataggcttatccaggaaatgttacagtctctttaacgacagctatagatgctggatgtgttccgatgacttaggtcatgtcacattgttgaagccattcattcttgagatgattctgtacaggagtgctcctaatcgccactgcaccctaattgctgagtcatgtgctgagctacttgtagtggtcactgtacacgtggggctcgggagggaagagagcaggacttgtctcttgtgaaggaatggaacaagcaaagaaacttgtgttggtgtcaggttggtgtagctggatcacccaagtagtagcccttgatctcctttcatgacggataggctcagttagtcaggaatgtttacacctcagttaacttcagtgattgacttaaagactgggaggtatattgcctgtgagagaaatgtcttttcatgaatcctaaggacatgctgtgtcagctaaacctacaattgattgcttctagagtttaaaaagggaaagttgtgcttgtatttgcaagttgaatttttttaatgttggttccaaaaacagtgaattagctgaaaagaaatggagaagtgtcttggagatttactgaaatagctaattgtcaggtgcttaagcttttgtgcagtaagcctaaaagttagcagaagatggcctcctgccagcaggaaatctttaccctttagtacccgaaccagtctcaaggtgttctttggaaataaccagggttaaagtttttaatttctcaggaagagctcttcagcatggcaggacgtgtaatgagggctttcgcaagtccttcagcgctgcagagcagtaagctatccatccagtgagtgtggcggctctttctacagctgaactcctcctcagttgagttttcagtttctggcttgcttctccctttgtataggggagaacagagaagaggtttatgctgagggggggtgactttttagaaacgtagcttcttggcgttttgcaacccatgctggcctccctcctgcagatggcataggagtccgtctgtctttggactgtctcctctgctgttgttcctgctctctccgtttctgtctagatgtcaggaaaaggtttaatgtttaatatttaaacaaaatatttatatctacacaataaagttaatcaaccttcaaaccagtcttgaagccagctacttgtttcttcatctcagactcctaggggaatgaaagctgtcttctgtgaatgtgcaagggtttggctcgtgtcatttgaaaactcctggcttatctaatgggaccagcttgtgaagtttatagccttaaagaaatctctgtgctaagttttagaacagtttagaaccatgcagggatgccgagagtctggagttagcccagtgttagggtaggaaggtagtggcagctttccaaagggcctaaaacaccaggactgcctctgtgaaaggcccgagtggctttgatgcagttggtaaccacttgagagcagagatgtcttaacttgtcaggagtccttacctgacatgaccctgtttcaacaggaaagtagatgttttgtgctcctttttggattttatcttcttgcacatgtttgtacagaaatcaccttcatccttgtggtgcttacacacacccagttgtctccacagctctgatacctttgccttctgttctcctctctagcataagactttggcttctgccttaaggttttcctaaggaattaacaggtcttttcatcttgtatagtttttacagtgtgaatccaacattggctcagtatgctaatgtgacagtcaacagttatctaaagcaggtgagctctgatgaacaaatgtattttcagtgagtctgagtcgggtgtatgtgggttttttggttcttggcttggggctttttgttgttgttgttcttaataatatgagaatccagttctcatgacaagaaccagtttaaaaactgctcgttcttaaaaaggtaaaactaagatttagaaacaaggcaggccttagagccgagggagactattaggcagcaggccaaaccactctggccctggagccgcctttgttaacagcaacaagaatgctgcagtgctacaacgtgctggaagatgtgtcagatttgctttaaagatgagaatctggtgtttctgtactttattattttcaataaaactcaatgttttgaacttttaaagtatctgtaatcctgtataaatgtaaattaagcatttt

SEQ ID NO: 19528 - DNA, 1136 bp, Mus musculus
ctgacctctttgttaccattgactggctggcccattctcccatctctgccttatatctaacttcctgtcagtgctgctgcatctggcttcttccgtgggttgctgggattgactccagtgtcaggtttctaaggcactgtaactgctgagcccgctccctgggccatggtatttctgtgatacacttaaatagcttttacattttagaattttattttatttttgcattcaggatctagcgttgcaacctcatctgggtttggaacttgtaattctcctgcctcagcttgtgtagtattgaattggggagtgggttatagattagtagtagaacatttcacatgcgggaagccctgggtctgtacctcagcagcacacacaccgtgaaaacaagcaaagagggttattccttcttgcctggactgtttgttttatgcagggatttgctgtgtcaaccggcaattgaagctgagatactcctgcctcggcctattgagttctggggttatagatgtatgttaccccacagagctctacactgaagacagttttttttttttaagatttatttatttatcatatatgagtacactgtagctgtcttcagacataccagatgagggtatcagatcccactacagatggctgtgagtcactatgtggtgttgggaattgaactcagaacctctggaaaagcagtcagtgctctttaactgctgatccatctctctactcctcactgtagacatttttgttctgtgacccttaacttttttttttcctgagactctgtgacccttaactttttttttttttttctgagactctgtgacccttaacttttttttttttttctgagacagggtttctctgtgtaaccctggctgtcctggaactcactctgtagaccaggctagaccaggctagcttccaactcagaaatccgcctgcctctgcctcccaagtgctggtattaaaggtgtgcaccaccacccagcgatgaccctcaactttttttttttttttttttttggttttggagacagggtttctctgtatagtcctggctgtcctggaactcactttgtagaccaggctgacctcgaacacagaaatccgcctgcctctgcctccgg

SEQ ID NO: 19529 - DNA, 1136 bp, Mus musculus
agtccgccatgttcaaagtgaaaatgcagtaagaaatgggtctgggtgcttctacttcccgtaaggctgcctgcctgtgtgtgccccgttagaaactgcgctgggtacactgccaacacagctcagcaggagctacttcctcctcacttggattattttccagatctccctgtggcttatctgacttcatgtcttgtttttacaggttgctttcactaccagaatctatcaccctaatatcaacagcaatggcagcatttgcctggacatcctgaggtcacagtggtccccagcactgactgtgtctaaaggtagagacactggcatggactgagcatgctggtctactggtcccccttgctgactagtggacacggaagctgaggaagaacagatggcttccccagatcacatagccctgcccagtcctgtgactccctcattctccatgctgtaaggcgatgagggcattgcgaagcacagttcccatgccagtaattctcagccatcagctgttctgtgatgctccgaactgtcacctgggtacaagaagatagcatcaactttacttgcattttcacctaaaagtcggaaagcaaatatgaaactttttttcatctgcagaccagcagactgtgagtcatctctgaaaggtcaaatacatggcctgggctctagtgtgtaaagacattttcctttcccaaaacaagttataatgagcttattggtggacggcattaagaattcaagctgcacacatataaacaaagcacttgagagttcagggccagcctaggagggaccccgcctcaaaaaaaaacaaagcaaaacaaacaaaacaaaacaaaacaatccaatctacaccatgctatagaatgctaggagctctggaacagagattgagtacggtagggcgtgcgtgtgggacgagccacccacagccggtatgaggagcataaggctctgggcactgggagaggcctcaggctatggggcaacgggcagggcaggctttggaatgaaacaaacaaacaagcaaacaaaaacaaaaaccaagaggcctgcagaggtagatatggtaaatccagaaggacagaactaccgtactgttcaggatcacagtgtaccccacacat

SEQ ID NO: 19530 - DNA, 1148 bp, Mus musculus
ctctgacattgtcctcaacacaggagggcacagaagcagcggtgagggcacagactggtcttgcagttctggttcggagtctctaacttcagcattcggaattcctgtcttcttgtcagtagacaaggctgctggggcaccaaagatgtgtggtgtgggtacagacgggcggttggaagagtgtgaaggatggaagtgaaggccaggaccacgtggaggaatcccagaacagtgtgctgtgactacactatgacgtgtgtcctgctggtattttaacatcaaatattatcgcgacttgaacagaatctttttgttgttgttttgtttttttgtttttgtttttcgagacagggtttctctgtgtagccctggctgtcctggaactcactctgtagaccaggctggcctcgaactcagaaatctgcctgcctctgcctctggctcccgagtgctgggatcacaggcgtgcgtgcgccaccactgcctgtagcagagtgtagaggggacagcagagtgtagaggggacagcaactgtgcttgaggatgctcactgggcgcacgaggagcccacacctcagggcctcggctgactgaccctttcctttcttcctagttctcctgtctatctgctctctgctctgcgaccccaaccctgatgacccactcgtgccagaaatagcccacacttacaaggccgacagagcgaagtatgcgccctcttagggttggctttgtgtgcagctgcccaggttcccacggacatcttcctgcccaagccaagcccatgtatgcagtgggtgtgtcctgggctgagcctcctgcctgcctttataactaacatgtcctttggccagaggagggagaagggataaaagtactttgccctgttggatagatcaccagctagcattgctgaatcctaaaatcctggcaagccctgacctgaggacagccacatcagtgctcagtcaacaaaggactcagaaggatatgacaagaaaagtcagggttaaattaaaaggtttatgaaataaataagagagttgcttggacacccccagatgagccagtcagggtggggagcactgccaaggttagcttgctgataagatagaagtctgaagtgtgtagctgtttgatcagaagac

SEQ ID NO: 19531 - DNA, 1214 bp, Mus musculus
gggccaattgtgattgaaagctgctgatgtcaagagtgtctccacatggagaacacccccaggttgactcctgcccttcaccctggtccagttctgcagccccatgcggcttgttaccaggtgccagctggttatggggcttgtcatctgagctgatgattttgtgagactatttttaagttcagctccttggactacaccccacccccagttctgctactggttgcctgcctctgcctgtatctcctggaatgctgattggcagttagggctggggtgggggctgggaaaactgttataaagcctaaagggccaagcaagcagctgccacctagagttcctgtgtcccccgccaccatgaccacccaccgcctagtaatggttcgccacggtgagagcttatggaaccaagagaaccgtttctgtggctggtttgatgcagagctgagtgagaagggagcagaggaggccaagcggggggccaccgctatcaaagatgccaagatagagtttgacatctgctacacgtcggtgctgaagcgggcaatccgcaccctttggaccatcctggatgttacggaccaaatgtgggtgcccgtggtgcgtacctggcgcctcaatgagcggcactatggtggcctcacaggcctcaataaggctgagacggctgcaaagcacggggaggagcaggtgaagatctggaggcgttcctttgacaccccaccaccacccatggatgagaaacacaactactacacctccatcagcaaggtgggccagatgccgggaagctggaaggttgggagcccaggggggagggctacccagtaaacaaaagcgaaatgttcctgtgcccttgtccccaggaccgccgctatgcaggcttgaagcctgaggagctgcctacctgtgaaagtctcaaggacaccattgcccgggctttgcccttctggaatgaggagatcgcacctaagattaaggctggccagagagtgcttattgcagcccatgggaacagccttcggggcattgtgaaacatctggaaggtgaggcctactctcaggaaagatgtgagacagaaaccactgcggttcattggtttcagctattttacagatgtcagggtttcagaagttgatggaggcaggagttttgtaatactttgtgttgtcccatttccagttatgtagtcagcacagacagcatagctgag

SEQ ID NO: 19532 - DNA, 1186 bp, Mus musculus
ccgttctgcgtgccagaaaagagagacctatgttcccgccctgggcttgatatgggaagtgtcattccagcagtgaggtgttgtgcagaagtaagacgcctgagtgcctgctgcagtaggaggtggcccaggacagcaacctccagtgctggtgctgttggcaccaccacccgaagacatgggtacctgtaccagacttcataagcagctcatctccagaatcggccccacatgtgtcctctctctgtagctaccaatcccccgcattccagcctaggctaagccgggcctgcctacccacaatctcctgtgcagcctcagcccctgcagtaccttctgggaaggctggtttcctagcacagagactgtagctcagcagcatcagtgggcagcagcagagcgctcttccttcttatcctgagattgtgagctgcgtggtccctggtcctgctcctctgctctgccacgtctaactgccctgcagcagtttcgaacctgcaatccttatgcaggcctgtgaccctgcagtcctcaggcaggccctgtgactctggtgtttctgttatctcttccagtctcagctgtacccctccagataagccttcccccacttacccagttcactcctggtccctgtttcccagctctttgtgaccaacttcttcaccttctctgggctggaagcactaaagtgtcacagtgtctttgtatctccaagtgtcgagacctataaagtccctttccttcctgtacacttagtgcccactgtccctgcctccttcagggcctgacagatgcgggcctcctagatcagtcagcagattaacaagtatttttaaaattaacattcaataaagtggattatttttttggattatagttttacaagttttaacacacacatgcacacacagagaatggctacttctgccaccttcaggacacaacagctctgtcccccagaactttgtcttatactgttatagtgacagtttccttacccaagtgtgttagggtttctattcctgcacaaacatcatgaccaagaagcagttgggcatctcattacggatggttgtgagccaccatgtggttgctgggatttgaactcaggacctttggaagagcagtcagtgctcttactcactgagccatctcatcagcctggaaccaaaacttctaggtc

SEQ ID NO: 19533 - DNA, 1200 bp, Mus musculus
tgctaggagatgtagccacaaaagggtttggactgtgtgtataaccttcactgctatgggggctgcccttagtctcattcaagagtctctaggtggttggctcaaggctggcaacatgctagtccaggactccatggaccagttggcatttgaatgtgagaacaacctgctggggtagatactggccaggcctccagtgtttctcttgaaaccacatctttgttcactcttccttggttttggtgttgaagagaagcacaagtaaaaaagctccagttgtggtaggttttcccaggaaactaagaacctggcgagcctgtatattagagtaactctttggggtctattgtaagcacaggctgggcctgtgtgtttataaagtgataaagagagagcttactgaagttttttggtagttgggcagcagaaatatgctgtccctagttggccaggattgagtccttgtcctgtggcattgcatgaagacaacactctcagtcaggggcatcgttctgtggattttgctcctgacccatccgttccttcttccacatagctcttcacccaggtcttcggggttggggtgaagactgccaaccggtggtaccaggaaggactacgaaccctggatgagctcagagagcagccccagagactgacacagcagcagaaagcaggtgaacttcccaaagctgcctagccctggaagctacacaatgaagcccttagctttagtgtggaacacgctaattgcctgagtgcggggcagcagttggtgcagaggaatcctggtagccatgcgaggggccccctgtggcttcctgcctggacccagggttggccatgagcctttctcagcgagtgttgtcacagcactgccctggcatcctgacctcatgtttcttcctgtttgatttcagtttgtgttagggacagctttggtctgggctacctgtccaatgtggtgtctgatgtatgtggttttttggtgtgggcgccacctgagtggaaataacagaaaccttgggctgagtccactcctccacgtgctaagtatgtaaccatggcttcaagactaacctctctgagtcgaggttaccttctctgagaaacacagagaaatgataaggtggaattcctaagtgcctccggaggctggcgagtgatgagcacacacgctgtctgtgtagcctgctggct

SEQ ID NO: 19534 - DNA, 1987 bp, Mus musculus
ggcagactggctgcttttattttgaagttcccaagaggaatggagggatgctttaagggtgggaacattgatgttcgtatgtgtggttgtgactttgggaaggaatttgaggacctccaagatgtaatgttgggaaaatgaaaccataaactctaagtggctcttataggtgctgaagggcttattctcagctaaccctggaaggctctagggagggagtctttttcctgatccttggtatgacttaggattcatttgtgcattcacgatattaactctccatgaatggggtgggggaggggctggggtgatagggctggggtgggcagagtctgaacactccagcattctactaccttgcactgtgggggcagggagaaagtcaccatggccagagaaaggtagtggtcactgggtctcacatgtttagcttgcctgcctggtaggactggcttctggcagggacagggcctatcctaagtaccttcacccagtatcacaaagatgactttgtgggaggtacttagaatgggctaaggtggacaggctgtgtaagttttatcagctagcagactgagtgtgggctggaattgttctggtgttgggagggtcagctgggagtgtccatctttagggaagaagcagacacaggtgccttcagctgtccagtatggaggaacactcacctggacttgcagttggactttgaacatcaagatcaaattagtggatgctgtcgtctcttaaagctggttttatttgtctctggtccacaagagtgttttggcaactgcctggagcttgcatgttgggacaaatcaggacaagtgccagcagcctgaatatttccagtgcctacctgtggtctgtccagttctggcctgtaagcccttccctatcagagacagttgcagagtagaggatattgaggggttgaggggttgatctgagctggtgccactgcgagcacagcctacatggtgaatccagagtgtgcccggttccacatcacctcttcatggtctgctgtgcacaaactatatccgagagatcctgtctccccaaaagccactgctgggatgctggcctctgatttttgagccagcgttgtctcactctgatccctaccctgagcctgctgaactgccctcagagtgctcatatggggagggggatatctactgtggcttccaaaagtccccactagttggtgtacctgtctatttctctggatactgctagccaaagggctcgggcccccccctggactgacctgcccatgtaattttcccactgccacagacctctccaacccagggcccctggacagcacagatccagtgtgttgctggcacttgaggtgtaataaatggcctggggtgctgcctctttctcttgttgctctgggggtactggggaggaggagaggtgggtggcagtagaagtttgtggggagaaggtaacctttgcctacatatggctgtcctacagggtctcccttgcctgcagtgggagagttgcccagtggttccccatcccccattatattctaatgctaaatcacttggcaagagtgtattttaatgatgcctaatttctctatgttctgtttgaaggtttctgtccagataaaattgtcttttgaaattcaatactgtcttgtgtttacttttagcttcagggaaacctcttccccagctcagccagtgagggtgggaagacaccaggtactgtgttcctgtggatactagggtcccgacctttctggtaggaatgttccttttttgttaagcgggtgagggagctctggaatagccttgctgtttcagagcccagttttctgcacactgaaagacttgcctgggtgtgccgcctcttagcaatagagtcctggggaggatgctgtgttttgctggtttcccgtttagtgcgggctggctgcaaaccacctagctttctgctaaccttgggagacttctgagggtct

SEQ ID NO: 19535 - DNA, 2154 bp, Mus musculus
agacggagctcaagccagagcttggcgggtcagcaatggagttggtcgtcagggtgggtcctgagctcgacttataaccattaacccacagcaaaggcagcctaggaaatgggtagcaaccacctctcctggcaggctccttccagaaaggaccttaacttactggattcctgcccaaaccttttccaaatagcaaaggcgtgggtggttagggtggtatgttgggctgagaaaggtgacctgccccctgtttcagagctgcgcctggtttcgccggacagagttggtgtttggagcccagccgccctcgggcgcacggcctgcctgtcgcatgtttgtgtctgcctcgtcccctcccctggtgcctgtgtctgcagaaaaacaagaccagatgtgatttgtttttaaaaataagatgatgacaacgacaaccacacgcaaaccaacaaacaaaattttggcatcggatgaaatggaaaacaagcaaacaaacaaaaacctaaagaaaggaaaaagctgtaaaaatctggcatttgtggggccaccccacccccaagctccactgtgtctgttgtgctcctggctttggggaccctcagggcgtgaatgtgcccatgccgaccgtgttagtctgtaggtaccgcactcaccccataccttgggcgtctgcatcctccctcccatgcatgggccccacgtgctaacctggctgttgtggtgtcaggtgtcttgggaagggctgggggctgcctcctttcctgctagttgtgcctgagagttgctgctgctcctgctttcccctacctgtcccttgtcccgtcctgtgaagggctgggagggtgctcctctagccaaggacctacctttgccccatggagtgtgtagaagcttgtccccgaggtcatcagaaaagaacctgggctctcagccccggttctttggggagtgaggtatggaggtacggatcttgcctccagacctcctgcctggcaggggttggttaagaaggcctgctggctgcagtgcctacccatgtagctatgaagagaggactgggcagaggatggcctccttcctgtttggggtacttgtcccttccctgccaccagcagctgagcaacagtggcccacccctggcctgggaagttcctctctgaagttggcagcagaccctaatgaagatggagaacctgagatactggacggatactgggaacaggccaggctgcgtctagggtgtttgtccactcagcttggagcctgggtgttcgagacttggttaaatgttgcagaatgtggtaaagaggggccagaagttgggttctagacttctgggcaatgcaggtccatacaagtgtttgatgaaatgggagtgctttcttgacctgggcctagagaagagcatatgccacctagaggcatgtggaaggccaaaattggttagggctgtattgtgtggggctcttccaggtaggccagagacacagcttagagagaaggcaggctgggggcagagatatatggctgtggggcctggataccagtgggtgggtggagggcccatcaggacagtgtggcacctccaagggcccagtggtgctcctaggtgccggctgcctggactcgttgtgggtggccctggcccttggtgactgagggaatcattaaggctggacatgttacaaagtcaggctagggagatataggtctgaagccgggttgggtgggggtggtcagaggctttgactgcagaggttcatgggcctccaccccaacgctgaccactttaaattcatgtcattttcaaccaggattttctttatcttttactacaaatcaagccaagggaggggcacgaagtggggaacgggacacaggatcctaaactccaaggggactgtccacctacagacactcagtggataccacctttcatccacactgtgcccaggacagctgttccctacccatggacacagggtaaacatctgccacccatggacacagggtaaacatctgagtggcccaaggccatggaacagtggcagggcttgccatggacagtgtgaggccctgtggcctgccaccctggcatcctggggtctcctttcctctcccacccaccttgttatctccacaaagctgcctgtctgg

SEQ ID NO: 19536 - DNA, 1149 bp, Mus musculus
gaggcactggggtttatgaggggcttcctgggctcttccctccatagtttcagtcttgcctggacacagtccgagagtctgttttaaagggctccccggggactgtggggaatgatgggattgggagcctggcttctacacccctctccagagcacaagctgagatggagagggaaggttaatctgctttggaaatgtgggtgttcttgctgctgccctgctcccaagtgctgcagagcctcggctggccactggccagcctgagagcctcatggggaaagatacctccttcacgtctgaggctggatctcaccaccagttgatgggtcctagtctcttagtcgtagagctccaccgtcgtttttgtttttcaagacaatatctcactatgtcgtcttggctggccctgaacttgctgggtaggccaagctgtccttgaattcatagaggtctacctgcctctgtctcccggctgctcggattaaaagtgcccaccactgcacccagcacagagcttatcctcttgatagacaggtgcctggacctgccctggagagctgacttaggaagtctgggtaggcctggaacctgggtctcaacagtgactataggactgcagggccatgccactgggtgcctgcagctgagtaccaagagcctgacacctcaccagtgcacctcttcttggagatcatgggcgatgacatccaattcagctccatcagtacctctaagcccttgcttacccactcctaactaagcagcaaccaagagctagaactcattgtgcctgtgttttcatgaattgccttatttgggtggtggatgcccagatgtgttttatgttattttgtttagttcttcaataagatgtctcccagtagcctgatgtgattcccagtgggttctgagcagtgacttgactccggcttcctgtgtggcctcggggggaaaggggccattggaagtccttgcagcagcttcatttcagtcaggttaggactcaaaaccagaacattccagaaggcagacccgaaactatgaggctcctgtggaaccttctctgaagatccaggggctctctgaggaggagaggggggactactagagttacccctagcctgctcttactctgctcacctcaacccc

SEQ ID NO: 19537 - DNA, 1227 bp, Mus musculus
ccagggaagacctctctccgggagcccggctctcctagggtcatttgttgctcggttcccatacagggaactcaccttcttgcaaggctaaggctggggatttgagcctcgtcagctggtgggcatcaagagaggttcctggggatggcctgtaggaagggagttgctgggagttagggtctgggccctcctgcctcagccttctgtaaagtgggtgaaattggcttagggaagcctagcttttctagctctaacattcctcaaacctggcagagtcctatccaagccctaccaccttccacagaaggcatacacagggtccaaggggtccaaggcccacaccgtggacccatttgaggcctggttttcaacacaattctcagcagctcatctctccttgctttgactttggtcccatcccagtagggaaagggatgtcccatggctgcactggttataagaaactgactggagctgggcgtggtggcgcacgcctttaattccagcacctgggaggcagaggcaggcagatttctgagttcgaggccagcctggtctacagagtgagttccaggacagccagggctatacggagaaaccctgtctcaaggaaaaaagagagagagagagagagagagagagagagagagagagagagagagagagagagaaagaaagaaagaaagaaagaaagaaagaaagaaagaaagaaagaaggaaagaaagaaagaaagaaagaagaaactgactgatagacctggagaggtgatggagaggtgatggagaggtgattatgcagttaagatcaccatcactggctgctcttccagaggacctggatttgattctaactacgtggtagctgataattccatctgtaattctagttccaggggatctgataccctcttctggtgtctctgggtaccaggaacacacatgcatagacatcatttaggaaaactactcatacacatacaataaaataaaatctaaaaagaaatggacttgtaagggtttagggagagatttgtacagattggactggggcgacaagctggtggtacagtaacatgggagggtgggaaagcaggtcccaagccgcctctggaggagcagggcctgggaagagctgggggtggtccacatgggaaccagcttcagagaggacactccagacgacatcccctcactctgcaggagcccctgtccccagaggctaggcac

SEQ ID NO: 19538 - DNA, 1206 bp, Mus musculus
gacagcctgggagcttagcttgccctctagccatctgtgggtggtcctggacagcaagcacttctctgtgaggacttagcttctgtcacagctggaatgtcctcctcacctgctccagggccatcgaaccagtggatggaggttcactactggaagtcatggtcagggtgtcacacagcaaacaatgctcacaggtcagatcgtgctgtggaagatgtgcccaaggcatgtggaatactgatggggacagggagcagaaggatagacaagccactcttgtgtaacaggaagtctccacagggtgtagagccacacctgcataggcaatgtgcaggttaggaaggtcacagtgactccagtgtattcttaatgaccttggctattctgtcgcagatattgtaatcataatgataacagtacaaaagcaattcctgctagtgataggtggatagatgggttctgtctgcattgttgcttagaagttgaaaaacacataaaaagaaaaatcttgtggtaacatcaacactctgttccaagcagaggttagtgtgtccagaaaattgtttaggtcagcattaaaatagtcaaggactaggcatgctgatgtgagcctatagtcccagccactctggagttgcgaggatggcttgagtggttcagagtcagcctggaaaacaccaggacctcatcttagatgaggagaaatagatgaatgaacagacagacagatggctggacagtcagatagatggatccatatatgcatgcattcatgcttgaatggatagataggtagatagatgatagaaaaggcctcttcttcacttttaagagctccttataatcagagggagaaagggattttgttcaggttagcacataactagcactttaagaataaattaagtatgaagaccctcagtgtggccatgacatgcacctactggtctgtctttaactttgaccccatcagtagggcctgcttagaactgaccatgtcagaaggttggagaaatggttggtttcaaagcagctgtttggtaatttatagtaggaaataaccattgcctgctcagcttcttccaaaaagttctggtgggaggctctgcggaggaggagccctgtgggggtctgcttgggtggggctcccgagggatctagtggagtgggcttgttgggtgggtcttctgggggttgtctggggac

SEQ ID NO: 19539 - DNA, 2377 bp, Mus musculus
ttttctttcatgatgaaccaggccttccatgctgaccttctaccttcagactattctagagaaggtacagggccagctgctgcttggcagtgtctgtggccaacactgaatgcaggtgtttgacatgcaggagggacatgtcccagcctactggtagcacatgttctgtctccacagcaaccaggcactgcaggcagcatttcctttctccccgttctctctgcttgctgttgttttgacgctattctgcttgcttgtcttctgattggggataaggagtggctgggctcagacaaagctaagttgttgtgtggagccaggcacctgcatgagggccagcggggcatggctgtggggctgctatggggttccctcacttgttgttgatctgtgtctatctctgtgtgtgtgtgtgtgtgtgtgtgtgccatcttgctcatttctttgtgaatacacttgacttgcctcagttttatgggcagagcagcaggaactgggtctgtttgagatggtaggagaaagtctgaggttctggcctctcacccaggtgtggtaaggattctgtctgccctctgactgcagctgccttgctttgattcttgttgaaatgagctgagactagccaccactactttttcccctcaagacctcctctttgggggtgctgcattcaagcctgggtacctccaagaagagatcacagcctgttggtagttcattggcagatccgtgtcaactacactccctaaggagctttgaccctgaagcatgcctcaggaaggaaaacgtatgcactagcttgaaggcaactacaattgagtccaagaaaatgaagatttctctgtgccaatcactagactgctttttggagctcagagcctgtgtggcgacgccagctaagggtgtgaagacctgcccagaggaccaggaccctggtgtcccatccctttacgtactctctctgtgctggttggtgcctggcatctccatttgcctggttcttagttgtgtggtgtgtgtgtgtgtgtgttcacgtcacagcactaatttctatactctggtaaccaaccatacaaagtgcaagaattaagacccattgaagccaaggcagactgttctctggaaagagccctgcaccaccgagtgctatgtccacttgcttggaaggagccattggaagagcaaattttggaacttacacaattgtgtagaaaggagctggttcattgtaggcatttaagggatttctggtttacttcctaaaagtccatactgggagttaatctgtgggcctgagtagaccatgatggtggtcaagggacagcagtggaccccatatacccactccagagtctgaacatgtgattggacattggtcatcaagttgatgaaatctccctcaagaggtcaccgtccaggagcagaatctgtcgtagtcacaagatccccaggacactttgctgtttgttcctgaagttttcatcaaggtctaggctgcgcacatccctgtcccatggaagctgtctcacctaaagaaggaagtctcgtggtgtgtgtgcacctgcagtcttctccctctcggccctcatcctgtgggtagtcttgcagaaggaatgatgtcgtggcggaaccctgcatccttttatttaagacaatgcttttctctgtgttgactcatcttcattactgtagcatggttttattttctgtgttgcatttttttctttgtccctgccgtgtttcaacaaacaagcctgtatagaaaaagcagcctgggggatatagcactggttgtaggccgtggggcaggaagctgtgactgatccctggggcatgttgtagtacatggtgtagtggtggcttctgtatctacatgtctccatcacagtgaggctcaatcccagccagccaagtagatagttctttgccctgaggcactgccctggtttgccccgccactgaagctggcacattgcctgttttctctttttagacacgacagccacagtgtggtctctaagtcccaccagctgaggtctgaggaaagcagggtgactctgtcccctttgcccagagacccaaagagtggggtgtccagcctgcagagttgctctggctcctcggtgttggtttgcaataaatctgtgtttaagcagttctggttctgtctgtgacagtcactattaagacacttacatgagtggtcgttacccttgacttctagccgtgagtcctgcttccctctacacagtcaacaccaaaactaaatgcactgggttgtttctcacctggcctttcactgcttttagaaatcctataagatgttaattttttattgttaccataaagacccattcaaaatattgaaccaccctgc

SEQ ID NO: 19540 - DNA, 1429 bp, Mus musculus
agaccaggctggcctcgaactcagaaatctgcctgcctctgcctcttgagtgctgggattaaaggcgtgcaccaccacgccaggccatcattttttaactttatgtttctcttcatcatcttatttcttcttctaggttatgggttctattttctgctggtgaaacagaggcgtagataggtttaaaagcctaggtagtttaaaactccagatatgggatgagtgatggttaagagcactggctgtttctccacaagacccaggttcaattcccagcacatacatggctgctcacacctgtctgttccaggagatctaatgctctcttttggcctctgggggcatcaagcatgcacatggtgtacagaaatatatggtggcaaaacattcatgcatataaaattaaaaccaaaacaaccctttctgccatcttccttcgccgccaccatggtgtgaatgaatgttctggcggatgctctcaagagcatcaacaacgctgagaagagaggcaaacgccaggtcctcatcaggccatgttctaaagtcatcgttcggttcttaactgtgatgatgaagcacggatacattggtgaattcgagatcattgatggtcacagagctgggaagattgttgtgaacctcacaggaaggttgaacaagtgtggcgttataagccctagatttgatgttcaactcaaagacctagagaaatggcagaacaacctgctcccttcacgtcagtttggcctcattgtgctgacaacctcggctggcattatggaccatgaagaggcaagacgaaaacatacaggagggaaaatcctgggattctttttttaaatgtaaagcataaataaaaagcctttgtggactgtgaaaaaaaaaaaaaaaccaaaacaaccaaacaaaacctccccaaacaaacccccccgaaaccaagaacacgcaacccagatacccagatgtagtctataataaagatttcttttcttggctaagagatagctttggtggtggtaaaggttatatatgctggtgtttttgagcctctggtgtaggctggcatctttttagcagagtcttgtagtaactgactgttccctgttaatgcagtggaacatattcctgactgccttctttttgatctttcctgagttggccaagtctatgtcataatagataatgagtgtctttacattttaaatagttgtgatatttatggtttaatttgtgccttcttacttacaggaaaagttatattttatgcaatggtttattttctattagtatttcctatgtaataaagttgatggacacatcaacattgcccttctatggttttagaagtaaaactttacatatattcttttttcctcttatttatttatttatttatttatttatttatttatttagtgtatgtgagtac

SEQ ID NO: 19541 - DNA, 1183 bp, Mus musculus
tctgttattttgaaacgatctgcctcataatatttcatcttagtgttttcagcaagtgtttaaactttgtttccttctgatggtgtatgctttttttgaatctgactataaaaaccccgcaaacaccaacggctcagaattgacagtttcttctccctgtcccgaaggtagtgtgcaaggccctgggttaattccacagaagcgtttttaaagaaggaagagagagagggggagagggggagagggaggggaagagggggagagggggagagggggagagggagagagggagaggagagggagagggagagggaaagagagaagagaaagaaatcaggctgtttgttgggcttgccactgtgacttttactgattgttaactgtgagctggttcagcatgtcctctgtcctatttcttgtaagtcacagttggattaagggtaacatttttaaagttacaaggctatgtaatggaaataaattgttcttcctggagacaatttgttcatagtgttttttgtaaaatttattcgtgtgtgcatatactttgcctataatacccagtacatgtgtatacacagcacatctgtgactgttgactttgccacatcccctaaatgtgctctgatcgctcaggcttgataaacggctggtactgacttggtgctttctgttgccaggcaccctctccttagcacacatgtgcgtttttatagtccttaaaatgacctggggtaggactgttgctctcctagcttgcagtccagagaagtggcttgtgctcgcgttgctgctgagggtgtcatctgggccttttccccctggaatggctggccccaaggttctgcactactgttgaacttaccctcactggggatgcagaacggaaattgctgggccccttcactgtctaataggtctgggtgtggtttgtatatcttgtgaattttcagaagcttttcagtgactgacacgtagtagccagggtttttcttgactgctatagagtattacaccctatggattagagtcattggagtcattatctaatgggtccctggggtggggtgtatttaagctgtttacaggatgctggtgtcacagatgctgctgcagcgaatatgcttgtgtgtgtttcttggaacatgtgtacgcgtatcagttgggtgaattcccagaacag

SEQ ID NO: 19542 - DNA, 1101 bp, Mus musculus
ccccttctcctaccttggtcccaaaaagtaatgacaactaaagctgtctagttttgcatcctctaggtttgtacatacagttagatttgacttattttgagtttattcattttggaaacttcttgaggaagagcaattcctaccagcttttggtgaagttgtagagtgtttccattttgctttggtttactgttatttaattttatacttagaagattttgttatatttctgtggtggtgtggtctgatagggtgcagatgaatttatttatttatttatttatttatttatttatttatttatttatttttgagacagggtttctctgtgtagccctggctgtcctggaactcactctgtagaccaggctggcctcgaactcagaaatccatctgcctctgcctcctgagtgctgggattaaaggtgtgagccaacactgcccagctgcagatgttgtattgatgtttgtttcatttttaggtctttaaaacatttgatcacatggcccgccaggatgatgagaaaaggaagaaagaactagaagagaaaataagaaaaaaggaggaagaggccaaggccttgccagctgctgaaactgagaaggtagcggtgccggtcccagtgcaggaggtagagatcgatgctgctgcagacttgagtgggcctcaggaagtagagaaggaggagcccccaggctcccaggaccccgagcacacagtgacccatggcctggagaaggcggaagctccaggaacagttagcagtgctgctgaaggccctaaggaccctcctgtgctccccaggtaggagcatctcctgcagtgtcgtcctctctgctgtgcttaagtttgcctatgagtggtttttgttttgtgtggtttgtaaaaaaatatcagctctgttttggtgggcagtggttaactatagaaattcatttcttaatagttctggaggctggaaaccccagattaaagtatgatctgggttgtttgtttgaaggcttctatcagtggtttgcagacagccatcttcctgtgtctcgtcacattcctttgttcttgcctgtgtcttattctcctattctcaagcagcactcaaa

SEQ ID NO: 19543 - DNA, 1144 bp, Mus musculus
cgaactcagaaatccacctgcccctgcccctgccccccccccccccccccagtgctgggattaaaggcgtgcactgccacgcccggctagtattagaaaatgttaagaacaaaagtagtctagtcagtcaatgactaaacagacaatgactcctggagtcagtgtgaaaagcatggctaagtggaagtcttccttataggagtcaggagccacctgtttctcacttctcttgtaacttattggaaaatcttagaggagtcagttcccctcttgtcttctgagatggcatattgaaggcaatggacttctattccaacaaggacactgcctctagggtgagtctgtgaacataggcagctggagctctggagtgttgtgagaactgggtagtgtagatgggcaggtggaaggggagtcgcaggaaggctgagtgaggactgtcaggccttggtttggagcaccctgaggttacaggagagtctttactgcctgacttcttgtagttaagttgaagatttaaggtgttagagatagagtgcttttgagtacaaaggactcagacactggtagcatggatgctagagagagtcaaaccttcaagctaccagcagattagaagtggtttttgactgtgttttgttttgttgttgttgtcgtcgtccttgtcgtcgtcatcatcttcttcttctaaagatttatttatttattttatgtgtatgagtacactgtagctgtacagatggttgtgagccatcatgtggttgctgaaaattgaactcaggacctctgcttgctccagccccacttgatcctgccccgcttgctcctgtcctaagatttattatatgtaagcacactgtagctgtcttcagccacaccagaagagggtgtcagatctcattacggatggttgtgaaccaccatgtggttgctgggatttgaactctgctcttccgaaggtcttgagtgctctgagccatctctccagccctgtcttttttttttttttttgaaacagggtctgactgtacaccctggctgggctggaactcactatatatcaatcacaatttatatcaggctagcctctgcctcctgggtgctgaattaaagatgtgtgctaccatacctggcctttgtctcc

SEQ ID NO: 19544 - DNA, 1228 bp, Mus musculus
attattataacttgataaacttgtccatttttttatcctcataaaagagcagtgtatggactgctctttgagaggtctagagttcaattctcagcaaccacatggtggctcacagccatctgtaatggggatccgatgccctcttctggtgtgtttgaagacagctacagtgtactcacatacataaaataaattttaaaaaaagaaagaaaaagaaaagaacttagttctatcgtatgggttcattgagctatgttcctttctaagaaagatttgtatgaactataagtcttttacccttccccacagctcactggatctgcttaatgacttgcttgtgttattattccaggtcaggggtcaccacattgcaaaacttgatcctctcggaattagttgtgtaaattttgatgatgctccggtaactgtttcttcaaacgtgggtgagaattaatatgtaaatgctaattttaatgtaattttactttttttttgccccttccctcttttttttctcctgtccttttgtgtgtgtccttccctctcatcgttggcccactcatagatacgagggcaccatgtagcacagctggaccccctggggattttggatgctgatctggactcctccgtgcccgctgacattatctcatccacagacaaacttggtgagggtctgcgagcagtcagctgcgctgcttgagcgcctctcgctgtgcacagcctgtgctagccaggacatccagacagcagggaaagactctgaagtttccttcgttctgatcacttgaaattcagcagtcagatagtcttagtgtgctttaaggatattatttatctcaagtttcagccagattgttttaagactcaatctggaaaaaaattttcaaaggaagggtctttggcaccaagaaaacctggctaactgctttagatagtagctcttctgactccagcttttcatatcctgcacaacaccgcctatggtaaggccacgagccctgcaaggctgctgttgtcatgactgtcccattctggagtatggtggggcctggtgggctagagagtgtttattttcctaaagagcaagttccagatcaagctgtgctatttaggttccctgatttataaatgctgtgatcatactgaggaaactttgggaggccttccctacagcgtcaggacaccagggcctttgggaggtgcatgtgtggagaattggggtttt

SEQ ID NO: 19545 - DNA, 1700 bp, Mus musculus
gaagtatcccaatgctgagctggcctggtgccaggaagagcacaagaaccaaggctactatgactatgtcaagccaagacttcgtaccaccattgaccgtgctaagcctgtctggtaagacccaagtccttgatggcctggaagatctggaagcaagctagagaacaggcaggagccacctctgacttcatccttgtcactccccctctctgtttctctcaggtatgctggccgagacccggcagctgctccagccactggcaacaagaaaacacacctgacagagctgcagcgctttctggacacagcctttgacctggacgcattcaagaaattctcttagatgctcctggagttgatgaggccatggcccccatgtccatgacgctctttgcttctcaactaaagaatagtgcctcagcactgtccacacgtcccttcgctgtgccacaccacccctgttctcataggaattaagttgtccactgcagtgctcagctgctccccggtcacatgctgcccagcctgtgccgacttctctcaggctgcacaccgttcatggagaccggaaggagcagaataaggaaagggcccctctcaggacatcctagagaaggaaggcagctctggccccacccatgcccccagtgcaatcctccagggtaggaacagaaccctatgtggcttcccagggtactagcactcagccctcgtcacccatcaagtcgcagattcaaggccaggagtagtttcatcttgctagggccaagctgagagctcatggaggaactatagctgccaggatttgggagtcatcaggatgttgtgtgaatagagattgtcatggggtatttagaggactttagcagtgatgttagtctagccctgctacccttcttgggtttgggctgtatgtgggaaacttaccccagctaccacgcctggagagcttggctctgagtacggcccagaagctccattggctcccaacgccaggcactgctgcctcttggtcctgctgcctctgctctcctgacccctccccagtcacttcattttctctgttgttcccttgaacacacagaagctgttgacgaattcttttttttgctgtgccaaggcaggtcaaaagcagatcagtggataagagcaagttgtcccaaggagccagctgtccttcctccctcttttgacctccactgggacacacctgatttatttattttggttaaaaaaaaaaaaggaaatgaaaaaagaacaaccacctttgcattgcatcggcttgacccataaactaagttatcatggccagcctgcctgctgtcgtgtgttccgcctcctccctgcctgcctgagaacagtcttcttgttggggtgggggggtcccagctgccatttgccaactggatgtgtgccccacagctttctgttccccctcatgggcagcagccattatcaacagcgcagcctgggccttcagcatctcatttcccctgccacccattatcttggttttaggcatgtctaataactacagtcggcaccaggagagaatgtcctgggacaggaacaatgccccttactctcagaggtgggactcacaggaccaaagtttgtatctgcctgtggtcggcatgttgctgtctggtatccccttctcccttgggacagccaggctgttttgcatacaaagctggact

SEQ ID NO: 19546 - DNA, 1100 bp, Mus musculus
tgatgccctcttctggtgcatctgaagacagctacagtgtactttacatataataaataaataaataaatctttaaaaaaaaaaaaatagaaagcaacgtgctactacaccagcttagttaagtccacagggacagctatctccacaggcctggcttattagacaagcttctaataccaggcactgacacccccatgaaggagtcttgaatcctttaacaactaccacaacacacacacacgtcaagacactattacacacaaaggcatatcatggtgttcctattggtctctttgtcctcctcttatcctggctaaccctccatctcacctgcctacatttccctcctatggcatccttcctttttgcctgtgtctaccatctcatctcctttcagaaatgcccttcccgggctggtgagatggctcagtgggtaagagcacccgactgctcttccgaaggtcaggagttcaaatcccagcaaccacatggtggctcacaaccatctgtaacgagatctgactccctcttctggagtgtctgaagacagctacagtgtacttacatataataaatgaataaaatctttaaaaaaaaaaaaaaaaaaaaagaaatgcccttcccttgtgcccagcttgcataggtactccacattagacactccatcctaagagttatataagagagagcatgcagtttgtccttttgggcctcggttacctcagagcaaaagagaaaaagaaagggaaatgggggaaggatttgtgtgaggggattctgggggaggggaaggaccgatattgggatgtaaagggaatgaattaatttataaaaaagaaattggtctggcaagatggcttagcactgactgctcttccaaagttcaaatcccagcaaccacatggtgactcacagccatctataatgagatccaatgcctccttctggtgtgtctgaagactgctacagtgtacttatgtataataataaataaatctttgggccggagcaagtggggctgactggatcaaccaggatgactggagtggtcagaggtcctaaaaattcaattctcaacaaccacatgaaggctcacagct

SEQ ID NO: 19547 - DNA, 1093 bp, Mus musculus
aagggaaccagttaaatacgctctgttacattaaaaagatttaatgctcctgttgattatgtcagagaaaccaagctcatggaagatgtcccatctgtactgtctgggcctcaccaggctccagtgggcagggtcccaagtagaccttgagctgcaggccagcaggagccatgctgattgaggtggcacagagatagagtggctcagaagccatagcatgccaggagtgtcttgacagaaaactagacagtggtcgagcaataccagagtgctctgctgagggctgaggcagtgtggtaacaaaatagaaaagcccctgcctatgtgtcagcactcaggagagcctcgctgccaggatggtggctggcttggctttcttccatactaagctcttccttccctctgtgcctgcactccttgaattcattcttagacatgtccccgagctgggtccaccttccctagctgctcctcccaccctccatgtaacatccctcactctgttgcagtcccacctcttcgtgctgcagctggtgcaccgtccgtctgtccgttccgtgctgcagggcctcctcaagaagcgcctattgccagctgaacactgcatcaccaagagtgagtgctctctactcctcaaccgcctgcctgtgctgtgctcggactgacccctgctctgtggcccagaggccatttcctctcagactgctagttctaaccctggggcaacggttagctccaggctactcctgagagcctttgcttgagcagtgacagggtccctggttagcccacggtgttggggtcctttactcaagtcctttcccctgtcaatgtcagtaaagcggaacttcagtagcggcaccatccctggcacccctgggcccaatggagaggatggggtggagcagacggctatcaaggtgtccctgaagtgccccatcaccttccgcaggatccagctcccagcccgtggtcacgactgtcgacatatacaggtgtgtggtccctgtagacatttgttgcccttaagatattttgagcttgtggagaaaccagtattgactggaatctaggtggaaactgagaaaactgc

SEQ ID NO: 19548 - DNA, 1787 bp, Mus musculus
cactgggcctgaggccagaacagcttggccactggaagtgaagggtctgcgctgcgcccacagctgctaatgtgtttgctttgccctcagctgctcccagaactgaccaatcctgatgaactgctctcctacctgggcccacctgacctccccacaaacagcagtgatgatctgctctcactcttcgagaacaactgatcctgtggtgacccctggcctggcgaagacacactcaaagatgccaccacagccttcccttctcacccagccccacaggctgcctgctggttctccctgaactcccaatgcacacaccctgagctggggcctgccactgccagccctgatgaactggaagcagccctgcgctccatggggccccaggccagtgggcctcacagcctccctccatcaagctcactgctccagaatggttcttgtgaggtgcctgcaggccccgtcagccccacgtgcacagccctctgccccagactcatggccttgcacttgtccttccaccctgcctgctcctacccagcctgcatcttgtccagcactgatccttctgtttctgttcctcctcagcagagctggctgctgaggctggctctgtacccttggtctgcagctccagtgcctgagcctggcagcctcagaaccatacagagcaccagccttagggggcctggcgctcccacccagctgaatctggtttaggggttcctccctccaccctgagctccaggtggaggctggggtgggagcaataaagcacaacaatgtacatagtgtagaaatgccaacagctgggaaagggagggaccgctatttcagtcagcatgttcctctggactggcctgcgccttccatgtggtgtctgccccttactgagcacagacagctcaggggaggttcaactcctctaggggtgggctttcaggctcagctctatgtaaattctccagtgagctgctcccccaagtttctcttttctgtgaaagtgaagaattagtacagctgtgttttttaaaccacctcatttccaccctgcggcccacacccaggtgggggaggccattgcatctgctggcaaagcgcctgggcctgcaagcagggtgctggcctgttgtgtctcctgtctgtgcaatctattaaaggactccctcttggtgggcttggctgagtccttcctttgtgctgagggtctgtggcctttctgttcttagaaccccaaataataaaaaatctagatgttttcatccaagctcaggatatccctgagctgtagtaaatttcctttcccctggaattttccaagttggcttcagctgcagagctattttgtaaagcgtctcaggcttgccctggagacatttgccaccatgtcaccttccctgggtgtgccctagggcagggagccagctatctgacaagtgactgcagcatgaccaggggcctcaacagcagtagggattgagcctgtgttcactgccccttcttggcctgcgccctgcctagacagcatttcctgtgcaacaggaaaggtgagaaccagggaggggtgaggggaatcctcagctggctgccagagccttccctgcagtactggaggaggctgccgggcaagagcaaggaaccgcctgcagaggctcagtagctgtctgacatttgagaacacaccggtgggctccctagggaggccgtttccagcttttctgtcctcttggctgagagtgggggagcggatagaagtggagaagacagcagtgggccagggccaagggaat

SEQ ID NO: 19549 - DNA, 1256 bp, Mus musculus
cgaattgagtgccactctgggttcctctctgctccttgtcatagtgatctgagtaaatacttgttctcccacctgtcctgtgtagtgctatttttattttagcttgttctttaaatgatgcgatacttcaaaccttaggtttaaaatatttccccatctgttttgaactatgctagagaactgccatgaccctgagcagttgtctaatgtggtagacgtggcaggactgagctagttgtgtgttaggaatctgtcaaggtgtgaggtgagttggcagttctcagctgttttgaacataccttacagatgtcatggctgtagttagccttgtttactgttcctgtagaagggttcacaggctcctgtaggttcagtaggatccaaatgagaagggtcttaaataagttcatccttggtataatcgttttttactttagctttaaagctttaagatttaaaggacattattaaaaataacaactcatactcattgtgttgtaggcgtgatcccgcacatccacaagtctctgattggaaagaaggggcagcagaaaactgcttaggacgtgagtcgctggcctgctctcctcggtctgtaacagggcagaggggactagtgcggtgtgcggaagagcatagacggttgctgtagacgagacaaaggccacatctgtatgtttttagactcggagtttgatgagtccctttccctgtggtcacagtcatgtgttgattggccaggtttctcccttgtgttttatacaaaagtagaattgataaaacattttttacaaaagtactgtgtctcagtatttcttcatgatgtattagaaatacttttttcaaacctggccagggccatgttgcctgcatccccagcgtttgggaggtgtgggcaggaccttcagaatacacgctgatctctgcctacattccaagttctaccacaacctggactacatattctcttcagacattgacgttttaagatattcagaataatcttaaagcaaaaattggaatgtagtataccttgattgttacagtgttagtttgaatctcagatataatcaatttttagaaatatatatttattaacgtatacagtgttctgcctgcctatatgcctgcaagccataagaaagcaccagatcccattacagaccattgggagccaccatgtgggtgctgggaactgaactcaggacctctgcaagagctgccagtgatcttaacctctccagcccttatcaagg

SEQ ID NO: 19550 - DNA, 2425 bp, Mus musculus
taaatttgtatgtgaacaaatgggagccagtcatcaattttgaaacttaaatttggaaaatggaaaaaaaaataaaattgcaccataaagatttatttccgcagtgattcccatttgctgtgtgtactcctgacccaaattaaggcctttatgaatgtattttatatttcctaatgaaataggaaatagccaccaatgtaatcacataactactttttcatttgaaaagcaaatgcctcttaaattagacattccaattggaataggtagagccattttaaaacaatagtaaatgccatatttgtagtttcagtaggacttctaataaagagaacagatctttgttagaagttaaagcctttttgtgattttaacactttgaagaaggattttaactataaacataaggttctgtgaacagattttatgcccactacattactgtcccctggcatggataagagggatcatttttgtcctctagtaaatgggtctcaagttctagagagaaaacagtagtaggccttgctcagtgtccaccatgaagtgcagaaggcacaggtgtgacctttccccaccttcaggaactcttcactggctaacgttttcaacacaatttttatttcttaaaggcaaaatattttgtgtcctgtgttgcaagatcacaatggttagtaaaatcttagtatttggaaatagaataagcttgtttcttcccttttaaaatgtctgtctcagaaatataagtccaggaaagtccaagaaaatgagcaggggcatactctgagcatggtgtatgtgggaatttggaggttttgtaaaacccttttctccaagcccatgtcactatccattgaaccaaagtcctcaggagtctggaaagtcgggaggttgggccaaaagtctagaaacttggctgtaggtcagcgtgacacacttttttacagagtctgtggttttgcatatttttttggcaggcaagtatattttagttatttttctgtgaccttgatatttgaaattaagattgtcagtgtatttggactttttttttcccctgaagttagaacagttgtattaggcatttactcttgtgaatctttatgcagatgtcttaccagtcttgtgaataaagtgcagatgacatactttgtattgtaggaatctcactgcccatcctgtctgccagtggctctgttaggctaggttcttcactccaaagctgggacttaatgtccttctagttgggaatcttcagaagtaatttgaatgagttcaaaccaaatcttgatagcaggagacagcttcctggtctagatgtacaattagcttaggttggaattaaagagggtttgggaatgtctttagtctctgtgtaaataccaacgtgcttattatgcatcgtaaaccagtgtgtatgcctgtgtatgggtctgtagagctggtttctgcttcaagtgaagctgcacctttgattttataaggtcccctccacccggaaccctataaacgtttgtaaatagaacactaaaatttgtagcgataggatcaatttgggaaatatctgctgagagaccaaaaagttcatttttttaagtaccttggttaaagagtaaagattattcctcttattttttaaaagaagtatgcactttaacaaacacagctgcatgggcaattcaaacaaatccatgaagtgcagtacccatccagaaaccacacttcctgaaaaccgttcaaagcagagtccagacgggctggtgatctcactgcctgtaggttgaagctcagattctgataaattgtgagacaagcagggctgcttcaaagagcaatgtgaatacagccagaagcttcagacaggtctgtaaaatggcgggtcccgtatttaccactaactagcaaaactgacagaaaaactcatagaaataaagttaagaatccttcctgctggtgtgcactccttccaatagcagacttttgcaaatggagttttacagtctatatttaaaaaattgtatgtttgtaacaaataaagtatgcggaaaagtgaatgacagtcttgtgcccttgcctcttatttaagggattgcatggtgattagggaaggaactattatcatcctttgtagttcacaaatggctgtgggtttgaagaagtccccacttgaagtgacctgaaatctagccatgttcagatcatccgggtttctgttgaataagtcagagcagattagaagggctcacaaaaacttgctgcctcagacgttccctcgtttacattgaactgactaagcagcaaattaggccagtcttctcttgcccaaatgctagagggaaaacaagaagatggtgctcagtggtcttggccagagagtctcagtctctttgtttcaggaactgctgtatccatatccaagggaatc

SEQ ID NO: 19551 - DNA, 1099 bp, Mus musculus
ttttgtttttctcttttctttttatttggctgaattgcagtaactagccttgcctttctattctgtagaaatgacagggtcttcacaatccttcaccagtggctactaagctataattagctgaatagaaagaatgtggaagtggtctgaggcatatagagtatatgccaagaacactaccatatatggcatcagctttggttaccagagaaattttcttagtcattagaccatataacagtaatatatcatatgtaaatctttagatttcaatttgagaatcctccaaaaaaaggagcaaagaatgcataagctatgtgttggcaaaagtaatttatattaaaattttgacctgcctttgtaagattaagtggtaaatgtcatagtggtgggtttttatgtcttaaccaatctctgaggtttatttctcctgcaggggatggttcatggcctctcttcccactgtaggaagatagcagaaggatgggggttaattgtagcatttcactgaccctcatccagggactagggacaatagaaatctgcaaacatggagagtcagtcataaatactagctttttgaaggcattgttggtctttgttgatttctgtcagaaaatggcattgtacaaattatgggaagcaaccaacttttctgttctgtttttgaagtgctactatgaacgattcagagtggtattttttttttcttttaaatttggcagatagcccagctaatgaaaaatagtcacattcctgagaagttggagctaaaactccaaattattgttgaaatacttgtttctactgtatgtagaaatgtatttttaagaaaatcaaagaggaaaaaaaaatctatgcagagaccctactactttgtggtttctattgtccctacacatcatttcagcatgtctataatggcagttcttgtcagcaagtccttcagtgcatatgctgcacaaaacaaaacataaatctgcacggcaccaaaaaccaaacaaaagcaaaccaaaaacccagacaccctatgtatctgttggaggcatgtaggtggtacaaatgactgtagccatgagcacacatggcttcttgtcat

SEQ ID NO: 19552 - DNA, 1099 bp, Mus musculus
gaatccattactaaaatagtttaaaagttggcaattttttttttcaaaaacaaaagcatttttacaatggggattgctgaggtgggcacaagaagtcaggcataaagcacaaagtggactgtttgagtggattggttgctgctcattaaagttcttcccttgatctcttaagtatggaggtctttaccaagaaatggcttagcatgagtgggagctgaatcccagtggctccaccgtatgaaccagagaattatggctaattcggctgttacagccactggctggctgcattttaaaccttaaaacttgactatctgcaaaaaaggaacagtgtggctacaagcctgagctttaatgaaatagacatcctcacagagaagttggaaataacagaactgaagtcttaatttaccttcagtttaatctgtggatttattgaaatactgacgatcctcaggtccagaattccagcatcatttattcttttaaaataaatttttaagaacttgatccatcttattcagtacctcacaatcaaagttggcaaatgatggatgaatgattcaagcgttgcacccggtagaagctgaatccatttgtgaatggactgaagtgaacgcgaatgctgactctatcctggaagcatttttataccatcttgaaatttcaacaaactggcacttgccggtttatccagctgtctttcaagaataaaagttggggttttcaaggatcgcctcttctatattttaaatggattttcagtataaatgatttttctaatcaagttaatcccaccccatcaaaaggtattcctagaaatgtcatagacctaggcaactttgaattgaatgggagctaatgttctttccaaagtttttcaggtatctgtgtgacaccttctcaagaaccaggaggcaagtaaccccacctccactatcttagtattttttttaactgcatgcctgccctttatttgagctgcctttttaatttattgcatatcctttttattatcttattttggtattattcaatctatacaatctttttgtatttattcggaaataagtaatatacaaaaaggtcattttttgtg

SEQ ID NO: 19553 - DNA, 1165 bp, Mus musculus
gacggaaatcctgcatttcatagacaaggcaaaggtaaaagcctgtcccatcccccgctcccccaatatgcttttctacttagcctgcatcagcccctggtcccctcacctgtgacctcagcctgagagggacggctcagctctgtcactttgtgggtgttcttggctatacaaagtcttcagacaaagatggtttcttagttgggacctttaatctctagacttggttttgggctcctccccaaactcagttttaagatattctaaatttccagatactgatcaaaaaaaggtagttccagaagaatccctcacatgattcaaacatgttgacattctcggggcgagtgctacttttttcgcctctccttggcttttaaccgaggactgtagccagcacagtgctcccagaggagagctggacacagtggtccagcgtttctgatgcttgtgattctttgcagcggtcccaccagcttcctgggcacctgactcaggagcacgatgctgtgctcagtctgtctgcctacaatgtcaagttggcctggagggacggggaggacattatcctcagggtgcccatccatgatatcgctgctgtctcctatgtccgagatgatgctgcacacctggtggtcctgaagacaggtatggattggctggctggtctggaggtccacgtccaaaggagaatccctggtttcctgccattgtgatggtttctgcagctccaggctacgcactgccacctgctacggctataaattagatttcctgccatgagctctgtcccagggtccctgtcacactcagggcctttggagacttgaggaatacagtattcagggtcagtgtttaaataaggtttttcttgggccaggtgtgctcagaggcaggtggatctctgtgagtttgaggcctggtctctaaagtgagttccaggacagccagagctacatagtgagaccctgtctcaaaaaccaccttcctcctggtgacttctcagtccctgctccccataattgatgttgcctccactgcttagatataggtgatccccagaaagaagggtggtgaccgaaagctgtaacagggacttcctctgagcccaaccaacatttgttttgttgttttgttgttgttttgtttgtttgtttttaatgag

SEQ ID NO: 19554 - DNA, 1178 bp, Mus musculus
gccagagttgtcatccaacatcagagagattaactgtgtctgtaggacgtggtcagagtagggggtgctcagcatctccaaggaacgggtggtcctaataaatcctttggtttggtggaagccagctatcttcccaggctctgtatctatctcctctctctcgtattttgcacacacatacatatcctcttccctagctctccaggattctaccgagtgggctctctttccccagctcccccataatgcctgtgtgctgtggcacagcagagcagggctgacttgagagacagaaaactgagacttaaatgggtagggtcctggacacttgagcttcctgggaaatgtacttggagtgtatagcagagttgtgattactatcttgagaggtgcccacaccaccccccacccccacacccccgcacccccgtgccactagagaacatctgaagggaacaggtgctgtgaagacatttggaaggccctagttctgggacaagagtaaagtccacttggctgatgctacaagatccatggccagactcattctcatgactactacagccaacccagggaccgcccttcaggtggagccctgggtcccctgcagctctgagtagcagcaggatgtctaccttctaccctctgcaggagtctcccatagataaggctcgcccaaaggggagacttgcaacaaagggggttattaccctacttggtacattcctcaaagcaccagtcctctgtgtgacttagcacttctattgtcctgacagactcttggttaccacagaggtgagggagaagcagaaaagcggctggaactggcttacaggaaggagcagctggccacaacttgtcttaagttgaggtgggttggtagtgctgacaacccagttggggaagtcttgtgtatgaggaaataaaagtttgtgctgctcaccacatgggccactggcttttcttttgagctaatggagatctccagctaatactcggtggcgtggtcagtggtggaactactgcagagccaccctagctctggcaatcggaagtcagctggaagatatgcctgtcaccacagggttcatagaacacctggcccgtattcaccaccgatagatagcgtcagtgttccattgctactgtcttctctaggaatgggtcatggggacatg

SEQ ID NO: 19555 - DNA, 1049 bp, Mus musculus
ttgtggtcgctggctgagcctgctcttcactgtgctccttgcgcaggtgcatgagaagctggaccccgtgctggggagcctggagccggccctgcaggtggacctggtgtgggcgctgtgcgtgctgcagcacgtgcacgagacagagctgcacacggttctccatcctggactccacgctcggtttctaggtgaggcttgtccctgcactctactgtaacatggaggctctgctctgcccgccagggaagaaacgggagcagagacagaagaaggccagagcacaacctccggccttttcccaccactccctgcagttggcctccgatcttaacttgggaacaccagcccatggctgggtggaagctactgctgtatctcctgtggtccccattctgcatctgctgctgtacatcagcctacctttttctctccctcccagagagcaagtctccaaaggaccagagtaccttccagaaattggtccacatcaacaccaccgccctgctggagcaccctgaatataaaggccctttcctgccagcctcagctgtagcccccatcccctcaccctctaataaaaagatgacacccctacagaaggagctgcaggagacactgaaggcactgctggggaacactgacaagggcagcctggaggtggccacacagtatggctgggtgctgggtaagggttccccttctgttgggaaaaagtctaagtcgtcttcctttttttcatgtatgtgagtacattgtcactgtcttcagacactccagaagagggcattggatcccattacagatggttgtgagccaccatgtggttgctgggaattgaactcaggacctctggaagagcaatcagtgctcttaaccactgaaccatctctccagcccccagggtctaagtcttacaggggcctttgtaaccctgcatggtatatcaagcaacaacccggattactgtggggtctctgaggcatcacctacagcatctcaccctgtcccctccctgcagatgcagaggtgctcctggatgccgacgg

SEQ ID NO: 19556 - DNA, 1183 bp, Mus musculus
gaagcttttagattgagtgtgctcagccagcaaagtctatgccagtgtttctaaatctgacaaaaaaagaaaagagctctgaagtgcttctggctgctagcatttcagatatgagagactcagcatgcattcttcacattctaaaataaaggaggcagatgtgctctggggtgggaggttccgagctgcaggaatgtctggatgcttatggcttgggcttccttctagattgcttgtcttccagaaagctgtaccatgattagagtgggggagactgtataagttaagtggatggggactcatttcaaacaagtgtccctggaccttgaagatccaggcagtgttggctaaatggagagggtgggaaagatacagagtcccagtaggaggagagggtattgggggccgtgagtggagatacccatttgagcctggccctggccactggaggacatacacaaacatactcaccaacagcatctctgtcaatgaccttgtgctgtgttttgtcccaaaggaaaaccactgtcgccgaatcaagatccttggtgactgctactactgtgtgtctggcctcacccagcctaagacggatcacgcccactgctgtgtggagatgggacttgacatgatcgataccatcacgtgagtgttgcactcatacaaggtctgtctagggctgcagaggctgaggcagctgtaggaggggactgggctacctacactggaagatgatgcgttggtgacccctgctcacagtttatgatgtatttctttgtccagagaaatcctttgtgtatctagtgtgcctgagataggggagaagaagggatctttgtaactgagcttggtggggcactgggaaaggctgagggcatgagcccgtttaaaagccagtgaatgttcttctgggcagatgattgcctcccatgctttggggagagagggctgaagtctgggttgaatgtgttctcctgttaagacctagcctatggaacccggtgcgcagaggaacatccatacagttggagctttggaacaggcataaggaaggagccagcaacatggttgcccaacgttggctctgcaggagatagctctctggagctgctcctgttaaaggccccccagaagctgatggactccgctctgttactgagagtgaaaaagttccctggtgccc

SEQ ID NO: 19557 - DNA, 1179 bp, Mus musculus
gctgctcctctgggtgtggccccagagatactgtgttgggtctgccttgtgtagataataggcgacctgtaagagaggagaatttgaagagtctggagtcagaaaactggggatgactgggctactttgggtccttcgtcctttctgggctcagagctgctgtgggagaaacggctttgggctcagtgtcagatgatggataccgaggaagaacaagctagtcctgagcccgggggctttcccttctatattggctcatttggtcttgagaaagccatggggtgagcagactgctctccgtgacagtctgttaggcagaggcttgccctaccacctagtcctctggcctgtgggtcctcttgggtgtagaacaaagcatgctgggacaagggagctttgaggtgccatttcctctgagccccagcgcttttcctctggcttgaagtcttccttgctgggtacctggtagatccctgggtactgacggtattttcccctatgcttgtgtttggtagatattcccaggcttgattctctcggatatcaaaccagccaagaggatgaagttcaagactgtgtgctatctgctggtgcagctcatgcactgccggaaaatgttcaaggctgagatccccttctccaacgtgatgacctgcgaggatgacgacaaggtagagaaggctgaggtgccgctcggctggagcactcgctgctgctgccactgctgctgcacacggctttatattgcgttgtattttgtgtttatctaggtctaagctcacattccccgctttcttcttttatttttcctggaaagcctattatgtggctattggagttcttgagctgacacaagatccacccccgcccccccacctctttccttctgttttctgcaaagggtttctcaactctaccatctaacatttctatacaacatttcaaaattcttaaacattccaggcagtctttgtttttttatgaataattcccttatggagttgtattcccatgtcagaaaccacaggcttgcctggaaactcactatgtagctgaggatggacctagaacttctgactctcctcctctacctcccaggtgtggggattacaaatgtgcaccatcacatctggttttatttcacgcaggggattgaacccagggattcataaatatgcc

SEQ ID NO: 19558 - DNA, 1197 bp, Mus musculus
aacacaaggctatgaggatggaaagtgagagtgggctttcagaacactgggccttaaagaaaaccatgggtgacaaggggtcctgcgggggggggggggggcatcttttgtcatatctatctcaggccaggagcccaggactggatatgtcagtgggtgcaggccatgagaaaactggcaaaggccatgaggaaagtcactgtctcttggccaaatgatcaagaatgggaaaccagaaaagcacaaataaccacacaactgcagccaaagaccacgtgaaagtctattcaccaagaatccgcaacttcccaattacatcaaatttagcctacttcctgaacctgcataacaaaatggtaccccactgcattgcgttaggactaaggacactaagtaccagaggcaaaaaatcaccttgatccatactcagaagtatttcctaaaatacaatatctagttcttgctcaaagaaaatcatgatgtaaacattaacgtacagggatcacttcctagtctagtattcatagctcaaagcatcgaaatcaatggtaaaatcctatatagcttaagagtttgaaagccgggcgtggtggcgcacgcctttaatcccagcacctgggaggcagaggcaggcggatttctgagttcgaggccagcctggtctacaaagtgagttccaggacagccagagctatacagagaaaccctgtctggaaaaaccaaaaaaaaaaaaaaagtttgaaagagaaagaatgaccttgcttaagactattgtctagcttaactattaagtgggaaagaaacaccatagcaccgtttaaagtacatgttatcaatgaccaagaaaatccaagataatttaaaaagtcaccacaatcggtttcagttagtgagacaagccattatcttcagtaaataaactcatagacgataatcatctgtagccatttttaatcaaaaaagctcgggagacagcccagagaaagttcaatcagactggtaacaaggaagaaaacacacagtatccagcacttggcaatactccaagcttgtgaaatctgacactgcagaggcagaagtcagggtttacacacaccatggacagagcaagatgcctgggagagcccaagctggcagcagcagcagcactccaagataaagcagaggctttcccagcccagcagtctcaccacaacc

SEQ ID NO: 19559 - DNA, 1086 bp, Mus musculus
ataggtggcgggaccttgggagtatcttccatggtcacagcaaaagctatggaggtcaagctggcagaggagcccaccatgactgagccccaagtcaactggcttatgggtggctccagccctggtaagccctggcttatgggtggctctagccctggtaggtcctggcttatgggtggctccagccctggtaagccctggcttatggatggctctagccctggtaggtcctggcttatgggtaactccaagcctgggtagcagtttcaagtatgagtgccagactgggaagttggccccgctgggcagggccatgacagttgagctgttcataccatgggcacagcaaagagctggtcaggtcttggtcagggcagtatgggaagaattgaaaagacacctcttactgcatgaagagcggggttgctggctttccccaagagtaggctcttgctaacagccagaggcaggtcttctggaattctcgggaggccctacagccccacttctgatctcctggcccgtacattctcttccaacccctcctggctgctggcttctgactgctgcgacagtgggccctcctcttcctgtgccatggctgcacattcagagaggaggggtgtgtgctgtcttctctgtggtgtcttggacgctgtaagtctaacaagaatcaagccttcgtttatgctaagagcgattgacccactatacccacgagtgctctccttgctggaagacatcctctccttggcctaaccagctctcctcttggtggtttcagagtcggcacagtgtgcattcctgagtctaggtgtggtgtccctgctccagggtgatgggaaagagtggccctgttgactgacacctgggacctcccacctgtgtgtcccagtaactgcaactgtgaggaaatcccgttagggtacaggattctggaggagttggtaggaagcaactggctggaaatagcgggatgaagcctggcttttgaagatactcagtttcaatacaggaagggaggcagcttgaagcagggcaggtgggcataagccctgcctgatcttgtctgtggaggcccatttc

SEQ ID NO: 19560 - DNA, 1829 bp, Mus musculus
tagggcagagcaaagcctagttttccccggcagggtgcatatgtggtgttctggattcagctctggttcaagtgtgtggctttgttggtgcctgggtaattttccaggtcagccagcgcccgttcctgggacactcagctgagtctagactcaggttacctgtgggtaggaagaaaactttcagcaagggagagctggaggctgcatgccaagtctccaagtctttgaggctgcacctcaggtgccctagggccgggtggggcagctgtgaagattgcacattctctgtggccagggatggagcttgtgggtggtggtaagggtatcatctagcaccttctgcagaggaactctgacccatgcccaccctgctttgttgcctttctgatgatatcaggtagcacggcctgggcattgtcggctgcctttctgtcagcccactgtggctagaacccagagccagggccagactgacttcagcactccactgcagccttcagggttggagagcaggtagcttcatcgtcctccggtggtcatgtctggttcctgaggcgtggtattttgttgtaacagtgttgggggagaatgctggctcccagagagttgagggcagcaggacaggcttttggtttctcccatggccctgaagaccatcttaagattgcacttataagaaagattcaggttgttggggcgctctgagaaggggcagattcctctgagccagaacctaggtaggcatgcgagcactctttctttgtggctcctgcctcctgcccgtccccaggtgttcctatccttgggacaaatggcttttcctcatggggctcttttgcactaggaatttctcacctcgtctgtctgtcttgcagtcagctcagccaggagcacccagagcaagtgagtatatggtgactttggctgagggctgtggcactgtccctggccttccaggccactgaggagggtagagaacctctcacacagcctggagttcctcagagtggcttctaggcacccagaactagtgcctctctggctgatcagatgagggacagaagagtggttctcaaagatgcccacatgacagccccaggtcctgtgtgtcctttgccacagtggaggaccttgacaaggggacttagggtaggtaggcctgaaggattgagaaaggattgagaaagtctacaccaatgggtttagtgtggacacagggcccctcagaagtggacagaaagatgcccaggactgagtctctgttgctgacctgaagatgaggacatgaaatacattgaagagacttaggaggacagcacagctccagccagcaaagaagccaggatgtcacgcacgcccataaccacaaggagctgaaactggccaaagcctgagtatacagcaggcagaccatcagagccatgagggaggaggccagccagtggcccctggatctgacctatatgacgctgagcagagccagcctaggtcgataacactgcaatcacgcatgcgtgtgtcaaaccgaggccacatgggtgcatgggcagagccacccaaggtgtggtcagagtgagagaaagcaacctttaggatgacactgccttctctgggcacaggactgttctgaagcagaccacacaggagccttggctgggtctcttcttcaggggcgacatctccatcatcagcaattccaaacccgcctacttcctgtgaggtcaggaaccacacgtgcagccataatgtaccttggggtttggtgataaacaaccttctttttacttgtgataaaaatgtattatattgccttatttatttttaatctt

SEQ ID NO: 19561 - DNA, 1094 bp, Mus musculus
ccaagcagattgctattccagaaactacctgtgcatgtgagattgctataaaggactgacatccaagtcccccatccctcccagaaggcctagctctagcttcttggttcctacagccaggattggtacacacacaccccgccctccaagatatagctgagcggactgagccagccaccagtcctgggccccactattgtcactaaggaataaaggtgagggcagccttccgatccttatatctatacctatccttgaatcgtgatgttttatgtgactgagggtcgtgatggtttgtttcagtgttgcaacattgaaaggtacttgtggcatattccaggtggcacatctggtgggaaaagggcacccccgagggtatatcaggaaagagctagaaagggctgactgaggattcaggctgtgggcttggctggcagatatgagcggcttccagagagctcacattgtatttacacgtgagctgaaggactcttgtaccactgtgctaacagcaacccgctgagactgtgcaaatgacttgctttaacggggtgagtaagagggaaacagtttggactgtggaataggggaagagttcactcaagtctcccagccaccctcagcaggtaagttctaggactctccaagtcccagggatcttttacagcctgtgcagaacttctgtcagtggacgtttggaggcatggttgtatagagcaagcatctacccttcacgtaatagtggcagggaaagaacactgctacatacactgcacacccgtcagcaccatgctgcagaagggatgctgatattttacattcttacatggctgtacatatgtagccaccagaaactgacttgctcgtgctttttaatggcttcaacttgcaaagggtgtgcttggcttgataaaattaataaagagcaaggatggcagcttggatattatgtgggtctttgaagcatcttgcttctctagctgtgattggctttgaatgtttctatagcaggcttgaaccaatagctcatttctatttacaactataggcttggcaggaggttgatggttaaaagtgtgtatgcatatgcactt

SEQ ID NO: 19562 - DNA, 1205 bp, Mus musculus
ccagacctcaactgctcatctgatcaggccaagctgcgcgttttctgttgcagttaaggtctctgctaagccaggtgaaatctgtaagaactaggctgctgttgatgctatcgtctatacaacagtgcttacccagtgtggtgcagggcacctcatggacgcgggtctcttgtgggcaagagttgcttgaagcccacatttggagcatgtggccaagtgctgtttggttctgtatttcttggcttcttgttgctaaattggagccgtttgattcttttccgatcagctgcattcctccaaggttagagacaccattccgagcaagaaattagaaccccggcttcagccttatagtgcccttgatagtctcaaaggttttgaaatacaaactgacattgtgtctagtggcatcttcttaaatcaatttttttctgaaaggcctgacatcgaatagggacagagctatgacattcctgtagagcccaagccacactgcccagccagcctggctccagttacagctcttacattcaatgctctcatgcttccagcaggcaggcacagcaatgagggtgccttcccagggacttccctggggggttagagagagttctccaggagtgcatagaaagcaaggaaggggcaatggtgcatggcagaaagcatggctgcctctcccatgttacaggagccccatacgctttccaggcactggttcctgccgatgccagactacatccacttcagatgtattggtttccaaacatttccagccatttgctgagaattagcatttcaacggacatgctatctgagactgactccagaaatctcttagacttcataaacttgtaggattgcctgcaagaacatttgcaggccacttagatctgtctggggtggtcccccctgctccatggcacagcattgggaagtgggcctgacagcagccagaaacttgtttctcacctcccaccagcaacctccactcagccccagaccccaggcacatgaagcacaagtctcaggggaccgttcccatgctgtggggagcccaaggaagcccccagcatctcttgcatacaccactggcagtgtgggcacaactggccaccaggagcacacatgcctggggaagaggggcctgctctgttgccttcatccctgttaaaattgagtatatgcaagccatttgcactacggaa

SEQ ID NO: 19563 - DNA, 2731 bp, Mus musculus
ggatggatcttggcccgggaaatgcctcatcagggccccaaggacaagggctgtacaaggagggagcatggaagacaaggctgtccccagtccctggctcattagcatctgtgtggaggaagagcatctgtcctgcttgacagggactgagtagccatggcacccacttgtcagcagaaatgctccctcatcttgtctttctacatcagtgatggaactgaggaggagatgcatggtcagtgaaggtctgagcaggttggaacatggcggggacctaagtcaggggcagcggaagggatgtgaggtgagggcagtggagaaagcctctggggtcagggaggaccacgtggggtctgagagccactgctggggggtaaggactctgtgattctgctctcaggttgtcacctgggctgtggagagcctagaggacctggagaggaaaatgagaagatggaatcaaaaatgccattttatataatatatattttacttatgccaaattatttataaccgcttgccattgccataccgtacccatgtcaaatgctgcagccgactaagctgtgattactaggaggcttgtccccttgtagacacaccagagacagctggcccgtcagctggaaggggaacagtggtctcagggtgatgccacgagatccttctcctgtagtactgccaaatggatttgccttaagcagcctccctaccctctgcctggcgcagcaacatgtcttgtccagatgcagatggttttgttcctgatggaaacgtctgggagacgtggaagactaagacactgacgtcagtctcagcctcttctgcaggactggctgggccatgtagaggtctgcgtcatctaaagcacacgtggccttttaccgtgatgctcctgtggtacctgcagcttccgaggggaacttctgtggggtccagagggggagaagggatgaagggaaagatcaagaactccagcactcacggctacgtttgatttgctgagtcatcttagttactgagtcaggtgtgatggttcttgctaagatgggcatccccctgctgcaggcttcctgtgcccagagattcggaagaatgcggtaagcccgtccttcccagggtggaggtggaggagggctccggctccgtggagacaaagccagggtctcctcagtcagaaccttctaccccaggaaggctctgagaattcctggcctggcctgaaattcccactctttgccttctaaaatccagacctagcttccacatttcacgtccaggacaggctacagttgttaagctgggatttttgtggtgaattctgtttcaaaaggggcagagatgtaactatgtgtagaattgggatcaactgtcaggatgagtgtgtgtgtgtgtgtgtgtgtgtgtgtgtgtgtgtgtgtgtacaggtggactattccatttttgctcatgtgtatgtctgtgtgtatacaggtggaccattccactttttgctcatgtatgtctgtgtgtatacaggtggaccattccactttttgctcatgtatgtctgtgtgtatacaggtggactattccactttttagctcctattgatgcaccaaaagcaagtgcctcatttctgtgccaaatgtttgccttggtctttaaggacctccttcgtggacactctgatgtgcctgttagagggaatgtgccaccattccctagaggccccatgtcttccacagaggcttctagtgttccagttactcatatgcagctaaactccagatgggggcaggggtggggctgaagtttgtgctctaagaagtatcacatcctatgattataagtttatatgcagatgtggcccagagatcacagccccgcactcttttcctcccgctggaggggggtgggggtggggggagagggcctaattagaaatcagctgggctctgctgaagcccagctttccggtgaattgaatgccacaaaggttggcatggaatgcatccaagaagccacacgaatgtgctttcaaaactgaccggtgaggtatgatttttactcaagataaaagtagtcaagggtatcaatggatctgatctgaggaaacacaggaagacagctctacaactgtctacaacagctggtagggcaaggctctgtcttctgtgtgtgacgcgtgtattgaacagaacaagaacagtatcatagactataccgtgtgctcagaaacactgcgaaaggagtattgcccaggcttttgctacaaggccatcggttgggcacaagttagtacattattctatgagtaaattcaatgatgtcccaccacttccaatagatagccagggtcccattaaccttctcattaacggtcttatagtttccagtgttgggctgtatccatgttaaaagccacactgcatttatcttcagtgtcaaagacattgtaatgccgccatatctgtcttatctattagcgcagttttcactattctatattgtaaagaatatatatccagtatgtaaatgagtgttctataaaccttttgtataggcatttcctctgctctttaaatatcagccttattcagagtataataaaaattatgaccttggtaagtctaatgaagcatttttttaagtctttgttgtacgtgtgtgtgtgtgcccatacctttgctcctgtgtttgtgagtatgcgagcacatgtgcctgccatgcgtaaagattagatgacaa

SEQ ID NO: 19564 - DNA, 1215 bp, Mus musculus
atcccactcacagtaacatttaagacttagcagttgtttatttctacagtgttctactgaatagttttagactgaggtcaacctgggtcactgaaacacatgcaagggatggggggatactgcgcttctatgctgtcctgcagcaagccccagtacctacttccccaatcctgtctcatctgtatcttgtaacagttgctgggtttgaggcatctgtatgtcccttacatttccctatggctatttttgcctttcgaacagcccgccttctgcagaacgccagtgggtagagagcagcccgaagtccaccctcaccctactggggaacagccacccttctgaaagtcccctcggcactcatgagttctgtagctctggtaaggactcaccagggctgccctgcttccagtcctcagagctccaggcctctttccacagccatgagctgtccatgtcagagcctcagggtgctttgcctcctgcgggcagccaaaccttcttaggtttcaacacagtaaccacagcaacaagtgttcttccacctggtgaggacgctggcaccttgctggtcaattcccatggaacatcaccagctcctggaacccctctgctgacgacaggggctgctgacaacggctttctgccccacaactttctcacggtgtcacccggagccagcagccaccacagtccaggcctgcagaaccagaacgtgagcctgcctgggcagccacccctcccggagaagaagagagcgtcggagggtgatcgttctttgggctcagtctccccatcatccagtggcttctccagcccccacagtggcagcaccatgagcatccccttcccgaatgtccttccagacttctgcaagccttcagaagtggcctcacctttgccaggtatgtctgcatctgccactccctcaggagaggagggctctggggcttcccgtgtgagccagtcttcagtgctaagtcagatgtcctgcaggaaatggtcagatcctctcttggctctctcccacccagtttgcctaaagccagatagacccagtttttccggtcagcttcctccttaatctcctgcagactcagaccagcgttagacagtgcagatgctgcagtagttctgtattcactttgactaaaaggatagagatgctttaaagtttctttctctcttcccaattacataattcatccagaattgagt

SEQ ID NO: 19565 - DNA, 1193 bp, Mus musculus
aattccctgtggcagtgatgttgttaaagaatccttggtgatgcttttgtgctcactggtaggatgcacacttccctggcaatgtctccatcactcttgtctccctgccgcccagcaccatgttaaagattgtagtccacaagctccttctctccgtctccagctttgacgatagttgagcttcttccccatagtgatgccagtgtcgtccttcctgacccactctcagctatcttgaggggccagatctgtggcagggacctttctgtgatttctcacatttctgttcttcttctatgctgatttcagacggtgatcactgcatatccctctgacctcaatatgatcgatggcaggattccaaacagcaaggagtcatctatgtgtctgaccccatcattccctgtgtctccggaaacaccatatggtaagaaagaagaaaaactagctgggtacaacttggtacttcaagatgggggagtgacagtatcctttgttgtactgttttgtccagtgaaaacatcgccacgctaccctccgttcagtccacctgagccccagctgagcagcccagccagtttgcacaaaggtcgaggtaagaacccatatgcatggttgctgtttctaccaaggcattttctgatgcagaaatatttccatttgggtcatatcccaatatccttgggcaaggacatgtctttctagaccttgggatgtggctatcagtgccttggttgggagttgagtagtagtaagacactgagaggattctcaggattcttaggaatcaggtttgatgctcacatatgtggcaatttaggctcaattcagtagggttggctctcagcttggcataggtgcttagcttgctggtgaattctccattcagcaaggagtttgaaggaggaatgctatctaacttcactatgcaaatgagttccagcaaagagcagggtgtctacatgagccctacaacatggtcatctttatgtgctgccgtgtgtgagccagctcctagccgaggcacacttggatttcctgtccctaaacccttgttctctacgttgaaacctagagactttcagtatttcgcactgtagggagagagtgctaagagtccagtgcttcttccaggtagaaattgcccacctttcttgggatcttgggatgagttgggcgtaagcagatggaga

SEQ ID NO: 19566 - DNA, 1189 bp, Mus musculus
aaaagctaaccagctagccaagacctatttttctgcccaacaagacgatcaggcttggctaagagcaggaaccaggtacccctgggtcaggagtaaatgcctgtggagattctggcactgggttgttaaatgttcattcttagtgttcccccatgtgaagactcagtttgccacaacaaagcctcatgcctggctcactgcgggtgctcaccttcttataacaggcctggggctggatcttagctggttctctctgaacttgagcttagccatagtctactgtcctagcattgtgggctgagttctggcacctgccttgccctttctggatggagtgctctgacttgtctctgggcatcccatagcctgcccatagcagtcctcctgtccgtgtagagtggctgactagtgacgacgttgtccggggatagtttaagatgggttttatcagaggtctctgctgtaaggatcgtacccatttgtttttcctcctcattggctcctcaggtgatgaccccattgggggacggcttcgtaagctgagcatcgggcagtatgacaatgatgctgcgagccaggtgaccttctctaagtgtggatggggaaaggctggagtggacccagccccaagcctgggatcattttcctctcctgaagacatcaaagaggtatgtgctggtcctgtgcccatctcctctcagcgccacttgttttcctgtctttatgcttagggaagtggctatgccatgtccttgcacaacatcaccagtcactgaaacttctctgcctttggctgacctcctcggctgatataaatggttcttaagtgacagacaggggttctgattgagagggagcacaggccagagggcctgggtgggggccacataatcccagatatggcaatagagggggtacatcatttgaggccattggagcctcaaagctcttatctgtagaatgggggtgaaatgcatacaggtgggatgtgaaggttaggaagcatcggcctgaccctagcagggctctgcagatggacgtacagccaacagctattgctgacttctagtctgccactcagggccctcatgcaaatgatgaccccaaggagatcctcagacaagagactccaaggtagttaaggcttctcatcagaatttggcagggcaacctccccagataattagcc

SEQ ID NO: 19567 - DNA, 2105 bp, Mus musculus
tgtgtgtgtgtgtgtgtgtgtgtgtgtgtgtgtgtgtgtgtagtgtttccttcatgggtaggtaagtatgaagctaagataatagctcagtggtcaatttcttactagcatgcatgagaccctgggttccaccctcagcatgaaaacgaaaccaagcaggaaaggcaaaaatgatttcggccgaatgcgtctgatatatgaatcctgttttattgctgctttctctgcagaggattgtgtagagtttggggacccgagctgagactgcacttgcgtactattgagttgcattatagacccactcatctgtttagataagtgcgtgcccactgtagtaggtaatacttccttttctcccttgcttacagcctgtctctttctttttctgcagtgctacacacacaggggccagtggatggcagcctgtatgccaaggtgaggaagaagagtgcctcagatactggcatccctagtagcccccagggcatgccagccactagcagtccagaccacggagaccacaccctgtcagtcagcagcgactcaggtcattctactgcctccgccaggactgataagacagaagagcgcctgacccccggagcacgaagaggcctgagccctcaggagaaggctgagctggaccagctgctcagtggatttggcctggaagactctgcaagctcccacaaagacatgactgatatgcgcagcaagtacagtgggacacggcatgtggtaccagcccaggtccatgtgaatggagatgctgccctaaaggaccgggagactgacattctagatgatgagatgccccatcatgatcttcacagtgtggacagcctgggtactctttcctcctctgaagggccccagtccacccacctgggtcctttcacctgtctcaagagcagccagaactctctcctgtctgatggctttggcaatggtgttgctgaagatcataatggtgtcctttctccagacctgggccttggtgtagacaccctttacgatcgggagcggatgtgtgggggccgagagcaaaaaccgctgcagcccctgttgaggaagccctctgcacccaccccagtgcaggcctatgggcaaagtaactattccacccagacttgggtacgtcagcagcagatggtggctgctcaccagtacagctttgcctcagatggggaggccaggcttggcagccgcagcacagtggacaatactggccttgcccagcccccaccccacatcccagttactcccaaccgtggagccagcagcagagtggctgttcagagaggcatcagcaatgggccaaatccccccgacacacagcagctctgtcctggtaaagctctccagcccagatttcaagatgacagagtcacgaatggagtccatcaggagccgaacactggctcctccccaggctctcctactctggatattgatcagtccattgagcaactcaacaggctgatcctggagctggaccccacctttgagcccatccccacacacctgaatgcccttggcatctcagctgtgtgtcctgacggtgtgggaagtgggctccggtgtagtggccggctggactctgtggatggccctggccggagccctggccggcaaggtgagctgatggggtgttggtgtcaggtaggaagtatctatgcagctgggaatttggatttgctgaaactgatgatggagcggcattttctactctcacaagctgtggcctagaatccaggtgatactgtggcactataagagcttgttagcagaattgaaaggtggggagaaagaggtgtaaaacttgcctataaaaatggtttggggccgggtgggcccccctgaagattcctcttcttaggaatcagtgtcttatttcacatacttgtcacgcttgttggtaagtgcagtaggtcatttggaagcaccagatagcctggtccatgttcctttgccacctgccagctgtgtgatttaaaacctatgtatacatctctgagcctcagtttccatgcctgaagaatcagctcaacaatgaaacttttctcagttcaagaatgtccctttagggaagagtgccgggcgtc

SEQ ID NO: 19568 - DNA, 2061 bp, Mus musculus
ggtgtgctgactgattctctgcctccgaggtatcttttcagtgtgaacatctggccacagctgttcagaggccataccatctatacttctgtgctaagcagtgagctctgcccctcagccattgcctgttttctcttcctctcttaaactaggtgaaatgctatcacaagaagttccgctcggccacccgtgatgtcattttccgcctgcagttccacaccggagctgtgcagggctacgggcttctgtttggaaaggaagaactggacagcgcctgcaaaggtgagtgaataaagccccctgggacgtcagaagtagcatccttccctgttttccttcccacttgctggtggagttactgccaacataacagaaccgagttgatctatgggtgaacaactcggagaagccaggaaaatgttgacactctgctcgtgaaggtggtcggtcacagctttgggaacaaccttgcactggctgggctggaagggcaggatcagtgtgtacacagtgcggtgtggttctttgtttcagatgaccgctttcctgactatggcaagattgagttggtcttctcggccacacctgagaagattcaaggtaggtgactggcagtgggcagacagacttgatcggactggagacagttttgaggatcctgagcttgtactaacacctcccaccttgaccgtgcgtgcgcgcatgtgtgtgagtgtgtgtgtgtgtgtgtgtgtgtgtgtgtctgtgtctgtgtgtgtgtgtgctgtgctgcttggggtcttgtgtattctaggcatcccctactgctaagcttggtcttgaattattatttttttagatagcatattggataataaggggtaggtggctttgaaacaatagcactcacttgggaaatatcaaaaggtagcatgacttgcctcaggtggcctcactaaggaacacttgaaggctagggtgcttgttggtgtccctgagggttcacttacatccatgaggttataccaaatgcttgctttttccctcagaaaaagtgttttaaaaggattgccagtacagtgtactaaatgtcggtatgttttagaaaatatgtttaatagtgtgtgtgtgtatgtgtatctatcattagatatatctgtagtgaaaagtactgatctgtctccaggcctcctgtgtatgacagtttcaagcgtgattattttgtagcctaagctgtgacatctgatcatctggcctcaaccttcccaatactgaaattggctacatggtcattttaactctattcttaattacttagaaaatgatccctcttaaaagtaggctcattgttatagatttgggtaggaaggctcacagggtagtatttcctgtggtagtttgagatgctgggctttgctaagtagcggctgtgccccataggatcggagcatctgtacagcgaccagggagtgaccgtggactataacacagcagacccgctgattcgatgggactcctatgagaacatgagtgcggatggagaaggtgagtggctctgcttgtaacaggaggcgcagggcagagatggggtgtccccggctagatcagcagagcttggctctcgtttacaaaatgaagatcaccctcaccccacagtccccgagctacacgtgtctggcactgccggttttgaaggcacttgcacatatcaggcttggtgaattttcagagttgtagtatatggagggctgatgaagcctcctgactggagcaggaagtgtgttctacccactgacttccatcctttccttcctgtatgtgctggggactgtcatatattgggcaggggcagtgtctactggctgcatattcccagggtcgtggaccttccggcactgtttatgtttgcttgttatccaggttgtaggcagacgtccattctctgatcacctgcagagtgtacactgtggctctctggggatccacaaagcagataaaaaataaacggacagtcatctcttggggatactgagagaatcccttggggttgatttctgagaagtgggcatccaggttttcttt

SEQ ID NO: 19569 - DNA, 1173 bp, Mus musculus
ggcccttctcagtgattttctaaattcttttaacaaaatagaggcaaaaaacctgaaggtgctccttagtttctggagggctggttgtccttgatgtgtggtctgcatagcatgggaaacactgagttcactgtattgccagactcctttttagcttgagtgggtaatacttgacagcattgtgggccacagactctgtttaaaaaaaaaaaaaaaacaaaaacaaaactaaagatcttggggtcctagattcttttacagtaaactctgaactattttaacgcctctaaaaggcttctatagaattgtcacccagctgcaaaggtgcagaccagcgcctggttgaggtgtggtctgcaggcaacgtggtagcctgcattttcgttcctataaaggaaactaactggccatgagctcattagctttcagaagaggtctacccagcatcccctgtgactgaggagtggattatgtcactatgagattaccacagaagggcccaggaggtggaaatcaaggcacctctcttctctgtcttgcagatcatggatgtgggctggcccgagctgcatgcacctcctcttgacaagatgtgcactatatgtaaggctcaggagtcctggctgaacaacgacccccagcatgtggtcgtcatccactgcagggtgagtgttcctgctcccacagcctctgggttcccactgggcttccagcgcttacggggccacgtggattagatcaggctgctcacaggcaccaactgattttccttgaagccaccgagtttacaggatacctgtcacctggtgtgacatgttccatgaaggtataccttttagatttcctattcatccttaaaaactaagaagctgacgaagaaactaaaaagaacccccaatcctcaggttgtctttagaatttataggtctgaggtttctggtgtttctggactttttaaagctcccttctatccattcgattctgtacttgttaattttgagtattagtgaagttgaaatgaattgtaatatgattgaaaacacatggatcaccaaagatgaaaacaccacctagatattttaccctcccgccttccgtaagtgattctgggctctctttgtccagtttatgggcttctgatgttttcctttcattacttaccatagagcactc

SEQ ID NO: 19570 - DNA, 1241 bp, Mus musculus
tcagcattccttcagcttggagagcaggtggtctgaacgccttctgaatatgccacatacagctgtagttggcagttgcttctgaggttgccctctgccttgcctgtgccgtggtcctcatgtctacacctcctgctctgcagcttggtcctgagctggtggccttttttccacctgcctcctgcactgcctgcctctgtttggtgggtgtgaacctgcagagttctcttcatctagcatgtttgaactctgtgagctgccaggtctgtctgaaacctggagtgctgcaggcttggggagtgacagtttgaatcgctgtggcacatttcattgtcctggacagtaagaagggcacgataagccttacctgatggactgagtgacagcctttgatcagggactggctctagggacactgttgcctttaaggtccatttatttgtgggaacaaaggtgccttcatgatggggaggagggacgtttggaatggctgccaggcattgacctgcgatgcttggtcttttgtttctttgctgatagcacagcctgtttgtccttctggcttacaaaagtaggatgtgatgttggcgtaatacatgaactgaaagtgttagttggtatgattgagactaggagctggaagaggaacctctctttgggatgactttgttgatgaagcaagtgtggtgggtgggctatgagttctctgggaacttgtgtgaaaaggaagcctttattatgggctctgtgtatgtgtgtgtgtgtgtgtgtgtgtgtgtgtgtttgtgagtgtgtgcgcgcgagagagtgtgtgagtgaacccagggttttatacagactaggcaagtactccttcacagagctataaaagggctgtaaagatataaccctttacccatttttattttgagactgggtttcactatgttgcgtaggctagcctcgaacttgtgatcttcctctggagtagtgaggactacagatctgtgccacacagcctggctggaagcttgcactttgtctgtaaggaagggaagagcagagaacatatttatttatataggacattgcagaggatgctgacccaggttgtaggacatgtcctgacccatggctgtcatctgggagtcaaaggtttgcgtcattgtaacttcattaggaccccaggcaggatgaggatagggggacgataagccttacccgatggactctgtttcagaacagtgaggggcattggcgat

SEQ ID NO: 19571 - DNA, 1138 bp, Mus musculus
ctttctctgtgataactccagatgtgtcaagttgacacaaaactaaccagtacaccttgcttcctgagccccacgtgtttcctaccctaggcttttgggagtcctgtctctacctgattccaagtgtctcctctcactgcagtcttgctgaacttcaacattttcagcctaaccccactcccctcacccttataggtgtggaatgctagggtggcttccgccttctgctctgaggcagtctcctacaggccagtgtgtctctaaaccctgacatgccctagagtacaagggtctgggaagatgttgttgatgctgaggtcaggtaggcatgggtgggcagggcctcactgattgagtaggagcctcttcgtgtcataccgatgggaatgacatagccacagaagcagggtctctccatctgcttactgtaggcctaaaaggaaaaagaaaggagctgagagcaggtcattggtgctcataggatgagcagagccctttagttggctaccagaggagaccttgtgggaaggagacccctagtaccatttgtgtcaaaccagaagaaggcatcagatctcattatggatggttgtgagccaccacgtggctgctgggatttgaactcaggaccttcagaagagcagtcagtgctcttaactgctgagccatctcgccagccctgtcattcacttgttaagaaaaatttggtaaggcctgtcacctccagttaaatgtctcagtttctcaggtcccagagaggccttcaggtcttcataagagtgaagaccagcatgatggctttgtgttccaaaggacattaacattatccacctttcctttatgttctgattttctgttaggctgcgaggtgtcactagtagagcccccctcccccacttcccatcccccaactctcagagtcctgtggtgccacgtagatgccttacctctactatctaccatggatgacagaccagaaagcactgtgcagtgtgtgaggtggggccctcctcacacactgctttgttctaggaccagaactgtgagaaatagatttgctattgtatgtagcccagctattcaggctgtggcttggtagtttttttttttttttaatagcagcccaaatagactgaga

SEQ ID NO: 19572 - DNA, 1170 bp, Mus musculus
ggtgtaaaggggtcgccaggggttaaagcttagctagcctctgcccatcatggagaatgtgccattaaacatgtcattgtggttttgctgaggggttgagggtgggtgggattcccatgtattttctttctccctctccaggggttgtgtgtcctggttccctgggattggaggtttgtcaccccagatagctcactgagcgctctttgggaacagagatttctttttttttgttggttcagaatacacagaaaatttgccatgcgtttattgtatttaataattgggtatttctgcttccggaaccccccccccccccgccccttttcctatagctactttctcactggggagggcgagactgtgtttgtctgggcctctggtcagaatgccataggagggtggcctgagcacaacagtcttgtctttagaaaggctggagagatggctcagcagtcagaagcactggctgcccttccagaggactggagtttgattcccagcgcctccagagcagctcacagtgtctataatgccagtctcagggagtatgacaccactggactcccaaggacaccagagacacaagctgtatgtcgacatgcgggcaaacacatatactcataaaataaaaaaaaaatatagaaaaatacaaataagcttaaaaaaagaaagtttgccagactgggccgcctggctttgtgtcctctcttgaggtaggctgcctagtcctttctgggattgtttatatgagctcgtgacccactcacctgcccaggctttgccttataccactgctttgaacatgaggatatgaatggaggcttttggaggagacaaagacattgtgactatggtgggctcctttctcttcagcagggctgttatgcacttgggaggggacagcagcatgtagtaaggtccttaggttggagcttactgactgggcctttccctctccctccctccctccctccctccctccctccctccctccctccctccctccttccttccttccttccttccgctctcttttggacaggatctcattatggtaccctggctggctatgttgaccaggatgtccttgaactcacagagatctaccaacttctgcctccagggttcctgagtagtggattaagggtgtgtgccttgagacggatt

SEQ ID NO: 19573 - DNA, 1191 bp, Mus musculus
aggactttcccttctttaaatactgtagggagtctggactacatctcccttatctagtcatttctcaatggccctgaaggtgattgaatctctccccagcttcctggaactactgcttctatttacaatgtctctttctctctctctctctctctctctctctctctctctctctctttctttctttctttctattactttacaatgtctctttctttctctttccttccttccttccttccttccttccttccttctatatgtattgtattttatatgtgtgtgcactatatggatgctggtgcctacggctggaactggtgagccactctgttagtgctgggaattgaacctgggccattgttattgttgtcttcctcctcctctttttttcttcctcttcttttgagacagtctcactatttgtccctgcctggtctggaattccctgttaagtctaggctggtcttcaattctttttcttttttttttttttaaagatttatttatttattttatgtatgtgagtacactgtagctgtacagatggttgtgagctttcatgtggttgttcggaattgaatttttaggacctctgtttgctccagtcaaccccgcttgctcagttcctgcttgctccggcccaaagatttattattatacataaatacactgtagctgacttcaggtgcaccagaagagagcgtcagatctcattatgggtggttgctgggatttgcactcaggatcttccgaagagcagtcagtgctcttaccggctgggaagcttacccagcccctggccttcgattttttaagaaattgtcctgcctccccctgcgccccccccctctcttttggcttttagagacagggtttctctgtatagccctggctgtcctggaactcactctgtagaccaggctggcctcgaactcagaaatctgcctgcctctgtctcttgagtgctgggattaaagggtgccacatccagtttagaatgctgctttttaagtgtgggtcatgattctgcaggagctgtctgtataagtcagtgtgggacacaggagaacatttggcaacagtaaaggtttttaaatgtgcaatgatcaaatgaacccaagctcaaaagcttagtgagtgtgaactgtttactgccacgcttgcttgggtcacccagctactctttgt

SEQ ID NO: 19574 - DNA, 1132 bp, Mus musculus
gtgtatcccaagggctggggatcaatggccctgtggtcacctaacgtgtcctgaagactgaaaatcaaggggtaccgcccccctcatggtctcatcccactgatccctgcttcctcatagttcatgccctctcacttttttgctcgatgccacagatagtggacattacctgtctgagggggtgactttgatagctaagctttcccttttttttttgctcactctgagagcttgccattcacagcatctggattttagcatagaaagaaaaagaaacttcgatgaagaaaagagcagcatagtccatgctaactgaaaaaacctttatcatcatttttttggaatattcacatttttagaaaacttgaaagagtaagttgtgaacttttgtgtacccttcattttgatttactaaccttccgtgtcatttgtcagattttctttactccccttccgttttacttgttagttttattttattttgtttttagaaggcttattatagcccagactggcacagtggttccaacatccaaggatgatgtctacctgaacctgtggcctttcactgttgttaggatctctctctctctctctctctctctctctctctttcacacacacacacacacacacacacacacacacacacacacacacaccttcttatagtgtagtctgcttgacctagaacttactagatagacaaggctgctctctattcacaaaaactggctgtattctgcctcctgagtagttctatttaaggaactgacgatcttggctttttgtttatttaaagatttatttatgtggggcttggagaaatggcctagaccgatgatgggtcataatcctaatgggggagggggtgtctaatgaccctttcatagacgtcagatattctgcatttcagatatttacactaagattcataacagtagcaaaattagttatgaggtagcaagggaataattttgtagttgggggtcaccacaacatgaggagctgtattaaagggttacagtatcaggaaggttgagaagcactggcctagcggttaggagcatgcaccgctctcccagaggaccccaggtctctcctaagcgtctgctttgtgcagctcacaact

SEQ ID NO: 19575 - DNA, 1149 bp, Mus musculus
cctgtgtctgatggagttaggaacctgctgcttctgtgtttattctcaaggttttcctctgactattgcatcttgtcttcatctagtattgtgcgactgctctattaggaatgcagttgtggtaatctatgagcattctactccaaaacaacatgtctatggtttggctccaaagcacccaccaggtaggcactgcagttttatttaaaagtgctcttattatactgagtcttagcagctcaatagtcataactattcagtcttacaagatgaaaagattctggaggctaatggtgatgctggttgcatagttacatgaacacattaaacgccaccgagttgttctgtgcaattaaaaattgagagaatagtaaattgtatgcaatttttagcttattgctttgttgttgttgtccttgaaagaagaaagagcaaaagttgcaccctttcatccctggagaccaatggccatggtccctggagccctcacctttacactgatggctacagtccctggacaccctcagactgatggccatggtccctggagccctcacccttacactgatggctacagtccctggacaccctcagactgatggccatggtctctggagatgctcaggctaatggccacagtccctcagactgatggccacagtccctgaaaccatcaggcagctgcctactctctcccagctgcaaggctgttctctggtttccatggatgctctaaaggccttgaacttgctgcgaactttctggagttcccctgctacctcctggccaggctgctataaataataatgatgacgataatgaaaagaactgcccgagatgcagcaggaggctctgcagactcacaggcgcactggggaatgagaaatgtcatgacgagggactgcttcatggactcagtgctaataaatcataataattaaatacaagtcctcatcgcttgaaattcatttctttcatttcttgtagcatggcaggaggatgaaggaaatagcagactattctgaatcccgacatcgtccaccagctcagggttggtccaggacctactggctgtttttgtccatggctctcagtccctgggcatggctgcctgcagcctgggccttatctctaaggcaattttttcat

SEQ ID NO: 19576 - DNA, 2396 bp, Mus musculus
tgagctgtacatagattgtcctggaactcccaagctcctatcctgttcctaagtgttgttatgacagatatgagccatcacaccactggctctgctgctatttaataataagacatatttaattaaactaatattttaaaattagggattctttaatcgttaatacttgtaacaaaaataaatcaaaatcatgatgcagatggaatttcaggagactccctacaccttgttccttaggcttgtctttctgccgaaagtaccagaacctcactagtcaccaatttcaccactgtgccgcatacctgatgccagtaactttacagtgacctaacgttgggggagaacaagcttccattggcagtcaagggatgtggtctctctggttcttgccacaactttctgcgtagtgttcctttcatagcttatgtctcaaggagctgtagtcaagggagggagctgagaaagccaggttaggagaactgggagctgctttgtgaaaccccatcctgaggtggagactgagaccagagacattttactgtgtgttgtctgcagtttggagatggactttcacttactatgactgcctaaaactctgaggtttggagagtacttccatacatatgagagccggtaagctaccccctgaccttgcctgccagggcttagaacccacattcctggtaacttgtcttgaactgagattttaagactgtcctgagagagtcaggaatgcagaagaattcctaatgcagtcacttaagccagtgtccaagtgggcttgttatcctgtggcctaccttggttcagcaggcaccttcctacccatcatcaggtctccaggctgagtctgtcctgctgtgcatcttgccacagagaatcgtgctcttggaagtctgaaaagcagttcaacattagttctggggcgggaattctggttcttccaccaggagcagtggctgatgacattcttggtaaacgtcacccaattagtggagtaccctttgtttttaagagatgtaattctgtactttttaattttaaagattttgctgggttatcagagcgtacaagctggaggattgttagatggttgagggttctatggctgtcactccatccacagttgttcctcacctttcactctgtgccttccctcttgggcacctggttatctctctcagtttctatacttacctgctctacacagctttttaacctcctcccaagacgcccaggcctctgaaaccaccattccttactacagctaggagggcctggtgctcttgactctggtaatcagaatctgcaatctgcatgtcaaatgtatactggtcccagcctttgcacctcggcttctgcccatgtccatccttgtatagtaaatctgtctagaaacgctgtcttcctgcaggccctgcagccactgcaaagcttgacggccttgccatttctacaagggtgctctcccagcagtcacactttgattgctgtgaggcacatcctggattgtatttaaatggcctgggtaggctagcgctgctctgctcacactgtctcatgtgaacagaccagaacagactcctatacaaagtctcataatgtggggaagccaaatgccagctcctgtctatttccaccgtggagtcaaatacagggaatttctcagtgtgtggtctatgagctgcatagagcagctttgtaattaccctggctgtctgttcatggttttgcatttctctgtgacccaatgggtttcacagcttcactccaaaatttggagaattcagggtagtcgtcttgttgctggaaagttagtagttggaattatgtggtgacacactccagttctgtgcttttgtgtggattctgatggagagtctaaagggagcatgagttggtcatttttcttctaaaaacagtgttaaactaagagatgataaattagaatcatttggacattgatggtaggaggggtgttagtaccaatgtcctgaaggtcacttggctatttactatccgtgggaaagcttgaaactgcttcctttgacttaatacttatgcttgtaagagtcatttaacacaggttataatcaaagcttagtactgttataaataagaaatttcctaatgtgaatgaacagggaattggtagataatctgtgctgtgatgtaatatcataccctaatgcaatacaataaagtgctgctaatatggtaacaaaccagtgggatgttggtgtccatggtgtgacattaaagaccaggaagcctgggtgtttttgacttcagtctttttatatttgtgtattttctaacaatttcacaaccaacattgtaatgacaatatttttatagaatgaaataaatatttataatttaactattacttggaa

SEQ ID NO: 19577 - DNA, 1201 bp, Mus musculus
gttctgctaggtgtgcgccgatgacctctctcagcagatgaaggtgctggagccacactggggagacgtgaagtcccccgtgtgcgtgtgcgtgtgcggcgggggtctaggggggaggggctcagatgaagcgagcccacgcgaggtaggtgcaagccagtgagggtcgcccaggtgtgggtcgggctgctgacaggtgagggggaacgtaagagaggcatgagcaggtgagtggctctcagcgtcctctggtgcttccagcatatccagtcccacacggagtaattcgtcttttcacgaaggaccgaacaaagtttcattttgatcactcgcatggatttccttgtaattgatttaccaaatgttatcgcataaagtattggctccaagttgtttggctgcagaccaaccgggaaactcgactccggtgtattaaatgtcactgatttgcacgggacctgcctcactttactgctccttttctgtgacaaccttcttgcagacctgcaggactctgcagtccttctcactctcatctctctccctcaggtcttgacgaagtgattgactggtggtctctgacactctggaagccttctcgcgacgtggacatcggtctctgacagtgagttaccatgaacacggaatctagggtagggcgaggggctactattacaggcagtgaagggcacttttacacgtcggttcacacttactccgtcctcttttctatctccccttcctgtccttccttcccttctccattcaagtttgtagttcactttgcctcatttttctcttgctggtgctatctgggcttaaaagaaaacaaaaaactaaaacaaaacattgggtccattcgtatgctgtaacccagtcctttaaaaacacatggtgacttccttgaatggagggctgtcttaagctgtctttgcctgtaagcgattcccagggcctgccattgttgatctctctttcagcttgtgcagtttgtgccccatctgcattttgggctaaaccacccccacttctcagccagtcagctattgtttctttttccttcttcagaggccaagcagaccttctggtctccgtagaaccctcattaccgcacgtatctttaatgcgcttcttgggcacaaattgtaatctcagtcttctatactttcagctctggtaagcagtcggcgctttaggtttt

SEQ ID NO: 19578 - DNA, 1099 bp, Mus musculus
agtcaggagttagaaaagcttgaggctttgtttgggggaacatatcggggtttctatactttccctgcttttgtgtccagttgaaagtttacaaaatacagaatctggaactactaagcttacatggtcacccagttggtggcgtgctagtcagtggcaatgccctgaagatagaaatgtcagacaaaggctgcagagactctggtgggttctctgcttatctctgccttcagcaatggtctgtacaaattcctactcagggaaagcttagtaggaaaagggatggacggctttgagcatatgcctggtgcctcagtacttggctttgccgatggatcctgttggctgtgcctaggttccgcgctgctgctttgtcaccctgtgtaaccgtgatctgtgcatcttcctcaggtctggagcctggctctgttgtcatcacgcagcaggcagtgaatgagtgcttcaagccggagtttgagcagattgtcctgggaaaacgggtgattcgcaacaccaacctggacgcgcagctggttcaggagttggtgcagtgctcctcagacctgaatgagttccccatggttgtgggcaacaccatgtgcaccttggacttctatgagggtgagaggaagtgagggcattgtctgctctagggatcgctcacccaccccaagcgtgctgtgcgatggtgtggttgctatctctgttggagtgctgacccactcagcatttctgtgatggctgtaacagtgggtggccccccttggccctagatcttaatggcatgtatagcatggtgcctaagtgcagtaggctttaactatgtacctgtggttctattcatttgctacagggcaaggccgtctggatggcgccctctgctcctacacagagaaagacaaacagtcttatctgcgtgcagcccatgccgcgggtgtccgaaatatcgagatggaatcttcggtgtttgccaccatgtgcagtgcctgtggcctgaaaggtacgccgatatggcatggccttgctgtcctttctctgtctcttttgctggaccatcatggaggggtcctcctgagagtaccccaatgctgaattctca

SEQ ID NO: 19579 - DNA, 1287 bp, Mus musculus
tgtagtccgggtacacatacgatgagttgactgtcacacagaaaagcacggatcctgagtgttcttgcagattccactgagaggggtcagaaagacggtgatgggatttcatgctgcccaggaagctgctccagccctgctgacagcttggctttctgaagggctaatccaccctgttatctagtcctgaacatccttccagttcagcattagccctcagaactgcctgtgctccatgggacaacgtatgccctcagtcctgcacagggcagccaggtgctggccctggaaacagctggaatgttttgggacccaagggcaaaggcataggtgatagagctggactctgccagagttgctggaagttccactctgtccacacagcactcccaactgtccctagcctgcacactgctggtttcccgaggtattgcaggctgatcctcagctccagagccctggccttcctccttggtgagctaaggaaggtatccatcctgcattgatgaggccattgtttttttgcagcggctgtggtgtgtgtcacccttctggaccgtctgcaaggagaccagatcaacactccccacgatgtgcttgtggaataccagcagagaccacagcggctagtgggccacttcatcaagaagagcctgggacgggcctgagccctgtgcctttccgccccggagaagcctctgcaactcctgggcaataaatctattttttcataacacattgtgtgactctgcggtagagtgtatggaactgggtttcatctgccagttagaaatccgagttagacacacagattgttctcttacacatcattggaacattttcagactattcaagcttaactgggggtggggtggggtggggtggggtgaggtccttcttcaggaccattctaaataaatgaaaactttcagacttttatttcaaaagtggtcactaaagtaagacattggcagttgtaccataaaacagatttccataggtattttaaaaattctatagttatttcttgatagctgcagatggaatacaagagtgactttgttgtcaggtagaaagcctaggaaagccattttggaacctagatcataactttcctgtggcgttgtgggatttggcaacacagatctcactccctccccccccatttccacgagtattgatggcgaagctcagggtagatccaggcagtgctataccaccctctgctgtccaatccaggtagtgcaggctgtctaactagaaatgtaaaggcttgacacatcctgg

SEQ ID NO: 19580 - DNA, 1149 bp, Mus musculus
tttgggtaagccactgtggcctactccttaaatgccagcaattgggagacagaggcaggtagatctctgtgagttcaggaacaacctggtctacatatcaaattcaagaccagccagagcttcgttgtgagaccttgtctcaaaaagaaaaaaataaaatctttgtgtaaaaggagcagagaactaatttgactagcttttaactgaagtgcatttctaccgtgggggaactgatccctgggtttatcagagtcgagaaacatctacacagaacagactatgagcctcacacacccaatagtgccaatcacaatcccatgtctacagggtccccattacagaccactgatactattttatgaaagttgtatttggctttgcagttcaaaagagaacttgctcccagcacctttctgtcactcctacctcaagcaccacccttccatcccacaaaatcttccagattcttcaaattaaagtttgactcctcagagaggtagatggagtaagaagatgtgaaatcaagaatatggaagaaaccgggcggtggtggcgcacgcctttaatcccagcacttgggaggcagaggcaggtggatttctgagttcgaggccaacctggtctacaaaatgaacagccagggctacacagagaaaccctgtctcgaaaaaacaaaagaaaaaaaaaacaaaaacaaaaacaaaacaacaacaaaaaaaaaacagaatatggaaggaaggaagactgatccagacagaaaagaatgaagaaagcagccccccaccccagaaggctacaaaccaactttgtttctctcctaactacactcaccttgtgcttcctagatagaataagtttcaagcagaaattactttagtcagagctcaatagttcccaaaaagccaaggaaaccgtcagattagcatgagaccaacttgaatacaggcgattatcacacacactcacttgactgattcctttgaaaggttatggtaatgtagtttaaaagttataatgtaaattattcaggattttcaggtaaaattgcctctttgtctctgtttaaaagctttattaaagtcaggggcaataagcaattagaagtttcattgcttaaagaactttcctgacccaaatgtttctcattta

SEQ ID NO: 19581 - DNA, 1194 bp, Mus musculus
acttaataccccctgactaacaaatggaagggtccagatccagttctaatttggggtagaaactcagtttgtgttttttcacgagatgaagatagagcgcggtggctgccagagagattaattcgtcagatgaacacagattctgactcttctggtaagtatcattctaaagactaaaattccttttgtgcttaaaattcagctgagagcaacagctctcaaagctgttctccagctactctctgaaccagctcccgacaggaggccggagactagcctcagctttacaatttgcatttgaataaagtacctagacttcccgaaaaaaagttctgctttcctactttctcactgtctttcaagattttgtctttcaagcaggtaaatcaacattcccgaggcggaccagtggatgtgcatccccgcccccctagagcacacaggtgacagctgttacccccagtctcaagacatttccagcatgtggctttcagtctgagttaaaaatttaggtttacctagaaggctaaaaaagtagatttttctatattaataaagattggtttttattttgatagacaggcttagccccttaactgacctctggcttttcacccttgctgttactgcaaggtgtccttagctcaataggctgtggaaaaaacagggatgaagaggaacgacttccagctcctattttacccacaaatcgtggtgttattaacgacataattcttgcttaggctttgctaattctgaggttgataattctcctttaggagctgcacagcactcaaaactgtgcatactggtttgtgattgtacaaattcagtatggacaccgcttggtgcagaaatacttactacaagggaaggtccggcttgaccatttctgagtttcctgtgagataaacccggtttaaaagaggttgataccaaattttggttaaaaataaaaaatattctccggctctacctcgcctccccaaaaggtaccaagagccacatgtgtgggttttacccacgagaggaatcgggtccatgtccacccaagccaaggttaaaagcccactcatctacggatgagaaaatcatttgatcacctcagttaagcgttgccttatttaacttaattaataggggggagagagattggagacgtactattgaaagggcaagcccttcactgcctcc

SEQ ID NO: 19582 - DNA, 1176 bp, Mus musculus
atttcaggcatgtaccatcgtggctagtttatgtcatgttggtattgacaccatacttgctatggaaatactcccttaactgagatatatcctcaagttgataacaatttttcaagactgacttttcttttctaaatgtttcacatgtcaacataatttgatcctcataactcctttaagcattgtggtgcaaccaaatttaagaagagaccatgataagggagattttatagcatggtgggtatgttaagatcaggttacataatactcttgaataaacttacagggtgtagtctcccctcccctagcctgaaacctgcttgctcggggtggagcttcctgctcattcgttctgccacgcccactgctggaacctgaggagccacacacgtgcacctttctactggaccagagattattcggcgggaatcgggtcccctcccccttccttcataactagtgtcgcaacaataaaatttgagctttgatcagaatgaaattgtcttagctccgttttttcttccgccccgtctagattcctctcttacagctcgagcagccttctcagtcgaaccgttcacgttgcgagctgctggcggccgcaacaacagggtgtctctttttttattcccaggaccaagtcatttatttttagtctgagctaaataatttcttcttgactgatggtgcagtttatgggtccactcaaaggatataatctttcttatcccttaaaatggagtaaaaccagctcgtaaaatggaatcctttagggcaagagacaatctaaaagttatggtaaatacaactttttattatttttaaaaaggaatacatgtcttcctgaatttgcttctttagcatatccaaccagcatgcacctgcaaaatacccccacatcactgacacctctctttatggcaaatggagaacatcacaggaaaccacaatggtacaaaatgcagagattaatgatctgcggggagcccaggcactactcctgcatccatggttcaagaaacatcatggaaagattgtaagatccagagtaccagcaagcatgctgtgaaatgatctcttctagaaatggctgcacaaacaaggacctaaatgaggcggtatcaatgcatatgttaatgtaaagggagaaaacgggaagaagcagttatatagccc

SEQ ID NO: 19583 - DNA, 1140 bp, Mus musculus
tttttaaagagaatggattgtttgcactgttaaaattgggttttgcttctcaaaattgtggttgtactctcttgttacaagagaaattgaaggcttctcccaaatcagagccaccagctaaatccatcagctcctccaaaatctatgaagcctcctgagtggcctagtccactacctcccccttatccacagcctcaaccccagctgctggggggaaccccaaacccctcggggcgtcgagaggtgggccgctgtgtgtacatggaaccgcagagcacagagtctgggcggactctggacccacccaaacttcaaacccttcagtactggtcattttcctctgctgatctttataactggaaaactagccaccccctttcccaggatccccaatgcctcacagggttggtggagttccttttatgttctctcatcagcctacttgggatgattgttaacagctgttgcagatgctcttcacaaccgaagagtgagagagagaattctgttagaggctagaaaaatagcccgggagccaacgggcggtctacacagctacaaaatgagatcgacatgggattccctttgactcgccccagttgggactgcaacatggctgaaggtagggagagcttgaaaatctatcgccaggctctggtctctaaggtgcctcaagacggcccactaatttggctaaggtaagaggtaatacaggggccaatcgaacctccctcagtgttccttgaaaggcttatgaaagccttcaggtggttcactccctttgatcttacctcggaagcccagaaggcctcagtggccctggccttcataaggcagttggcccccgatatcagaaagaaacttcagagaatagaaggtgtattacaagagggagacagttactcgatctagtgaaagaggcagagaaagtgtgtgtgtgtgagagagaggcgggaggcagaagaaagagaaaacaggagggatcgtagacaagaaagaaatttgactagaatcttggctacagtggtaggagagaaagaaaagacaggatctagacaggaaacctgagcaacagaagactgagcctcagctacaaaggctcagctgtgtcaggatacacccttcgagataggaagcagt

SEQ ID NO: 19584 - DNA, 1379 bp, Mus musculus
ggctggcaagaaatttgaagagtctctgttggaacctgctgatgcatcagtagtcctgtgtaaagagcccaccgcctttgaggttcctcagcttagtgtttgtggaggttctgaagacgctgacatattatccagttcaggtcatgacacagataagacccaagccattccagggagcagtctgagatgttccccttttcagagtgctcggctgcctaaggaaactaataccactaagacatgcctcacctcctcaacatctttaggtgagtcagccactgcagcatttcacatgacaccattatttggaaacaccgaaaaggacactcaaagctttcctaaaaccagcacaggactaaatatgttcttatctaatctgtcttgtgttccttctggctgtgaaaaccctcaagaaaggaaggcttttaatgactctgacatcattgacatactttccaatccaacactgaacaaggctcctagtaaaacagaagacagaggccgaagggaagataatagcctgcctacctttaaaactgcaaaagaacaattatgggtagatcaaaagaaaaagggccatcaatcccagcatacatctaaatcttctaatggtgttatgaaaaagtctctgggagctgggaggtcgagagggatatttggcaagtttgttcctcctgtatctaataagcaagacggaagtgagcagcatgccaagaagcacaagtctagtagggcagggtctgcagaaccagcacacctcactgatgattgtctgaagaacgtggagccaaggatggttgaacttattatgaatgaaattatggaccatgggcctccagtacattgggacgatattgctggagtagaatttgccaaagccacaataaaggaaatcgttgtgtggcccatgatgaggccagatatctttactggattgcgagggccccctaaaggaattctgctctttggccctccagggactggtaaaactctgattggcaagtgcattgctagccagtctggagcaacattcttcagcatctctgcttcatcgttgacttctaagtgggtaggtgagggagaaaaaatggtccgtgcactgtttgctgttgccaggtgtcagcagccagctgtcatatttattgatgaaattgattctttattgtctcaacgaggagatggtgaacatgaatcttcaagaaggataaaaacggaatttttagttcagttagatggagcaaccacatcttctgaagaccggattcttgtggtgggagctacaaatcggccccaagagattgatgaagctgcccggagaagattggtgaaaagactttatattcccctcccagaagcttcagccaggaaacagatagtag

SEQ ID NO: 19585 - DNA, 1196 bp, Mus musculus
tgagataagatctaagtttgggagattctagaaggatcaatcacaagcgttatggcgtgagtgctagagaggagccccatgctttctgcaagcatgaaatgtaatgtctaaggaagatgtatagaatgaccaagaaagtgggccataggtagcttgtgtgggatgcctcaagtatatgtctctggagttcggtgtgtggagcatgggatatgacagggctaccaacattggcattggtactgtgttgacttctttgtcctccaagtatttgttttcattgcagtgggctgctgcagtaagatattttcagttttgtaggatgcttatattttaattttaatggttttattgagatataattcatgttggcctttagcttatacatttgagtgatttctggttgtgaggtcatcaccataatataattttaggacctctttgtcttccttaaagacctctgcataatatcgcctttgtgattgtcagcttcactcttgatgtgatgttgtagtgaaggctaagatattggtggatttgtatcatttaggattattccaaatacacttggcctcagattttgctccttctcacatgcatggtagtgtgcacagccgtcacacacagaaccctccagactctttggctaagaaacttttccttctgtgaaactttgttacctccttgccacgattgtgccttttttattaaggaagcatgttagccaaacaccatttctttttttttttgcctgtataactatattgtgtgatttgccaccttgtccttgtcttttccaatttgatgagttcaagaagcatatactgtggctgcttacttattaagacagaatctcatgtagcccaggctactctcaaactggctatattagcctaagactatcttgaacagattttttcatcttcattctcaaaaggtgagggtacaggtatgcaccactctgctgacttaaagtagcatccattatacaaaattcatttttgtggcattggggattaaaactagggtctcacgggtgctaggcaactgctctaccacaaagctatactttctggcccttgtggcccattattagacataaagtatgaggcattacaatggcatagttactccttcttccctggccaggctccttttatcttacttatcttacttttgcctttaagaaaaagtattta

SEQ ID NO: 19586 - DNA, 2688 bp, Mus musculus
cagaacaacatggctttttgatcggtaccaaccgacctacatcaattagttattggacttcacaaagatttgccgctgtggatcaaacaggaccacctccctctgcgtcagccatttaaaattgggggagggaagagatccagtgcaagtgtgggaagaaactggaatgacgattttgattaggccacgtagggtgaaaaccgcagaaaaatgattggaaatgaactcttgccctggaataaccttgacaattcaaaccgcgatgtttactttttgtattgatcacttttttgcactccttcttcgttgtcgatgttgtactcagcctatggtaggagaggatgtggctttgcaactcagatcagacaaagaatttttgaattggcaggctttagcctacaaatgggtcccccaagttttctagataacatcctgctctctgcaggttgcggcagtgtgggtttggctccagtccttcccattatacttgaaaagctttttttttttttttaaataaaataataagataaaaggtgacaaccgcagttgacacctagcatgttttgtggacgcagtcaagctgccacagtctggtcatcgttgttgttgtgctgacgtctggtcatgtattattagtgtgtctcgttctccacggtgctggagacctcattactttggaaaactcactgttccccagcacagcacagctgcatgacctcagcttcagactgatgtcagccagccttcttggaacacattgctattcattgtggatgccacacagtccatctggggtgccctgtgcctcccattttcacagccgcccactgttgtagaataatcgctgcctttaccctctgcagtaccctcagtcatttcacttctcccacaggggtggggtaggggtggggttaaaggatcgaaagagaaaaaaacgccaacttgttggccttgtgctctgtcactctgagcatctatggtgataaagagaaggaaacgctgcagaggcacaagcataagctggctttgagtctttgaaagcttgatggcctctgcaccctactgaaaaccccctaagccagcaggagcagggtatgcagaggctttgcctctgctggcttagggtgagaagtacctcacaatggatgtgaacattggacagattttaggagcatgatgtttgcctcctccgagagagaggagtcagagagagagaggagtcagaaggtggccggagttatcattgggtcccctgagctccatgaaggaccctctgttgtccccttgatgatttatcaggcatgagagtagcagacaggattgccttgagaaacacacagacaacaacggtggtgaacacatttccctttcttgataccacccagaaagtctgctacatacctgagttagccactagattgcctgtcccgactcattgaagtgctccccagggagccacttctgatttgccatggttgacagcatagtggaagatagatatgacagcgctttgtaaagcaggccagtggcaagctggcccacagtagagaaacactgtagttcacagaccatgcaaccgtgtttccacgagatgttattacaacaaatgaagaatttttttccttttttttcattttaatcttttttgacttttttttagttaaccattttttatgcataagtgctcaaatgcatttctctttctttcgaaactagttaatcgttaagttgacaatgagagaattctcaagttcatacctggcagcaggctcccactgatcttccccttacagacagataacagacatttcagttttaccgtgctcatttctttttgctgacttaaggtcagaacttttacagacaacaaacaaccctagggtttctttttccagtttacacagaccggtccccacagtgcagaatccatttctctttcgtctcaacagtagacaactaggatgtggatctcatatttataagtatgcattttatttaagaggaagtataggcttgactctggttcacaatttcgtacgtagctggtttgacgtagaactttgtacttcccttgccgaagtgaattgttgaaggctgcaacccacccaccttgagtgtagcagacttcagtggccccgagatcgccagccctttgcacaggcagctgggaattccacctgaaacagctggtccctaggttagcgggttcccagcccccctaatcagagactgaaggacaattgacttttatttttgtatttaattgacatgaatgtaaaggggacagctcagggttgttttggagcctgtttgactttgtaatctctgcctgtgattttcttttctaaatgacgactccgtgtaaccacctggactaagttgagaaggaaactgccaaatgctttgggtttttagggttttaataggtagactctgttctattattaggtgttaagagtttccaaacgtgttttcttttttcttttattgtttgcttaaactttgaagaaatatgtgcctcagcttagatgttttgtcttcccctttctgcacttaaatacctgacagcctgttcgatcgctgtgcctccgagggcgcttctagctcatcgtagatttgtgatgtcatagtgcaaactgcagtgaccggtaaaatgacctgacatgtaaccgttttcagggaatgcag

SEQ ID NO: 19587 - DNA, 1121 bp, Mus musculus
ctttttgctttggatctgccttttttgtgtttacaggagtaatggtggttctcacttctgagatttcttttttttttttttttgacttccacagagtctcaagtttcatccctgatttccagttagatttcaactcttaagcatttgatgagtcagttacgccttctccactggctttgatattacaactgaactggccatgtgtgtagaatgctagaaggcacaggcgtggcttctctggagtccccctcagtaatcattagattgttctcctttgcttttttttttttttttaatagagaagagtgggggtttgatgcttttgtcctatatgacctgctcttctagaccaggaagctgtagggcaggtgtcctgtccaggcaaaggagttcctctatcctacctacccccaacattgagcagccaagcagaggggcccagggatacctatatgagttgactgtccaaactaaacataccccgggaacccaggttttctctccttggactgactgtactttaagcatagacatgagctgaagtgtgttccttcccttttgcaatttaaagttggcttctgtctgtcattttgtccctggtggtgtttgctttgctcagaatctccacaaaagaagtacccagtcaaagttaagttttcagaccagggcttgctgtgtttgatttgggcttagcactgttggatgccacactgagaacagcctcaaacctgcttctgttggattgactttatatttaaaaggattctatagcatgaccaccctgaagcctctgctccccggggagcatctactgtttgcccatttttcacccctccaccccgtggtacttagggacctgagctgacgtccagcccacttgccttactgcaacgtttctgtttggcctcagaaggtgcctagatagggttttcagagctccctcctccctttgcagatctgattattgcgtagtctacctccgcttcggaatcggaggtctactggtagctgccactgtttttatcgccatctacagtttctgtctgttagaggagagtgtgaaatctactgcgtcctagctctgtaccttggtaagagtcagaaataatctctccaaacct

SEQ ID NO: 19588 - DNA, 1484 bp, Mus musculus
cctgcctccaggactctcttccagcaagactggtgaggggaacaaaaaggagcaatgagatgctgtgggagggacctgcaaataaacatccacagattctatgttacttgttttctcacaagtcactggaaggttataagcatatttgtattttagaaaggtctttgggagagtgagaagcatggccagtggtctagatctcaattcttcaacatcttttacaaggatgagcatgcataactctcttctgtatactttgttgcccacagaggcagtaactctacccttcttcactgcaggttcccttgctcgtgtgaagtcctaccactgaagagaccacctgtacagctccaagtatcatcactttagaaatccacatgacaggaaatgaaaccttcaagaagtggcggtactttcctgtctccaggccaacttgcccacggtggattttcagtgttcctacataatggtcaaagaggagatactgctttgctgtgtgacttgtgtgccaaggacatatgatctgcctctgaatgctcacagttgccaataaactgctcttgttggcagagtaatgggaatacacaggctggagcccagcactcacacttgattttagctatgggcacaaggaattatgccctaagttgatttttggatctttgagactttgaccacatacacatggttaaaatcacttatgatcctttgaattctaggtgtacaaaaacataaatcaacagaaatagtcagaatctattacatgctccaggatgctgcttctggagtaagaagcaccatggaggaaggctgctgagatgacttttgcaggataagaaagcgtcagattcgtatttgtattcctcacacagtgaagcctcacacctcacagatgatcttggactgtgatctgaccaactagcttttaaaattccactgttgctgcccagaatagcagccctacttgaccctctgagcaagacattcctggctccttagaagatgatgggaagcagagatgagaacactggaagggttgtccgttttctgtatagatgtgtcccacttgtatagtttcccccctcccccatccccagtgtcccagaaggctatgacatgcatcaggttactgtgaaggagccttgcatggagcctgagatttcaccagtagccttctgaaatcctgcacagggccagagagcagagtgttgaggacctatatgtagcagagggcagtccacattgtgctgcacattctgtggcttacattttatcctgacacactttggcatggtccagcagctgccctggtattatatgacattcttatagtacattgtgggtagacaccatctttaaagaatttaaactcagcaggaagttttgtgattttttttaatgtatctctaaaaccttttcttatatggagaaaatcaagacagcaatataagtcaaaatgagttcatgatataaaatctctgcct

SEQ ID NO: 19589 - DNA, 1137 bp, Mus musculus
agatactagctctctaaccaactctgtcaatggtgtatccaaccacagtctgcaagaagccataatccctgatagtggcgtggatgacatcccagtcacttttatcggggaagtttctgatgagccttttgactcagggctgttctccagtagatgtaacaatgccactacttttaacacggggagcattgctagccaaagatctcatctgtccccatctcagactgagcatagccagccattcgtaaggacaagtagaaaagagcctgatccctcccctccttcccaagataacaggaagagaaatcagccaaccttagccaacacatctgaaaatgagaatccagttgaaacagaccccacagttacatcacttgtttcaaagcttttaatagatgacccaaaagcaaaggataaaggcaaagtgcatggttctagtcacagtgagaagacacaggcaggtcatggaataaactcactgcgagtgaatccaagagatggtaaggatgagagctccaattcagcacccccaccatggtctcatcatggccaggccttagggggaagctatggactcaagtatggcctcacgacatataaaattgttcctcccaaatcagagatgaggtgttatgacagggatgtgtccctctccactggtgccattaagattgatgaactagggaatctggtgagtcctcacatgaacggaagcaggaccatatccccaccatcagctgttgtcgaaacagacactccacctattggaaaagtcaaagagttctggaggcgcaactcaatggaaaagtaccttaatgggccggctgagtgcactatcaaaagggccccctccaccactatcactgccacaccagaaaaaccacagcaagataatgggatgaaggcagccttcacagtgaccactccccagcagcagcctgcctcacaggaatatggggcacacctggaggaagagagaagccggccacagtcagcagtctcttgttctgtgaaagtgccagcatctaatcccacagacatcacattcctcaagcctcaaagaagaacatccagccagtatgtggcctctgctattgccaagaagatggggcctccaaaagtccatgctgatgtggt

SEQ ID NO: 19590 - DNA, 1137 bp, Mus musculus
ccttataaagactcaatagcttccattgtttgtgtataccatattatctttctccatttatccatatacagatatatttgtttatacttcttatcaggaataatgccagagggaacatagatgtacaaatatctcttcagagtcatgctttctatcatttgtcattaccaatccagaaatgggctactgaaatgctacttggtatgccttttgtcttggcctgttccaagaactgtcactctaaagttagaactagctcactcaatccaaagtaagtctcatgtgagttctagagtcaatcatggtgactgagccacgcatctagaatgcaatgaccagaaacaagtaacagcaaggggagtgagagctgtttgggtcactaagatccttgtgctaggaaactaggttgttctccacataggagagaaacacttctgagcaaccccaaccttgaagtccttcaggataggcaagactcaagctgcttgggaccagctcttaactctgttattacataatctcgggcaatttaattgttctcttctgcaatttctatgaaaagcaaaactgtccttgagaattatacaagcaaataaatatataaacatttagagtgataaccaacgtgaaacaaatcaaaattagtatgaaagtggctacaattcaaaatgtaagaaagtatacattaaaacctagatgtgtgtgtgtgtgtgtgtgtgtgtgtgtgtgtgtgtgtgtgttcttataataaaaagagagaaggcaacatcagtttgtcctgtgaaggtgttatggggtacagtagtacctctatgccttgtaagtggctgatgatactctggatatcttcgacatccaatcagaccactcctgtcactcagcctgtctctcactgaagtcccaaggtctctttcaatttcattctcaaattttcaaaaactagaaagattaagcaacttaagtcctcattgtaaataacaacaaaacaaaaccagaagaaaatttttgatcatgttatgaaataaaccaaaataaaacctcattctctacttcataccccttcctgagaaatgcaaggctaaattgctatttttcttttcttaaaatattgtcattgcatggctcctttgacagaga

SEQ ID NO: 19591 - DNA, 1200 bp, Mus musculus
cacaacaaacaattaccagttcatttgaactgtgctattctatttcatgatgagagccctttcctcccttcaagctctcctcctcctttttatgaacaaacagctcaattttaagggagaaattgtgggaatgttttagaaatacatactttaagtagcatgtcaatttgttaaatcagcttccaaacccaacaccccatttctagtcaagggaggaccaaagcctcatattccctgaacctgggcccatgctggacacgagatcagctggtggccatagatgccaacagagatgtgagacatatgtctaaaacttaaaactgtactaacatcccttcattgagagagattacaaagagaagatgtggatggtggcagtttgccatgcttcctcctacccagtcctagacttgtttgtggggacaagagaatccagaatccctttctttctaagaataacgttgccctttgaggacaggggctggtagacaggtcttgtggttactgctaggtaaatggctttgatattgggtgtgactgttctaatgcagagggagctggaatttggcattgtgtatggctggcttggtgcagactgaggctgaagttgaaattgaacatggctgttttggtatttgacttggtattgaatgtgatttgtttagcattagatttggtattgggcgtgaccactttttggtataaaatttgatgttgtatacatatgctttgttgtaggatttggtattggatatggctggtttggtgcagagtggtgtggggtgtggtgttgagtgtgactggttttatgtctggtgagcaatagcagtacaccattcgttaaaagataggacctcctttggcttaacctttgaatccttcccatgtaggtgttggacgtcaggtgccacaaaagcctcccagaggcacagctcggggcccaccccagttagtgctccccccgcccccaccctaccctcctcctgacacagatgtgacagagcctgtcacctttcctggggaaggcgctggttccgagacctcagagctgagacccaaacgtacgtgcctcttgttgccattccagctatgtgttgaccatctgtctttctggtctctactggtataaagctgtgttcagacattcccttcttgcttttggacatctgtacctttcctttccaaatgctcaatgcaatg

SEQ ID NO: 19592 - DNA, 1178 bp, Mus musculus
tgagaaaaattaaatgcatttctggcttagtataaaaaatgtatagtgcatttgtacgcatatatttgtattcacacatatgtctgtgtatatatgttatatgtacttataaagtctttataaacatatattcatatatacacccatatattcatgtaatgttttgacttcttaagcaagcagttttgttttacaagatttattcttaaaactatttctatcatttacaaacatctttcctttaggaaaaaaatacaaatgatttgtacccaagtttaggcagactctgtgcaaggctgaacatttagacagaatttaaactaagatacctcaaccatgccagtttttccctgttgtttagcagttgccaattaacatgagagagtctagcaaacatctcatattctgttcagttattttccagtattcattatgctctttttattttcccctggacccaccaactttgtggaagaaagatcaggggctggaagtatcctgccatacccaatcctagaattgaaacagaaattaaaacaattgcaggaagatgcactcatagaattcatatgtctggtgtgttcttgcagaaatctgtacgactggtagtgaactacctgagaacgcagaaggctgtcgtgcgggtgagccctgaggtgccactacagaatattctgccagtcatctgtgcgaagtgtgaggtcaacccagaacacgtgattctgctcagagacaatgttgccggggaggagctggagctgtccaagtccctgaatgaactagggatcaaggagctgtatgcgtgggacaacagaagaggtgagacttgctacatcctatatataccctgaagagccacatggtacgtgccctgatatgtatgtagtacctggacataagatatgcacataaaacctgtattctgcccctgcagctgtcaggaacactatctagaggtgggcatgggaagcttcaggcacctggagttttctgcagtggtaaagtaggcagaagagtctaggttgttgtcttatcctacaatgctaagtatgtctctttcctcccatgtctgcaatgccttttaccttctgtcttcctctgagctctaagaagtaacagctaagaaaagaaatggtaaggagagagagtgcaccttttgctgttactactcaaagact

SEQ ID NO: 19593 - DNA, 1208 bp, Mus musculus
tttaattactgattcagcttctttatttgttattggtattttcaggattcccctttctctttgatttggtcttggtagagtctgtcagtttctgctgagtaatatctaagttgttggctcattgttcatcaaagtgcctatcacttttttcaacttaaaatttagttgtttttttttttttccaatactttacacttacaaacaacggggaaattcatgccgtgggctcaaaggctgtgtagcttttgcttatagaatttagttaacctaacagttgtatttaactagaaatggaactcttgtttttatttattatgattttagttggctattaaaatggactgttagcattgaaactgtgaacatgccatcatagaattatgcataagaacctgcatgttttagaattgctactgctgtcttcctcttgcttcgtctctttctttttacaagagtctagtctttcatccagctacatgaccatttgttcagccttactcagacagacagaagggcacctacagacagtcttgacaaccatgatttgttttctccttttcagccacgcaatgatggacctactggttgaactctgccttcagaaccacctgaatccttctcaccacgtcctagagatctggtcttctgagacccaacagcctttgagttttaagccaaatacgttgattgggtccttgaatgtgcatactgtacttctgaaagaaaaagtccctgaagaaagagttaaacctggcctaaccaaggctcctgaggtcagtggtgcccgtggattgtctgagaacatacagagatgcaaatatatttgtatatacaaatagatatatacaaatctatagatttataacctatacaaatctatagatctgtaatctgtacaaatctatagatttgtaatctatacatttgtacatgagtgcgcaggagtactagagaggccagtggtgatctttgtttgagttccaaacacgcagctctgtgttgagattccttcttttatagcaggtataactgatacttttataccaggcacgaactaggcttgcttacaggagataaaactttccaaatttactaatgtttattgttataacactgatcctttctagattatacagacagaactgttgtaggacaagctgtccatcagaaccttcttgaagagggaaaatgttctaaatctccatttt

SEQ ID NO: 19594 - DNA, 1188 bp, Mus musculus
ggagaagagttgtgagctgcccgatgggcaggtgatcaccatcggcaatgagcggttccggtgtctggagacactcttccaaccttccttcctgggcatagagtcctgtggcatccatgagaccatcttcaactccatcatgaagtgtgatgtggttatccacaaagacccctatgccaatacagtgctgtctggtggtaccaccatgtatgcgggcattgctgacaggatgcagaaggagatcatagccctagcacccagcacaatgaagattaagatcattgctccccctgagcacaagtactcagtctggatcggtggctccattctggcctcactgtccaccttccagcagatgtggatcagcaagcaggagtatgatgagtcgggcccctctatcatccactgcaaatgcttctagatggactgagcaggtgccaggcatttgctgcatgagccgatattgaagcatcgatttgccctgacaaatgtacacatctcctgctggtctcatgaaagtggaataagcctttgaaaagaaatttgtccttgaaacttgtatctgatatcagcactgggtcgtagaacttgttgctgatttttgaccttgtattcaagttaactgttcccttggtatatgtataataccctgtgcatatcttgatttagtccttagttcatgtgcctcggtcacttgggggctggggagagcatgcacgctgtggaagagaaaggcccaagctggtggatctctgtgaacatcacatagtgatctgtgcagggtattaaccgccagcagacttccaggatgtcccgaggctgacaagttaccattccttcttgccagtctatccggatgggaaagtctgagccttaggagcagtttccattctggtttttttttcccccctcctgaccgctatgggttgttagttgccttgagctgggaatgtttgcatctacacctgtaaatgtatccatcctgttaatttatgtaaggtttttttttttgtactcaattctttaagaaatgacaaattttggttttctactgttcagtgagaacattaggccctggcaaaacgtcattgtgtaaagaaataaaagtgctgcagtaactgaaaaaaatcttgacctattagcaaatttgagcacaaatttatgcttttcaaatataaataagaatat

SEQ ID NO: 19595 - DNA, 1099 bp, Mus musculus
cggtccctctgacggatctctggagacagccaggcatccctggctctccttacctcccagggcgtcccccagggccacagcctgtggtcctcctagcatgtctgccagccacagtcctccggtcattacggcccaaaaggacagctgtaaataccgaccgctcacacatttcagaaaaccccatcaccccatcctctacaaacaccgtcgtccacttctacctagatgaccaaaacaagagaagcacacttgttcctcactctgccaggtgtaaaaccaaggcacaaggtgggactcgaacgcacgatctcgtaaccctgaaaccaagacccaaattagaaacagaattctaggccgttaggcccaggcttgggaatgtggcctttgtaaaggtatgctaatcataaaacagatagctacatccctccatccacctgcttcctgggttcaaagagtgctcattcaaagaaagtcacccagaacctgcaatgcaaatgtgctattgttaggggctcctagaagctgtcttgagagttaacacttaccaggtgttccttgtgactcttgtaactttgcacttccttgtgactcttaactggtatttttggtattttccaacaacacccttcccacctccttaagttgtggtttcttcctttaaataccccctaatccagctactcggggcgccacagtcctctacccctgcgtggtgaatgaccgtgggcccaagagcgctcttgaataaaaatcctcttgcaatttgcagcaagaccgtttctcgttggtgattttggggtgtcacctctcctgagtctgaacgtgggggagtcctcacgttgtgggtctttcagtggcatgtataggtgtgtggagattagagaacaacctgtaagagttgattcttccaatatgtggatcatggaggttgaaatcaactttgtagatttggctacaaatgtcggctgttacaaaaactgtattcttttcttaaaagcaataagagatagttaattatgaactcattttcagggactatggcccgggaacacagatgtaggtagcccaaaatgccatgtttcaatggggaagcagtttc

SEQ ID NO: 19596 - DNA, 1285 bp, Mus musculus
cattctgattggtgtgaggtagaatctcagggttattttgatttgcatttctctgatgactaaggatgttgaacaattcttcaggtgattctctgccattcaagtttccttatttgagaactctgtttagcactgttccccatttttaatagcgttatttggttctctgtatatattggatattagccctctatcagatgtgagattggtaaagatcttttgccaatctgctggttgttgttttctcctattgacagtgtcctttgctgtacagaaactttgcaattttatgaggtcccatttgtcgactatttgatcttatagcaaaagccactggtgttctttctgttcaggaacttttcccctgtgcccacacgttcaagatcctccccactttctcttctattagattcaatatatctgttttttttttttttttttttttttttggaggtccttgatccatttggatcatcaccacctttgagcatgctcacaatatgtgcatgatgaagttcagcgtcagccctgttgtcatggtggcagtggaggccaagaacccagctgacctgcccaagctggtggaggggctgaagaggctggctaagtctgaccctatggtgcagtgcatcattgaggagtctggagagcacatcattgctggcgccggtgagctgcacctcgagatctgccttaaggacctggaggaggaccatgcctgcatccccatcaagaaatctgaacctgttgtgtcatacctggagacagtcagtgaggaatccaatgtgctgtgtctatccaagtcacccaataagcacaaccggctgtacatgaaggccaggcccttccctgacggcccggcagaggacatcaataagggtgagctgtctgcccgccaggagctcaaggcatgtgcccgctacctggccgaaaagtatgagtgggacattgctgaagcccgcgagatctgctgctttggtcatgatggcactggccccaacattctcaccgacttcaccaagggcatgaggtacctgaatgagatcaagaacagtgtggtggctggcttccagtgggctactaaggagggttctctttgtgaggagaacatgcgtggtgtgcagtttgatgttcatgatgtgaccctgcacgctgatgccattcacaggggaggtggccagatcatccccacagcacgccactgcctctatgccagtgtgctgaccgcacagccattcctcatggagcctatttatctggtggagacccagtgtcctgagcaagt

SEQ ID NO: 19597 - DNA, 1180 bp, Mus musculus
tactttttatataaatatgtccctggcacctaacacgcgctagtttaccagtgttttctattagacttccttctatgttttctgtttcattgttttgagttgtaaatatgtgttcctgtcttcatttcatgaagtaaacaaacaaacaaaaaacccagtattaagtattatcaaagaacaaccatgattccacattcgaacccattcaaaccatcagtattgtgaccaaaagcctttaactaagaaggagtaaccatgcaaaaatccatagaggaatttaacccaaaattttagtctcagcattgtgtctgctgaggtgtgtatatgagactacgaaagtgaactactcttcaaatccactttgccttcactcctctataccctaaatctagtgtaaaccacacatggaggataacttttttttttaattttaaaagtgtttattagatatgtttttcttcctggtaaactgcagccaaacatcagttaagagccatttttgataaacactatcacaatgatctcgggatccatcctttccgatttaccaagtgatggatagacgtgaactcataaacactacccataagacaaaacaatgagtgccagacaagacatcagccaggcaccagagcacagagcaggactgggcaatctgttggagatatctagaaagttcacaaaggaaacaagattgtccactaccttgtgagatctagcagtcataaataccagggaaatggaaagtgtgtttccttacagcaccaggtcttcgatcttcctaatgctgtgaccctttaatacagtttgccatgttgtggtgacccccaaccataaaattatttttgttgctacttcataactgtaaatttgctactcttacagaccacaatgtaaatatctgatatgctatctgatatgcaggctatctgacagaggtcgcaacccgcaggttgagagccactgccttcaaggctttaatcaagagagtagtgagctgagggctttactggtaagtcaggggcaagtccaactcaatcatcctcacatactggctgctccctcaggcctgagaatgaggcttgcagcatcctctggtttcctaaccgttatccatccctgactctcatctctgaaaatagatgtcatccatgaaattaaggagtgagaatattaagca

SEQ ID NO: 19598 - DNA, 2457 bp, Mus musculus
ttgctttcttctccatctctgaagatctgctcaagacgtccagcaatgctctctgtgtatttaaatggaagtatttttctctgtgaagccacattttccaacatgagcctcatgaagccaactaagtgttattgaactcctactctctcaataactcagtgtagcactttaaagtttgaaggacagcagcatgaaagagcatatcagtatggtggagaaagggaaggggttggctctttaatttatttttcttcatcttttataacaagaaagtatctatatatacatatgtaaatatttatatatagatatatgtagctttctatatatttagtaggttggctttaatttaatatacttgattcagaaacaaaatgttagagtacaaaagtgccaagcagaacataaaccatccttacttttatttcacacggttttatatgtagatagaagattgtacaatttgcgccaggtattaggccagctcttttcctttctctgtgctttctcctttgagagattgataaagcatttgttaatgccctattatttaccttacacttttgtaacgagtctgtaactttatttatatctctgactatctttccagggactgtgtcttattgctgagcagcgtttaatccatctctgttggaggtctagttcagtgctgttgccaagagtgggttcttgtgtccatagaactgcatatgctatggctgcttcaggctgatactttttaagtagtcactgttatttttattaagtgtccctgagaaaatgtaattagcagttgtgattttataaaggtcagaagttttctgaggcagtcatgacttttttaaatgtattatttagtgaagaaaacccaaagtaatcatgcagtggcttaaaatatccttgttccattatacacaagggaaaccatgtgaaatacttgtcactgaactgtaaatcatggactcatttttcttctgcatttcaaaagacacagttaacctaaaaaaatgaactgatacttcatgagcacatgtttatgtaaaattccgtctgtggttaagatgggggagtatcttgctaatctacacgccacaggagagcagattttgtccatagtcacatctttaaaatttctctgccagatatcggcaagatagcacatgatggatttttgttttgcccgtacaactagtgatggatgatgatttaatagatttgtgtgacataaaagtgcgtcatgtcctaccacttgacattatcccttcccttttctgcaaaggtactgttgatcggaagaaagagattctggctagttttatatggcagtcttccctacacagtttttctataccaattggttttataatcatgaatggtaaagggtgggttgaatcaaggtgagagaatattaaattgagtctacctgcctgccaccgctgtcccttcaactgagtgctgcacatcatgggctctgtctgtgagagaaaccccggtgcttggtgtctctgcatgacatggagttttgcatgtagatcaatttaaaatgtacctcttgtttacataatctgcataatttaaaaagatgatgttgccaaactttggaaatgttaatactcaaaacgaaaatctccactccatgtaactactttctccctctggatcagtacatggcttgcaatcccagccagtggtttgatctgtcccagtgtcaaccgccatgtgctctgcttcaagagggaactagtcttttgtgaatttttttgtacataattatttgttacaaatattttagcaaatgctttctatatctcttgcttgtgcatatcttggctggcgttgtggaaaaaaatagtgcaaactatttcaaactatttccttactggggaatgaggggttttcttttttagtttgtgtgagggaggtggggagggcatggtttatgttgaatgtttaaattttcttctgcatgatacatgtcatgttgtgaaatctttagagaacttcatactgtatgagtaagaaaataaaatatttgaaacttggcttgaatgtattgtgtcagctttgatgtgctactagagttgataatcctgtccatgcttttagggctttaaaaacttggataaatgttttgttgttctgaaccatgaactacagacaactacagattccccctgcatctgcctccccaatgctaggatggtttaaaagtgtgtaccaccatgcccaacctacttttgacactttactacaaaatcctgtgtgttcagcactgtgtaacaaggttgagatactcatcccagtaagtgatgtccctcactcaagcgagttttagggcagtgggtatgtttataccaagatggtaagtattcaacagtttcaagatcatgtgcattaaattgtgtggctgctttagaggatctgaagagaaaatttagagtgaaatgaaaattcttt

SEQ ID NO: 19599 - DNA, 1795 bp, Mus musculus
ggagagccccaagtcagtccaacctatagcattcatattaaaagagaagcacaggcagatgctgaaaagaggtgctgtgtggaagtttgcaggaaaagtcaccgttgcccgaggatgaaattctgcctttactcgtgtaaggtcaatattggaaagtcctaagtgctgcttcagccatcagctgagaaataaaagtcactgaagcttacatataaaaatccacccgtgaacgccaagctttcactcttacccctttgctcctgtcttttagtgaatacccaactcagcggtcaaagaaagattccgagggcttggagatgggagtcgcaggttccgtcagccttctgcagaacgtgaccgtgtctactcagcccatctccagtttggactggagtcctgacaaaagggggctctgcgtctgtagttcatttgaccagatggtgcgtgtgctgatagttacaaagctccagaccatttgactcagactttacacttgacattgtccagagggttgctcacagaactgtaacttgatctgtgttctgcatcctctggccccattgaagacggttggatttgagtgatgagtgacagccatgggcacaaagccagccagccagcctctagcatctttgggtgtttgctggcctgaccagcatgctgctgcacgtgaaggccccacacaccagcaccagctttgttccttttccccatgtttctactcagaaacattagggccaggagttgtggtgccagctacttaacaagctgaggcaggaggatcaatgtagtccataagatcaagactagcttgggcagcatagtgagactctgcctttaaatatagttggatgagacccaagtttgatcatcagtatctctatcaggtgacttataattcctgtaagtccagttgcagggcatctcataccattttctggctgtattgggcagtggtacccacagacacatgcacattcttagaaattaaaaaaaaattgtttttaaattaaaaaaaaatgtaaagccaaagtcagtagttgttatttaagtgtatttaagtctgttctgtatctgcatagctctgtgctttctctgtacactgtgctcctactcggagtcacttcacttgctctgtaaagctccagaagaacacggttcgactagccagcctggagaactgttttcagcagtgtaactggtaaaatactgtgacttccagctgtctctcgtttactcagataccagccttagttgtcttttgactgtggtaagtgatgacgagccgttgaagattgaatttgtttttaaacctttttgtcaaacctttaaaatatatattttaaaataaacaggtttttaaaatatttggaggcgttgattctttccctttgttcccttcttcctccttgttaagtgcaccttagtttcactggcccacatcataagctgagcctccggaaggactggattaatcatacctgcaataaaccttgtgtctcccagctcagttcaaaggggcagagacatataatattcatatttacaaaaccaatgagctctattcccaacatgcttttatagaacagtgctgtggagggttaagtgcttgctatgaaggaggaacgcctgagttctgaggactcatagtaaggtggaaagagacagccactcagccctgaccactgacatatgtgcacagcatgctcacatacacatacaaagcacatctaaaaggaacggagttgtaagtataatataataaaaataaaattgatctttaaaaaggccgctt

SEQ ID NO: 19600 - DNA, 1248 bp, Mus musculus
gggacatgtttatcctgtgcaattgcactctctagttccatggacttaatggacaataacgattcactgttgattgtcactgagaaagtgtgtgataaacctgggatgctgaacagctcaggaaatgactgtcttctattttccttcctaaggaaagaatcagagtctacatgaacagagttaaagaaataacagacaagaagaaggctgccaagctggacagaggtgctgcttcgagatttgtcaagaacgcactctgggaacccaaagcaaaaagcacaccaaaagtggctaataaagggaaaagcaaacactaatcttttggttttgatgtacatgttttcaaaaagtacatcctttttaatcagtttacaatgtagttatgtgaccatgtggtgtttaaatggattccttttggaattcatgtataaatttacacattacatttgtgatactgaatcttttttttgctgagaaagattaagttgtctttgttgattttcatataaagcatcatgatgtgtttaatattgtaagatattctataagcagttgtgaaatccaaatgttctctgtaaacatttgtagtgtttgaaatgaacaatgatattatgaagtgtgctatctgtagactggaggtgtaaggacatttgttttcagtaatgatgagaaatacagtgacttaaatacccactctgttttctgttcagttagttcaacatgtttctgtgatttttttttttttggagtaattgctgtcttgatattcaaagtacaaaattgaaaccttaaggctgtactttaattcttcatgttccatttaaaataaaatgttctcattaactctgatggaaaacacggttgtatgtcctgactggctttggcttgattcccttttaataagtatggtagctgggtagctcacatgcttcttgctgtccactgcgtgagtgaacaagccctccagatgaggcagtgtgagcagctccaccaggtagagaaggctgatgagtcatggcggctctctgttctcttggtctcactcttagaatctttctgactaagtatttcctaagccatgtggatgttttgaaatatcttctttattaaatactgccccttaggcacaggaggaatcaaattatatttacattctgatttatttttccagggtgttcgttatgatgaattctacttattaatgtctgagctcatataaccttgcttctctaggcccacatagtcatg

SEQ ID NO: 19601 - DNA, 1219 bp, Mus musculus
atagattcaatgcaatccccatcaaaattctagcataatttttcatacatggtataaaaaatattcaacttcacatgaaaacacaccacacacagtgttacggtggcatcaggctttgaagaaggtctcagatgctcaaactaggtctaatttcatttctgatgccttcagatcaagatgtagaattctcagcttcttcaacagcatcgtgtttatttacacaccatctaccatgaaaataatgaactaattctagagttctaatattgtacgccagccccagttaagtgttatcctttataagagctgctgtggtcatggtatctcttcatagcaatggaaaccctcactaacacaatcatattctagttttcacttctttggtgatcctctcttgcccttattcccttactaggtacattacctctaggattatctaaattgtagcacacactttgaaaatcaacatccccatataagaaaagaacatgatatttgtcttttgggggctgagttaccatactctgaatgatttttttcttttctttttcttttttttttttctctttgatttttttatagccccatttactcgagaacctcataatttcatttttaacaattgaatagtattccattgtataaatataccactatttcattatttattcatcagttgatgaacatataggctgtttccagtttctggcttccatgaatagtttactagtagagtcttgaatcttgaggtagatcaattcacaacttcctggggaaaccaccatactaatttcaacagtggctgtatcagttttcactctaatgagcaaagaataagtaattcccttcccaacatcctcatgaccatgtgctgttgttagttttatagatcctagccattatgaatggactagaagaaatttcaaagtagtattaatttgtacttctctgatgactaaggatgattgaacatttcaattttatgcagattgatagatatgaatctattttcatttttctatatgtagccatttagtttaacaagcataatttttgaaggtaccattttttcttcagattttttttaaatgaagtgtttctatgtgtgtgattttttttttcagtttgattacatttatcagggtgtttgtttttgtgtcagcaatatgttttttgcactgctatagttctgtgatacaacttgaaatctaggatggtg

SEQ ID NO: 19602 - DNA, 1179 bp, Mus musculus
agagaagtcaagagtgaaagccagctgcacaaagtgagttcaccctcctcctgaaagtcagtgaggcaggcgctccattcttgctcatagtcttgggtttctgtttcaatatgtgagttaaaaacatagtattctgagagttaaaattttggtgtttcgtcacacgaaactatactaaacagtaatctagtagttattaaacaattttttaatcaaaatgtttcaatgtttttttaatagattaaaaacaaaaaatcgagaaaaagaacttatgaaattggcccaacagtttgataaaaatatggaagaacttgatgtgatccaagagcaagatgggaagaatcatgattttatccagatgacttcaaaaatgggacatttagataaccataaagattctgtgcagaagccgtcaggtgatgtagttcctgaaatcacttgtactcctgtgaagaagcaaatgaaaggagacagtagaatatccttggcaaaggcacaagacagcagtcagaaaccctttgaccaaaatgttgaagcagcctttaatgctatatttgatggttccactcagatgtgtagtggacagctaagccaagatctgttagatgcttttttgaacaatagtaaaacttccttgagaaagaaaaatgccttactacaagaggaaataattactactgaaactttgctcactgaaaacctgctaaataaaactccaatatcactttcccctcaaatagatactaccgtaatactaaactcatgtgtgactccctgtcctaagacaccagcagcacctgatacacagcttgatgagttgaccgctaatgattttgaggatgattgggaaagcttactaggcagtgaacccttccttatggaaaatgctgaaatgcttgaattcgttccttctacaactgcccaagatacttgtcagaaggcaatttgtacctcagttggtgaaaatgatacaatcacatcaagaacaaatatgaatctaggtggaaggttaagagattcaaaagtaacactggatcttccctcaaagacacgaaacggagagctaagaaatgctggagaacataggttttcatcacatccaggtgatgaatcaaggaaggtaccattcacaggaaataaagtgagttttgagaaatctgtcactagcatagttagtaa

SEQ ID NO: 19603 - DNA, 1217 bp, Mus musculus
cccgcaaaacccatggtgagtcaaagaaaatggctcctcccccaaaggaggtggaagaagatagtgaagatgaagaaatgtcagaagatgaagatgacagcagtggagaagaggaggttgttatccttcagaaaaaaaaaaaaaaaaaaaaaaaagcaaagaggctaccacaacccgagcaaagaaggtggttgtttcacaaacaaaaacgggctgcagttcccacagcagctaagaaagcagctgtaaccccaggcgaaaaggcagcagccacacctgcaaagaaaaccgttacaccagccaaagtagttccaacacctggtaagaaggtagcttcacaagcaaacgcattgtaccaactcctggtaaacaaggagatgtcactccagccaagggagctaagaacggtaagaatgccaagaaggaagacagtgatgaggatgaagatgaatgatgaagatgatagcgatgaggaagaggatgaatttgagccaccggtagtaaacgaagtgaagtcagcaaaagcagctcctgctgctcctgcctcagaggacgaggatgaggaagatgatgacaacgatgaagaagaagatgatgatgaagaggaggaagatgactctgaggaagaagttatggagatcacaacagccaaaggaaagaaagctcctgcaaaatttgttcctgagaaagccaagagtgtggctgaggaggaggatgacaaggaagaagatgatgaggataaggaggaagaggaggaagaagaggagggaaaacctgttaaagcagcccctggaaaacgggaaaaggagatgatcaaacagaaagaagcccctgaagccaagaaacaggaagtagaaggctcagaaccaactacacctttcagtctgttcaatggaaaccttaatccaaacaagtctgttgctgaactaaaagttgccatcagagaaattttgctaaaattgaccttgctcttgtggatgtcagaactggcacaaataggaaatctcgttatgtggactttgagtctgctgaagactcaaaaggccttggagctcactggtttaaaagtgtgtggcaatgaaattaaactagaaaaaacaaaaggaagagatagtaagaaagttcgaactgcaagaacacttttagccaaaagcctctctttcaacctcaattgaggatgaattaaagaagtgtttgaagacgccatggagatcaga

SEQ ID NO: 19604 - DNA, 1212 bp, Mus musculus
gggtggaagcctgagcttactttaaggtcctcgttatcctgctaaaatggaatgcagggacctagcacaagtcctctctcttgaccccctctctttaaataccaatcagtgtctagaataccatactggtctgccttgggtcaaattcagtgatgtcaaccttgacatggcagagcctctgaatcaaccttagcaatcacccacttctgatcttagtaaggtagttgtagtctcccctcccccagcctgaaacctgcttgctcaggggtggagcttcctgctcattcgttctgccacgcccactgctggaacctgcggagccacacccgtgcacctttctactggaccagagattattcggcgggaatcgggtcccctcccccttccttcataactagtgtcgcaacaataaaatttgagccttgatcagagtaactgtcttggctacattttttcttccgccccgtctagattcctctcttacagctcgagcggccttctcagtcgaaccgttcacgttgcgagctgctggcggccgcaacattttggcgccagaactgggacttgaagaatggcagagagatgctaagaggaacgctgcattggagctccacaggaaaggatcttcgtatcagacatcggagcaacggacaggtacacatgctagcgctagcttaaaatttcagttttgtaaagtgttgctgaggatgcggtaggatacgaattaagcttgaatcagtgctaacccaacgctggttctgcttgggtcagcagcgtgttaatcggaactagaaacggaaacaggcaggttagccgcagctttttaggaagctgcttaggtggaagaagaaagggtttaaagtcatggatcaggcggtaggccgtagctctccgaagctacatgaggtgtgagaaaagaaagggtttattaaaaggaataggcgtattgccccagttaataaaaaatgcatcataagggaggaaaatgtcccaaaaagcagagagaaatatctctctgggccttatagcaggagtactctgttaccttttgtgtcttgtctaatgtccggtgcaccaatctgttctcgtgttcgattcatgtatgttcgtgtccagtctgtatgaatgaatgttctatgttttgtgttggataataaagatggtataaaaaactttatctgcaaagccgagagctgccacgtgtttcagcca

SEQ ID NO: 19605 - DNA, 1203 bp, Mus musculus
gaggggcacgctcagtaggcgggacaaagtgttttgtgagtgtgtttttttcctctctctctcctctctctcttttattttggtcgcaagtaggaagctttttgcactccaccacctctggccgctgggaagacgtcatcgcttccgccctacttcctcctcctgttggcggcgctgagaatccaatatggagtaaatcggtggagtggcgagatggggctcggacggggcgccctgcaccgcctcccaggcgcatctcccccggccgccgagcactacccggaaccctgattggcccggtccccgggggcgaccccggcccggccccagcgcagccgactgcccgcccgccgcccggagcgtgcttgtttttctgctgctctccccctccgggtccccttcccaaatctcgcctctgcaccccctcagagccccggggccgtgcccggccggcccacggcgtccgctgcctggtgtgccccttcccagacctcgccctgatctcggggctctccatttccccgcctgcctcggcgcccccttcatctctagctccccccctccaccaccaaatcaggagatgtcggagatgtgaagaaggggggcgagcgcacaggaagatgaagggagccaggctgcatgccgcgggacaggcgtctaggtgaacaagaaaatgaccgaagaaacacacccggacgagtaagttagccgcgggtgggacgcgggtgcccggaggggtggtgtgggggccgccgccaaggacgcaggaggggactcgtcggaggaacttggcctggggtgcagccgctggctgagctgtcggggctatgcgcgaggctcttgacttggctgggggagacggcagaaaccgcctggggtctgcaagtccaggtcgcagcccgggccaagggcgcgcaaatgacctcggggcggtcctcgggctgcgggagcggaagctctgacgccctccacgcggggcatcccggggtcgatgggtctgtgtgcatggtgactttgtgactcctggcactgctgccctcccatagccctctccggagccctctggggcccgggctccgccatttcgttttcttgaatcgctctcatttgcataccacattttcattcataaaaacacggaggagttgggggagggccagtcgggctcggcacagggtcagtgcgcccgggtcctcgcagcgg

SEQ ID NO: 19606 - DNA, 1174 bp, Mus musculus
acggaaagcctgctggccctgggcagcatgcaagctcagccctagaagaaatcacaggaaataattaaacagagaaggtcagagagagaggaagttcttgtgttgtttctgatgcggatagcattgttgttaacagggatcaagatgatggtgtttaaatcccctggcatgccactgcttggggctttgattgtatttaaattgcggctcttatagtttattcttttagacagcaatcttgttaggaaatgaattgcttttaggtcttatcaggaatccccgtgtgcctaagcagaaatcttaagtaagagttgcttatagcctagcatttaaatggggtgactgtcaagactattggaggttaattttaggtgtctgcagctctccctaacccttctgattaaacactttaacataatagtttccttaattggaataatgatggaatattagcatgcatattaaaccatttacctaagtctgaatagggttaaaatgtaaatgatctgtcacttgtcagttcttactctttgagataattcctggtgaggaatgagaagagactggaatatgaattggaggagggagggctgtacttgggcctggctgctggagatctaagaatagaccacaaggctaaaataagtgagagattctttgtctcccccccctgccccccacaaagaagcactaaaatactggtagctctcctgggaggaaggggacccagtgctttattagtctgtcacagttttcttcctgaggatcctgagtagggcctaaggtccattcccaggaagtctctttttaagactatttttaaagatttgtattttttttaactgtatatatgggtatgtgcctgggagtgtgggttcatggggaggccagaagaggagggtgtcagatccccttgagctggagatgtgagtagcctgacttgggtgctgggtaatgatcttggggcctctgtaagagcagctcttcctattaacggctctctccagctcttgcgggtcttgctacttagttttggttgtgtgtgggcatgtttgacccacagtgtgggtgtagaggtcagtggacagcttttcggagttgatctcttgtatgactatgcagggtccatcaatcagtcaaacccaggctgtgagaatttacccagggagccgtc

SEQ ID NO: 19607 - DNA, 1087 bp, Mus musculus
actggagttaaaaattgttgtgagctatcatgtgggtgctgggaactgaacctgggttccttgcaagagcatcaaagttctcttaacctctgagccatctgtggagccctgatttcttttcctttctgtgttttaacagttcacttcattgctcctgcccactctgagttgggcttcaagggggcctctgagttaccaagggcacctcgcacaaagggccagtcatttcacagaagccccagttctcaggcaggagtgctcctggtgggaggcagagggtggatcagccggaggacttgtggaggaactcagatgtagctgcttaaattagttcaaagtgagaaatgtaattactatgcttgctcaaaccaaatgtctgaacattgttatacaatgaggtgtaatcacagaaaaggaggttgcatacgcagcctcagcactcccacaaaatagcctttgtgttcccgcagccccggagctgattaatcttctgggggtgttgaatcccattaagttcaggtgtgtgtgctggacttaattggcggagtttggacactcatttacagtttctttgcatttgtagcaagtatctgaagaaagaaggaagcagtgttcagcgtcttagctaagagtaaaagatccccgaggagaagcaagaggtgactcgccactgaccccgttgtctgctgtgaaaggcggcctttttgaaggacattggctgtgattctctccatcaagctggaaaatagcgtgagagggcagttggggttctgattccaccatttgttagtcatgtgacccaggacagttaggcaggctatgagccttctgaaaaaatggactgatgtgtatgtgactgtgtgatttatgtaccgttggcacacaaggggatattagcaagctgtcttttagcataaccacattcacgaagatgtgtaacagcagacagacataccaggtgtggagacaagaggggagtgtggtgggaagccggagcctggagccatgtgaggctggtcctcgaatgggcggctgtggcctgcaggagaaagagaggcagatctgtttatattggagcaagtggtgc

SEQ ID NO: 19608 - DNA, 1153 bp, Mus musculus
tgtcaaaccaaggtgttctcattcaaaacaaggagagagaagtcacgtctttttttcctctttcagttttctgagggctgtgactaaaacatcctggcctgaacagtttcttgcattcttacttaaaagaagactctggcgcacagcagacctcttctagctatctttagtgggctgtggggtgtatgtgactaggaattcagctgtgcttactaccacggctgcatagcatacacgcttgggtaggactttagaatagcctcctggggctcggagatctaatttttcaagtacatggtatgtaagagtctctcctcaggtccgtgcgcctccaggacttcttgcaccagaggcctggaacttctttgtttaaaagccaccaccctcggccctggaaagacagccgtgccttgcttggagcagacagaaggctgacttcctttcagtcttgtgtagtttggccttagcgtgcctttggattctttacttctcgagtgtggccctgcacagatccatctctgtctggagactcagctgtgtggtagaactgcctcttccgtgtttaaaacttggagctgccttttgcctttgctcagaaagttgtgttttttcctcagctaatgttttttagggtttctgtcatttacgggcccatacggagctcaaagctgcatccgattcgggaatgtccacagccggcggcagccaggtatacagacccgtgcgccaaagtttgtcttttagataagaatgcaagaactgttctggcaatacaagtttagtcaaagaaagccctagggaaagtgaaagaagaaaaagatgtgactttcctctccctgttttgaacagaaacactaagatgtgaggagggccagcgggtccgggagctacagtgtctctaggcctctaggcgtttcttggcagggaggaggttagttaggtgggtagaattctgggaactcctggtggagaaaggggcgcctccctcatcttaaaggacagcaggtttgggtgtatgggtatagcatacacacccatgtgggccagggggagaaacaggagtattcacactgcatgttttgtgtgtgcctgtcacttgcccgaggacttgatcacatcatcccattcaatcctcttagtaacttttttccta

SEQ ID NO: 19609 - DNA, 1183 bp, Mus musculus
taaataggattcttagcttcataaaacgttaaagcttggtcaatgattgtaaactaggtttgaaagatttaagttgtaacatccttttaagtaatgggcttgactttccgactccagtgtcagattgtagagatgaatttattcgttcagttaatacctaacacccagaagctggagaatgtcaagcctgtgtatacattcaaaggctcacaaataaaaaaatgtatctttttgaagatggacttgtatactgcattacatgtttttcctaatgtcagggtgggctcccagtccgggttattgtcaggtctatttctgcagacaagtcaaaagaagtgtcagctggtggctgtcttgccctgggacacacgttctgcagctgctagaccgttgtcatgccctttcttgtcgttttagtgacagctatattgtgcgtgtcaaggctgtggttatgaccagagatgactccagcgggggatggttcccacaggaaggaggcgggatcagtcgcgtcggcgtgtgtaaggtcatgcaccctgaaggcaacggacgaagcggctttctcatccatggcgagcgacagaaagacaaactggtaatgacaagcacacatcgtggtggttaaaatagtgacgactgattctgtacataagctacagcccgcttccctttccagtacagtcgcttggcatgcaccttagagagtgcatgtggaccagggtatttgaccatcttgcttgtgtctctgattaatcaaggttataacaggtatttaaagcaaaagtatgttctttattattacaagtcatataatgacaaactgtagagtcagggttttccttgtgagatttggatggtagaagaaaacaagtgagagagcatcgtcacctaaccttggttccttctaaataaacgtttgtctgcaagatgctggggctgggaggtggcccagagcataagagtgttcgatgtgcaaacatgaagaactgagtcagatcccagtacccacataagagcatggtggctgtggccttttaaccccagcactgtgattgacaggagcgtccctggggcttaacaacccaccttagctccaggttcagtgagacactctgaggagaaaggtgaagggggtgataaagcagggtacttgatgtcgccctctgatctccactcacagaag

SEQ ID NO: 19610 - DNA, 1141 bp, Mus musculus
agtcattcctcagactcagttgttaggaacatggagttgtgctgacaatcctaatgttcagttagtaataataccaccagaggagagctgcagggactaaacactttgcaagacacagggaatgggcttggtgactaatggtgcaggggacagagaagcaggaggcgaatataaccacaggagttctgagccagggagaatgagcagacaagggctggtgttgccagataggagaaaatcgggagagatgaactcttcccggcttgttgtattgattgacgcggggagacagacacccatggggacagacctcccagcactgtgggggcaggaggaagaggagtggtgtccctggggatgagtccaggtggagaggtgcacacatggagaccagggtctgttgccatcagtgttggttccccattgggttcacaaccggcaccattacagctgtcacatgagtaaccagcctgtgtttcaatcctttaggtggtattggaatgctatgtcagaaaggacttggtctacaccaaagccaatccgacgtttcatcattggaaggttgataacaggaagtttggacttactttccaaagtcctgcagatgcacgagcctttgacaggggcgtgagaaaagccattgaagaccttatagaaggtactgaatttgctgtcacttagtgggactgtggattgttccagattactttccattcaacagtctgccatcttgtatctgtggcttgtttgaaggagggtttggggtcattagaaggtcatcagatgacaacactttccaagcgcaccaagtgagcagttgtggggtagcctcgctggctgagagtgtactaagcagctctgggtctccacatggatgggcttcacccatttcacctgtggcgtggaacacagggctatagctgctttgggatatttactgtgtcatgtaagtagctagtctgtaacatgaagggctccattagaagaatgttatccagagctggataaagtactgggtgttaaggcacacatctttagttccagctttcagtgagcagagacaggaaaatctatcgcttgagtttgaggccagtctagtatacatagtaagttccagggcagccagggctacatagagaaa

SEQ ID NO: 19611 - DNA, 1736 bp, Mus musculus
gaccagggcttgcaaggcgatttgggtttctgtgagcttgcccagttgacccgaaaaataggactttttagaattgcattgccacttctaaaatcctagcaatacttagaataacacatcagtgagataaattttactcaattattttacaaaccaaattgagttattcaaacacaagccagtattctgtgaacaagttccagatgaaaaacacagaagttgtgaatgaagttgtagccattccctgccctgcactatatttttcagggtgcattttaaatactattgattcaaacagtggtggcttgcgtttttttaggtatatatttttggttagttttttggggggggttgttttgtttttttaatttgaggctcaattcttcatttatacttgaaaaaaacaaggccatatgtaaagaaaaaaaaaaaccctctttcaatgcctaagtgtcttcttctatcactccacacccacagttgccacttggggtgcacagataagggtaggtcaccaactgattatgcctgtctctgagccatgcaagaggctcctaatgtgctgggggggggagcacatatgcatatatatatatgagaatagccaacttctacagaaaaaagacaagtggaagtggtttaccaatacctagcatggtacaatcagagctccgtggggactgtagggagcagggtgttactactggccgttcttcccacagtgattaacggtagagatcaagctcagtcccctttatccccccccccccccaagctcagtcccctttagtccttcttcccctcccccctcccccattgcacacagacatccgtctttaaaggaaaaggccttttttccagtcaatcagtcagtcagtcagtcagtcagtcatactgggagaagctagccttgcatccctagcactgtctcttcctggcagtgctttctgctcgcccgacagacagcctgtcgtgtctctttggacagacggaccatcagtgtagataatcagcatgcttgtgcattacgtggaggttggaggtgtcatctttgttgggatgactgattggggctatctgttgtcaacaagcgtcgtctccaccattgtggatggagggggtctctgtgctaggagactctatagactgcctccagccgccctccagtgctgtggagagactgtccccagcctgagggactctcctcgggccctcgcctctctaccaagcacaacactaatcctgtttccttaaacctccgttcaagtgcccctatttatttcagtgagaatgcgtgtccggttgcctctgtccctgtttgtgcgtccttcctcccagccggttcccaccctcctaagggttatgccagtggatctcacgcctctgtgcatcacctatctttggtttgtgaaggcagcagttaagggcacaaagacagccatggggacatttatgtaaatatgtttaattgccacactgcagctgaacggtgtgtagtattttcccagtcagctttgccatactgacgtcaatcatttgagagaaattattcagattttatttttatatccatggtaacagaacctaaccaaaaggtttcccgttcagaagtttccttagctctcgtcccaagctattcgctcacattaacaagtcaaagtgcctgaagcataactcatttacctgtatactaaaacccctgttgtactgatttttttttataataagccttttta

SEQ ID NO: 19612 - DNA, 2686 bp, Mus musculus
cctttttaaaaaaatttttctttattgccaatctttgaagtcattcaacccaggactgaaagaggctctctgtcccttttgacagaaaggtcaagtttttctctgtcttggggaagcattgctaaattcttgttaatatgggtaaatctggttgtttaaggctaccaaatctttgcagacattaccagggcaaggggttgctgctgctctgtttctttctttgtaggcatttagaactgcttgtaggcttccaatttttgctttcttgctctaatgctgctagctttagttttagcacagtaggtggtatgtctttattagcataagaaaaactttcacaggagcttttacatatgctgggtgggggtggtaaggggtgggtgggcagcccgagcgggagggcctttcctctgtagtgttagctttcagcaggtcactgctgctacttttgaagtcccctgaagtgtctcctagtaacatcttagggaaatattaagctcacaactaaggtgtttgggctagagttttatgtgatggaacaaatgggtgacctttctgttgtggcttttgaggtcttctgctctgggtacaaaagatgcatgaacctcatttacaatactctgacttggtagttttcttctttccgtctgcctggaactgttcccatatgacaggaaaaaagcaagcccagtgttttattaccatctgtcagctgggagtatatttcctatactctatcagtgaaaaagtaacattttaaaggaaatgctttttctaggtcaaattacagatagaaaattgctcaagggccagcattttctaatgctgttgtttttcctggaagcactaaggaaatgaaccaaccaagttccactcttgaaagttgtacttttatgttcctgatcagtgcttctcgacaagagctactgtacagagaagtaattcatggctgtgggttaattataattgttgtagtaacattcacattgggacttggtgccagttgttttgttttgttttttcatgagacttgggactaaaattttagcaacaacaaccacaatagaaaatttaccagtagtcaaccatgtctgtacagttatggaggctacttcccagccctctttggttcttgcaggaagagtgtttgcaggcctgtcctgttggtattgtttgtcagctcagaaagaatcaggtggtacccaagtgcggggtcttcctaacgttgaaaaatgaaacgagaagctgtatcacagaaaatacaaaatgatgattctgagagaaatattttccttcatttcaaatgttctttactaatgatgaatttgaaagaatggcttttttccttttttcttttttttttcttttttttttttttggatgcttaaaatcagaatttttaatggattttttaagataactttaattagtttatatgaaatcagcagcaaaaggaagtttgtcttaataatgcagcttctgtgatgttaagtatttttgcctgttttacctcaatttgaacaaataggagaagtctgtgtgcatgctggacatgctcagtacacacgacagcccgccggtgcagtgcggtgtcagctgctcggtgttgggtgcgtgactcagtcacagtggaatccctaagcgttcctaaatcatgttgtcaaattctccagtctcgggagttctgggcccattacctgctgtgcataggactggtaccaaggactattgagtgtagacaaacgatcaactcttggctttgaccatggctttaaacaaaggggtgaaaacaagaaagaataggatggaatctggaataaaacagtgaaagagcattgttctttgtaccttgaatgtagaatttgtttttatttcataattctgctagcaaacatgactgttaaaatgatgtatttatatatgtaataatttagaaattccattttatagtttcctatcctaaggtgaaataatgaatttagtaatttgggagttcggacatactgtattctattggaggtgccaggtttgagtccttcaaaaataaaaaaaatttaaaaaatctgttttttaaaagatctgatttttagctctttgaaacccatcgtcacttagatttccaatgctaattaaaattcttttatttttaaattaaaatcaccaatgccttgagggtcttcttagaaaatatggtattggatattaactttcatagttctgagcactattagtatctatctgacaagtattgggaagatcaatggaaagctaaatattctaaatttaacacaaatatacttctttttaattaagaaaataaataagatttttcaacataatttgaattttgtctttttcttttagtagtttttctctttaattttgatatttttatttgtactttcagttttgctctgcaagatgtgttttgaacccagttagttcaaggtcattcaaggttcttttgctgttgtttatcttatgtggagtagacagaagaaacaggtgtcatagccaggttgatctggaactgtagctgtgtagccaaggaggacttgaactcctgattctcctgcctctgccttccaaaatgctggggtgaggtgtgcacaccagtgccgagctctggtttagtgtttgttgtgacaaaactatttctactgaggtttacttactattataacct

SEQ ID NO: 19613 - DNA, 1187 bp, Mus musculus
agtcaaatacaaagaaagaaagtcttcagggagcaaatgctgcctgccatctgtgattagaaattaagtgctgaagttgagcctaggggcacacaccgttagtcccagtgctcagaggcagaggaagaggcagaggcagaagcaggaagatctctgtgaatatgaggccagtctggtctatatagcaagttccaggatagccaggaatacataaaaagacctgtcttgagaaaaacaaaacgagaagaaatgggggctggagagaaggctcagcagttaggagcattgaatgctcttccagaggacctgcgttcaattcccagcacctacatggcagcccacaactgtctgtaactccagttcagttccagggtatccgtggcacaggacatgcctctagtgcacacctatatgcatggaagcaaaatacccatactcataaaataaaataaatctttaagaaaacaaggaaaggaaatgctggctctaagcctcactagccacctttttgtgggtggcatctctactacatttgaaacgttctcgctttgattttctgaattaactcagaaccttctggttcttgtgcaggtttactgactggtgtagtagtggactctggagatggcgtcactcacatttgcccagtatatgaaggcttttctctccctcaccttacaaggaggctggatattgctgggagggatattaccaggtatcttatcaaggtaagtgagaggaaaatataataaaaggtagtcttttttttttttttttttttttttaagtttgtttattgacttatacaaagacagaggctagagagctggctcggtgatcaggcgcacatactgccttgcagagaaacatcttggttcccatcttggcccgctcaccattgcctgtaactctggttcccatgaagtctaatgccttcttctggacctctcaggcacatatccacacaaagacacacaatacacataatttaaaatgataaaataacttagaaaactcactatacaagagttgtagcctcaccccaggatagcattattggctttgctattggttcccgggattgagtttaggttgtcgggcatagacagcaagtgcctttgaccttccgagccattttatcctctaggagattaacttttgttcagtggaactcgttctcatagatt

SEQ ID NO: 19614 - DNA, 1240 bp, Mus musculus
atatgggttttatttgtgctaatgctcttcttttggaaacatgtattaaaggtaaggtcaatttattgatttaaacacatagtatataaaatattgatttaactctgtaagctggtcttgaaagaaaagatttttaacttttaagtaaaaaaacttgatctgcaagttccagaaagtttaaaattgaatcattcctgagttttctgagctgcaggaatatcattttctaaaacttctttatgtaaagttttaaagctttgatatctcatcttgtaggaccttatggttggtgatgaggcaagtgagctgcgttccatgttggaagtgaactaccccatggagaatggcatcgtgcggaattgggatgacatgaagcacctgtgggactacacatttggaccagagaaactcaatatagacaccagaaactgcaagattttacttacagaacctcccatgaatccaaccaaaaacagagagaagattgtagaggtaagttttgattggctagcataatatccatgtgtatctctgaaagaatgttaaatcggttttttttcttcttgctgcttctgctgcaaaggataagtaaaacaactgttttgccctagatcccgattattttgcatgtactcatctgaaatctgaagaccatgttagcgatgcacatgaaactgaattttggagcattgtagattttggagttttggagtaagggaactcaactggtaaatgtaaatgggcaaatattacaaaatctaaaagcagaagtctctctctggcccccagcattttggataagggacagtgaacatgtatgtgctagtagatgagactgctcttctctccctaagttaggtgattgagttaagtagtttattagaaagcagttgatctagtggaaaaatagtgaagttaggagagtgagaagttgtggtgataagcctttcattgtgacagtgctgtttaataaagacaagctaaggaagctgctgggtagcagggaaagggcatcccaaggcagagagaagagctagcttggcatctgtatacttgagagcaggcaagcggctgctatggctggagggcctaggaaggggatggctgaagaaacaagctagagtaagtagtagtaccttgctggtttctgtaggagctggcctggggcagtgcgggcaggagggggctgctgtagctaaggtttagagtttgccgtgagtatgccacagagagacagcag

SEQ ID NO: 19615 - DNA, 1117 bp, Mus musculus
tcttgcctgagcagagctcgtcaagctgtctccacccctcctcactgtcccaggcttcctgggagccccctccccctctgctgcggcaccgccctccgccgagttccttcctcctcccctcccgatggggcaccgactcgccctgctgccacgtctcactgatgacatcaacacagcccggtcggccttagccaatccgctagggggagtccgagcgaagtcctagccagcaggccagcggggaggggagcaggaagggcggggtgtgggggtgagggaatcgggacggggcgggctacaagctcgaaagtgcgcatgcgttcagggcgcggggcctagtgggaagctgagtgcagacagccctcggcccggtcgggctgcccagcgcgcggtgtgctcatgactctctttcccagcgtgccccgcgacgctgccgccctctgggccgcgccaggccccttggcctaggcttccccagttcctggttcgccggcggccattttgggtggaagcgatcactgagtggcggcggctgctgattgtgttctaagggtcggagtggggtcgacgtttgctctaccggaacagcttagctcattcctccctttccattacctgtggcgcggagagttggggcggcggctgcgtcagcaagggcggtggtggcggcggcggcggcggcagctgcagtgacatgtccagcatgaatcccgaatagtgagtgcaggagagccggggcgggccggggtgagagcggccggccgggggtgagggccgccgggaggttcgctgcgcagcgccgggaaggtcggccgggcgaaggagacggagcagcctgagggccccattgtctgaaggccgagggccgcagcgcagcggggaggggtcgggcctgcgggccgggtcccgaccgcagccggcggggagctaggtgccgcggctgggcgttggggagagggcctcggacagtagccaggaggggcgcgtctctggaggcagtgacggctggaggaggacttggttttaaggggaggtaggtgggagagctctgctagagggcactgtcagaccctgcgccggctctgcggagctgtcagcgtcggctttacttgtaaat

SEQ ID NO: 19616 - DNA, 2739 bp, Mus musculus
cagtgaaaatgtcaacaagttgttggtagggaacaaatgtgacctgaccacaaagaaagtagtagactacacaacagcaaaggtatgtatgaggtttgactttgacactgaatttaattatggggactgcctcaccctgtaaaagccagtgagcttagtcccccattcccatttcagaagactaagtcagaaggattttccattgttcactgtgccttattattctctcaggaatttgcagattcccttggaattccatttttggaaaccagtgctaagaacgcaacgaatgtagaacagtctttcatgacgatggcagctgagattaaaaagcgaatgggtcctggagctacagctggtggtgccgagaagtccaatgttaaaatccagagcactccagtcaagcagtcaggtggaggctgctgctaaaatctgcctccgtccttttctcacagcaatgaattcgcaatctgaacccaagtgaaaaaacaaaattgcctgaattgtactgtatgtagctgcactacaacagattcttaccgtttccacaaggtcagagattgtaaatggtcaatactgacttttttttttattcccttgactcaagaccgctaacttcattttcagaactgttttaaacctttgtgtgctggtttataaaataatgtgtgtaatccttgttgctttcctgataccagatcgtttcccgtggttggttagaatatattttgttttgatgtttatattggcatgtttagatgttgggtttagtcttctgaagatgaagttcagccattttgtatcacacagcacaaccagtgtctgtcagtttccacgcataaagtttagtgagacgttatatgtaagatctgatttgctagttcttcctggtagagttataaatggaaagattacactatctgattaatagtttcttcatactctgcatataatttgtggctgcagaatattgtaatttgttgcacactatgtaacaaaactgaagatatgtttaataaatattgtacttattggaagtaatatcaaactgtatggtgataagtattgttttaattcctatgattaaagggaaatagagctttgcattctactcagcagccacgtgtgtgcagcaagggcactgtagacctatcttaatagcacagcatccagggtttgctttctagtaataggtctgatgagtgacctagagaagcttttgtgctgtgtagagacttcaccaccttcattggttcaaggaactcaaactctagtgcttcatctccagcccaggccacctgaagtggcttcaccagcaacccttttttccctcatctgtggtagagatggagagcagcccatgcttcctcccaggcagtgatctggtaatagtgctggtgtttcttcatgctcagtctgatggcgcacacacctttttctttcttttttctttttggctattggagatagggtttctctgtgtatccctggctgtcctggaactctctctgtagaccaggctggcctcgaactcagggatccacctagctctgtctctgagtgctgagactgaaggtgtgcgccgccacgcctggcttttttcccctttcttttttgagacagggtcttactatgtagccctggctagcctggaacttaagtatgtacaacaggctgcctccccctcccccattcacctgccttttcctcaaaagtgctgggattaaatgatgtcccagactgcacctattttttgagacaatgtctcatatagctcaagaggcctcaaattcacttgtaaccaaggatgcccttgaactcctgatcctcctgcctccacttccaggtgtcaactttattctttccaattgtatgaatcatgttggtggagagtttaagcattagaatagaaagcaggaaatgtgattgccctaattgtagaaattctatctccccccccccccaaattaaatgaaaacatgaacgctagatgggaatgatgggagaaataatatatttatttcggtgaaattttgcatgtgtgaaagtttgttaactaggatcttcgaaatcctagactttgcttttgtcttactgtgggaaacaaagtctcttgcagacactagcattttaaggtgacaaaggtcagagattgtttcctttggtttaaggagcagccaagcattcttcaattgggggctagggtagggtatggctgttgataacacattttatcatggggtctttaatgataaaatattaaactaaaaataagccagaaattacaggtttatttttcactaaacagacaattgaaatacatggtacaaaaataagtggtaagattattgtaaattgaaaaatggacagaataaatattcaatttaattttccatctatgagaatttcacaataaaatcatagtttactttgtattatagatgcgcttgttgggtctattcatccttatatataaaaaggtaactggaaactcctcaagtcaccaggaattgggtcaatatcttttatttttttgtagctgttggttttttgtcaatataaagggagaaagagttcataaactgttttctatcataactaaatgatacaacaccaatataggatgaaatggtgccaagcactttaattttacacagcaaaagttgttcaaactgtcagcttattctgttagcagaaaacattacatgaatttatttttaatataaacatatttacaga

SEQ ID NO: 19617 - DNA, 2025 bp, Mus musculus
acttaggattctcaggcatacagggggatgggatctaagagagaaaatgttagtggccaaaactgtagagtgaaatgctcacccttagtaagtcgggagaacctctacagagtcctaggagttgccacctatagtggtcagtctccacttcaaccatgtcaagaatgctcaggagctggcctgccatgcttctgaactgcatgcttgtgctaacctctggggatctcaggccacagttctcttccccttggaagactagtcagaggactgggccgggtagagacagccacatggtctgtgcgtacgtaaattaaagcagccattggtgatgaaaagcggggagtctttgtagtttgggagtgaacaggaagttgtgccttgtcaggaagaaaagaattctatggacctatcataggtccatatgttcaaagcatcagttacagctttccaagcaaagtgtttgtatgttggctaccacaaattccacaaagtatcaaaggtgggcttttcaggtttaaaaaaaaaatagctatttagataagcatgtacatgactttaatcctagtacttaaaagtagctctgtgagtttgaggacagtctggcttgtttattagagtccaggctgccagggctttataaagaagaagaagaagaagaaggaaaaaaagattcttcagtaagtatgcataaaatacagtatttttacatgcctgatgctacacagcatgatttaccataatgcttatgggcatgatccatattaagagttttgttgttactggtttgtttttgggtttttgagacaaggtttctctgtgtaacagaaccctggctgtaccgggactccctctgtagactaggctggcctcaaactcaagagagatcctgtgcctccccaagtgttgggattaaagtcatgcaccagctcacattagttttattctgccatctctaagttaaacttatttcttatactgtacatggtacataaagtgctttcaagaggctaaaacaaaacttttctagcaaataatttaagttaaatgtaaaatatcctataaaacctagaattggtcaaaagcacatcttacctctcatgtggatttaaactgccttcccaccaatatgttaaaggagccctcaggtattaaagccatttgtcaagcatgaaagtcaggagactcatagagctagccagctgctccaactgaatgcaaaatggggcactcctcttcttttgctgtataattacaattgattcaactgacagtgagcatggtttcccaacacaatactggcccgaacatgctctatgcttctgctcatcctctttgtaacaagaagatagactttttgtaactaaagggtgtaactctgaccttggctgtgaatgccatttaggaatatcaatacaactgttgttttatcttctggtgtgtgttatgtttgagctaaaatgtctcagccttggatgtcactaccatttgcatctgtaaatgtggccaggctagactcaaatagcctttttagaatttataaatggtcccttaaagttcagagttcacagtaaagtagcatcttgagacagggttgttacaggtctacagtgaagctctagcacaaaacaagataattcaaacagctttgaaacttaaaatgacatcgtggtacaagatgtggccaaatatgagcctgagggaactgtccgaaagagcactggaccttaggggagccgtggccaactgagagagtgcttttcattatgcacgtttctctatggcagtcatttttaaaatatatcaagggacagttttctattatgtgaacatattagagcccccaagagtcttgaaatatttatacttgaaaaatgggttatttcccactctaaaacagcaattatcagcacatacatgaaaccaaatagtgaagcatgctgaaatagtctggtaagccctaatcttgctgccagtggggaaagagcactagaattttagtctgtaaatatgtttatattaaaaata

SEQ ID NO: 19618 - DNA, 2701 bp, Mus musculus
ggaactataactgtttgctcaggacaggaggctgacagtgaagacttccaggctacgcttgatccatctcaggtgttgggcctcagccagcaaccacacacctcaggtctccctctcccgccacagtggaagtccacggtgagcccaggtgctcctcagctttctagcagaagcatctctgcctcctcggtgggcagcagtcttcaggatcaccaagagaaggcaggacctcagagggcctcttttgccaatgtctcctctcccgagttgactgtaccccaggcagcccactctgtggtgggggcagggcctccgctccaggggtcagcacagcctctgacctctggcagtgatgctacaggcctgggtaagagacacctctcctttcaggcagaatactgggcctgtgcgctgccaaattctctgcctccttcccctaaccgccactccgcactctgggacccaaataaagagtatgaagatctgcttgactacacttacccactgaggcctgggcctcagctcccaaagcaacctgaaagtcatgtcctgactgagcctgttctgcaggactcaggtgtagatctggacagtttgtctgtctccccagcaagtactctaaagtcacccactaatgtctcccacaattgctcatcagcagaagtgcctactctgccattttctggagccagagagtcatgtcttaagcgctggcccttgggaatattccagaaacagggtggcacaagcttgtcatcctggaaccagcttgcatcaacccctagagccccaggcactgaagatgcttcttgggagaacagagaggcagccctgaggggcacagcggaggactgcctccctataggtgaggacctccgaatgggctctccccagctgaagacgaaggagaaagagccaccctttcccagacagaagagaggcaggcagcatgttagctgcccggcctgtgtgacgcctggatggccatcagaagaggaggtgggaagtgatgaggagtaccttgctctgcccaccaggctgactcaggtctctagtttggtgtcctactcaggtgccaggccctcctttgtgaacctacacactggggctgctgaggaacacagttcactacaagtctcagacagtgacaagccagcctcccccacattggactccagccacaggaagcatccttctggaacttcctttcaagggcctgtgggccagaacccctgcttcaggcattctatccagccccaggactctagaggcaaaagtagtctgatgagtaaccagaccctcggggtctcttcaaaaccactgaaaactcagcccgcctcaaaagccatgacggacaggcggctgttctccgagctagtagctggagagacacttcccaggacgacagatgagcaggagaaagcttctctagtgcagtgtgtgcaggtaaaaatgttcacggagaatcttctggaaggagtgatgtttccccagcccaccaacagcatgtctcggcaccctcaacatatatgaccccaaattagaggtatcgttctcctttagtgattgcaagaaaatggcagagaaatcaggtaacgcagcagcagtgttccgtgtgctttggtagaggctgatccacagttttactagtttactcactcatcctgcatctgcttttctgcagagaaagtttagtggtcggtaacggcccttgttccttagttccactctcaccttcagggctctgcattctgagcctagttctgatatcacatctggctgaggcacagccagttatggcattcattatcctggcagaggaaaacctggagtcttgggatagaggtggagacaaatgaccatctgaaagaaaactctagaaaatttgtatgccaaaatgctggtaattttagccttcggacaagttaaatagcagctcagtcagatgtgccatgtagacttctcttgttgtactgagccctgaacatgcctgaagtaggcagacttcatcactgagctcagtccagcccaccaattgttcttgtctccacagacattttgctgtcggctggaagagctgatctgctggttgtataatgtcacagatgttgctgacctcagtgctccacccaggaccagccttacaggtctcaagtcttctctgcagctttacagggtaatatgtagtcctggcttgtttatccacggggatgggagttaagtcacttttacaaaataaaatctcaagtaactggagtcttgtagctcagttgactattttatctgataaatcgaattaagatgtccttttcaaattctcagtgttgaacactataaaatgtactaagtgaggtaagaggataattacatacattggagccagaatgctttagaggagtttgcatgggattctggcagatccctcagggctagaatcctgggctttgatttacagacactaatcaagtatgacaattagttagggtgagcaccacagctatgcagtggccaccacaccaggcagtgcagacacagaacgtgccagcctcaccgcaagttcttttggactgtgttggtgtttatggggttgagctgaaactactgggatccaggcacagacaaggtgatgtgagactttgggttttatttctgcctttttgttactacggtctgttatttcacacctgtgaattttagttaa

SEQ ID NO: 19619 - DNA, 1195 bp, Mus musculus
agataggtctaagcctcccctcagaggcccgcttccttctgccagtgtgggcactggagaggttttacactctatgggcagccaagtaagtatggtgggagctgaggtgggggtgtcctttccttgactgttaacctctgtcctggccactgtaaggtgggagctgtgggatccaggtatgggctgttatacaggttctcttggagagctgaaccttcccaaagagtcactgaggacctcttaaggacagtgacaagttcaccaggaacctactgtggatcaggggtctcgttacaagggaacccccccacccccttcctggttctgatttagtgatctgaaagcttctaggggaccctgggaagacttggtagagggctgtgggttcccagaccaaatcctcttggactggtcagaacctgacgctcctttcgtgcgcagctgtctctgctctccatgactggaggacaaggcagcgccctctctagtgagccatgtgggccagggaatcccccatgttctaaggccagtgcaaggctctggatcttttaagcccttgtagtgggagagactgctcctcctggctctggcaaccgattatattcagcctacctcagcgcaggaacagctttgatctgagcattgtggcccttggctctgtctttggagccccgtcctgtgagaagaatagtaccttacggaaggcggtagaaacagtgcattaacatcaggtcagtctggtcctaaggcctcatgttagttaccctgtctccttctgtggtgagttactcactaaagatgaaggtccagagtgaagagggactccttttgccagagtatactgaggcatgaactgaagagggcacacccaccctacccccacggttagtggtgatggagagatctttcacttgccacgacccatagtcaaagaggtggcagaactgtctttgagttctcctctcacaaagtgactaagtaacttaggaaaaggtggttagggcttcattacaggagatttccgaaataggatgagtctcggtactaagcactagcagcgggcaccctgaaatcccctgaacgctctgctcgtcttccttttcttagtataccaagcagtcggtttaaccgtaggatccttagaccaacttcgttttcattgataatcttccctattccccccccccccccagtc

SEQ ID NO: 19620 - DNA, 2229 bp, Mus musculus
gtgctgtgattgggctgggtctgggccagcctgccagtaccagcaacccaccctggtagcctgccccattgatgtgggcatggccctcatacacttttcatctcccaaggaatgctttgcccaatcaccagtttgagagtggcctctcagcactggcatgaatgcctcctgagctagaacactctgccgtttgtcttgatccatgtctccatggagctctggatacaccttgagtctataccccttgagctgccaggcctgagggattccaagttcatggaggcctggggaccaaggttggggggcgatgcagatggattcttcactttcccctgggagcgttgcatctggtgctttctgggccaaccagaagggttgatagttgtctgtcacgttgtctctgcagcagcagacactgaagagcttcccagagtcttagactgagctggaatctgctgggctgccgctgggttaaaggattatgctccacttgtgtgggaggcttctaaggggccagaggtaaaacaggtttagagagaccccctgtgacggttagcacagctaggggctcagtttgagtaaaccataaactctgaggtcaggaacagactggggagcaccctaaagaagatgagacagaattgttcccactctagactgaggctcctgccaacttcccctccatttccatttggacttagccgcagaccataggacctcctcctctgggaagggtgatgtggtcactgcactgtggacttgtattggttggtcagtctattactacagtttgactaggtccttcctaaaatgctgctgagctacaaagtcatatactcccccaataaactcacgcgctggcgcagctctgccccaggcccctgtctggtttccacagtatactactcgcttgtgtgagacctatggttagtcctgggtctgatgtaacttgcctcttgcctacttcactggaatctgataaggccaaggatacgtctgtggaaattatcgttttgctccttggaagtcaagttctaacacccgtaagtgcccagcttatctgagagacagcttttttcgtgaagggtgcctactggcgtgagcaactctcctgaactgttaccctcacacttccgaagctaagctctgaagagttgtgaagacattcaacgcagccttttcttaatgagctacccaacttctaccacattcctgggtacccaactgtgttgttactctgaacccacagtttctgccaataccaccctaacaggagattaagtccctaagtcattggcttcatgctttcgaaaccttgctttctctgctgtgttgtcaccagacccacacatacttgggacagagtccgttttaaaatggggcctgtgcctgagtgaaggggtgggcaaggagcagagcccacagccagggtaaaggacagctctctgaaccagctgtgccactgcactctcctgtggggccaggaactaagcggagagcggtaaaccttattcccagcactgttttttaaaggggaatcaatcacattgtttgattatgagtgagcatttggtattttttcagtttcagtgtatcttttcctctgtatttacatatactttatgtatcaagtgtgtgtgtgtatgtgtgtgcttttagctccaagcaaacctgagtttggataaaggggaactaaactacaaattatgtctatggtatcctgatattcccatttctacagaatcttattatgtaggaactggagctggacagtgaaaccccctggctggcactcaggtctcagcctggacccacagtaacaaatgctgctgtggacagagggagatgtttctgtgtgacatgcgtgggatctccctcttggaggccaaaagagaaggtggccccgcacttccctgagttctggctctcagagaagttgatggagtttcggaacagggaagacaccaccacaactgactgaaatatctcctggctatttttctaacatgttcatgtattgatgttttgtgtatgtgtgacatttgccttaaaacgtagcacagccatcaagcctgagtaacgtgtttttcctggcacctgcctgtctttgagtcctgtcttgtatttgatggagctgttgcgcttttaggggttgaccgagggtgtctgagtacagtcttcctttcccttccagccagcgtgagaccctggggtgagaagggcggttcc

SEQ ID NO: 19621 - DNA, 1193 bp, Mus musculus
cttctccttcttcttcttcttctctcctcctcctcctcctcctcctcctaagaatttgctttatatgtatgagtgttttgcctgaatgtgtgtatgtgtagtatgtatacacctggtgcctgtggggttcagcagaaggcatcagatcttctgaaccggagttacaggtgtttgtaagccaccatgtaggtgctggaatctacaaaagcaataagtactcttaaccaaagagtcatctctccagcctctatattgctgcttttgcagaggacttaggttctattcccagtacatacgtgataactcacaactctagcccagggaatctgacattttccttgggtctccaggggcaccaggcacactggcagtctacatacacacatactcacatataggcataaaagaaacttttgttttgaagggcttttctattcttattttatgtctgtgactctttgtgtgatgtatgtctctgcactacatggatgcagtatcaacagaggccagaggagggttttggaccccttgagataggatttacagacagttatgggttgccttgtggatgctgggaattgaatagggatcctatgaccaagcagccagtgttcttaagtgctgagccatccctcttgccccaaaataaagtaattttttttttaaattaagaatggactctgggaggccgggcagtggtagcgcatgcctttaatcccagcacctaggaggcagaggcaggcggatttctgagttcaaggactggtctacaaagtgagttccaggacagccagagctatacagagaaaccctgtcttagaaaaccaaaaaaaaaaaaaaaaaaaaaaaaaaaaaaaagatggactctgacactgactgctcttccagaagtcctgagttcaaatcccagcaactacatggtggtggttcacaaccatctgtaatgagagcagatgccctctcctggtgtgtctgaagtcagctacagtgtactcatatacctaaattaaataaataattaaaaaaaaaaaaagaggactcaaatggcagctcaaagacaattttattagaatttaacagaaaaacttcagggcaggccaactataaacttcactggctgcccagaggccaggagtagaggcaagaaggagagagccaagcttggaagctggcatagaagtcaagcacttgat

SEQ ID NO: 19622 - DNA, 2670 bp, Mus musculus
caaacatgcattaagcagttggcggggagatggctgtgtttcttggggtagggagggcggagttgatgtggcaggctccttagctccctcttttgaacagaggctgcatcatcttatttaagagtggactcagcagggtgtggtggcacacccctgtaattccagcatttgggaggcaggggcaggcagatttttgtgagttccagtccagccagaactatacagtgagaaaaccctgtctcaaggtgggggtggggagggagggggaacagggggataaaaaacaaaacaaaactgtatttatgccaagttgctattttaattgtttttattttaaatttttgaaatgaaaaccccagtctttgtcttttggcatagcttttatgacgagaccacaattttacacaacaaaattttacaacaagcaactgaccttttgctggaggtgagccccacttcagtacttagttccccagaaggcatccatcgtgttgctgagctgcctctcccatgtcctttccctggagcttttgttccctctgttgctaagagctgcaaatggcatctttctgatcagcacagtgagctagctctgcgcacctccgccagccgggacgcgctcgctcgctctcctgacatctgtgactagagccgcagtccaccgccttatgtcatggtgtccaatctggttgctttccttaattaactgctaatttaactacactttacaaagctgttattcccaaatacatagagaggaatttctatgcacgtctctggccttcccctacccccatgtgctagcccctccagcggctctttctttagtgatccccccaacacgtgcactcatgagatgcagtcgtttgttttagtgtatcaggcctgttgctgaaaccgcctttctgtttcatggctcgctcttgcagtgtggtatttgagctgttgagtgcaggttacaacctatatggcttctttagaaataacttttatatttatttaaaaaaacttaaattatgggattttgtttttgtttttggttgtctttgttggtcatttgtcaatatacagtcaccaaccaactctgctcacttcttgccatggataaaatgggcctttctggccaattaaaaagataaattttataaatggcactttaaaacaagccataaatagatttatttttataatgcacatggcaagcaaatgcatttgtgatgaaggaactgctcatccaagcagaagatttgtggatggtgcgattaatatctttttaccttttcttcactggaatgtgtctgacaggctgactgtcagctctggagcagcgggaggctgatccagctgtgctcctacaggcacctccagcctttcaccagccccttcacgcgtgtgtctcctttcttgtagggcagggaccacacgtaggggaggttgtcatgcacacttgcaagtgtctctgtgcctgtccatcttaagaacttgtctgtcttgtagagagcaggtctgcccgtactctgtgtgttttagaactggaggatcctgtgaactggccacatgccacacacatctgcatacatgtgcatatacagtagtgttgatgattcccagcaaaaatggcacaaagcagttgattgccattgtcaaaaactgatttacagtaacttagaacaactgtacttttgttggattagcaaatcatgtgtttaaacaatcccatatgttgggcaacagttcaaataagcacagagaagcattgcccaaacttggttctcaaactctagtgcatttgtaaggctgggcttcaaaatcaaaacacccacccccaacaccggcaggcagagtgctaattcctgaaacatccatgggaagccaatggccctgttttcaggaagagcaagcccaccaagagttaagactgtctttgtgtcctatttatactaagccatgtcccaacagggaagagtttggaaccagagtgagagctcccagtcccagtttgagtgggggaatgtgcttctagacgcttcctggcagtagtggctcaccttcacaaagacagtcttgtggcatccgagccaggcagacagcctggggtgcctgggcctgacaagcttgttgacaatgacgtgcaatgacgtgacaaggtgagagcagaatcctgagagacttaaagggatggttttccccataagttatttattctttttttttttctgtgtaaatatatttattttattgtggcactctaataacatcctggtggtatggtgcagaatgtatggtaggaatgtatttcttgtagggatgtagatctgtgtgtattaaaagggggagccaagccagcccccacctgtctcttcatcagatacagtccacattcatttttaactctcatctccaatatgggtctatttaaaatatgcaaaaaggtatggatgaggaatgttttaatacctccaaatttttaaaaaaatcaagcataaaagagttgataattttttaaagttttcttagtagcactttctcttgatgacagaagggcaacacataggcacccaccttcataccaaagggtgagaaatggccacagcctcctacaccactccagtgtctttagcaattgagctttctatcgccatagccccaaccatcctgaggtcaatcaag

SEQ ID NO: 19623 - DNA, 1245 bp, Mus musculus
ccatgagctcccaagaacaagcagacgcgtagctgcttgcatccatcggacagttttaaatacaccttccttgattccaccccttccctaccatcaaaagcatatctgctgtaatttagaaataaaatcattcaagtcagatgatttgttggtaagccacactagaaaggtatacatagtaatgtatatttatttacataccgaagtcctaaatttatattagaaaaaatgtaaataattggggatgaacatttttgaagatttattcttttgtgttgctggggtgtatacatttatgtctttgtgaaatacactggtggtgtccttcttaaaaacttttgaaataaaaaaagaaaatgaaaacctcaaatctttcctgtctgaaaccccttcagtctttccccgtgcctgacagctcttgacttacctgtcctatggtctgttacttttactatcacaaaaagctgcaaaattcttgtttgcttttcagttgtgtgtgatgggtgtgtttaagacctggctttcgttcactttcctgggctttgttttcagtcttcatcaggcgttctgctgtgtgaccttctctgaggtcacgccatcgatgcttgctggttgtggagtgtggatcactgtcaggacatgattgggggcttgaaagagaatgtacctgttttaactggtgtgatttggagaaggaccaaattatatgaatgtcttaaaattgagtttgtagagatcttcctgttctgtcataccactattttttgaggattttgcacagtgtaaaatgacataatcatagattgctatggtttaggttgtatatacagttggaaaaaaaaaactatggattttaaatgtttggggaaattcctatggaaaaaagagagagatgtagaagagcctctaacaaggttgatgtgcatgcccaagggttttgagatttgagtgtgtaaatttccttttagcttatacaagaataaaataatttaaaagaaatttagccttttgtctttgtatctagtatctcagggaaaatataatacatttgaatgtgaggttttattcataattaataaattttgtttcaaatgaagtaatttggtaggacttcgacctggttaaagtcagggagaattagaacctgctctccaagaactgaatcgtgaggctggagagatggtccatagcccaagagcacttgttcttacagaggacccaggttctcctcccaaccatgtaact

SEQ ID NO: 19624 - DNA, 2011 bp, Mus musculus
ttcagaatggtaatgataaggatatcactgctgaactttctactcctgtgaaaagtcaatctgatgttgtactttctaccaccagcaaagaaatgattccatctaaaactttggatccttccatcgatggtatggaaagcctggaagacttagataaagtagtggtgcagggaccaagcactgggcaactcagaagtttctctcctggagattttagaactgataagaacattgttcaccaaaccaagcagttagagagctgcaacggtgaaaagcctccttgtctggaaattctaacaaacgggtttgcaggtttggaaactgtaaatcctcagggaacagatgacctggacaatgtggcagattcaaagggatcgaagcctcttaacacttgtggcaccgagtgcattttagagtctgcagctagtcatgctacggaatttgcagatttttctacattttcccaaacagaaaggacacaactggaagaaatagaatgtccagttttaaatgatggtgatacactgaccattcagggaaacagcaaaggccccagagtcaaggaactaaactgtgtgaaagaagtgactttggatggaagctttgaggatacggggaacactgaaagagaacatcaggtctgcgtctcagaaatccatgccgtagctgacagagggctcagtgttgaaaaacaagaccttcaaacactgcaacaggatgagtttctaaattcaaggattcagtctgaggcttggagcttggtagactcaagtgaaaattcagaagccattacaaaggagcggtgtaaaatggaaaaaaatgacttatttgcctctaagtgtgctgacttatccatggattctgttaaaacttcagacgttaatgaaattggttcttccaaagaagaaaacagaaagctgactaatcccaaaagcccagaccctgatcccacaggacaaaatgctttggatgattctgctgcaagcatgaaaaatggtgacagtgggaatggctttgtgacttgtcatgataccaatgaggatgattttggtgactttggtacagccaatggcaccactccaccctttgttactagtactcaagattcaatgagtgacgtcacttttgaagactcctcagagcattttctacatcttagtgaaccaggtgatgattttggagaatttgaggatacaaatgctgtttcttgtcaagaggaaatgagatttactgagtcagacctaagacagacttctgatggcttatcagaggaatgtccattggcaggagagtctggtggaaaagacagtaaacctgactcaaaactgaaaaatggtcaagacagtgaatttggagattttgattctgtgccaaatactcaaggtagtgcttttcaagactcggatgattttgcagacttcagttcagcaggtcctagccaagctgtagattggaatgcttttgaggatgaacagaaagatggttgttcttgggctgcctttggggatcagcaggagactgagtctcatcatctaaaggaagtctggcagtcacagaggacagatgaaactatgggcactctgggaacccctaagatgcacagtgtttcttcagcagcttccaaaggagcagttgctagtggccatttgcaggaaccaggcacttcagttcaggtatgtacttactgcctctgatttgtagaacatattaattgccaaggagacttctaatacagctttaaacaaaattacctgagtatctgtcaaagaggtttctgtgtgatatatgaggtttgttggtctggtttgcacattagttagatttttcacaaccctttgaaaaattgtaaaactgctacacagggagtgtcttaactagttaacaggaatttatcaatttaaattatccatggatagtatctgttttaaatagtagccatttttccttctgtttttatctttaataattatttcaattaacagactggtgaaatactttcagtttagaatgg

SEQ ID NO: 19625 - DNA, 1093 bp, Mus musculus
ctcaagcaaaggaatttttgaaagttccagacttctgaactctgagttttgaaaatctattttgagaaaaaaaagacatagtttaatttgatgccttcctttgtttagtgttcttgaatcaccgcccaccctcagtgttgagaggttgtgctgtagaactgagggtctgttggttcaaactatgttagtttacaatttgttgcagacattgtaaaatacagcaacatgtatattaatttttctatttatctttatcatagaaagtaccttagaatgttgtgataggctagcatggtaatgatggtgtcacacatttggtgtgagtggtagggtagtgagcacaaggctcaaaggtttgcaaagttaaggagaaagacaggagagcttcccccccccccagccccataattaggggatatttcataaaaccagaatatttcataaaaccagattcatattaattaccattgtctaaaaggtgtttgtttttaaccatattgacgttaaccagaaaatggtttttttccttaatctttctctcaagtgtagtactagaacaaaagttaatgctaagaaacgttttatatgctcctttgaatatgcaatttaatctagatgatctatttttctcccatgataactgatctgtttttagtgccagcaacatttggcaagtttatttttttggatataaactgtggttcatctgttcactgtttctaaaaaaaaaaagaaaaaaaagaaaaaagaaaagaaaaaagaaaaaaatcctatgagaaagtgaagaaattaacaagaaaattacttgatttgctctagaaaaattaaataaaaagtgttttgttaattattctgtatttggattattccaggcattagaacatctagagctgtaaagggttggctgcaatggtacctccctttgtagcccagcagaccagccttaactgtgggcttgactcctcaggagctggcctcagtgtgactcatggaaatgtttgcttagcggatgaaagtgaggacacaccgcaggggctgctgttctcttcctccatatgtgctgtgcaggacagtttcttctcaccgtagcctt

SEQ ID NO: 19626 - DNA, 1667 bp, Mus musculus
ttaacacttggaaaattgatggtattattgctgtggtcttctaaggagctactaagatgtcaaataattagaaaatagaaatagaaaattataaaactatccttttccaattatttgtttatttaaaagacttaaaaatatagcaccataataattaatttaaatctaatatgctggtttacctacacacacaaacaaaaaggtgtaacttgaatatatttgagttactgtgttacaaagtgatgaccggctttagacatcttcagctctgtatgttccaagttttggattctaaagtattaggaaatttcagctaaagtataaatgttttaaatcataaatataatatgatacaactaacatactaggaaaataaaaataacagtagcagttactaagctccgtcagttttatagctcatgcatcttttgtgtaatactaacttttgtcatgatgcggtgtttttaaaacttaggacggttttcttgaaaaattgaattccacggaattcatagcactctcgagattaatggagacattcatagtggacactgaacagatctgtgggaggaagagcacgtcactgcttggggcccttcagagccaagcaaataagtttgtgaacaggtttcatgaagagaggcggaccaagctcaggtagcgccgggtaccttctctgctttccttttctttacagaacagctgtggttaaagggtaaacgtagttgatcacaggccaaattcctccgaatgggggagtaagatcaaatttcttagattccgatggaattagactttttatctttgttgaagtcttttatcagttgatcctcactgaatgtctctttctcagggttgactaaattggttttcttagctgattttggctaggctaagagacaaacacctgtttgttctgttagtgggtgggtccagtttattctgttccttctagctaacgactgatcctgagatgtgcctgttaaagttcaccattttttcctttccttttgaacagcctcctcttagacaacgagcgttggaagcaggctgatgttcctgcagaatttcaggatcttgttgattctatagcggatggaaagattgctttacctgaaaaaaagccagtgggtatgtgtagtttgtcacacatggttcctcccactgtatattgatgacgatgagggcatacctctgtcccacagcctacagtctacattctacattatgcaaacaaaataggttttcgattaaagttatagagtgattgctttaacctcgtgcttcaaccttgtgctttttcctgctttgctgtgtgctgccagaaccccgtaagggtgccatgccccatccacatctcactgactcactagagactgatgtgggcaccaggaagtgaaggctacttgacatgtaataatgagtgattgcttgccggcaggcattgatattctaagccatttatagatgttatgtcattgatggtcctcacactaagcttttaacaaacacaggtgcttgagccctacacagttatgtaagtagttgcagaacaaggacttcagattcaggcagactgacatcaggatctttttcttatctgctgtgcctcaccctatctgtgcacaatagagagttaattaagagtgcttcctgtcactctgata

SEQ ID NO: 19627 - DNA, 1099 bp, Mus musculus
tgtttctgatttgtccccaaattggagtacttgctgtatagtagagacttgcttaaaattgccatgctgagggaatgacaagatttctcatcagtaaaaaaaaaatgcttttttttcttgcagagaacccaagtttggttcccagccacccctggtggtcagcaactatttttaactccagttaaactccaggggatccaaaactgtcttcttgcctccctgggcactgcacacatacggtgcacagatctatacacacacactaaaaccacctatacatatataataaaaataaataaatcttaaaaaacaacaacagaatgccatacagagaatggtgtttctacagcacagagtttgagaacaaattcattatcagtctcttagatgactctggaattatacaactaccaagattagtgtgtttccatagatgtttttaactggttgtttgactcttggtgagtgtctgagggttacccttttctcctagaaccgtcttgctgttaataagaatcattcttgaatattgccagtgtgtggataacatcccctccgtcactactgacatgctcactcgcctgacagatctgctgaaggtgaggacagctttacctgtttatctgaaaaacagccggagtataactaattcttaacttgggagacacttaccacgatatttctagggtaggggttttgtgatactgatcatgcgctgtccactccacattcagtgtgtgcataggtgtgaggtgcacacatgctcgtttgtactcatgtgtgctcacatggcctaacatccttagagctgcgaatagccctggagacaggtgctgagcatgacgtcactcaggtcagagcagggatgctgctttcacatgcatgcttgggatgtccagagactttatctgctatgatgtcacttttccagaaccattaatgggaagtgaaatggtgataatttcagctattttgtaataatgtctttatgtgctacgatagtaaactaccttacctaccccttgtgaattaagatgtatttttctcacataatctgatgattagcgtttcccctccctctcctcttcccagttccgtc

SEQ ID NO: 19628 - DNA, 1740 bp, Mus musculus
gttggatactcagtagtaccttcctaaagccccagttttcgtttactctctcagcactgccaggaaacctgagctttctttgagcttctctgttgaagccacatgtacatgttttagtgacaaccaattgaagtcatttcagtttagcttgttaattttttttagttcatgctttttagaaatctgattttatcagttagaatctaccatgaaaccttttcaaatcagtattaagtggacctttgatactggaaatttgctaagacaagtgtcaacattttcatccctagcaattctggatctaaaaaaatattctagcagctaggctaaaaaagtgaacgttgttcctttactatcagaagagaaagtattgtatttaaaatgcctttctccctactgttcaggttggtcacagcagatgtagctttttacactggaaatcttcaagccttaaaaggccttaaagatctggatctaaatatggccgagatctgggaacagaagaggtgatgacagactggagacccaggtcgttcatctgaccacgggatgtgtttctgaagaaaatctggatgcctggtgtgttaggaactgaacctgggacccaaagtgactgaggtgggggaagggaaaagaaggatcagtgttgggaactggattcagtgggatctacagagaaagccattctgtgcatccctgagtaaggagcaagtgatcaggtgtctataacatttttcattctctctggaaacagactcaggtttctttggaccaaatccaaaagaacacatagctgtaacacagctgtagctgcctagaatgctctgtatactttatattaaaaatgctctgcatttcttccagtgcaatgaaattcatatggtgtcccaccttatttaatgatggtacaattgaaaatattaaaatcttagtcaacctctgtagaaagttttctctatgaaagtaaagctgtttgagaaattatttttttacagatctttataaaaaataaacatcttttgattgcttggatttaggaattcagtttttgttttaatgaccaatgtcaagtttcaggttttgtgtgctgcatatttaactttttcactaccactgttatgtcactgggtaaaagcctcaaactgttaaatatatgggagactgattataaagaataaagaatatttgcatttacttatgcaactactaatttaaatactttccagaagtgggatacataaagctatggtttaatagctgtatttattaaagtacctatgaagggtttggggtagcattctgttttttctttgctttttcatttctagcagaggcaagaatacatattcatatacgcttacttatgaattaccattttaacatttagataacatgaaatatggccctcttgaattcttgcttttaagttccttttgatatgtatataagcaaagaccagggataaatggaatttttaaaatacaggctgctgtgttggggccagaaatacaaggttgatgagtaagctatctgaagacttttataatgcctaccttcaaaaccagaatcggcagcactctacaaatgaaagtgcctgtgtctcacaccaagaatcttgcctaacctgtcagagtgcctaatcttgtggttataatgtacaatgaaataatcttgtgggggttttttgttttctcaagaggaattttttttttttatcattgcagaggtatgtcattggtt

SEQ ID NO: 19629 - DNA, 1188 bp, Mus musculus
taagacatagaattgttgccagttaactgttctttaaacaggaaagggataggggccaaagagatagaaacttgtagagccaacataagacaacatggtggtaacgtggtatctattggtcatacctacactgaagcagcagagggagcatgctagccagcccaacctgctgccccaccgttttgctcactgcctagtgagctccagcaaagtgggagagagatcccctctcaagaaaagtagtacgtggcacatgaacacttgaggttgccctctggtccccccacacacatgtgcagatgtactgacacacaacaaaaccaaccctgtgtgtaatgtaacccagcaagcagccttggccatttgtgatgcagcctgtgtctgcctcctacttccatagctacctcttaggagacagcaggacacatcatgtcccattattggcctttcatgtttatttacttattatgagcttgattttaagataactagttgtatgtttcagctatgatttttaagtacaatctcttttttttcttcttcttcacttagggaacagttattattattgcaaatcatggtgacagaattgacatccccccaggagccgtgttagagaacaagattgtatctggaaaccttcggatcctggatcactgaaataagcactttcagatacactttctactaattatgggctaaagagtttcttataataaaatatcctctaagattataaaataagcaggtactttatttactatgttgtactctgcagtgttgattttttaaagtagttttctgcaatgagcttttagtctaaggaaagcatagatgaagcaatactttccttctttgatgaaaagcctagaaattagttcctcttaaagtgcaatattacttaacctcagaatcgggccagttctgtagatcctcaagagaagcttcagtgactgtccctttgaattgcctccgatttcaaaaataaataaataaatctacacgtttacttttgctgtctagtgctcactcttgtgaaatgcagaaaaagtcaagtactcttgctccaacataaacaggaaggtttgttcttgcagttttatcactagccagtccaggattttttttttttttctgattttcatttctaagactattaaacatagttgacactagaactaaacttga

SEQ ID NO: 19630 - DNA, 1130 bp, Mus musculus
ccagcaggcgactccactgcagctgcggtgcatctgatttccgtgccagcatggccttgctgacaggagggaggcccagagcttgctgtttgctgggcaagcactcttcccagctccaaagtcaaattgttgaaggtattttctccagaaagtaaacaaaatcgatgctggaagttcatttaggaatctgagatgaggaacttctctaaaatttggacatggcatatcgaggcataagacccaacaggacaaatactggaaataaaatatgccagttcaaactggttccttctaggagagtctggtgttggcaaatcaagcctggtgctttgctttgtgaaagaccaatttcatgaatttcaagagaatactgctggtgttgcctttctaacccaaactgtgtatcgatgacacaacagtaaattttgaaatatgagatgcagacggccaagaactaccggtatcatagcttagcaccaatgtactactgagaagcacaaacagccagagttgtgtatgatattacaaatgaggaatcctttgcgagagcaaaaaactgggttaaagaacttcaaaggcaagcaagtcctattattgtgttacttttgtcaggaaacaaagctaacttagcaaataaaacagccattgacttccaggaagcacagtcctatgcagatgacaacagcttattatttatggagacattagctaaattataaattatggtatgtaatataaaggttcccaaagaagcttttatcctaatctccaatagcaatggtggaagaggtagggtccctcagcatatagcaatgacttgcttgccactggcagctcagagacaaaggtgcacagatgtcaaggcctctagaagctgggaatgaaggattggcagcaggctcacttcttaacatggagaaacctgaaggtcctttaacacacgaaatacatgcaaaaacatatatggacacacatgtacacactcacactgttacactcactcactcaaacgcacacattcatacaaaaacacagtaacacacagacaggcccacaaggaaacactcatgcatatacacatgattttatgattgacatacctactgacacagaaaattactgcatagttg

SEQ ID NO: 19631 - DNA, 1226 bp, Mus musculus
ttgctgtaagtagaggctaggaagatgtttataggccaccctgtgggcactgaaaaccacctgcaatcaggtcttccacctggtgcatttctgtagctttgtgtgactggctagcaggcaacaatcagtgtgtcactcactaatgagagtaactcttggggaggggcctttgaaaaggttgtagaatctgtcctttgtttctaatcttggtgttttgagcccaaataatcagatgtgaaatctacaccacaggaaacaggcacccgtaattctaacaatgctaaaatatgtatgctaaaatccttttctaaagtctttgttaatttttttctctcgacctacagataattgaactttctcttcatgtcagatatcgtagtcatctattgttagctatttataaagagaaatcatacctgcagctactaagcaagctatggcatctctcttccataattatgactaattagtgggaactaaatatatacaaacaaaaatagggtgggactttgtgtgagagagaatgcagtaaccaccccgaccttcaccataaccgcattgcctgctgtccttgctctttggcagcccatcattcttgtgctgttggacatcacccccatgatgggtgttctggacggtgtcctgatggaactgcaagactgtgcccttccccttctgcagggtgagttgggaagtcaaagaaaacagatggtatagcactgcatagcttactaaagatagattgttttaaagatttgtattaaagattgtcagaaattgtttcacaaaagtgttttgttgttgttgtttgaactacactactgtttttaacgcaaataccaagaacaaataagtacaaaagcaagaagcaatcggtggcaagtcaagggcttgttttccctcatgcctacatataatttataatactaattaagtatagtatgctcaaggattttacatccaggttgtttgcattgtgctgttatttgaagtcatttagaagtaatagtaggatcctataacagactactttccattccaaggggtgttctccaggttgggtgctgctctaggcattagttgttccttgtatatttcctcttccatttgccaagcacaggtttgagatgggtaaactgtccttaaactgcccagcttgagggaaagcatgaactaactccgtgtcccatcagacatttcctagaagagcgactctccaggtcact

SEQ ID NO: 19632 - DNA, 1233 bp, Mus musculus
aggaattaggggctgctctagagtctctccaggtcagaatggtaaataaattggattccacttgtatccttaagtataattatttttgtctagtttttaaaattgcttcctgacagattaaaagaatctgtgctatcatatgcaatagtcctcaagacctacttacaaactgtattactaaaccctatgataatagagcctactgtatattaggagcaggagccaaatcaaaagtctagtccaatcccagatgatgtggcttgcatccataaagctaacactcagaaagtgaaggcagaagactggtgaatttagttggtttgaggccagcctgagcaaactgaggtagaggcgtggggggatggcaaaggcagcgggggactagagagcggagagaaatactatatttcattactacttaacttaatgaaatgtagactataattgccattcgtgacaagaccactcaaaatatagccaaacacatacctgttatttttaaaactgtcacaggccaaatgtatggtgcctgcttcaggaagtgtgtgagatcattctaacatgcatacacactctgtaatataacagacagctaccctcctgctgtaagaactcgttccctgggcaaaccaaagcagatccctgccatctcttccacagagcaccacccacaatccgaaggacaattctacctgggaacccttgcattggggagggggcggcaggagtgtgagtgccacagagcagccccacccccagaaagtctcacctctgagcagatggcaggcagccgacatctagctgcttagatggagtgcccacttcagctaaccccccactcccaccgcagaccacatcatcacgcccctggaacattcgtaattaaaacagaactgcatacaaatgcccaggccatgcttctatgaaagaacattaacaaccagcaagcctgattcgggtgctctctcgcaagtagtcagagctgtcctgatgaagatacagctgtttggcttaaaggaccgtggtgtgcaacccacattccttatccatgtttcatctttgttcgccttgcttcatgctttaggtgtgaatttagcatagcactagctcgagaaagcaacagttaccccttcccttcccccacgttaccctctatcttctcactgtgcccattaatctccagtataaaagccctaccagtgacaagggatttacttgaatgatagaagcggg

SEQ ID NO: 19633 - DNA, 1195 bp, Mus musculus
tcctccaggaaaagagccaagacctgctgaggtgctggctgaaggtgaaggaaatacagaatgggtagtagaggaaggtagttataaataccaattaaggccacgtaaccagttgcagaaacgaggattataaagtaatatgaatgcccattgtaaatttactaatgcgtttgcgattgtacgagggatagttatatcatgttaggcgtatttacaaccttgttattgtttcatgtgaacatgagatattatttgtgtcaagttgacaaggggtggattgtagtggctattcctggttgtcaacttgacaatatttggaatgaactacaattcggaattggaaggctcaccagtgacccttatctggaggcttggagatccttatctggatcttggtttgaagatcttgagccatagtggctatggattccagaagattgaatctccgagtttaaggaacacacctttaatctgggctactcctttcatctgggattaaaggtgtggtggaacacacctttaatctgggctacaccttctgctggagacaatataaggacattggaagaaggaagtctagctctagctcttgctcctttgcctgcttgctgcgtgagactgagtaactgctagatccttggacttccattcacagctgcgactgaacaattgttgggaattcggctgccgactgtaagtcatcaataaattcctttactatttagagattatccataagttctgtgactctagagaaccctgactaatacagtacccaaggagctaaagggatctgcaaccctataggtggagcaacaatatgaactaaccagtaccccagagctcgtatctctagctgcatgtgtatcaaaagatggcctaatcggccatcactggaaagagaggcccattggacttgcaaactttatatgccccagtacaggggaacgccagggccaaaaagtgggagtgggtgggtaggggagtgggggggggtatgggggacttttgggatagcattggaaatgaaaatgagaaaaatacctaatcaaaaaaaaaaagaaataaaaagaaataaacaaacaaaaagaaaaaaaaagaaagaaagactcacagttacagcctgcatatcacctggtactatgaaagccagcaggcagggtagaagcttcctggtcagtaccaattttatttc

SEQ ID NO: 19634 - DNA, 1154 bp, Mus musculus
tgagtgtgtgtacatgtgcacatgcatggatatagtagaatactctattggggtacttgatcatctttcagtcagtaatagcaggagtgagctcttaaccatgctttctgttgcacatttaccaggagacttgaggttggcagcacaaactcccacccccactccacccctgctcccatctatcctagaacagcttggcctccaggaaaggaactaaagtcaaacacacttgggacaggttactctcaggatgagtgatgagtctgattcttcacgttccagcccctaagcatttgcctcaaatgatcaaaatgacaaggcaggaatgtttttgtaggagagcccgatactgtttccagtgtattttccacttgcataactttgcttttgtccctgaatagagcataaggtggagtgttctccactgaaataataaaaatctctttcctggcatgtacgtattcagatctgtgcctgatactgtgtgtgttattaactatagctaggtttgctgagagcaaagtgtttttatctttggtgaggaaatttgtgaactcttggttgcttggcctccacgagtggaggaagcattgtggcagcggcttgagaggtcttaggcttttggagtgtgtgtgtgtgtgtgtgtttcatttttcaatctatttgttggtttgggtttatttgtaaaagggcttattccatctcatgcagcaagagctgttttaccgcccagggagctgtttttgtagctttacagactcaagttttcaaaataagccagacacccctttgtggaagttttgtgtgagaaggagtcatacaataacgctctaagtgtatgtgtgtgttaacctcataaacaaaaatcagaaatggaaagaaaacaagtaaaaatttgcattaagatgttataatggatgaaaggagggtaagattgcttactggacaagcatgaagaactgagttcacattttagtaccagtgataataatgataataataataataaataataataagcctggcgtggccacaggagcctacctaagcattgtacaggatggagataggaccacccctgaggcttgctggttactaacttagcttcaagttgagtgagagatcctgtcttcaaagaataaggacacctaatg

SEQ ID NO: 19635 - DNA, 1483 bp, Mus musculus
tattgatgatgtttatacgggaatgtgccttcagaaactgggccttgttccagagaagcacaaaggcttcaggacatttgatattgaagagaaaaataagaaaaatatttgttcctatatagacctaatgttagtacatagcagaaaacctcaagagatgattgatatctggtctcagttgcaaagtcctaatttaaaatgctgaaatagacatgagctgcatttcacagaaaggcctagcctgactagttcccatggtgtgctctcacaataggtgagttctgtgtgaggctattagccttcatgagcaggtagcccctgggctcccaagccctcagtccttcccttgccttgtgaagagggaaggctgaagacagctcagcatggcagggtgagtggttatgacccttcctctggctgccggtcctcagtttctaatttgttttctttctcctccacaattatgtatgtatgtgtgtatatatgtgtgtgtgtacatacatacatatatatatatgtaggacacaacctggtggctttgtgaaatggaattctatgtattttcataagattttgaaagttgtctagaaagtagactgatgtcaatctcccgtcacccagcagtattgtccttgttactagaaaccgttacttcctttatgcaaggaaagccacgcagtgcgtgtagttcatcttgtcagggcttatggccatgaggacagaggggattttctttttacttgtgtttggtttcctgggtggcatcatggtagttaacctatttttagtatttgaagatcatgagtgtgattccctaatggccaactggagactgagtagcccgacagccatgggtctgtgagtgttcagagactgggaagcattcgccacttctgagctttggacgtgattagtcagttaaaaccccaagattctattcttgccatattatcacgtattccttagataaaattctgggtagtgacacttccctgtctcagtgtagaagtgcctgtgcttttatttattgttcagatcaaacaccaaaacattttcttaaaaaatattttgtgtaatattttatttgtatacagtgtttgtgaaatatttaactagagcatgatattttattttttctcatttttaattctttgagaatttcatacaatgtgttttgattgtattcacctccccatctcctcccagatccagcatgatgttttaaatgttaagctgtaacatgttagataaagttaactcttatttttgaattttaaaatttggatgggggggtatgaactgctagagaaaataaagttctgccaaaatattgcatatactagtatcttgtaacatgctttcttgaaatatttttgtgctttagagggttctcacctgtgctacaggggactgggaaaaagtggaaataaagtgattgtattttttaatcatcacgtataataagtgatactctttctgttct

SEQ ID NO: 19636 - DNA, 1138 bp, Mus musculus
tctctgttggaagccaatgaacttaaaacattccaccaattttcattttatttacattggtagagtaggaaataattcggggttgggtctgcatttttaaatgacagacattaagagcgaattacatgacactgtacttagtgtaacatgtaatttatagtgatattatgtgcatgtgtacatattagatcacagaattaaaaatgtgctattatgaattgtaagtgacttagtttgcaaagctctgatttgtatgtatgtacctttttaagcaaagtagttgaacaattacaaggttatttacttagtgatatttgcttctgccctccaagtgtctaaaatacattaactattacatagtgattgtaatgggccaggcaggatttcaaaagcctgtgtgtaaaaattgcatattttgtacaaccaaccccctttgtagatggaaaagttgaagatttagtttgaaacagagctgatgagtcaggagtccttattttagaacatttattcttaggaagacttttttaaaaatacagaatgggtctcactgtgtagccttggctggcctggaactgggcagttcatctgcctctgcctcttgagtgctggaagtaaaggtatgtgtccatgctaagcctaaagtgtctgtgggcatcagagtcacagttcactaacgtacttccctgccttttcccaggtatgagagatgagtgtggggcgtcgaagagtcaagttgctgggcatcctgatgatggcaaatgtcttcatttatttgattgtggaagtctccaaaaacagtagccaagacaaaaatggaaagggaggagtaataatcccgaaagagaagttctggaagccacccagcactccccgggcatactggaacagggaacaggagaagctgaacaggtggtacaatcccatcttgaacagggtggccaatcagacaggggagctagccacatctccaaacacaagtcacctgagctattgtgaaccagactcgacggtcatgacagctgtgacagattttaataatctgccggacagatttaaagactttctcttgtatttgagatgccggaattactcgctgcttatagatcaaccgaagaaatgtgcaaagaagcccttctta

SEQ ID NO: 19637 - DNA, 1194 bp, Mus musculus
ccctgggcctctgcaccttgctcatgccagataaagaaccttagctagagctcgagtcttagtcactgttgtgtcactgtgaggagacactattaccaaagcattacatttgggggcttaagtacagttttagagggttagttcatgatcatcacggcaggaagcaagcaggcatggtgctggagcagtagctgagagctttatatcctgatcagcaggcagagagggggtgtggaggaaggagattggtcttgggcttttgaaaccttgacgcccatttccagtgacacacttcctccagcaaggccactcctagtccttcccatcctgctcatcatctggatgcaaatgtatgtgcctaggggccattttcattcaaaccactactgctgtcttgcaggtttttccttaaacatctttttgtgttttacaggaatctgaatttttgtgtctggaatttgatgaagttaaagtcaagcaaatcctgaagaagctgtcagaggtagaagagagtatcaacaggctgatgcaggcagcctaactgaagagagtatcaataggctgatgcaggcagcctaactgaaggctggaggaaggggcgtttgaagtgaagctgctcacagactttctccactgaccctttgaaagtcctgtttgcccactggtgttaccaaaagacattgtatacatgcatgaaagtcttcaagaataaataaaaatatattttaaaaagtgggtaaaaaagagaaacctctcaaagtccaatcttgcttgtctctgcttgttgggttctttattttcccatctgttccactggagagggtctcatattttagcatgcataaagattatgagggacatttataaaaacatactgaaatttgccaagtggtggtacacacacttttattaatcccagcacttgggaggcagatgcaggcagatctctgagttccagttcagtcaggtttacctaaagtaaccctgtctcaaataagtaaaaacaaacaaaaagtgaaattaaacaggaggctggagggtaagcactcatttagtgtgcaaggaggtgaggcaggttcacctcagagcctcagggtcaacagaattgacactttagaattctttccagctgttgtttgttcttgggagagctgttagtcatccacacaggacacattgtgtatcatataatat

SEQ ID NO: 19638 - DNA, 1729 bp, Mus musculus
ggtgtgctatgatgttgtgagcattaattgctaaactgtatctaacactgcctcaagaagactagtaataataatttctataacggaattggttttaagattgaggtaaaatgatcagtagagctaacgaaagaataaggagtttttagctggacatggtggcacacacctttgattccaggactcagcaggtgcaggcaagcagatctggtttgaagccagcctggtctacaaaatacattctaggaaaaccagggttgtacaacttaggtaggaattcttcacataaaattaaatgcctttttttcctttattgctatttgcaatcttgatagtgtcaagtgttgtaataaaagaaaagcatatatattcttaacttgtatatggagcaatttgcaaactgggtggagaaaacaactttaactttagtgtcttatctactgtatcctaataggtgataataagtccttgtaaatctaaagtcggtatttcttaaattattgcttctgtagaagtaactttctgttgtaaatctaggttgtctctcagtattcaagtctactctctccaatgagtgtcaatgcggtgatgaaagtgattgacccagccacagctaccagtgtagatcttcgagatattaaaatagttaagaagcttgggtaagcgtctctgatttcaatttcagttttgccaaaaccagataactttgaagaacaactaggggtggcttatacatttagtgccagcaattgattggctgaggtgggaggctagctatgagttcaaggccagcctggaataaatagtgagttccatgacaggctgagctagagtgaggttctgtctccacaaaaccctttaaaaacaaagatgttcttagtccgattacctttctgcctgggccagtggatgtaacataagtgaaaataactctgaaagtgaacattagaaatacttgctgacttaaactttattatatatggtatcctcaagggtttgcctgtatttccttatggtaggatggaagtatatccaagaggtcccagaatgggttctgagaatgagtaagaccaaagcatttcctctgctctgattattttttcctagtgggacaatagatgactgtgagctggtggaaggcctcgttctcacacagaaagtagcaaattctggcataacaagagttgaaaaggctaagattgggcttattcagttttgcttatctgctcctaaaacagatgtaagtaaaatccaagctggtttcctacttattaactttctagtaagatctgtttttttaagatgaaaatagaaaatgctggtattagtgatgtctttaaaatgtagattcaaaacaataaaattgagacaaaatcagaaattgttgctactacaagtaataaggtggagactgattataggcatttgcataaaatagaaaggtgtgtgtgtgtgtgtgtgtgtgtgtgtgtgtgtgtgtgtgttgtactcattccttgagtttgcagattgtgtctagcttcctgagatattacctgctggagcccacaaagattgtgtttgtgcaagtggagccttagactaacttgatagccaaactataaaaattttttttatgaaagatattaccatattagtatgattctctaaaaagtgtgttggtacctcagatttgtttttactatattctgccaacatataggtgtgttcagtattttgttcaaaaaaa

SEQ ID NO: 19639 - DNA, 1804 bp, Mus musculus
aaattggtttttgcttagctttgatcaggacggtaatgtctgtcttgctggatcacagggttgctgttactaggattggtttgctcgtttgtgagaattgtgcttctgaataatgtaagcggtcacctagcaaaatgtgctcacttcttaagaatcacagcccacttgtcatgtacagttttgtgtcatagtaatttttctagtaaaattagaaaccttcagaagaatttttgaacttctactgggtataataatgtcccaagcctttgatccagcacttaggaagcagaggcaggcagatttctcagttctagacaactaaagctacataggaagagtttgtctcaaaaggaagagggagagaattttgaacttgtaaatggaacattaaaagtgtttcccttcataattagccatttggataagagtaaaattaaaatcttaactactcaacaataacactttttaaacgtaagataacacttttgtgttttagagatgcccttagtgatcttgcattacattttctgaataagatgaagattatggtggttaaggacgttgaaagagaagacattgaattcatctgtaaggtaaaattaatgtgtgcaaaaatatccattaacatgtattgtgggtttgatttgtatgttatggatagttgtttggtttagtttttaattttaagtttttttgttttgtttttatgtatgtgcttgcatgcatgtatctctctgcaccatatggtcctcttagagacctcatgtgggcttcaggtccacctggagctatgaactgccattgggtactctggaagagcacccagcctcttaactactgaaccatgtctccaggcccagcagtggtttttttttgttttgcagtccagtgttgagtctagtgctttgaataaaataccagacaagtgcttgttcttccactgagctttgtgtctagcacaatgctgtcttgatatgtgcacttgattatctttttccagacaattggaaccaaaccagttgctcacattgaccagttcactgctgacatgctgggttctgctgagttagcagaggaagtcagtttaaatggttctggaaaactattcaaggtaacaatatattgttaagcctttttttcttacctttttgtttttttcttttagccaattacttaatttgaaatttgttcactaaagattacaggttgtacaagcccagggaaaacagttacaattgtcgtacgtggttctaacaaactggtgattgaagaagctgagcgctccattcatgatgctctctgtgtcatccgatgcttagtaaagaaaaggtactgcatcatatttattactctgtgtgtgtgtgtgtgtgtgcgcgcgcgcgcacaatgtagcatctcggggggtggggtcctggggcaatctcttcttttcctaccatcatgtaggtcccagggatcaaacttgggttggtgtcaggcattttacatgctgagccatcttgctggcctcaatattctgaagactttaatttgaggctgggatataatacctaccattgataacagtaattgaccagttcagcctccacccagcactgcatacagcagatgtggtggggcacatctgtaacacttaggaagtgggggaggaagatcaaaagctctgtgtcttcctctactttatccaagttacagggcagcttacctttaaaagacaaccaaactgctttatcttgacttttataaagttagtaaagtagcttcctttggggtaaaaataagctaaaaatatttgtgaatttca

SEQ ID NO: 19640 - DNA, 1485 bp, Mus musculus
cccatttctacagtaacagagctaagaaaccgccatgcccaaggagaaaaaactacaggcattaatgtccgaaaggtaatagtcttggtgcttagagttgctgaagaacagattggtggaaggaaacgtttacaattttgtcattgttggttagtaggcttttgaacttaaaagtagtgtgattttggatttacacctgagacctggcaagtttactgcatgttcttcagaataaagatgatgccatgggaaatagcatttatttactgtcatttactaacttgtaaaacttagtctggtctttgacttcctgggttgtaagaacagtacctcataggtcttttgggagggcactagttaagtagatataaagtgtgaacagggtattctgttgtatcagcaattagcatgccagatgagtacagaagagtgatacctgtgctcgtgtttattgtgtgatcagatactgaaggcatctgcttctccgcagggtgggatctccaacattttggaggaaatggttgttcagcctctgttggtgtcagtcagtgctttgaccttagcaactgaaactgtgcggagcattctgaaaatcgatgatgtggtaagcgaatagagttaaattccaggggaagtcaaaaaggcatacttaaaagttttatattttgcttaaaagcttgctactcatcaagaagagactaattcatgactaattttttttccataaaaatgaagcaaagatttatcttaaacatgattacaagttatgtgattacaagttttgaaacctaagtgtttttttctcatcaggtaaatactcgataatctggataaaaggatggttgactgcatcattatggacagaagtactgtggctggaatgaaggacaaccaccttgttccttgtctggaagcttcagagtttttggacattgtcttccagttggcatttgtttgaaattgtattgaaacaatttaatgaaaacattaaatacttggttttaaactccatattaacttgtcattttaaaattatactgtttttgatacttgggagaaactgcctataggtaaactaccttcaaattttaacatttacctattgatcttacagcttaattctgtgtattaacattatttttgtttgttcacttgtggttgtttggtttgtaggtttttgttttgtgagacatctcaactgtccttgaacatttgatctgtgtaccttccaagtgctagaattaacagatgtacactgtgacgcccagtttgtacagctcttgagattgaaacccagggcatactaccaaatgaaccgtccccctatcctggttggtggttttagttttcagattgtgctcatatagctgggcccggaattgattgtgtcctgcagattatctcagctcttgatcctcccttgtcaaccttaaatgaatgctgagattacaggtgtgtgccagatgttaggtctttaatttcctt

SEQ ID NO: 19641 - DNA, 1224 bp, Mus musculus
tatattattcagagttctaaacaaacatataagatgcttgtaaaaaaaaataaaacaataactttcatattagaactgtcacatctttcaactgtacattgcatctgaggtttttgtttctctttcaggacagggtctgacataaaccagtctggccttgaactcccagcagagctggcaactttgaactcccaggtgctgatattacaagtgtgcaccagttttacacagtgctacagatcaaagccagagcatcatgtgtacctatatcatctgagtcaaatccccaacctatatatatttagtcagaggcttattaatccagactcgcctcaaacttgctacttagccaaagctagtctgcactcccatcctcctgtgcctacttcccatgttctaaaattataggcttgagtcaccatatccagtgattgcctggaaattttattttattatttatttgcttgtttgtttatttaattacttatttatttatccggtgatagcctagaatgttttacttgcttatttatttattttgttgtttgtttgtttgttttgagacagggattctctgtgtatcacttactgtcctgaaactcactctgtagactaggctgtcctcaaactcaaagattcacctgcctcagcctcattggatactgggattaaaggcatatgccaccaacacctgactgttgtttttttttaagcatacaagtgtcaatggttttaaatataaaagatactgtacacatttaatcaaaattttctgtgttttacttgatcttattgggtctgttggtcacagtatttgtaagccaggcacagtagcagtagtctcattatactgtggagaatacaattctccataaaaggcttttgaacttctttaagaaataaacaattccagatctgagtagagaaacgtaagttggtccttgaaactatcactgtgccttaaggaaaggaagtggaccaactggtggggagccagttcatggggcctcacgatggccaaattaggagaatgtaagcataattctagaactttaatgatggtaatacttataacataccaaataaatgaattcatcagtcataatgatatatcacctaaaagaagcaggaagccctttagggactgctgtctaacatagagtagataaacaatttaagaaaatggccattggataagccccaatatcacaacacattcgggga

SEQ ID NO: 19642 - DNA, 1206 bp, Mus musculus
cccagctaagtaaagctttattcaaatttccattagtgtgtaacttccagaaaatgattaaaattcgcctgcgtggaagagttaatccactggcagctttctgtcacctttacatttcaaccatctttgccactagcagagaaagggatgtgattcctttgtgcaaagtgaattttggcttagagaattgacttatagaagaaatagtatactctctttgtttgtttgtttgtttgtttgtttgtttttgagacagggtttctctgtgtagccctggctgtcctggaactcactctgtagaccaggctggcctcgaactcagaaatccacctgcctctgcctctcaagtgctgagtagtatactcttaattcatttattttctgctaatgaatgtttctttgaccatttttgctataaaagaataccacagactaggtaatttatgaagttcagagatttgcttctttcagacaaagagaagtccaccatgagggcggtggtgtcttataagggccttcctgctccacatggtgttcaaggaggcattctatggggagaaggcacacatctcagcataaaggtctcaacatcaggatttcaaacagctctactcgattctgaaagtaccctcctctaggtatcgcctgcatatgagtctggggaataaggttccaatcttaaatgtttcagagatatattcaaaccattgcattattattttaagattataattagtgattatgattgtgaacaagccatgtgagatgtgctgtcttgatatttaacagtctatgtgcccctttcagtgaaaagtatgtatggattttatattattttccttttgtctgatatactgacttgttcttatttgttgggtttttattgttttgagacaggatttggagagtctcgctatgttgccctggctggtttgggattttctgtttaccaggccagtcgaactcacatagatctgactgcctcttccttctgagagctgggattaaagtcacagaccataatgtctagccttgatatgctggctttcatatatgtattgaaatgtaaaaatggaagtttacagttgatacacaatacatggaaatcataagaaaatccagtggtctttatgatatctcgtgaacattttgttctacaaaggtagattaatattccatagacacatagagaaagataattcttaa

SEQ ID NO: 19643 - DNA, 1099 bp, Mus musculus
gtgacccagagcctcatcctggctgcctgatgaagaaagtctccttctagctgcctttgaatcaaaatgtaggactctcagaaactccagcaccatgtctgcctgcatgctaccaaactttctgccatgataatggactaagcttctgaaactgcaagtcagccccaattaaatgttttcctttataagaatcgccatggtcatggtgtctcttcacagcagaaaaaggctaagacaggcaggctgttacaacctttgaactcagcagcactcctccttaggctcccaagtgctaggaatacaggtatgactgtgatatatgcaattcccaacacataatacacagtacacagtaggacataaattgctttttaaatgaacaaaagagcaagtgaagaacaagagaggatggggagaggatctagtggctctgtccctactatcaagagggtctagtggtcctgtttctactatcagagtgtttgggaaattttgctgttttgttcatttttgcttatttgtttatttcttcttccagtggtgggaattgaattcagaggtttgtacattgtaggctagcactctaccactgatctacatccccactctggtttttctcttttaatatcatccctagttataataaaacctgtattgcctgtagggaaacatctttcagtttgttcctctttcagtctatgtcacgtttgcaataagttgcctgtaacgatcttgatttcccagacttcccttcattgctatcccccaacccctcacctccagcctgtagaaatcactgtgcatttcccctaggctaacctggacaagacaccttttctttctgcattatttactacctggatttaaacttggatgactcagagttaaattaaatcttaatgcctacagtcctctctgcttttgttatatagcaagaaaactggtcacagtgggtgcaaaagtgcctgttacattgtgtcctggcatatctgctttgcattggcaaagtacttaaggggaaagaagactcaattaggttttgttttactttgttttgtttatctgagctaggatagcacataccctcaaactccatttg

SEQ ID NO: 19644 - DNA, 1201 bp, Mus musculus
gctctgatccatctgaccttctgtgactcaggcctgcaggcaaagattgaatgagagtagcagttggaccaagtaagacttactaggaaaagattcattattttatgctgttttaatacaagttctcacagcagtcatttctcagggaggacattaagataagacacttcacagctttggatgtattggtagtcgtttgtaatcctagaacgcagaagccagaggcttgtactttccaagcaactgagttctttcaaattccagtgccttttacaagcatgatatatgttgagtgtatttctaatagagtggtatagatgcagatgcccttaggccagaagaggatggtaatcgatccccctggagctgcaattacaggcagttgtgaatactggtaactggtacatttctcacatgtttctagaaagtgaagtatcacttcactgtgttgttagggtgtgcattattctctgtactttacgttataatgaattctaaagaacacactaacttaaattgttttggtgtaacattctagcaaagaatggctcaagaagtactgacacatttaaaggagcatcctgatgcttggacacgggtcgacacaatattggagttttcgcagaacatgaacacgaaagtaagcaagtggtggtttaaaaatcattattcttttcttccagtcgtaaactttgaggaaggtatctcatttttagtattagcagttgttaccaaatcattttatattgctaacttatttcagaatttctctaaagcttagaattcttgcaaatagtcctaagaattatgaagtttttataactgggactagagtgcaaggtgttttttttcttttggggggtggctgggtatttttccatcgtagaacatgtgtagagtaagttgtaaaagttattcagagatgagataataacattattttgggcaattaatacaatataggttaggcaccaccaacacccagtagtctggacagcttaaaatcctactccgtggtaccagtattttcaatgagacagcactcagttcttatttgcacttgaaaatgttataactcagggctctttgtttttatttttttaatttttttggcttgagtttgaacagaagggttgatcaaaatgtgttttgactgtttattgcttggtgattcacgcttctctttaaacgccttaaagta

SEQ ID NO: 19645 - DNA, 1099 bp, Mus musculus
tatagaatagctactatagatcagccatggtgtgattgtgtatatcttacctgtaatgttagatagaaatttttatgtttttctctttgaaatattaaggctttagggataccatgataatagttctagaagtttgaggttgaatattgtgaatactgatcacactggaaaactgaccagtgttccctcagactgatgaagatctgttgttgctggtgtaaaagaattgttttaagccccaatttgattcatctgaatgcactgctagtgttgttgttgccttcttgaggaaaagtctgatagaaaaattaaaaaactttaacatcagtctggattggccagaaacaaatccaagatagtcctttgtatgttagtattagcaatggctgttgtcattttagaggttttttttgatggtttcataatatatagattgatgatggttttcaacttgcagatgcttcctttaaacactaatatccgacttgcatactcgaatgggaaagatgatgaacagaactttattcaaaatctcagcctgtttctctgtacctttctaaaagagcacggtcaacttctagaaaaacgactgaatctcagggaagcactcatggaggtaagtctggtttttgtcatttatttctataaaaagatgctcttggatatgagcctgttaggtgtatgtggattttggagatggggtcctgtatgtactcctgcctggctgtccttgaactcactgtgtaggatgtggtaacctcaaactcagagatcttactgcctctgcctgccagatgcttggattgtatgcaggtactgggctcagttttgtttttggtttggtttggtttggtttttcaacacagggtttctctgtatagccctggctgtcctggaactcagaaatcagccagcctttgtctcccgagtgctgggattaaaggtgtgtgccaccatgcccagcattacttttaatatgtacttttttttgcatgttgtaaagaactacctttactgtgttcttcatggttatgtaatatttcagtgtgagaatttacacattttgtgtttttagcccttgtggcattttactttgttc

SEQ ID NO: 19646 - DNA, 1146 bp, Mus musculus
ggggaggaggcatgagcatctagttttcagggatttctaaaatactgagtcaattcagcagtgaaaattgattacttttaaatggagccattctagcatctggtagggacatgtttcatcatccttcatagagctcatgagttttgtatatgctctttgtccattagctcttagtatctatcttaaaaaccagtgtggtgttagaacttttttttgttgttcttttggttggttggttgtttttgtttgtttgtttgttttttgtttttttgatttcctgtatagcccgggctgtcctagaactcagatttgcctcccaaatggtggaattaaatgtgtgtgtcactacacccagtgttgatttggcgatttgtttttcatcaattctctagcccctatctcatctctgcctgtgcgtggaggtgtgtgtcatggcttgcatgtgcaagactaagtatgcttgcttgctgctgttcctgggaacctgggtttgatttcttactggttccaatgtgtctgttatactcttctgacctccacaggcacaatgtacacagtatgtgtgtgtgtgtgtgtgtgtgtgtgtgtgtgtgtgtgtgtacacagacagagtataagcatccatacacataaacttgagggcaggatttactctttactgacctatgctccactgtaagagagacaactttcttttctgggcattttggcttgctttctctgggaccctgtaggaattcccatgtgtaggaatcctgctgtctggatacccatgggtaattgcatggctcgtaggctgcccctatgaaagggttattcaacacctttaggatcaggactgaaaggttgagaaccagtgtttatgattgtttagcttttatgaatgtctttactccatattcttgcctggagcctgtggaagccagaagtgggtggtggatgccattgaaccaaggttgtggatatagttgtgagccatgaagtacattggtgctaggaatcaattctttgcagcagcaaaaagcattgtaagctgctgagccacctctccagctccaatttattttttgacacagggtctcatgtattccaggctagtcttccaacttaatgatcattctgtctctactttctaaattctggaca

SEQ ID NO: 19647 - DNA, 1456 bp, Mus musculus
agagaaacagcccttcgacaggctcaggaggagaaacataaacttcaaatgtctgtacctgggattcttaatccacacgaaattccagaagaaatgtgtgattaaaatctgaagtcatgctaggcttttttctctctgcaacatttgttcctggaagaaaagagcagatggattatttgtcgaccaaaatgatgccaatttgtaaattaaaatgtcacctagtggccctttttcttatgtgttttttgtataagaaattttctgtgaaatattctttcattgtttaagcttttgttttggtcatctttattcagtttgcatgaagttgaaaattacggcatttttaagataacttttacttcatgcccattttgaggcaatgctgtgggaggcagtaaatttgatttgaaaatagacttgtaaattctaatacaaaattataaattttttcttgtaaacaatacaaattttaattagggagcatttttttctagcctgtatcttggcctagaagaaacgtaatgagtaaagcaattgcgtcaagggggttctagagctgcattgtccggagttggcacctcctgagctgaattgtctgtctctagactacgtgtattaaagtctgtgtgtcaagtttgcagcaagatcatgtgcatatcatcccattgtaaagcaacttcaaaaatatgggaacagttagttatttttacacagttctttttgtttgtgtgtgtgtgtgtgtgctgtcgcttgtcgacaacagctttttgttttcctcaatgaggagtgttgctcatttgtgagccttcattaactcaaagtgaaatggttaaaaatatttatcctgttagaataggctgcatctttttaacaactcattaaaacaacaacaacaacaacgaaaacaaaactctggcttttgagatgacttatactaatttacattgtttaccaagctgtagtgctttaagaacactacttaaaaggcaaaataaacttggtttacatttattttcccttcactgacttaaaattattcctacttaatgaaggtgattttaaggattgtaatactttatatgaagtttcgtacttgtcttgttaaaaggactcctacctgggagtggtgcctcatgcttttagctcagcactacagtcagagactggatctcttgagttggaggttaccttagtctacctagtgacttccagtacagttagggctactctgtctccaaaacaagggttctaagatagttggtaggttttaacagtcagagctttgtgccaaagtcttataatcccatcagagtctggtggatctcgagttttgttttacttttggttttttgagggagtttctctgtgtagccctggctgtcctggaagttgctatgtagaccaggctggcctcgaactcagaaactggcttatctctggattaaaggcaggcatc

SEQ ID NO: 19648 - DNA, 1154 bp, Mus musculus
acaaaaaaaagataacagccttgatcttgataacagcttgagtcactgtggggtttagggaacatctttttgtgcagctctagttagtggctgtgtaagtagattagctttggaaggagtacaggcatactcttcatcctcgcaactggcacctgaggctgtaggcttagagttttcaagggtaccttggtcacttgagtcccaatggaaataagtgttagccaaacagtggccctagaaagaaagatgtttatagtggtgcgtgtaactagttaatgtgttgtcttagagtctctgcttgacaacaaaactgttaggctaatatgaccaggatggcaagaaaaaaaaggctcacttatatttgaattgagatgtggagttagtgtgtacagtgtgacaaggggttgtagttatggttgtaagcctgcatcaaggagacagcctagctaatttggtagaggttatcttcttgggggttgtggggggtaggtagtccacttactcagcatatcaggtattcaaggattcaaagatcaggtaggccagggaaagcaagaaagaccctgaattcccttgccagtcttggaaaagagagctggaactgtgcttaatgatggatatcatttgagtaaattttagaatacaataaaatgtctaagcacacttaataaagtgcttaaattacagtgtacatcaaccagtgcaaattcctctgaaattggtgtgtgtgtatgtagaatttgacaaagttgcttctttccaaagaagttctgggcattgaattctggttgtccagcttgcttgcaagcacctttacccgctaaaccatcttgttggccttttgcctcttgacttgaatttttgagtacacaaaataatgcaagagtagggtttggcttacaaaggtggtggttcagtgcttggagtgtttgctggagctgggaaggtggctctggttaagagcacttgcagttgaagaggccctgggttcagttcccagttccacttaagtctataactttttacagatacctaaatatgtgagtcaaaacataaaatttaaaagtagtaaaataaactgggcagtggtgactcatgcacagcactcgggaggcagaggcaagtggatttctgagttcaaggccagcctggtc

SEQ ID NO: 19649 - DNA, 1294 bp, Mus musculus
atcatatgtttattgggttttagaagaaaaccaaaatccccagtgctttgaatgcatgccttaacaatgtttgctagtgtttaggaaggaaatgtgctgtgtcttatgaagtcagctcctaatcactaaatccagaactgtaaatacgacagattttagagagtgacaaagcattatggagcacccaatgataaatgacttggttctttgcaattgtgaggtcaagctggaatctaagcaatgacacaattaagagttttttttaaactattaagtaaaatagtttaaattgcagctcactaaatgtcttagtgggtggacgtacttgaagcctgatgccctgagttccgtccactgtgagccatataagtggcagtaagggccaactccctacattgtcttgtgacccccacatccatagtgtggcacaccccacatacctgcacacacagtaagtacatgtaaagattccaggagtctcataaaacggaggtttggagcaaaggaatgttggtaaatttctgttgggattttcagaagtgtctggtgagtttgtgtgctttctgtttttgaatcattaggtatttatgcaagctctctgatcaggagttacgacagagtgcggctcgtaatatggctgacctaatgtggagtacagtgaaagagccattggatacaacactgtgctttgataaggaaagtctagaccttgcatttaaatactttatgtcaccaactctgaccatgaggttggctggattgagtcagataacagtaagcaatgcttcctttgtttttggtaactcgtttgtttgcttgctaaacaaatgtaataatgatactagagaaggactttattattctaggtttaatgcatggattattttgtattgccttcacaaataatctctgtattttccttattttaaaactgagactagtgagaactaaagtaatggcacagtggttgagagcatttattgtccttgagaggacctggtttgattctcctcacccatatgtaggctgacaactccagtcccatggcatctgatgcctcttttatggtggtgcatttacatatattcaggcaaacactcataaaataaaaataaatctttaaaactaagagtgaagctttgatttgtactttagatctatttgatctaaaaaaatgagatccgagtctcatcattgttacacagtttattttgcttatattgtttatttagccagtgtcttagtatattgtcaaagctagtcttgaattcctacacacaggtgctagttatct

SEQ ID NO: 19650 - DNA, 1162 bp, Mus musculus
catgcaggttgttattgggaacaattctttatgtgttcatctcttaggtaacacatacttcctattttgcttattaattcattgtagaattggtattgggaaatcttttctaaatgctacagtgctactgtggaaattaattcatgaacacaaagttctcatttcaggagttggtgttacgttaacttttcaaatgtgaattgtttataaattcaaggaatatgatgttacatttcagtgtagttatgatttgtagtattgtactttttttttaaaatttgtactatatggaagtttttctggtgtctttatgggaaaaggctttaaataatattttttcaatcatttggttctaggtccattgcaaaagaacttgcagactggcttattagcaacaatgtagtagaacatatatttggaccaaatttacatattgaggtttgtagacaattgtttctttttcttaattatatagagaggctttaaaaagtaactataccaaattttcctcttgtagattattaaacagtgccaagtgattttgaatttcttggcagcagagggacgactgagtactcagcatattgactgcatttgggctgcagcacaggtaacactaacatttcttatttaatgttttgtttgtaatgcttcaaatgctactattttataaaaggagaccaagatatggggaagatatggcaggaactctgaggtttcagttgagtctgtgtgttcttatgttattgatagaatataggatattagaatcattagaactgaaggctcaagccgcacagtcgtggcgcatgtctgtaatcccagcacttgggaggcagaggcaggcagatttctgagttcgaggccagcctggtctacagaatgagttccaaaccagccagggctacacagagaagccctgtctcggaaaaacaaaaaaaacaaaaaaaacaaaaaaatgtatgttacatatggctggagagatggctcagaggttaggaacacttgctactgggggactgatgtgttggttcccaaacctacacatcagctaactcacaaatgtttgtaagctgtgtttcagagaatctgacacctattctggcttctgaaagcactcacacataggtggcatctcctaaacagaaacacagacacacac

SEQ ID NO: 19651 - DNA, 1160 bp, Mus musculus
tcctgtgagtttcacatgtatgccagagcaaatgtgcatatagacactcgtaataaataaaatctaattagccagtttgtttctttttagctggtctgaatttttaaatatatttgtttataaatacaggaatccatgcaaggaagttctgatgaaactgccaacagtggtgaagatggaagcagtggccctggtagcagtagtgggcatagtgatggatctagcaatgaagttaattcaagccatgcaagccagtctgctgggagccctggaagtgaggtgcaatcagaagacattgcagacatcgaggcccttaaagaagaagaggaagaggaggaggaagaagaagaagaggaagaggaagaagatgatgaagaagaagaagatgaagaagaagatgatgatgacgacgatgatcatggtcacaatcctgccaaaaatacttgtggtacagaacttcgaaacagaaagttagaaaatccagcaggcatttgcttgggggaatcccaaggcacatctgaaaggaatgggacaaatagtggaactggaaaggacctggtttttaatactgagccattgccatctgtagataaccgaatacgaatgctagatgcctgtgctcactctgaagacccagaacatggcatttcaggggaagtgagttctgctcacttagcacaaggttctcaggaggcttgtatcacacgaagtggggacttccttggggagactattgggaatgagttgtttaattgtcggcagtttattggtccacagcatcaccaccaccaccaccaccaccaccaccatcatcaccatcaccaccaccaccaccaccaccaccacgatgggtaagcatgcttaagaataaatgcttagtttgcattttttgtagtaaaatattgctagtatttcttcagttgatatttattttagtgtaatactatttataagtagtgtaatgcaaaatataaatgcaattttcaaataagtaatttaaaattttattgttgtcaacttaaaagaaatacaaaataaaggctaagactatgattgttgctagtgtacctcaaaggtcttggttcactccacaacactgaaaaaagtaaggctcattttatttacatactttactgcttaaaagatcgtaaataccttaa

SEQ ID NO: 19652 - DNA, 1108 bp, Mus musculus
tgatgggtcctctgaaacagtagtacgggctcttaaactgctgagtcatgtctctagctctggtgtttctacttgtagagcataagtttgtggaatttgttttaaaatactttatagaaaatgtgctcagtcagctcctttacatatctggctctagctgcttttaacagtgaattaggaccaaagtgttttctatattcctgacttaaaatttctagacaaaaaaccataaggaattactactgatctagtaattataatatatgtatttataaaaacaaactatttacacatatgtgtccagaaagagtgtataccttttttgcataatatataaaatgcagatgtcataactcaccagtattgtgttacttggcaggtgcaggcaggtcaggtacaaggctagagtgagctatgtagcaaaggtcctgtttgacactcctaacctcctaaattaataatgtacaaaatatgttatttctgtttagggttaagtttagagcaagtggacattttatggcattgtttggtagaagactctgagtgctatgatgatgcacttcattggtttttaaatcaagttcgaagtaaagatcaacatgcaatgggaatggaaacctataaacatcttttcctggagaaggtaattatatcttagaagtttgatctgcatattcttctacatgcattcaaatctcttcaaatatgacttcttgttcctctcacgtagtttttaaataggacaaatgcatcagtttttgatgatccttatataagttttctaattcagattttcctgtcatgttatattttaactaaatgtaaatttagttttatttataaatgtagtttattacttatttgagaatttggagtaactagaataatatttaagtatggtagtaatcataaatgttaatttaaaaaatgattgtccagttgtgaaatgtgtgcccataacccacatctatgaattttagaccaggccaatcttgaactgtcagagatctgcccgtctctgctccccaagtactgggattaaaggcatatgccaccacctcctggctctttaaattttcttaatgtttttgttgttgttgttgattag

SEQ ID NO: 19653 - DNA, 1831 bp, Mus musculus
ggctattagattatccattggaagactatatctctgcccatagtttgagacctttcacttaaattatttctgcgttagcctttagccgaaacatttctttcattatctcatagttaacatcactaatttgaacaataattagtttattgtgtccactatattatttatgactctatgaaattggtagctttatcaatttacctctgatgaaaatcattgaagcattatgctaaattattattcttttgtgacatgttttatataattgaaggttttatactatataatttattaagcatcatattcttttcctgctttataaataaatacaattggctttaaaagttcttcattaactgaggaaatttgtaagcttttattaattattatttcattaattccatatactataatttaccctcttaatactttataaaatattaaatttagtgtgcaaacatgaaaatgtttggtattttaatgataatctgtcatctaacaaaatttttaaaacgttttatctttatttcttagctgtgtggtatggaccaattttggggtattgcattaagagcacaatcaggtgatgtcagtagagctgctattcagtatattaactcctactatattaatggtaagtaattggaaatattgtttaaaacttacaataattaaattgataaaatttcaagatttctctttgttcttgtttctttaaaacttttttgatacatttataattatttgttttcatgtatgtatttttgccatattgtacagtgccatagaggccagatgagggcctcagatttcctggaactgctgttaaagatggttcatatgggtgctgggaattgaacttgggtcctctggacgagcagtcagtaatcttaatcgcttagccatctctagcctgtgtttcttttcctgagactcagtcttgctatgtatcccaaattggcctagaattctcaatcctgcttaagtttcctgagtgctggactaacaggcagctactgccaattgcagttctaattaagtacctttttacgtgaagagatttgattaagcttcagtttggttcattttatttaatacagataaataaagatgtaaaagtgtaataagtatatatctgggttttaggtaaaacgggtttggaaaaggagcaagaatttattagtaagtgcatggaaagtctcatgatagcttctagcagtcttgaacaagaatcacactcaagtctcacagttatagaacgaggattgcttatgctgaagacacatctggaagcatttaggagaaggtaattttgttacattgtactatagaatgaatttcagtattcatattgttaacttgtctgaatgtattctaaaaggttttattatgggcttgttggaaacatattttacccaaactaagtggatagtaatggaaatagttgatataaaaatttaagtgtcatttttccattgaacaggcaatataatttcctcataaacagattttaaaatctttagcacttatgcatgagtaagaaactggacaaaatttcatttctcctgaggtgttagtcatgactgaaaaggcaggaacacaggtattgaaacaagtcacactacagcttcccacagcctcatagaatctttcatattttatcaagttgaatcatttgtttcatttgctgtttttttttttttttcttcctggactaggagagagtattttaattttgaatttccatttaccatggaaacatgaccaaaagtttctgtgttaatgaatatctgtataattaatttagacataccctgtgtaatacagaata

SEQ ID NO: 19654 - DNA, 1179 bp, Mus musculus
ttatgaataggccacactttggagggttaaggggttgcagcactgggaaggttgagaaccactgcgctagaagctgctgatgtttatctcttccatgggtcttacatctgactccacaagagttattgcatctctgctctgacttcctcacacagtacgagttatgatgtctctctacctgcactatgttgttcagatcttgttttttattagatgtttactttatttacatttcaaatgttgtcccctttcctggtttcccctccataaaccccctatctcctccccttccccctgggtcgttttcttaaaataaagttgcataatgttaaaaactcatgtagcacattgatgagaatctacccataatttttattttttgtctgtgaatttcagagttgaataatggtcacacctgtcatgtacatgaagtggagctgacgttgtcttctcattcacagtggcagctggattgtcttgcttgcttgctgaaattaatctgccagtttgcagtagatccgtcagatttggatttagcttatcatgatgtttttgcctggtctggcatagccgaaagccataggaaaagaacctggcctggaaaatcaagaaaggctgctggtgatcatgccaagagtcttcatataccacgattaacagaggtaaagtttggaaattaacattaaattgttctaatgaattctgcttaaattttgagaaagcatatgatttagtttttataaagttaagagtacactaattgattcctatgatacttcctaccagccacagcaatgtcataatttgacgttgtaatgaagttttggtaatagttttcagttcttcatttaacaggatgcacaatgtaccattttaatatgatatcttaccttacagttacatgtacaattagaactttatgatgtgcgttctgagtgtatcagagtccattcagaaatacatatttcaacagaggaaatgtagtagacgttgagtttcatatatgtgttgaagtgttaaaaatataaaatgaagtcctaaaggaagccaggcaaaactagtcatcactcctatagctgaataaagatcattgttggaattttaaggagttagaagctttactagagagaacttgttgaactagatttagtaaaatgggtctttttgaaagctgaagac

SEQ ID NO: 19655 - DNA, 1101 bp, Mus musculus
ttgtttttaaaatatagcaactacatggctattaaaaataatttagccaggcgtggtggtacacgcctttaatcccagcactcggaggcagaggcaggcggatttctgagttcgaggccagcctgatctacagagtgagttccaggacagccagggctatacagagaaaccctgcctcgaaaaacaaaaacaaaaaaaatttcttttttagattatacaaatgaaccctttatctagtcagacatacctgccatttataatttgtacatactttgttcatagattttgcattaggtgttatactgttaggaaacataaatttctatatttattaacttatttaccacacagttgtggcttagtatgcacataagaaataaaacttactattgcatgattttaggggggttgggtaatgaaagtacatttggtattttgctctgctcaacatttttttttctcttccttgatgtttttgtttttaaaggtgtttcttgtgcttgtccaaggaaccagtttgattcagcgacttatgtctgttgcttatacgtatgataatctggctcctaggtatgcatttttgtgttttttatatatgtatattcacttcttaagcttcattttgagctggacatgctggcactcacctttagtcttagtattgtggaggcagaggcaggtggattcttcactttggggctagagagatgactgagtaaaaatgcttttgtaagcgtgagaacttgagttcagctaccaagcatccatataaatgccagatgataaggtatgtacttgtaactctagagacgatgtgtgtcagagataggatcatcccctgagctcaaccaggctaatcaacttggcaagacccaggtttagtaacagagagacccattcttaaaattaaaggtaaggtggacaataatagaagatactggcatccacccctgaccatggttgcatgtatatcatatacattaaaacagtaaacaatcacttccttttgaaaaaggtttttatataaaagttacttggattttataatatatttccctactttttcacctagacttaaaatatcttgttaatatttgtcaa

SEQ ID NO: 19656 - DNA, 1385 bp, Mus musculus
attgaataacccattgtgtaaggagatggatgcactttttaatgttattcatctagtttaatattaatttggattcatggatttgaaatatttatttaaaaatcttttgtttttgttttttgggtttttttgggttttttttttttttttttttttggagacagggtttctctatatagccctggctgtcctggaactcactctgtagaccaggctggactcgaactcagaaatccgcctgcttctgcctctcaagtgctgggattaaaggcgtgtgccaccacacccaactgctttcttacttttttttaacaaccccctatactatcctatcttctaaaaacaatcttgttgcttttccaagtgtttcacttactagtagttttaaaaatacgtgacaatcagagtctgactatgtaagtctctgaagtctatttggagtgaagttattaaagaatatatagtaattattttactaccttgccaaatttaattaggagtgatgccattttcttgttttacagagttttgaaagctcagtctgatcataggtctagacatgaaggtaagagctcaacaaagtttattttaggtttttttaaatataatttttaaagaaagtgtaaaaaccattgttaaacactctgtatttaatactgagcattgtgtctttataacacaaagcatattatgcctttattttctttcagtgtcccattattcaatgtggctcttggtgagctgggctcattgctgctctttagtcaagtctagtcttgccgacagtgatcatttacaagattggctaaaacagctgactctccttattcccgaggtaagagaaaaaggaaaggttggttagtgctgctgcttctacaagctttgtattactagcattgctaattaaataagatcaaataatggtaaaggaatgttcatgattctattaatcattttcattatttaccatttagatacagaatctgataaactaaaaagtgtaaatattataaagtcatatttgtctctttttaagttttgttctgttctggatattccaggtggccacatctggattattcacttggaatctgtgaagtgacttaaatactttttaagttgcctgtggttctaaaatgtttttatgttgtaaataccataattatgaaaaacctttaatcctatttatttgtctacgtgtatatttttatatttgtttctgctttatagccttaagcatttcttttcaaataaagtaggcatatactgccatgcactactgaatactttaaatggttatatgttgtttacagtacattgctagggctggtgatataggtcagcacttgcttgccttacatgtgccaggctctatgtttagtctt

SEQ ID NO: 19657 - DNA, 1150 bp, Mus musculus
tatcgctccccttccctcttctttcttcattggttttatcctcttcacttttttccctttctgtgcacacacaagtgctcctctcctttctgcttacatctcttccaccctccgctgtgctggagcccaaacccaaggccttatttatacatgcggggaacctgctctaatgctccattatatgggttgtattcccaggatttatccgcccctccccccaaggtcttatgtagcccagtttgataccaagattgataatgcaatttaggataagcttaattttttgagacagtctggcctccagcctactgagtagccgagcataatacttcagtgctagaatctgattgataaaatgctgtgaattaaaattggggagcaaactcaaagcaacctctcagctgagctgtttatctagcatatgaatagccttttaatactctaagctgtctctgttttctcctttagactgcagttcgccatgaatcttgcaatggtctctataagctatctctgtcaggcctagatggaggagactcaatccatcgatccttccttcttttggctgcctcaacattattgaaattccttcctgatgctcaagcactcaaacctccaagggtaagatttttaccttgttgcaaatttgttatcgtgactgtatccttgttacttcataaactcctgattctccagtcccaacctaggagtgctgagaatgtcagtgcacaccatgatgcctcataccgttctcagggtcagcattacagccactaacagcatcaatgtgatgagattttagctttgaattgtctgtcatgtggatgtaattttggagataatgtttgtccctacaaagttgaaaaattatggagcacccttcttcactcattttatttgttttttttttttaaattccttttgttttacctagtgtcctagtgtgacactttttaaaaagcttttattgcataataaatacaataatttttaatacctaataaaagattcatgccgggtgtggtggcgcacacctttaattccagcactcgggaggcagaggcaggcggatttctgagttcgaggccaggctggtttacaaagtgagttccaggacagctggggctacacagagaaaccctgtctcaaa

SEQ ID NO: 19658 - DNA, 1184 bp, Mus musculus
attgtaccttgatagatgaagtcaagggggaaacaaaaaactagtatctggtcaggtgtttactgttccactataattactactgtggctgtgataatctattttaaatttgtctcctgtgtgctgaggtttagggcatgagccaccactgccttttttaatggacttgatgcactttaaagtataggctttggggtttgttcatttgtttgtttttaatactatgtagatgaaaagataaatcaagtttaacttaatttgtaaaataacttttattatatatgagataatttatatttttctaatttgtgatacatcaaacataaaaatctgcatttgaattttgtattttctttttgccttaagacaacactccttgatttagatgctttggcaagacatttggctgactgtattcgcaggtaaaaatctaatgcagaattaccaattaaattattaaacaaagagaaaagaatatctttatttatcttttgcttgtgttcttttctaacagtagagaaatcctggaccacctagatggcagtatagaagatgatgggctttcggggctcctgagactggcaacaagtgttattaaacacaagccacccttcaaattctcaagagagggacaggtatgctttaaaatatatgcatgagtcatagttgaagcttctttttacattgtatgtgtgttctgttttgttttacattatatccaagccatgtttgctagaacttgatgatgaattctgaataaattaacagtgaaaataggaaacttagaatatatgtttagaatgtaaaaacaaattttaatttctgttactcaggggaatgtccactctgacatttcctatgtgaaaacatttttatatatgttttctcttgtgcactaatgtcttcacgtagtagagtcagttggtgatggtcattctgactataatggctttaccctgcctcttactttttttaatatttatttatttatttattttatatatgtgagtacactgtagctatcctcagacacccttgaagagcgtatcggatcttattacagatggtcgtgaaccaccatttggttgctgtagaattgaagtcagggaactgctgagccagctctgtagctcatgctttcatatttttaaggcctccttgaaatgtgtcttgaatatttatag

SEQ ID NO: 19659 - DNA, 1101 bp, Mus musculus
ctagcaaggttcttattgtttctgctcttttgcacggctggcactcagggtgggtgaggtacttctgttctcgttgttcaccacatggagaaacatctgtaggatttggcaaatagggaatgacaaggccttaatagaatatcagtaatttacaaatgaaaataataacactgtgcaaggataatctgtaaggatagatatgaaatttgaagtggggagaaactaaaagatgggtccattctgttccgttttcttcaagaaaaagaactttggtgatgatttatgatactgctatatacttatgatggatatcttagtaaattatagttagcccattatccaatttgttttttgttatgtttggaatataattggtatcatgtttagataacatacctgctttcttcttatctcctaggaatttttaagagatatcttcaatcttctgtttttgttgcccagtctaaaggaccgacggcagccaaagtgcaaatcacactcttgcagggctgctgcttatgatttgttggtggagatggtgaaagggtctgtagagaactacaggctcatacacaactgggttatggcacagcacatgcagtgtaagcgctcatccttttcttgactctttataaattgaatgcagcaatgaacacttaaggacactgattaaagaatcaccttttcgcacacttggttatacacattgttgatagaagagtcagcatttgattttactagaaaaatgtaaaaagcctttatgtattttcaatatttgtgctttctttgtataaagtagcataataccaagtaaagtaatgctttgactgttaatctgaattttataattagatttaaaatgtttttttaattcttaatattttaaattctacacatactagttggcaaatcaatagaggtagtaggtgccaatcaaagcaagatatgtttaagtttgtttggggtatcttctccctctttttatcagcagcccatgcaccttacaagtgggactactggcctcatgaggatgtccgtgcagaatgccggtttgttggccttactaaccttggagctacttgttacttggcctctactatt
